United States Patent 10,407,724 (METHODS AND COMPOSITIONS FOR SCREENING AND TREATING DEVELOPMENTAL DISORDERS) - sequence listing, part 78

SEQ ID NO: 2142 - DNA, 558331 bp, Homo sapiens
tttacaacataaatcatttaatgtaacatttgcaaccttagaaaggcagacatgtttaatccaagtccgtttataaattccaatttcacatggattaaaaactgcagataaattaagtcacaataatatcctgtacatgcattaaggctggtgactgctaaagtctcttgggaatctacaaataggaaatcacacgcagattactgggtctgaagagtgtctacattgttaaaaaaatcttgcttttttttttttttggtgatgcagatttcaacagtaactctggaaaactgtgaaaaatgttatttaaaaatatatatgtatatgctactgcacagtttcaaagatgtgattcataaataatgttggctgcactgattaattttataacaattactgcacttccaagttgatgcgaacacgcagtgactcatactcaatattaggcactagtaatatccttcaggcgtactacagttttatgttagctgtattgtacatatatatttttaaatgtatgcatttatacaaactgtgtatattatgtatggggtgtcagaaatgtacacatcactgttatataatacacacatcattgttgtacatatgaggataagttttagtgcagaaagtctcattgcattgcattccatgtgttcaatctagtacacaatttgtcaactcttcagattatttttccagtacattcctcattagattgtgggtttcaagtttccatttgcaatttgaatgtttccagaaatctctgtcttaaccaaacctctctctccaggcacgattctgcacatgagtctgatctgtgtagagtagtatcatcaaaaatgccaaattttgatcaggaatatacctggactactctctttcaaaggcaattgaacatcgtgataaaggatagcatctattcaggtcatggaaggatatggtcagttgaacttgtgttgaactttggaggcaaatgtacgtcttcaaataaaaagacatggtaataaaaattatttgcttaaatttgagagtctctggaaggatatacatcaaactgtgagcagtggttgtctcaggcagaagggacaaccagggacttacactttctactttctacatttctgcactgtttgagtttttacaatgagtagatattacttttctaattagaaaacacaagaaaggtatttcaacttgaaacaaaactaaacaggccaggcatggtggctcatgcactttgggaggccgaggccaaaggatcgcttgagcccaggagtttgagaccagcctgggcaacatagtgagacccccatctctacaaaaaaaataaagaaaaaattagccgggtgtggtggcacgtgcctatcttcccagctgcttgggaggctgaggcaggaggattgcttgagcccaggagtttgaggctgcagggagccatgatcgcgccaccgcattccagcttgggctacagagccagacccggtctcaaaaccaaccaaaccaacaacaacagcagtaacaacaaaactaagtaaaaggaacaagttatgaatgactttcacaagcaacaattggaggatggttactaaccaaaatcacccatgccaaaccccacagaaactgctgtaccaacgtgctccacacgtgctccacagatgaaacaagacagtcataagaactacacgctctgaccactgcccacaacggtaagtttcaagaagttttcctgggaaatgtgggccatcagagtgctgataaaacactgctggcccacctgtcaaatggggcttcacagggaagctcatcacatagatgttacaacaaagtctgcaactttcaaggtgggcaggaccagagaagctctccaggtatgcaggatagacctccagggccatccctttatgtgtttgaatatttcatcaggattcttcaagagtaggtagaacaaagcctcagtcctccaaaaaaatgactcaaaatttcttaagttaggttcaagtttctgacataggatgggattgtgaactctgccaaaaattagtgaaagggctgggtgtggtggctcacgcctgtaatcacaacactttgggaggtggaggcgggtagatcacctgaggtcaggagtttgagacgagcctggccaacatggtgaaacccagtctctactaaaaacacaaaaattagctgggcatggtagtgcacacctgtaatcccagctacttgggaggctgaggcgggacaatcacttgaacccaggaggcagaggatgcagtgagccgagatcgtgccactgcactccagcctgggcaacagagcgaaactcgtctcaaaaaaaaagtgaaagggttgtaagaagcaccccagttggagacatgtaaaatggaaattctcttaatatttccaaatgcttgaaggccaaagccaaatgcaaattccacaagcccttcttattttcaattaatttcaaatcatctaagttgttcagtcatttatacaattttgaatcagtgctcagagctaaggaattatgatgatcttacttcccacctacagatcaggctaacaaaaatgttaacactgcaaaccaacctgtaagaatatcagtgaatgtttatggatcagcatctagtctaagtattttgtgccgtcatcaccttgaaaaaatggattgcaccacatattacaccgcctgcctttctcagaccgtcctggtgcaactttatcaagtaagaggccacaaggacattatttttgtttttaacgtgtggcaagatagaccctctttttcaggagttattttcttttcgtcaagatttcatatccaaatatatttaacaagatgactaaatctagggcataagacactacaaaagaaaaaacatcagacaaaaactgtaaacaagatgtcaaagaaactaaaatgtaaacttaattaaaaaaagaaaacaagagaaaaactcagagcaaggtgtaaacataccagacacacaggacacaggaagaggctctggttgctgctgccccagaaaggaactgtgatcttctgcattgcaagcagcctgctaatcaaagcctgaaaaatcgcccccaaatcaaaacgcatcaaagggctgcaggtgcacattctgcatgaggagtgagagaatcagcattatcatggcaaatagctctcagcctggtaagcgaaggattcaggctcctactgaagggacaatctaggtaatggcctcatttagccaagaaaatctgtaagaaagctattggtggaaagaaaagacttgaaacagattggctgacaaatgccatgtggctctacagccaccgagtcacagtggcaggaagaagaaatgcatgtggctggtgggcttgttatcacaggtgcagaaaacttcaactcctaactgagctccaacacacaggcactgctaccttagtgtctgttaactttcaaagacgccgcgtttttgctaaatctcagtgccatttgcatactacttggaggtggggctgggaagggctgtgagtgtccatctgtttgcctggaatgcatttagttgataatagagtcagatgggggaagggaattagaggaagagcagggtatttggtaacatgcaatctagtaaacttccggcacaaaaatacctggcttattttcattattcaattacccattaatacataccaatcaaaaaataattggggaatagtatattaatactgaaagtaatcaacagtataagagcaggtccatcttcactggcagtcaagcttttggtgtgctgtattgcacctggttaactaacccatgagattttggttgaattttctaagaagtcacggtttagcactggaatggaatagaaagtgtgtgtctgtgattgtgtgtgagtgtacggtgtgtgtgtgtgtgtgtgtgtgtgtgtgtacttcctctagtcagaaacctctgatcactttgtctagcctgggattatggaaactagacaaagaaggtgtgttctgaagagctgtgtatcttacacacatacacaggcggcttcttatatacccacacatacaaacacacatgccctgcaaaagatcattgttcaatgctgaggaaatgttcaccgcagtctgataaatgctgtggctgggagtttcagtagcacagtgtccaaaaacgttgagccatctgtggagaccagagcccactctggccccagggtgaggtccctatgacaggtgggcgctgttccgcagccagtgcaggccctgttgggagtactggaccaggtgctccatgctgctgtgcagggtgaccggccccatgagcagatccaggtcgttgaagaattctagggggacagaaagagttgttaagaatgccacacatgctaggtgtgctatcctgagcaactgatgtaaggaaaaattccattcatggtctctatataaatcaaggattctccgttccatcatgtaactttagcattcctttgaacaaaataaaatccaaggatggggaactcatcctatatccaaataaataaatacatgatatctgccatttctaactcaaatgaatagtatttgcttagccaaatagcaaagaaaatccatatcctccagctgcattctcctagtccagtaatgcttcccactcctgaacgtgaacgtggctctgtcgtccctcaccctgtactcaattctggtatgcgctgagcccctggagtgagtccaaggggtgaggctccaggttcctgggggcaaatcagagatgggtcacgagacatctggactgaagtcaccttctagcttttgaacattccctaggtttgccctttcaccaaatgtttatgatgtggccaagcacggtggctcacacctggaattccggcactttaggaggctgaggcgggtagaacgcttgaggtcaggagatcgcgaccagtcaggacaacatggcaaaaccctgtctctactaaagatacaaacaaacattagccaggtgtggtggcgcacacctgtaatcccagctactccggaggctgaggtgggagaatcgcttgaacccgggaggaggaggttgcagtgagctgagattgtgccactgcactccagcctgggccacagagcaagactccgcctcaaaaacaaacaaatatctatgatgtaccaaggcactctgctaggtgcaggggtgggtaggggatgatagcaggatgaattgtgtgggctctgctgtctcaaaatcacagtttagtggctgatagaggaaaacacattcatatggctactctactgtcatggctggtcactgcatacatttcttgggagtaagcatctgggagaagtgtctcaaaggtcctcacatacatgctgaatgaagacttgctggggcagggatggggaggtggctaggaggttggccagggcagggatccaggggtagaacagaggaggaggagcaggtaggggtaggggaacaatgccaagtctgcactggacacttggcactgagccctctggtaggagacatctagcaggcagctggcagtgccatctggagcttggcctgctcacagtctcccaaactggacacgtgtatttctatacatttgtcctttctgttttgtccactggtgacacccaccccacctatttcagtcactcaactgctaagcgcttttcttttctttattttttccttgagatggagtctcgctctgtcgcccaggctggagtgcaatggtgcgatcttggctgtctgcaaccactgcccgccttccaggttcaagcgattctcctgcctcagccccctgagtagctgggattacaggcgagcaccaccacacccggctaatgtttgtattttcagtagagacggggtttctccatgttggccagcctggtttcaaactcctgacctcaggcgatccactcacctcagcctcccaaaatctaagtgcttttcaaagccctgttccatggttccatgccagctcctctagcaagctcctcctggtggcttctgacccccatggcattctcattggactttctctgggctgcatgttatgtactatgtggttttatttacaatctcatgcactctgccatacattccttatctcatcctgaacatcttgctctttggagctatcatgctcccatgctatcatgggaacatagtttgcatttcatggagtgaactcagatttgcactcttacctgctgctgtagggccaatagtaaattagtataatctttcaggagaagagttaacagcatatgttgatatatataacaatatatatcttaagagaatctgtatctgttgacccccaaattttattccacaactccctcctaagaaaataatcagaaatatggccgggtgtggtggctcacgcctgtaatcccagtactttgggaggctgaggcaggcagatcacgaggtcaagagatcgagatcatcctggccaacatggtgaaaccccgcctctactaaaaatacaaaaaaattagctgggagcggtggcacatgcctgtagtcccagctactcgggaggctgaggcagaagaatcgcttgaacccaggagacggaggttgcagtgagccgagatagtgcccattgcacttcagcctggcaacagagcaagattctgtctcaaaccaaaaaaaaaaaaaaaaaaaaaaagaaaaagaaaaagaaaaagaaaataaccagaaatatgaacaatgacttatgtagggatatttacaccaacattatttgtcacagtggaaaaaaattggaaggaacttaaatgtctaacaacaggggaatggtttgagaaatcaggatactttgtgactgtataatcaatgtactaggatattattatagaaccaccataaagggtgtttttgaactagttagtgacatgagaaaatgcctgatataatgtcaaatgaagaaaggatatacaactgtgtgagtatcccagctactcaggaggccgaggcagaagaatcgcttgaacccgggaggcggaagcccctggttccccgtggggtgtgcgctcacctcggttttccttggccaggttgtcggccatctcccagtagtcgtagctgtgcaggatgctgttggtgatgctgacgtggttggccgccatctggtggatgcgctgtgggatgctgacgatggtcgacggggacagggcgctggcgttggagaggctgccctgagaccccacggagctggcgggagaggggttgggagacatgggggatggggttccagtgctcctggaaggggagaggtagaaaaaccagagtggcgaggtcgggagcaagcgaggcagggcagccccttggggaacagaaagcaaagcgcagtggcccagcaccatgcattgtctggcttacggcattgactttggaaaagcgaacttactttccactggccccccacggagatggggcttgggcggctttagatgagttctgcaagaaaataaaaacactgacagtgagtgccatctgcgtgaggtgaaacaggtgacatgaacgtgttttcaggtgactgcagagagaagcaaaggcagacactgcaggaaaaaggcaccttcagagaaactggacctgggaagtctccatcacagttctctgttccctttctggaagggagtcgggacagctgcctggacttcggaagtttaacagtatttctcttaaagggagttgctcttgaacattcctaagagaatatatttaaatgtatttccctagcagacaggatactcaaaagttctagtttatctgaatattctgatttagaagttattttgcatggacaaggtgcctgcatcagccctcagtgaggtaagtgaagggcttcacccacagcctgggtttttatgtacaaattttaggtaccacattaagtcataatcccaacggtctgttaaatcttgaagcagccttactttttcattgtaaattaatttttcttaaaaggaaaaaagagcaggaacaccctcatatctccccttatatacaatactttatatttaaaagtaggacatgtttgcagaaacagtcgacatacatttacttagtgcctgaaaatacatgacatcagattgtattgttttaacttaggaagtttaaaagtatttcttcttaaagtaagttgctgttgcatattcctaatagaattgattaaaatatatttccagaacagacaggatgttcaaacattctggtttatctgaatattctggtttaggaagttctgttgcacaagccaggtgcttgcatcagatatttaaaagttttgcctctagttagggaagttgctcaatgcacagttagatttcccctctgagaacccaatcatgccttcataggactgttaagggagaaagcggtctttgtgatgctgatgggagttttccccttccagagacaagaaaacagcctcagcctggttctccagagacaacatgtttcttttggttagaaagaactttatggagtggtgactgatttttctggttttagtgcgggtgttattaaaatggcaagaaatggcctgtcagaactctgaggtgctacaatggcaagatgtaaatgtaaggacaacaccgcaaaccatgccacttttacctgtgtcaggaaatacaattattttcatgaggagaattaggaaaccttcctgaacaggggagcttatcctccctttcttgacacaatgttactgacacctttctcaagctggtgctactggactgatcactttgtttccacttcatcctgtggttctgagaacgtgatctatagaatgcatgttctggatataagaacactaatggcagaaggggagaaaggcttgggggttgcagaaacagtccagtaaaggctactgaatggaggaagaaggcagtgactcacgcctgtaatcccagcactatgggaggctgaggtgggtggatcacctgaagtcaggagtctgagaccagcctggatgacatggtgaaaccccatctctactaaagatacaaaaaattggccgggtgtggtggcacacgcctgtaatcccaactacttgggaggctgagacagaatcgcttgaacctgggaggtggaggttagggtgagccaagattgtgccactgcactccagcctgggtgacggagcgagactccgtctcaaaaaaaaacaacaaaaaaagaagtcttgagttctcttcctctaccactaagccccatgcccaagaaataccggtaggaacaaagttctttttttttagagatagctctgtactgataaaacacatatagccaaattgtcttgggtacctaaagatttcatggtttctgaactcaaagtagcatttaaatagcccttgaggctgggtgtatggctcacattggtaatcctagcactttgggaggccaaggcagtaggctcgctggaggacaggagttcgagaagggtctggacaacacaaggagaccctctgtctacaaaaaatgaaaaaatgagctgggtgtggtggtgtgtatctgtggtctcagcgacttgggaggctgaggtgggaggactgcttgagcccaggaattcacagctgcagtgagctccgactgtaccactgcactctagcctgggcaacagaacgggacagaaaaaaaaaaaaagtccttgaaactttgtatccaagtttcagttatcaggaataagttctggagatctattgtatgggatggtgactacaattaataatgatatatagtatacttgaaaatctctaaaagaatcgattttaaatgttcccatcacaaaaacggtaagtatgtgaggtgatggatatgttaattagcttggtttaatcattccacaatgtataaatatatcaaaacatcacattatacataagtacacgcaatttgttgttgattaattaaaaaaattttaaaaatagcttttgatgaagggtaaatgacattaattccttgaggagcaactctgattttctggttgtgttttccttttttttttttttttttgagacaaagtctcactctgtcgcccaggctggagtgcagtggcgccatctctgctcactgcaacctctgcctcccgggttcaaacgattctcgtgcctcagcctccctagtagctaggattacagatgcctgccaccacgcctggcgtgttttctacccattctgtatgtattagtgggctgcagagaatattaagaacttgtatcccttaaaagtttgttgtagcccctggcggcttacagaattcagcttccttctttattcaagcattttccttgactgtaataattctctttagtagtagatcttacgttctggatttttgaacactattgatgttgactttaggcacctgaaggaaagggaaggctcagtgctggttcttgtcctgaagacacaggacggtcaatgggctgagaaagtgatgtccatggcctagcacctggttactctacatgcacaattggaaggcagtgtgctgaacataccccaggaacccccagcacagcctggccattagagatcacctctagaggaggttgggcatgaacagatctcaaatgatggttgtgtatctgacaaagggctgttggagatagagacggcataatttctagtttctatagataaacagagaagaggaccagaaatctcaaattaattattaatgtaaggtcgacctcacaacagtacatcagcgaaggcttttaaaaatttattctcccagtgaaaataatttcattccctgagataagtaaaaggtggcatggtttgcaattttatccctatagctacacactgctatctactgcttctgagttctaacaagccatctcttaccattttaaataacgccattaaaaattaaataagctactagagactggctaagagggaatggctctaaggggttacttctaaggaaaagaagctctaagtgagcatgaggaatttatgttagctataaagatgaatttcctaggacagtggaacgagtaactggatcttctttctcttgaagccataaaaatacctggacaaggctgggcgtggtggctcacacctgtattcctagcactctgggaggtggaggcggggagatcacctgaggtcaggagttcgagaccagcatgaccaacatggtgaaaccccatctctactaaaaatacaaaattagccaggcgtggtggtgtgcgcctgtaatctgagctacttgggaggctgaggcaggagaattgcttgaacccaggaggcggaggttgcagtgagccgagatcgcaccattgcactgcagcctgggcaacaaagagtgaaactctgtctccaaaaatacataaaaaaataaaaataaaaaaataaaaatacttggacaagaaggcagggagatacattagatgggctctcaaaggtccattctgaggcctgaaagccacaagtgtggcataaatggggttaccttggggaccagaggtgacctgcattaaccccaaagcaatggagtctaccaggtgcttcacaaatttgacagggagacaagtgaaattaaggaacaattctgctcattcactagacagtaccttgaaatagtcgattagtgcttttgaatactttacagcgtggtcccttttgagtcgaaacatccgccagtacaggagggccaggcatcggtaactgcaggcgaaaagagaaacaggcccagaagcggctgagtgcgtcgtgcgcaaacaagacttaaacatttttgttgttgttctaaggtactcaataacaataccttgtttctacataggaaatctttctatacgtgcatataatgtctgtgagggaacatcttttgtccaaaaatagaattcaaaattccaagaaggtattccataaatacatttatcactagataattttacagcattaggtgaatcactctgttgggtcacaggggccggccgcttccttcttccaccacgagagggcgctgtctctccacgagaggcgcgaggtagctctagtacgcagccttcactgcttcgcgggcgagccccgctctgcggaaaggacgacgctgccacctgatgttactgaactataagcagctccactaaagtcacaaacatgaatgtactttataaacaacaaaaacactatgctgggaataggtgccatcattataaacaacaaaaacactatgctgggaataggtgccatcattttattatttcctataatattttgtatacttatttatatatcagtattctatcttatataatcatattattgtcatttagtgtattattccaatatgggacttaaagtttgaaaggggcacaaaaggcgtttctgagacttatcctctcttccttggagctcttcactcagttatttgctaactcggatctgatgctgacatccagaataccaacattctgggtgcaatggcaccatctcctcctaccaaccaaatccaggacaggtaacaatttgagaccttttttgtgtctgttgctgttattattattttttaattcaactgtctttatttcactgcttggtagacatgtattctatcaacattctctgccttccacctactgatgagtaagaaagggctgacaggtaaaggaactataggttacccgatcgttcccttttttctgtggcatcattttcaaagtaagcggctgcgccgggtgcgatggctcacgcctgtaatcccagcactctgggaggctgaggcaggcagatcacttgaggtcaggagttcaagaccagcctgaccaacatggtgaaaccccatctctactaaaaatacaaaaattaggccgggcacagtggctcatgcctgtaatcccagcactttggtaggcctgtcgattttcaatcactgtgaattcagatcatgtatagtacggcagcaaaaaatggtctggactttccctggtcattagaactgctctggggctttgtatgttagaagacattgggcaaacactatgcctttcagcacctggtttgccaatgatggcatgcgaggctggggctgctattctaagcggagatgggcactcaccataatgcagccagttgtttgtcttctggtgtggcattggggcctgagtgggtttttagtctcatagcataccttagaaaaagcggggaggaggaatagaataaaaaacataaaaagcaaagaaatagtaaaactagcttttttattaacagaacttctatgatggtagttctccctgcctgatccttagcttttcatagtacttgctgataattctttcttaaaagctagctggtgctgctccattttcccaagtattacattactgtgatgactagaacagctactttctgctctttaacagtacaagttcaaatgctacagattgtcgggagtgataccagttcaagaactattcatgtatatgctaacatgtccatttttccacattttgatttatggctgagtgtctgacagatggaggtgaagttctatccttctgtgcttacctccagaagaatttccatcctgggtatgcagaggaatgcttagatttacccctctttctttgttatgtaacttttactttgacagctacataagtgtcctgagtacatttttaatctctgtttgcttctacagacagatactacgagaaactagtggcttttatggactgcacttaattccatttatttttctgaaccaaggggactgtggccattgctttctcccaacaacataccaaattacatatgcagactctttgagagagctgaggcagtatgtgtaatgatcagattgtcctaggttcaaatctcagctcagcgacttataagttgtaagtgcttagacaaatgtattaacatctttaagcctccatttccttatctataaaataagactaatactgccaatcacataacattgtgttaagaattaactaagatagcgtttgtaaagctcttgggatagttggctggcttgtaaattgctcaagaaacatactgttatcatcgcactatctcctcaacatgcagacttgtagcatttttcagtgttatctctttgcataatttttacagcggttgctctggattttacaatatacatgtaatttattggtatcaacattttatcactttgggatagtatggaagtcttacttcaatttagatacctttaccttccccacttaaaaatagcattgtcttgagtatcagatggtggtataattttttattgttttgttttgtagcagtggggtcttactatgttgtctgggctggtttcaaactcctggcctcaagctatcctcccagcttggcctcctaaagtgctgtaattacagatgtgagccactgtgcctggactgctggtataatttttgtttcaatcctcaaacctggtttataaactcataaggagtagtttattgtatatatatctatgtgtctgttcttccttctttcccaatgctcccatattccttcttttgtcattttatttctgtttgagaaacttcttttagccagtctttaagggtgggtcttttagagacacatacttgtacttttcctaaatctgaggctatctttatttcccttcattcttgaagaatagtttcactgactctagaattcatggcttcacagttccttctttgaacccttggaaactgtcacgccactccctcccagcctgcatggtttcagagaagcctgctgtcattcgaattgattctcccctgcagataattatcgtttctccctggctgctttcaggatatttggcctttagtttttggaaatgtaatcatggtgtgtttttgcatgcatttctttgggtttatcttatttaggtttttctctgcttcttaaatctgtaggtttatgtcttttgacaaatttggcaagtttcagccattatttcttcaaatactctctcagtcctactctctattcctctcctctgagacttccatgacacaaatgttggattttttcttattgtgcttgaggctgtgttcatttaattttttcagtctatttcttctttactgctcagattgggtaaattatattttttgtcctcaagttcattgactctctcctgtcatctccactctactactgagtccatttttggggtttatattatcaaattctacagtttcacaatttccatttagttctttttaaaataacttccatttctttgaaaagattttctggttttgtttgttgagtgataactgtgattattgaagcatttttacgatggctgctttaaaaatccttgtcagataattgcagcaactgattcatctttgcattgaggtcttctgatcatcttttttcatgccagtggtgactgtcctagttcttggtatgatgagtgagttcctatggtatcctggacattttgaccattaggttaggagactcttgagtcctattttaaacccagccaccctgtttaggtctagcaggaaggccctagcctactttgggggctgtggttccaatgataatttaattttcagagcctttctgatactattttagtctgtgtggttgatctggtgccaccggggcttcagctcatccctgatggtactgcctgcggagagtggaagggtgggaggagagggtcaccaggctgagctcgtgtggtggcagtgctccactgacccacgcctgcttggccatctggagttccctggtgaagggaattctgcccgtagggacaaagtgtacatcctgggctaggtcatcttggtggtgagaaccccttgccagcgctccaggcccttcagtgtctcagtaggggagaggagggtcaggcagggtgggcaatgtgcggatgtaattaatgctgttttcttttttttttttctttcttgagacagagtctcgctctgtcgcccaggctggagtgcagtggcgcgatcttggctcactgcgagctccgccttccaggttcacgccattctcctgcctcagcctcctgagtagctaggactacaggtgccggccaccacgcccggctaattttttgtatttttagtagagacggggtttcatcgtattagccaggatggtctcaatctcctgacctcatgctctgcctgcctcagcctcccaaagtgctgggattacaggcgtgagccaccgcgcccagaaaattaatgctattttctaatgtaggttgaaaaaagagctagccaggtgcggtggctcacgcttgtaatctcagcactttgggaggccgaagcaggcagagcacctgaggtcaggagttcaagaccatcctgaccaacatggagaaaccccatctctactaaaaatacaaaattagctggatgtggtggtgcatgcctgtaatccgagctactggggaggctgaggcaggagaatcacttgaactcgggaggcagaggttgtggtgagctgagattgtgccattgcactccagcctgggcagtaagagtgaaatttagtctcaaaaaaaaaaaaaaaaaaaaaaagaaagaaagaaaaagagccaaatttgtctttttgtctttgttttctctgtattttgcgtgattctatcgattctgaagtatctagaaggtggacagtgttctctacctgtgaaagattacttccatcagtgggcacagtgggtgtggtaccccagcaccctctctttgatggtatatctggctggcatggttttttgtttgtttgggcttgcttgtttgattttcaagtgtgaatgcctttaagcaggtcatgatactccagttcacagcaggccctatggcttgcttattcattgattccttaattgtttattaagcacatactatgtgccagaaaatattcgaagggctgaggattccccagttagcaaatcagacaaaacccaaaaaactccctgtgctcaaggtactcacactctagggcatcttccagctttgtccctgtccagtttctcccactttcctccctgcctgcctatgaacatctcaggctgggccttgttctgaggaaggaatgtatggatctaggatccgttagagtaacttttaccagtctttttactttgctgctttcatttcatcactactgaaagtaatgtgccatataaaaagacagtataaaggattcaccaatatattgatttagtagaaatactttattaagaaaaatgggcagtgttgactttaaaacattcttgaaaaatgctttatggaggtgatgtgttctctgatgtcggcatgacagtttcaaaggctggaaactatttactgagggaaagtggtgtgtaaaacaccaagtagcatctttgggccaatgtagaccaaaaagatcacatcctaagatgattagaaatcttccatgcagaatgtttggacatggtggaaaatgtctaagctttgattgcacagaaccccagaatcagaaaaacttttaaaagttagttttaggaagaattatttctcattatggatattagacattatgtcaagcagttaaactggctaaaaacataaaccatactatgaaggttctcagtagggctaatggatgaaattcccttaactgttggttacagagatgtgatggaggtgcctttccaggtctccatcatggaggataagtgtttgccatcgaatgccttgacacgtctgctcacaggtcttcacccaggtttggggatggtgcccatgtccagtttttagaccagacagtataagatggcttctccttccataaaatcctcctgaatgttcttccattaaatactccagaagtatttactgatggagctaagatttagatgatactaacctgaaccagatttttttttttttttaaagcagcctagggctgaaataggctcaaaatctgccacttcctagctgagaggagcaggcatgtcacagcccactcagactcagcctcctccctcagcaattgggggctacagcagctgccccccttgctcacggaggacagagggggcagggtgtgccaagacgccttgcacgaccttaccctcttattttggggggatgaacactggttcctggtgggggatggtgcaggctgacattcttttctctgtaaccatagtgcttccacacattcctcactcctcccctcatccagcaagaaaacacggtgcttacctgatgagctctactgtttctgaatacatcgtataaggagatttggattccatggggccttgttccattgcatttccacactcgataaacgacaatgctgcttcagcatagttcaaagcctttccaaacttttccacctgatcaacagagttaatacagtgtcttcctaaacaatagttttttttaaatggcattgtcatgtagtttatacaccttatttgagaaacccaactctgacttctaaaatcctatgaagctgagagaagaaagaaatagaatacttcttttcctacttattttctcaaactgctactggcttggagtaagtgagcgaacagttatatacagaattgtatcaaacccatgtgacagctgtcaatcaacagagctcagaactgcatggctgctctgatttctgtttccctctttctaacccctaatggtttggcgacttcattccttgttcctccatgctatgctaaatatgcatcaaagttggtaggtctggtcccatataagagttttcatacttcttttggtacatccccaacttggatggttctaggccttggttattatcttttacattatttgtggcacttatatctccatgccttcctcttctcaattttttttaatttttttatttttgagatggagtctccctgcaacctctgcctcctatgttcaagcgattctcctgcctcagcctcccacgtagctggaattacaggcaggcataggccaccacacctggcctcaattgttttttttttttgttgttgttaatatttagaacctcacttaagagtgagagtgagtaggggaaaggagaggagataaacctcaaggagctatttcagctttgctaaaataggacaaaaagttgaaaattattaataaaaatgatttttggttgggcctggcggctcatgcctgtaatcccagtgttttgggaaggtgaggcaggaggatcactcgagcctggaagtttgaggttccagtgagctatgatcgccccactgtgctccaacctggataacacagcaagacgctgtctctaaaggcaaaacaaaacacatttctacgggattatctgtagctgtcgaaatttgtgttattctttccccacatcagcaagggcagccacaaatcagctttatattcttaagatctcatcagtctaaacttatgcatcaagttcctggttccataccttactactctttgtaggtaattacatattctaactctggattgcagaatctccccagttttcaaatgattcattcatcaattaaaacagaatgacataatactcaaatactattccaagtcttgccactaaaaatacaaaaaaaacttcattagtaatgatagcttcaaaaccagaaatgcagagcaaaacttcctctccttagcaaatcaaaattttaaactgcttataaaggtagtgtaggctataatgcaacatttcttttttcttttttttttttttggagacagggtctcactctgtcacccaggctggagtgcagtggcatgatcttggctcattgcaatctctgcctcccgggttcaagcgagtcttctgtctcagcctcccaagtagctgggattacaggtgtgcaccaccacacctggctcatttttttttttttttttgtatttttagtagaaacagggtttcaccatgttggccaggctggtctcgaactcctgacctcaaatgatccacctgccttagcctcccaaagtgctgggattacaggtgtgagccaccgtgcctggcctataatgcaacatttcttgataacactttcagatgaagtcatttcatttagtattaatatttcctaaagcacccaattctgtggtatgtgcactccacaagcgaaagctctttccaggaacatataatagacttggagagagaaaatgtacacctacaagacagttcaaagtgcaaggcagtctgtgattacccaacaaaatacaaaatgaggcatccagtgcaaatgagatggaggaaagtgagctagtgatggggccgcagagaggctgggaaggccacagggaggagactgaatatgacgccgggaaggaatggtagggtttggctagatttggggaggatgctgagggtgtgagtgtgcccatgagagtgtgtgagagtgaatctctgcaggtgcaaaggcccgctggctggcaggagcaaggtgtgcttagaggtcagtaggggaccagcctggctggagcagagtgtctcctcttgggaaatcgtcaacaggaaagatagggttgggcaagaggacaatgaatgaataatgctgtaaactttagatgctggattcaggcagaaaatctctttctccttaaaaatctgatgctcttctccaagagtggccattcattggcttctccagatgaccagaactgtccatcagactcagattgtgtggacaagagctgtaccttccgctgccctcctctattttctgatacgtaggggttattcctcctgtaccccagtgtacataggcagtggtcttcacgtaaataagtgtttaataggtgacactggtagcattggaagaggggtactgttactgtttaaacatcttcagtattctgaaggtcactggaaatgccttcttcatttccagcacctgcctcaatctcagttatgaacactggaggagactaaaactggaattactaggtgggaagatgtccctttggacttcattcatttaagatggaacaaccacatgatctcttttagaaaagaaaacaaagttttccatctcttgcctgagagcttcaagctttccaaaacaggagatcatccaagcaagaaaagttattctttgaaaacatcaaatcatggtgactttagagtcttacgtgcagataatagtttctgtgttgtacagtttcagagaaagcattcatttcggcagatacatgtgaagaacacaagtgtttttgaaaagagatttgatcctgggaccaagccaagggtttgtcaggctaacaagagaaaaatgcaaatctagattttactttttaaaggaaaaaaaaatactaccgcccactgcctccactggctctagttactattcaaaccttaggactaaattgaaatattcatttgtctagggctttttcccagtcaggcattattggttgaagtcatactttattgggctatgaacatttgattatataaacatttctccattgaacagacccggccatccttgtaatagattttataattaccccagctatattgtcccagtgatgaagctgcagtacacacataatttggaagaacgtatctggaaagaaaagggtctcaccattgcatctgctttatgcttcattcgtttagcttcttgcataaaataatcggcactgcgaggcctacaaggagagaatgatattaaacgtcattatggcttaagtgcaacgtctttttaaaatattccttcctttcactcaaacttaaggcacaatttaaaaactctgcttaatgcggaattaagtgtgttttttgcctttccaaactactgcctgtatgtcaaataccacaatacattttctcttaagttagcaattcgaaacacactcaacatacgccagtagtctctatttacagtggatttaacatggccccctagggcctaatttgtgaatatatttttttattgtatggttaaaaaaaaagcgagaaatcttattttaggtaatatttacataaaacaatccccttttaatgtaaagattgtaaatatacctcataataattgtatggctatatatgggtgagtatatttatgtatccttatgaaaataagtgtcatttatatgcatatctagtacctagagttttatgtatatattgaattatcttaaagcctcacagtgaaaaataaaaagaggtaatgttggatgattacattccagttgtaatgaagttaattgtaaaatgatgtctaccttgtaacaatgcaaacatgccatgtattctctagagttctgattagctagctggtaaacattaacagcagacatgtggattattaaagcaataaccctggccagcggtgactctgccgggagatgaaggtaactcatccagagactgatttgagtgtgtgtaatgaggcccagttacgctaaggtactcattagacagtatctttaagtgtttagcccgatagattaaaaaaatgacatttttaggcaccggcagcataaactttatataatcaataaacttgacctattcatgaatatcaaatataagccaggactctctgaacgggagattcgacggaagtagtgatattaatcatggactgtttagccaatgattacatgcttattttgaactgccttatttcagatcctaatgggtcttttaccttattgtaatattaggtagtcagaacattcatgtatccaaagaggtcaaaacgcttagaaaagcaatgtgtgacaatgacattgcattttaatcaaacaaaccagaatcacagcatagttttggggtcaaaatgtttcctcaccccatccccatgcccccctctgagggctggagccgtccattcattgtggtgggtctttcactgagggtgaggcctgaggtctccttcctaggaaggccctgctcctgccactccgttttctctcttgcatctcctgggtgcccatgctttctccatatgaatggctttgttgttgccttggtgagttttccttctttgtccacatattgacacatattgtaagaatgtccatatattgtctggtctttggttccaactctggcaattgatgttatttttgttgttgttttttgagaaaggttctcactctgtcgcctaggctggagggcagtggtacaatcacccatactgcagcatcaaccacctggggttaagcgaccctcccaccacagcctcccaggtagctgggactacaggtgtgtgccactatgcctggctaactttttgtatttttagtggagacggggttttgccatgttgcaaaggctggtcttgaactcctgaggtcaagtgatccacctgcctcggcctcccaaagtgctgggattacatggcttccatcacatcaccatcctgctcacagacctaaaatcaatctccagggtctacgagataaaatctcagttcagatccccaataatcttgcccaacccacttaatcatattgcttactcacgaaggcccttgaccaaagtcagaggtggctcctcattgtcttgataacatggcatcctggtccgaggagctctgctcatcacttcccccacctggaacactctcctctctgttcattcactgagtgccttctaggagccgaatgttgcctggccctcaatttcccccgccgtaaggcgttccgagtaaccttggtccatgttcccctctgtccttcctgagctcacacagcacttcttgtttactacacttggtatttcattatcttctgagctgtactgggcatgtgtgcaacttgattgctggtacgtttttagtaaggaccatgctgtagacttctttgatctttcccaccctgtagtttttggcacacggtagaaggtaagcaggtctcccttgaatgaatggcactgaattcattttgagcttagaaaagagtggtgccttccgatggggtgcagcatcgcatccaatgagccagagagtgtctccatggcaacctgaaattctccacatcattatctgttctatactctagtatataagttaggtcattttttttttcttgccctgttttgtcactaacagttcactacttcaaatgcatttcattaaaggattatcttggtaataagctatggtatcttagtttccaccagccttctaagttacccttatggatggcagtggctcacaattcctaatataagctccttaatcaatattgttttcatctgcagcataggggcatatttttaaatcctgatatggaggctgagtcacagactctcaccatagcacatgtgggtaagtaacacacctaattttctgaccgtatcagagcagctataatcagagcagtaacctgagatgctaatagcataggtaccatctggaggccacttaacgaacacatttgttagaactctcatctttgcatagaatggagggctcactataatgagtcactgaagattgcctgatgattggcccattttctcctttcgagtgatttctagtgctgtacttccagagcagatcattataaagccagcaggaccaatgggatgtcacccagtgtccagccttgccacgaatcacaaaggcatcccttctgacagcaatacacaagtcagtaggaaaagtaaaattgcttgtcaccattgtgacagttatagaatataatacagcaaaggtactaaaatgagatcttatctgagtgttcaaatagattttccatctaatcttctattttttttttaacatggaaaacctagagttttcatttttcatttgtgtaataaaattcttcccattgtttcccacagtgatggtattttatgatgacacatgagcaaacctaataaaagtttaattaaacaccataaatggaactaactgtgaatcatgggctcttcagaaacggggcttgagtgatctgaaagccagagcttagctgcatgcatcttcattatgagagctctctccaacaaaagcattctgagcacttgatccaaatagaatgttttcttttcttctcttccccctcccaccacccccccccccccacctagaaacacacggtcttggttctcagcagcatcagggtttgagctacccccatatttcttctggcatgggaatattaaagcaaccttgctttttgttctcctttgtggccgggatagagttgaatggtctcccacggagagcctggcagactcctttctgtaattcctacctctgtgaaatgccgccctcagtagagccagcctgttttgtgaaaactggcagggatgagagctcaatgtgtttgaacaacaagttcctcggcgcggcagaaattggatgattttcttagggaagttgaaatccaaatcagacaaataggcaactgcataccaaatgaattcatcatctgctatccgatatgtcagcttgtcatctgataagccccagaggtgttaatatgtcccaagctttgaggagaatgcataagaaattaagtaattatttttaatacacagagtcagtgaagactatggatgagggcacttcagagtcagccactccaggatgctggcactgcctttataggcacttccccacagatccaggtagattgcatttgggtagcaaggattcaaacacagcttttatttccacaactttgatgtcggctggggctcagagtccctggaaccgggcttctcccaggcacaagcggtcattcactgtttcttcaggccacaggactgcttccctctcagccggccacagaaggcagggtttgctctgcaggacgctcaggctaagtggggcgggtgttgaatcaaaagtaactttctgttgaaatgggaaattatcaatctgatggttgtttttctctgagtgtgacatttaaaataatcttacaaaaccctaaagatgattggacagctgagatttcaatccaggagatctgaatgtccttgtctccgcaccctgtcccccgcacccctttgcaaatcctacttcatttctttctctctctctctcactcactcttactctctcactctgttttggttagaacaaaagaagctcctggccttgagacagggatttcataatgggagaaattccatatgaagaccaataaaggcttaatgattaatcaggaaaacaaaaaggtagggtccctgctttgaaaggactaggagaggagaccctcaagagaacatgcccactgcaagcccctggtgggggagcgccttcccagctgcaatttcgcctactcaaggatcttaattggtgtcctttgactaaatcatgctgctagggattcaaccttttacaatatgcgagtattcccatcctctataaaattaaaatcctttagctctgagactgctgtgcaagtacattacaaatgtcaagtccctcttccttcctcccggccacatttcacatgccatggccttcagcgcctggcgtctatagtcagtctttcctcactgtcgggaggttcaggtagccgggctcctgttacgggcaccatggggacagaagggacgtttggtggtttggctgaatgtgctgattgtgactgacttttccatgtgacatacaggcagcagccagcacttcctccagggagcggcaggcagccctggcacctggggttctctggcttcctagcacagcagaacggtgggcaggatggaggaggtggttttccagccaagcatctcaccaccacttagccctgttcaggacttctgtacggaggccttcatgacacagttgttctctctcaattttccccagccaagaattcccctgtcactaattatgataccaagtaacttacagctcatggctttgcactaataagatcagtttctaggcctcaagttgaatcaagtgttgtcattcattgacacaaattcttacagatccgttttttaaacaaaagtttgataaccacactagtgtcaccttaatactgtggctgtcaagtagtgaatgttgtgcgtttgcttaatgtcaggggaggaggtgaggtcacactgccaccaatatgagcccacaacatacaaaggacaggctgacctgattacatttttaaaaataaatgttattcttctcagttctgtctgtatcccaaaggaactaactggtgcctgtttacaggcattatagggattacaggcacatgctaacacgcccggctgattttttggtaagtaacctaggaaaacgggcttggaaacccattaatttacattcacctgcatgtagattccttatagtcatagaaaaaaaaaattgcaggcactcttccctgggaatgtaatttataattcagctgggttcattcaacacttgttattgagagcctactggcttcagctgttgtctgaatcccatgtttattcaaccattaacaagtatttataatacaaagagatgagtttacttttttaaaaaagctgcatgatgcggctttaaaaattaaatgacagtgtggcatctgttactttttggatcactgtaactggatttccatcaactcgaaatcactccagtgttaattatctagtcttttcttccactggtggcctctctttggtcatttcactgcttgtttttacaaatggctgaagttcactcttcaccctcggtgaagagaagtcaagggaggtgacagggctgaggtcttcctctgtcactgaggctgctggtggggaagctggcacagaatggaggtgggcaggaaggaggccgagaattaaatttagtaatcctaggaaaccttcctggagaggtcatcatgtgcctctctctcccctgaagaactgagaattaattaatcattatacttcagctcttgtgcctgtacttggcacttagtaagtgctccatatgtaccaaaaggaacctgggagacgttttgcacaattttaggtgacattctagcccagtgatctcttgaaggttgcttatttttactgcttaaaggaagagacgatgcctatttttgcttttttttctttaagatggagtttcactcttgttgcccagattggagtgcaatggcatgatctcggctcactgcaacctccgcttcctgggttcaagtgattctcctgcctcagcctcctgagtagctgggattacaggtgcctggctaattttttttttttttttttgtatttttagtagagatggggtttcactgtgttggccaggctcgtctcaagctcctgacctcaagtgatccacccacctcggctcccccaagtgctgggattacaggcatgagccaccgcgcctggcctatttttgcttttcaagcttgaagaatctttccacaactttcttagttcgatggttgagtggctgtttgagttgcatgtttattttactgttatggatttcaaatcagttgggacatatggcaattggaatgcgacatctatctctccatatgatggatatgtaacagtgtttttttattctattatatctatatccataaaaggagaaacagtttcattgtagctgtcagccaggaaaattatacacattgctaatgggaagaacaaatgataacagcctctttgttgacaccaatagtgacaagattatattagtttcagccatagcagattaagaaacatttcctcttataaaaagtccaagggctgccagccacggtggctcacgcctataatcctgcactttgggaggctggggtgggagggttgtttgaggccaggagttcgagaccagcctggacaacatagtgagacatgattttttttttttttgagacacagtctcgctgttgcccaggctgaagagtggtagcacgatctcagcttactgcagcctccacctcccaggttcaagcaattctctgcctcagcctccggagtagctgagattacaggtgcctgccaccacacctggctaattgttgtatttttagtagagacaagatttcaccatcttggccaggctggtcttgaactcctgacctagtgattcacctgccccagtctcccaaagtgctgggattacaggtgtgagccactgcgcccagccgtgagacgctttttctacaaaaaaaaaaaaaaaaatttaactgggtgtggtagcatgcatctgtagacccagctactcaggaggctgaggcaagaagatagcgtaagcccaggagtttgaggctgcactgagccatgctcataccactgcactctagcctgcgtgacagggcaagaccctgtctcaaaaaaaaaaaaaaaaaaaaagtccaagtacctgtagatcaaagtacaatcatttagttgttgctgtttctgacctagctttctggttcatacactggaaaattccttgcattttaatatgacatatgtgtttgtattttgtgtgtatataccatgctctcaaaaccacccactgcaagtatgcggtggtgtgagtacctcagggtctaatgctccttctgtttgatcatgttgttgggttatgacttccaaatgcaaatttctatgttatccttatatacaattttaatctcttctttttacaaatggctgaagttcacatgaacaatttatatcactgaaccctaattataaatgtagttggccacctgactgtactcccactccatgccctccctggggggttaatcaccacctacctccctggctgcttggcaaaggcgatgaagacagtgagaggaagcggggtggtgagggccaggagtgtgtgtggggtgggacgcagctgccaccacaggaagagaagaaacacacatgccctcctgggctgccctcaagccttcctaaacccagttaccttggaatgtgttcatttaacaaaacaaacaacaaatgtggatttggctttcacccccaaaaccctgtgccctaattagcttacaggagttcatgcaatacttgaagactaaaacttagtattttaaatttcccagggaattgtacagaggtgaataaatagatcatgccgagactccgggtggcagttagggatggaggagcggggcggacgatgaggctggagtagccacccctgcatggtgctttctgtgctccatgtgacaccccttaggagacggcatttaatggatcctaggagggccccgctgagcgagctgtggcatttgtcactgggactcttggacatgtagagccattttattttccagtgtccagtggggttagtggtttgtagtctgctcctcagctggactggaagccctcagagggcagaagtgcctatttctgctgctgctccaccccagagctgaatttttccttgttcacccagccatgtatttgacgcccgtaggactgctaaagctgaaaagaggattcttctgccttccaggcttgtccttgacacatacattttccctacgagccgaaataattttcagcatcattttatcatttctcatttgtcattttcagcctctcgagagcattccaggatgttgtttttattcatcttctcctcttgtttttcctccttttaaaatgatgctgggaatggaagttatacttgtgtgaaactgaaagtgctagaattgggtgaaggatgatggcatttttcttcctatataagaatcatttatactatgataaagaatatagcagttggaggaaaaaagctttcaggagtaaaacactattattcattgcctattataatttacaaaaacaacaatgcttctctttctagtagcataaaaccgccaacagcccaagtacaagtgcttagaagtgtaagactcattaatgctatttgcctttgttttttgatgtcctggatccaaccccattagcactgattattccgtctacccaaaaaccccaccaggactcaggcgtgcactcaaaattaaggctccaattccattcaagagggacatttaaatgaccaagtcccaggggaaaaaaaggccgcactgtagctgaaggtggccacaccaaggtgcccatgccccttccacctgagcagcttctgttctgtcttgcccctcaccacatttaaaagcgtctgaacttacatatcatcgaagacaagtttctgcctcttgcagtccctgtggccgttggagcctggagaccacggcttcgtctgcggccgtgacttgtggaggggaatgttttcagaattgttgtgagctgctttctaaacaacaaacaacacacatctttgagaaattggccacctggtgaagcgagcagcccatcacatacatacatacgtagaatatctttggctctacagaacatctttgtgtgctgtattagaattgatggtgattttgtctcaataaagaaatacatgcattctaggtatttgctgagggcttctacctgtgttctcaactgtcattcttatgacactatcaaaagggaagtcatgacgcctactctcacagatccagaaacaggcttggtgaggttcagcaagttgcccacactcagtgactgtggtggaggccaggggttagggtttagatgcccacttttcccagtccgctagactggaggctggccagttcagtcttcatcagcatcctccagggggctggtgaaaacacagattgccaggccccaccctgagagtctgggattcagcagggctggggtggggacctagaatctgcctttccatctggttcccggtgatgcggatgctgtaatcacccatgatcctggaaccacgctttcagaaccattcactcatctcaacagtcaaccagtcactcatctcacaggtttgctggttcttgttggctgtctgtgaagaccagaaggagtcaacaggaatcactaggaattacttaaaaaataaatcgactgggcacggtgtctcacacctgtaatcccagcactttgggaggctgaggcagggagatcacctgaggtcaggagttcgaggccagactgaccaacatggtgaaactccgtctctactaaaaatacaaaattagctagacgtggtgatacatgcctgcaatcccagctactcgggaggctgaggcaggagaatcgcttgaaacctggaggcagaggttgcggtgagccgagaccatgccattgcactccagcctgggcaacaagagtgaaactccgtctcaaaaaaaaaaaaaaataaataaataaattctaggccaggcatggtggctcacacctgtaatcccagcactttgggaggccaaggcaggtagattacctgaggtcaggagttcaagaccagcctggccaacatggcaaaaccctgtctctactaaaaatacaaaatttagccaggcgtggtggtaggtgcctgtaatcccagctactcaggaggctgaggcaggagaatcgtttgaacctgggaggtggaggttgcagtgagccaagactgcaccattgcactccagcctggacaagaacaaaactgcatctcaaatatatatgtatacatatgtgtgtgtgtatatatatatatatggaacacactagtctgtggaaaagttttaaaaatcacattacttgggatacagacatttacatggcacctattgtgtgccaaacacatggatcataaaacaatgtcagtggttaggaaatgcaaatggtttctctgaagtaattaaattgagtgtatacaaatgcttctttaaatagggactgcttttacgtgtagcactgtaagggttagagtctactgtcatagaagaccaggaagctcagatgtcaacattttaaaattgttcttaaactcctccagtggcctctgcttgctcttggtaaaaggagcgatcccagccaagtggcccctcagccattctttgcctgtggcctctgttccccagattcatgagcgtgtgcagttctttctcgggacctctgcacttgctgcttcctctgcctgtaatgctctttgtctcttagtatatggtgacttgccttttagagatctcgcatcaggggtcagccatctatggccagggagtcaaatctggccctttttttaaaataaagttttactgtaaaccaatcctgcctatgtatttatctactgtctgctttcctgctacaacagcagagttgagtagctgggatggagactgtgcagcccataaacccttaaattatttatctgactctttacagcagcagttctcaactggggcaagttgacaatgcccggagacatttttagttgtcaccactgcgagtgggtgctcatagcatctactgggtggaggccagggatgctgccaaacatcctacgttgcacaggacagccccaccacaagtaattactcagtccaaaatgtgaaaacctgcttcgcagaggccgggcgcggtggctcatgcctgtaatcccagcactttgggaggctgaggcgggcagatcacgaggtcaggagatcgagaccatcctggctaacatggtgaaaacccgtctctactaaaaaaatacaaaaaattagccctgggcgtggtggccggcgcctgtagtcccagctactcgggaggctgaggcagaagaatggcgtgaacctaggaggtggagcttgcagtgagccgaggtcgcgccactgcattccagtctgggtgacagagcgagactccgtctcaaaaaaaacccaaaaaacctgctttgcagaaagtttgccactcctaggactaattcaagctgctttgttataagagctcctagttctttgtgagttccctttttagtactgaaaccattggtggtgaatcatgcatgtgtgtgatcccctgtataaggctctctccctagaactgtaagcttcatgggggcacaaatgggatccgctggattgttattgcatctctggtgctcagcacagtgcccagcacgtaataagtacttaccgaatgagcacctcttcggtgaaaaataactaaataaaatctacaattggtttatagttctctgcgtatcatagttgctcatgatataaggatatagagggaaataaaaaaacttgagttggtggctttttgttccatgtttttctaatataggtcttccccaattctttcagtctagaattaaagaccactgctcccaagtgagggtgcacaaaaaaggttcatttcctgaggatgctgtaagatttaggctctcgtgggaacttccagcaacttgtaataatctttaattcatgggataaagtgttacacactgctccctccctcatctttctcatctttctttgcagaatcctgttcttttttttttttttgagacagagtctcgctctgtcacccaggctgcagtgcagtggtgcaatctcggctcactgtaacctccacctcccaggttcaagcgattctcctgcttcagcctcctgagtagctgagattacaggcatgtgccaccacgcttggccacccagctggttgtgataggcacagtgattatgacaggggagggtttggaagtaactaatgttcctgaaaggatgagtggtccaggaccactggctgttagaggctggcatggcagtgaagaggaactaacatgtagtgttagttgcttaggcgtccctaggtgttggagtttttttttttttttttttgagacagagtcttgctgtgtcgcccaggctggagtgcagtgccgagatctcagctcactgcaacctccacctcccaggttcaagcaattctactacctcagcctcctgaatagctgggactacaggcgcctgccaccacgctaggctaatttttgtattttcagtatagatggggtttcaccatgttggccaggctggtcttgaactcctgacctcaggcgatccgcccgccgcagcctcccaaagtgctgggattacaggcatgagccaccacgcccggtcggggtcttttcatgatattgtctcttttaagtcttatcactaccattttgcaggtaaagaaacaggagcagagagattaagcaactggcccaagatcacactgcagctaagaggtgaggtcagattgtgaacccaagtcccctgctcttcccctggggcgtgctggaatcacccgagatcactggaaaaggggtggtggtgggggtcccccactgcagctgcgacactggccaataagggcagagtgggggccctgtagctttcagtgtggggtttcaatcccagatttaactctgccctgggataagaaatttttcccaacagaaagattggttggttcaaactcctaatttactttgtcccgggatggtattactttgaggtcttttcttttcagaaggaaaaataaaatcttgcctaagcaaccgagggttagaactctccctcagggttcttcttccccgctctctgttgggacagtgaagggggctgtcctctgttgggtcttcctagaagcgggaggcattcaggaattctcaagggacctcaagcatgtgttcagactgtgctaggttagagacagagcttgggggtgctcaatttcattttggttttaattgggaaaggaagagcatcaacaaaccgtgaggtctccgccgtgaggctgcagctggctgtcggccttaggctttttgctggaagaggctgaagtaaacaaactgttgccattaggtcggctggaagaagttaagtcctcgctggtgtatttgtgtttagatgcatcagagaggggtgagatgggcgaccgaagcattttttcatttttatttattggtattgccacactgaaaaaggaaattacggtaatggaatgttacagagtcagcacagggaaaggtaaatgttttcatatgacccaaaccacccaactgggacctgttggtaggagaagcttattgggaattattataccaggaaacaagttaatggcattaggatcataacaaacaataagcaaatctcactcactctttcttttctcttcccatcaggatgagtagtaattctggagccagcaccaaagtacacgactaagactaataacaccttcattttccaagtcctttatccaaggatctcaaaatacccaacaaacaacttactgttttcctaacaagcataaggagcaagcagtgggaaagtcaatcaacaacaataaatgaattctacatttctgtctttttttgagacgggatctggctctgctgcccaggctggagagcagtggcaggatcttggctcactgtagccctaacctcctgggctcaggcaatcctcccacttcagcctcctgagtagcagggactacaggtatgcatcaccacaccgggctaatttttcatattttttgtagagatagggtttcaccatgttgcccaagctggtctcgaactcctggattcaaggtgcctcggcctcccaaagtgctgggattacagacatgagccatcgtgcccagccaaattctacacttctttttattttttatttttttgagatggagtttcgctcttgtcacccaggctggagtgcaatggcacaatcttggctcactgcagcctctgcctcctgggttcaagtgattttcctgcctcagcctcccgaggactcccgagtagctgggattacaggtgcctgccaccacatccagctactttttgtatttttagtagagacggggtttcaccatgtcagccaggctggtcttgaacttctaatctcaggtgatccacctgcctcggcctcccaaagtgctgggattacaggcgtgagctaccgtgcccagtccatattccacatttctaaaaagacttttgctatctcatctgagcttgtactaaatataatatagaaaaataataaaaccagagaacaacctgcaatatgtgaagccaattcttaatatctgagtttatgacttaaccagggattgatcagattaaacctagaatataaaaacggtgagtaggaggccgggtgtggtggctcacgcctgtaatcccagcactttgggaggccaaggtgggcgtatcacttgaggtcgggagttcgagaccagcctggccaacacggtgaaaccccctctctgctaaaaatacaaaaattagccgggtgtggtggcgcatgcctgtaatcccagctactcagctcaggaggctgaggcaggagaatcgcttgggagaggtggacgttgcagtgaggcgagattgcgccactgcactccagcatgggcgacagaataagactccgtctccaaaataaatacataaataaataaaataataaataaaaatggtgagtagaagttacagtttctgattcctaactccttattttaccttcaaaactactgtctgtgcttgaatgtaacattctccaaaatcaaccatcagtgaagagggattcacttatatctgagtttgcaatgtatattatattgttaggcctctattacttaaaagtattgtttggggaagacagattagtttgaaataaactcagtcatcactaatttaggatacttccagaggtcacctggtagagtcagttaaaaaatggtaaagccatctaacaaagatttactcattattcttggggttgggatctcttaattgcacgtgttggttatcaccgcaaagaagccactaaagtcacttcgaaaagcaatttccttagctggtggtcacagtggagaaattacaaacacagacctctagaacaaatgacaaaaccaaggttctgaatgttatgcaaatggatacatgtggggatagcatttctggtgaaaagcactgttccaaaagcacggtgtgtctaacaacatagaggctgtgtcacgcaaaagtgctttgggagaatcaaaagttgctcatctagtgatggctaagatgctgatgctgaagataatgcgaacagcctgattataattgtttctcgaaatgtgagtgaagaaagaccttttcctcagtctctattatttgacatactttatgatttttacagtgcatggaaaacaaaactgtgacattaaatattatcatggatatcatgattgcctgtttttcatcactgcaagtttatatatatattcaagttggccaaagaaactttctttggagctcttctttgaaattggcaatccccttctcttggactgctgtacagcactggtaaaacttgatagtagtaatcacaattccagaggtacacagaccacctttctcagaatgtactctaagcattttatatgcattgtgtcaccacttaacagcaacaaaaccatcagaactaagaggctcttccaggctaagtctctagagcaagagttttttaacctggggtccaataacttgaatagagaagtgacctcttcattttcactaacctctcactgtaacagaacatttccttcaactatgagtaaaggtatgaaaccagagtcatggtttagcaggagcagtagtacaacacttgagaccgtgtcaccggtataaatcacagctattttctttttttctttttcttttcttttttgagatggaacctctctgtcgcccaggctggagtgccatggcacaatctcggctccctgcaacctctgcctcccgggtttgagcgattctctggcctcagcctcccaagtagctgggactacaggagtgtgccaccacacccagctaatttttttatatttttagtagatacggggtttcaccatattggccaggctggtcttgaactcctgaccttgtgatccgcccgcctcagcctcccaaagtgctgggattacaggcgtgagccaccgcacccggccaaatcacagctattttcatatcatattgcagttgtgcatacatacggtttatattcctcactgcttagaaattctggaagccaccagatcagctagaaaggttatttagtgcattaacaagcactaaaggatatcacacatttaaaaatatttggggactacattttccccatttcccctttcccaatattttgggctggcatccaccctgcaaagaggaccgaggagtgggcagcatgcaggggcagccctccctcctgctcagacccacaggagccctcgcctttcaaggtgattccggcgctgcagtgtgcctgtgtgtgtgcaccctcaccctccagttccctcgccaagttttagcactgctctacatcttttcctaacctttcagtttacatttttatgtgttgtgccgagacattcatctctcttcaaaattctatgtatacggtcagggagggtgaggagtgtcttagagaggaaaagtggtttccgtgctgtggtatttcaaaatggaaagagcttctacgactgatgataagctacttgtttctaataaatacctgggatcttgctttgcttgtaagccattcatcacagaggggagtcagtgctggatgcgtccatctggaacctcttgagaggagtgtgtgggtggccatttaaccttgggagcacggacccttctaaggccacaattttagtctatatccaattaattgctttaggtgctacacatggagattcagcttgaagtgtgtatttcttcgtctgtgtaataagcttagtgttcttaggagtttagcggttaccattaaaatattgattagaaattcagttattaagtttttttgggggaagggcatgtcttggggagtgcagagctgtgtgtaactagtatctggtctttggttatggagaagaaccttgcgtgagtatctggagctataatgtgtggcacatgtgtagccataataataagatttgggttaaaggagggaagcaagtctgcagaccttgaccagagtagtcctcaaaaagcctgaccctcctccaacatagcaggtgactttcagacccagagatctctccagctcacttccactttggagggaatgcacgtacctgttgatgttcatgttgcagtggtttgcagacaaagtattactggtggaggtggccagtcttgaagagctgtctttctctccctgggacttcttgatctccctgtagtcgtcttcgttgtcacactgtatgggaataaactaaagtcaatcagcactggatttcaagaggtattatgagttcccaggcaccgacttccacagagcaaggcctcctgggagccccactcacctggcttccccgaagcacagcctgagcagctgtgcccctgccatagcttccccattagctcctcaacaagcaaggatgaaatctgtcagttttacaattgacagctgatggagaggagaggcacgacgccatgattcaacattttgaattctgaaagctgctctgccatcaaccggcttaggatttagccctccaactggtctgagttcccactgcagctccagcggcactcaccttggcatttcttggtatcagaataaagtacagcaagtgtgtgttctctgggattcatgccataagggcagtggcaagcctggacttttctgttttaaaaattcttgctttggccaggtgcggtggctcatgcctgtaatcccagcactttgggaggccgaggcaggcgaatcacgaggtcaggagatcaacaccatcctggccaacatggtgaaaccccatctctactaaaatacaaaaaattagccaggtgtggtggtgcacgcctgtagtcccagctacttgggaggctgaggcaggagaatcgcttgaacctgggaggcagagatttaagtgagctgagatcacgccactgcactccagcctggtgacagagtgagactccgtctcaaaaaaaaaaaaaaaaattattgccttttgtgaactgcaagcagaagctattatctcttggtgccttaattctagttttcaattactatcccatgacatcttagaatccataaagtacctttttctaaaacagtactttgattggatccttgttgccatgattgggtttaattttatttgtttatttagagacagtcttgctctgtcacccaggctggagtgcagtggtgcgatcatggctcactgcagcctcgacctcccaggctcaggtgatcctcccgcctcagccttccaagtagctgggaatgcaagtgtgtgccaccatgcctggctaattttttgtattttttgtagagacggggctttgccatgttgctcaggctgatctcaaactcctgggctcaagcgatcctcccaccttggcctcccaaagtgctgggattacaggtgtcagctatcaggccagcctgtgtttaactttagatatgtgttaaggtgcaacacaaatatattcagaaagtaccattttccatgagataacaggaacctagtatggtatcctcagggctgtctgcattgttttccaggagacaagtgccaacaccaaagagagaaagactctgactttctcgctctggctgggattttgccacacagcctctgccacaggggctcccagatgcccacactgtaatagtacccccatggagggcccaaaccaaagctccgagttcttagtccttagctccagggctccagcagggcgagactccacaaatttgacagccaggtctatggggtcccatctccagcacccagtactggggtactaatgcccagaataccaagtaaagagcactataagaatgttctttcacttctcttgtgtctgtgtttaatgattctttagattttatgagtacagccaggtgtcaggcttactgtaaatgaagcttcttaagttaaaataaaaatggccataagtaatacaactatttaaacacagaatattacggaattttatgtaagtctttctgcacatctctctagtaaactctgcatgcctggatggctttatgtatttccaatctgtctatatattaccaatgtctatctctgcatatttcatgtgtatatttccatcagcgtattcagttagccatccatcccagaggtaatagccacactcattcccagatgattaactgattgattgattcctacactcaacaaagactgagcaccagcaagtagtaaggaagacagggtgtgtagagaaaaacaggaggaatagcaggtagggaagaaaatgagctgccaagtattactgagttgcattgttggaacatattgtgtgaatctgacaacacccctgcaaagatgtcaacatttttttttttttttttttttttgagacagagtctcactctattgccaggctggagtgcaatggcatgatctcagctcagtgcagcctctgcctccagggttcaagcgattctcctgcctcagcctcctgagtagctgggattacaggcacgcgccaccacgcccagctatttttgtatttttagtagagacagggtttcaccatgttggccaggatggtctcgatctcttgatctcgtgatctgcccaccttggcctcccaaagtgctgtgattataggagtaagccaccacggccggcccagatgtcagcattttctagatggagaaactgatgttcagagaaagtaaggtcacctgattaaggtcactgaggaggccaaggaccataaataaccttctgggtctagcgcaaaatgaaaacgctgggccctttgttcaaaaagcaggaaaagagtgatgttataaagccctcaaatagaaaacattctccattctttcacagtctctgtcatggaggtgtctacagtatttgctatacacactgtacttctttgggcatggggatacttggggaggcaagtgtagcctctcaagggctctgtctgcccttggacaaggtatatgtgtgcagcccaccagtgtgggcgttccccttctgccaatcagaggccctacctgtggtgcccgagttgtcaggcatttccccaacaacccacagcaagtgggcaacccccaggggatttcaagaccctctttggaatgtcttactacctggatgagggatgggcaagattcttcctctgcctgcacctaggccccttcttggggcaagggcagcaatagtccctggactaagacaggaagtgggaggctgcctagggcccagggtgccaggaggcagaagcgcaggcagaacctgccctgcagaaacaggcaggaggtgggaacacagtgagtcaaagctccatatgcccctgcacatgtaccatcaatttgcagcatcacaaattcaaagattacaggaaaaattttaagatggcagccacaagcattcaattccaaggggccctgggtgatgcacaccactatggtcccatgcatggggcccatgaaaagctggacctgcaggagggaaacggtaaagacaggatttgaagtcaggacactttggtgtgaaaatccacacactttccattatatgtgagcactctcagggcaatggggaccaactaagggcgcccactgccggctaataatggccagtgctgggtggaaactatgttggggcctctttataaaattatctttgctggccacgtgcagtggctcatgcctgtaatcccagcactttaggaggccgaggcaggcggatcacctgaggttgggagttcgagaccagcctgaccaacaatggtgaaaccccgtctgtactaaaaataccaaattagccaggcatggtggcacatgcctgtaatccaagctactcgggaggctgaggcaggagaatcacttgaacccaggaggcggaggttgtggtgagccaagatggtggagcatcattgcactccagcctgggcaacaagagcgaaactctgtctcaaaaaaaaaaaaaaaaatttttttttctttgcatccataccaaggaaaagcaaaaagctgccccttgaacatatttcttttcatgaactttcttgcaagggcttcaaattctactttatagggataaattacttaatgttattaatattatgtgaagaaaaacatcctttggtactttattttttattttatttatttatttctttgagatggcgtcttgctctgttgcctaggctggagtgcagtggcatgatcttggctcactgcaacctccgcctcccaggttcaagtgattctcctgtctcagctgcctgagtagctgggactacaggtgtgcaccatcatgtctggctaattttttgtattttagtagagatgggattttaccatgttgtccaggctggtcttgaactcctgagctcaggcaatccgcccatctcagcctcccaaagtgctaggattagaggcttgagccaccgtacccggtctggtactttagaatgaatttctctggtcataggtgcccttaggttacaaagatgattgtcataaaaaggagactgagtgccttctccatgcgcacttacaaagcaagaaatatattcatcgtggccaggacaaggtaacaagctgtactccttagtccccttctcaatcagggattcgaaatagctgtgaaacgtatgtgtccagtctaacttttctattgatagactagactgtcttcagaaaactggaaaatatacagacctcagactgatttcttattgtgacgctctgaagccagacagcctgggttaattcctggctcagccccttaggacctatgtaaccttgggcaagttgctttaggctctctgagcctctgttccctctccgtaaaatgggtatgacaatatttgcctcataaagttataaggatgaaatgatttaacatgtataaagtgcctagagcagcatctgtcatggggacctatatacctgtgagctgttgttactgaaaactttgtcctaaatttggagccatccatgcatattgcaatcttggtctgtcacccattgtatttttcacagtgataaaaattacttatgaagatacagtaacaggaggggttaaaaaccctcaaaattggctttaatggatgattaaggtattcccctgcacaaaaaccttcgaaatgggctacacgttcaggctctgctgccagagatgccccccagctctccctgtccttgcttttgctgcccttctcactccctggactcaccgcttccattcctgaccctggacgtattcaaatatccctcctctacagagccctgttttcagggcccctccaccatgaagccctccttgatcaatgctaacagaagcaacagctgctggttctgatgctgcatcagggtctgccgtattcattttcacctgccacaaccttgaacttcatgaggccactggcctcttgggccaatgagtgatcccaccatcaatgtcaccccattcctgccagcaaagagtgagggttctcatgtgtttagctttctcacaggccctacatccagctgcgtgtgcacacgcttgataaatatttcctattttgacatgcagtgggacaaggcttaattacctataactataaaatagggataataggctgggcgtggtggctcatgcctgtaatcccagcactttgggaggctgaggcaggcagatcacttgaggtcaggagttcgagaccagcccggccaacatggtgaaaccctgtctttactaaaaatacaaaaaaattagctgggcatggtggtggacacctgtaatcccagatacttgggaggctgaggtaggagaatcgcctgaacctgggaggcagaggttgcagtgaaccgagattgtgccatcgtactcctgcttgggcgacagagtgagactccctcccccccccccaaaaaaagggataataatggtacttccctcactgagcagttctaaggactaagttagatgttaagtgcttacaacagtgtctggatatagaaagtaccctagaagtgtgtgttaggtaaggacacacaaaactcctgcggcagcctaccgtcccaaacagcagcctatgggtgctctatccaagtacccacaagttaagagatagccccttcccctccacgcccccgcaccccagtcagccccaggcctaccttgcgtttcctcttggattttggcaaagccttttctgcaggtgtgtccgaggtgtggctgggcggtgcgctctcagagtccttggtggcaggggcgctcaatacccctggctcctggggcaggtgttctgggatcctggacaggagggtcaggtcgattttgacccagagagacctgatctcatcactgtcctttagaggggagagaagttcgttccggccaaaggggaccagtgtgtagaactgctcctccagctccttggcgatgtcactggtggtcctggcgttgatggagcctacaggggccctaggaccactgcccccgttggcagcggcctccttcagcctctgatcattcccggaggaggcagaggcagccacggtctgtgctttggacagagggtactcctcctgctcggactccaggtcggagtccgaggaggaggatgaagatgacgactctgtctcaatgaactccttggatttggggacgatcctgcttagcccccgcgtgcggcgcttctcgcaggtcacggaggagcgcagctccttgcggtggctcgctctgttgttgccacagggcctggttttggtgggctccggggggaccaccacgctcgtccccagcgcgtccgcggccgcgggctcctcgggccggtggcagttggcgccgtccccggctgaggtcctctcggtgcgcctggtgggcttcttgcccgcggacctccgggcaggcgcgggcgcgttctccgcgggcgcacagggcactgcgggtggcggggcggctgcgctcaccgccacggccacggccgcgggcggggacttctgcttcacgcctttactcccaggggccttgttggctgtccttggcctttgctcctccttgcaagtgctcttgatctccttctctctcaggctgggctggcaaacgtcggggactttcccacagtcctggacgtcctctttcaccgggttgtagtactgattgctctctgacccgtggctttcattttggatcagaataggaggcttgtggggattaactttgtttagccatttatccagctgccacttgttagaggatgccggttcagcctgaaagcagaaaaccggtgacaaacaaaacatctttcattacaggctcacttaaaaggggcctggctgtttttatcttgacttacttctctaagtatatgagcagaaaacgaatgggctggaagcaaaaggaaaatggaagcattaagcgtgtgtggcagccccatgtggcactcaggatgcctggatgatgctgtccttaccggcccgtggcactaaatgtccttgcagcacttcctctttggaaaaataaggaaagcattgtgtctcattagaacccatttcctagtacttttgagtgttagtataaatttttttatataattatatgtacatatgtaaacttgaaattccccaaaactcagagaattgtttagaggccctgagcataaatcacttgtttttttggtgagacttaaaactttggggagatctgaagggggactaagtggaacctacaatcccaaacaattaacacatgatttatgtgttgaaggcaggtaggctgtagtaatttggtagtaggagcaatgaccttgggaagatggcttgttttgcatatagaactatttcagaggtatttgtgcatctttggcagcctgactgggtcagtctatcctcaacctgcttccatcacactttgctagaaatatttcaaacatggaggtgagatggaacactttcctgcaagcaggtttgctaacttagagcaactcatgaaagtcattggttttgaactgtggccccacaggttggctctgtggttgagggtggggggatggctagggaatgccctgaaatggatgggaaatgtgtagatgcattttgtttctagaagaggtctgtacttttcagttgtgtctctaagaatctatgtctcagaagcaaaaaaaaattaaggaccaatccaataatttcacagggagtaaatgctgatgtctaaaaagtcaatttatccagcattatgataattaagagaaaacaggtgtattgagaagaatagaattttagccagagtattttcaatttgtgactctaagtgaaatggggaaagtattttggctaaggtgatgtgttttttcttccctatggccttccacctttcgaattcgtggcatccattgtttcagaggagaccagataccaggctagagtaagaagacactgcttagctccatacttcaagcttgatcagttcaagtctagagcaaattgggtctgttgccagagaaaaaatggtttaacacaataaataaaaataataaagtttaataaaattttaataaaaataataaatacatttaaataataaaatttgaaaaggttcctttgaagtatcaaggtttgtttttcaacagtgaggcctgtattaagagcagaactcagggctcttggcctcaccccaggcactgaggatttcagaaggggaataagagggctgtatcatagaagcaggggccttggctgagtccgggcacaactcagggaaatgggaagcctctgatgggccagaacgggttggggccaagaggaattggccacagagcgtggggatcaggcaaccagagctatgacagggaccatggacatcttgctggttgccccaaaccagatgggaccaactgccctttggggcagactggcacagggtgtctggtgacttggagaagcaagaaaatttcagtgaaggccagaatgaggatgaaggccccttccctgggctgtgaggatgcggaagcccatcctggagtgcaggtggggaaggggggaccccctggccccgacacagattctggtctttgacgtgacatttttctttgcttgttttcatggccaccaacggaaccggggcaccagagaaatatgcaaatgagtagaaagacagatggtttttgtacctctgagttctgcgtaaatcatgacctcgctttatttggcttctccagagaaagggaacacgggaaacctatggaacatgcccagtgcatgtggcggtggcagatgccctcccatggtcagagaaagcaggacagtgggacacggaacagcttctcggccaagggggatccctcacctcccctgagattagctgagagtgcctgaaaactaatttggtggcaaaaatcaatggcttctaattttgtctccctcaacccccatttctctcatcaagtcagtgccttcgcctgtgcctcagcttccctagacaaatgggacacagtaaacaggaatggatgctgaaggggcctcttgcagaaagggtgcacatattggaagagggcacacacacacacggcagaacacacccctcacactggccccgccactgcgtttcacactagttctccctcactgctaccatccggagccttctatagcccacatctcatatgtgagagaagtctgtttgtagccaaaacacagctgcacacaggaaaattcacactgaaacttcctagcaggagcattaacagaagggcagaatttaatacatttagtacaggcccactgcctggtatgctttagggtcattttttctgcacttcacagctgaggaaatcagtttgaagtacccactttcaacacatcactaaatcatacttttttttccctcaaggatctacaataacctcctattgcctctcaaacaaaatccaaatttctaaggggggcgtttaagggcgtccattatctcgtaatcatctttcattgtcagaatacctacagtttaactcccacttcatgtgtattatctcatttaatctttacagataagaaaggttatcatccctaacttgtagatgaggctcagagaggctaagggacatacccagagctgcacagctaccgggctctacggagactaactttgtactcatctaggtttaaagaccaattgtctccacggctgcatcactgtgtctcccactgtttggcatagcctcgtgaaagggggaccgcattcctttgagaaatgtcagtcttcaacttaaaatgacagaattagatctgaattttggagaaaacaccaagaacactccaaacagtacttgttgccctctgttatactcaattgcgttgtcttttgatgttcgtatttgtttcatgtgtatatatgtcttgtgtcttcaaaaaagccaaatgcttctttcaggcaagggccaggtctctgtttctttagtatcccttgcagcatctatactaggtcagggaggcagattgccacatctctcctcctaataagaacaactcacaatgaggtgtcactcaaattgtaccatttattcctttattatcatcattttccccccgacaacctcacaggttaggcagagcatgattatctgccattctggaaatgaggcaattgtggccaaggaagctgcaaggatacagagtttagtggcagtgaggaggggaacctcaggctgcagacgccaggccactggcatgcggctggccacagtccgcctcctgagccgtccatccggggtttctgcccaaggttctggtttgtttgctggctcactgctttatattttcagccatgactctcctccctaattgatcttccctctgactcacgcaccagctctccatcatgcactctggtccctgcttcatctaaatccttcaagtacccgctgccatggacctcgtaggcacctaataaatgagaagcttgttgagtcagcgagcaacttgaatcacatttctgttgatttttaagaacgatctagggcagcattttccaaaatgtgcttttagctcatctatcccatgaaggagggtttccagagtcagatcaatctgggaaatgccacaatggaaaacacagtacacccgagcaatagtaagggttgcgtgatgattcgataggtaaagaggtggaatcaacctattttgtcccagatctctttaacattaggtatccaggcttttttattttatttttttcctccacgtaatatatattgtacaacaaaggccgagtgagttccgtgtgtggggtcaacatgttagctgagtgcaaaagcaacttctcctgcaaagctctggtataagaggctgtacagtgcctggaaagcagattagactccggtgagaaaaagttgtctgagaccaatgaagcccacatcatgccacagagagggcccctccatgctacgcgggaacatggcattaccatactacagtgatttacgtgaaacaaattggctctcaacacacacagccagaaagaacatctcctacgcaacccagctgagcccagtgggttttctgagtgctgggacatggtggggagaatacagggcgcctcctacgcccatagcaggatgttacagcaggggagtgaggaacagaggcgttctgcttcaaagcagcacaaactggtctgagcagcggaatgtgaggtgcatggctatgaagagcctgactgtcatgtggggttcaggaaaaggagtcttacagctctctgtaaggtgacctgggccagctccgccagaccaggcagcacagctgtggaggacacacagggtgatgttacttcctgcctttgccatttgcagtctgcaaactcattttctttctaaagggtgtgtgtgtctgtattatccttaggaaaagtgttaaaagaactttacttttattccaacaaatacatttctttcctgcagaaagaacgaacgtgcagcctggctaacacatcacctgctgcttctgcagtcctctgtgtagggaagccaggaatccaaaaccacacatagcatcaggtgacttaaacttttaggactgactcctttaggaggctcttgcccctctccttagcgaggggcctctgatagctgctggaagaaatgacaagagcctcctttcatcacccaggagttcaagtctttgtaattatctcagtgacatttagaaagcatttgcttaaagcactttataactgtactgctctttttttctttctttctttttctttgagacggagtctcgctctgtcacccaggctggagtacagtggtgtgatcttggctcactgcaacctccgcctccagggttcaagcgattctcctgcctcaggctcctgaggagccgggattacaggcgcccaccaccacacccagctaatttttgtatttttagtagacacatggttttaccatgttggtcaggctggtcttgaactcctgacctcatgatccacctgttcagcctcccaaagtgctgggattacaggcatgagccactgcgcccggccaactgtactggtcttaaatgaggttccagccaacacaggagctctaggacctacatttcaggatgaaaataagcctgaacattcatgaatttaacctgcaaagccacaaggaggagcctggatggatgatcttcacagacacaaacagtttttggatatcctcactgcctgccctgtccttgcactgtccctgggacgcagttatttcttataactaaatattccagaatttctccacaaagtatagcataaagcaggctttaaagaagcctgcttaactcttctactttatttaactcctgtatttttttcattttgaattatccccattagaatgtcagctctatgaagatagggacattttttgtcatataattgtgtattccagggccaagtactgtgtgactgatgctcagtaaatatttgttgaatgaattctgaatgagtaaatgaatcaatgaatgagtaaatgaaattatgctgaaggaataataatttagtttctgggaaaagccagggttatgttaccataaggctttcataggttaatgttgctaagagccttcccctcatacagagattgatagatggataaatagatggatagatacagatggacagatggagaggcagagactgaacctcatgggaaggagagcgtggagagatggcttggttcaggatgaatggagagtcctgagccagggcagaaaggtgctgaggagaaaatgaggagtgtggggaaacaaaatgtccctgatttcacagtgctcctgcaaaaagctttagcctcctgaaagaagtagggaggggaaaaacctgaaggaactgaagagccactctgtgaacctgagatggaaccactgctttcaggtgtgataacatccaaggcaccgctataaaagctggacacggggatgctgatcgggcccattaaggtgctcccctcccactgagatggtttgtagaagtgggtttagttccatttcagagcctatttaggaatatggcccccccaaatggtacagagggctgtaagtaaaaaattaaacctgacaatcattagtcatgtcaaatgtttacgcactcaagaagaaactctattttactccttgtttagaaattagagtctacccttagagctctgcagcctggggaagtttctctcagccctctcccaagaatcttcatgctctgaattactatttaattttccccttcctactttaaagtagaaacagcaatggtttttattggtaccttctaatgtttttataggaggcacctaaatcttccacatagatactcatcacagctataaaaggtttcatcatttttttagggtgatgctaatttttctttttctattttcacaaagaaaacacagttaagaaggttttattaatatttatagcccttcttcttctgatccgtgacaaaccgcaaaaaggtaagaatctgaccatgtccaacccataaaacccctttccctgtgatttatgggtggtcacacttcccaggcggtgagtggctctgtccagcgactgccctggctgaccccaagggagacctgagccataggttatttcctgtcagtgatgtttatagcatacttggaaatttctggaagtcaagagagaatctgggggcaatgaaagttgatgtttctgtacttcaaaggaacctgtgaaattaggagactgtgaggagggggaaaatgtggagcccgaagcccatagcctcctccttcccagcacctggcttggggtctgcaggagggaggagacctgcagcagtgtgacagtgacaatgcccggacttgctatcctcatagagacagaagtgggcagaggagaggcctgagccaggcagcgcttacctcggggctggagaagtgggggggcttgctgccctcactctcgctggagctgctctcggtctccgagtcagatccggagctgctctctgagtcgctggaggagctgctgctgccgctgctgctgctgctgctgctgcccttgctggaaggcaccgaggttctgcagttgggctgctggaccacggcgctgccagcccgcgaggcccccgggaagcagagggaaggaaagccaagtgagcaaacaggaaaacaccaccaagctgtcatgcaccctaaagagggaggaggcacgcagcctacacatctgtcaaccatgacctggaactcaaagagcaggcatcgaggtcaaagtcatcctaaaggttaaagcaactcatatacagaaataaaattgggggtgaagttggtgccccttggtagtcgggcactggttattcgtgtggccattttggaagggaaggtggtataacatccaaatggctgtttccattttgctgctgttctgggaatggcttttcaaatgcatccccaaatccaatcatctacaaaaatgcaaggaaatccaaaaagcttgaactattttgcaaagcatgaaaatgactgctttatttttgccctagaggaaaatgcagcatgatggcagggattaggcagagggctgtcaggaagggcacggcgttctgctctgagctttcatgacctgctggaaggttccagagacgaagggactgtccaagttcatgtcttgcttcctcccttttcccacctgtagttgagtgctgtagcgattacaggtgctgggatgttgttataaactgtaaccttcctttgagccctttcctagagaactgaagatccctcactgacacactttcgtatattccggactttaaaattcaatcccggtgctgtgacttataggaactgcatttcacatttatacttgatgtttatatccatgctgaaatttgccagaaagtcattacatactcaaagataacaagaaaaattgactgatgctttccgatagtaattaattaaccataaaaattcaaatagcatacatccacccagaaagtgtttgagcagaaaagaaaatttcagtactcacataatattcaacatcttcaaagtcctttattaacaaaattgaaacacaccatactgtgttcttttgaggtcaagctctaaataccaaaaatgccggtcactcttgtatgttgagtcagcaaactgcttccaactgtgaccagtgcttctataggaccgagcatcaatgaaggccaggggccagggagcttgtgggggtttacggtctcaagtgcaaagcagcctggacatggtaaaggacttgtttcacccatcccttaaatctttgatacgtgctttgcccaaagaggactttcataaatcctgggtatgggggtggggatggaggtaatactcattggagctttgtttctataaaaaccaccagacaagaaactgtcttgcaggggatctaaaaataaaagcacctcttggaacggcagggttaggggaaccagagtgtgaacataactttccctagtggggttttcatttcttccaccaatgtcacggtccacactgattgtctgacaaaattcttcagcagcagacaacatctgcacatttatgccttgcctgagctgcagcgatttcttttccagcctgttatttgtgtctagaattgagtgaggaatcctggatcttaagacagagtagggcaaggcacagttagagctcaggggctgtaatatttctttccttccttatgaacaaaaatctgtctttcctgttggctgaatcgagatggttactgtcattggaatcataaaaaaaggacgattgaattctgactgaacatgaacatctgggatccatgttaatagtctgtagaacctgacagaaacaagcaatggggaaaggattccctatttaataaacggtgctgggagaactggctagccatatgcagaagactgaaactggaccccttccttacaccatatacaaaaatcgactcaagatagattatagacttaaatttacaaactaaaactataaaacccttggaagacaacctaggcaataccattcaggacatatgaatgggcaaagatttcacgacaaagacgtcaaaagcaattgcaacaaaagcaaaaattgacaagtgacatctaattaagctaaagagcttctgcacagcaaaagaaactatcaacagagtaaacagacaacctaaagaataggagaaaatttttgcaaactatgcatttgacaaagctctaatatccagtgtttataaggaacttaaacaaatttacaagaaaaaacaatcccattaaaaagtgggaaaaggacataaacaaacacttcaaaagaagacatacatgtggccaaaaagcatatagaaaaaagctcaatatcactgctcatcagagaaatgcaaatcaaaaccacactgagataccatctcacaccagtcagactggctattacgtaaaaatccaaaaataataggtgttggcgaggttgtggagaaaaaggaacccttatacactggtagaagtgtaaattagttcaaccattgtggaagacagtgtggcgattcctcaaagacctaaagatagaaatatcactcaacccagcaatcccattactgggtatatacccaaaggaatatagatcactctatcataaagacacatgcacgcgtatgttcactgcaacactattcacaacagcaaaaacacagaattaactcaaatgcccatcgatgacagactggataaagaaaatgtggtacacatataccatgaaatacaatgcaaccatttaaaaaaaaaagattatgtcctttgcagggacatgaatggagctggaggccattatctttaccaaactaatgcaggaagagaaaaccaaatgccacgtgttctcacttataagtgggagctaaatgatgagaacacatggacactgagaagggaaccacacacactggggcctattggagggtggaggatgggaggaggcagagggtcaggaaaaataactaatgggtacaggcttaatatctgagtgatgaaataatctgtacaacaaacccccatgacacacgtttacctatggaacaaacctgcacatcctgcacaggtgccccttaacttaaaaaaatcgttttttggtagatcccaaaacactcaaaacactggggggaaacactcaaaaataaaaaagcaaaacaacacatggctcaaaagcttccttgttagaaggatggggttgggggacatagatgtggaggaaagatatgtgtttctctgtcaccctctggagtgacatctgccaaagattagcaaatgaagatgaataaagaacattctgattggtgatcaaagccattggacatcatagaaaaccaatcagtatattctatctgctttcactcaacaaaaaacatgcgatgctggttctgtgtgctctgggctttgcgtgtacagcagaggcagcaaggtgtgtgggattccttgtggcttgcaccacaaagtgactgtcttttgaaaactggcactttaatttctgggaaagcgcccattcaacagttaccatgctgcctgcctttaatggctgcggtcctgaagtgatgaggcacactagcccaaggaggcagcatctccgatctgaattacattggcagaaaaaccttatacgttaatgttttcctttcttaaattacgaaattcacttaaaatgacagttttactggcctaactattatttgtttttaaaacagctgagagagccaagagtttaggtttttcttcatactttacttgtaagggttgtgaaatttatgatgtctggattaaatatattcatgtttcaatggtcccggtagagcatgcataatatccagaaacaatcatagcaaagatgggggcagactttcctggaagggcgctggtagctccagttgtgggatcaagatcactctccccacttccacaaaggcaactcctctaacccatccttgcatggggccttggggtcagctgaccattctggcctcagtgtagtgactgctcccaccacgggtgcttgcagctgctttacccatcgtggggcagctgcagcagtgagggtggcagagccaagatgaagaagccaggaatggcattccctgcagacgagtgctagtgaaaggatggactcggctaagccacaaacacacacatatacatacgtctatagaatttgttgttgcccaggctggagtgcagtagtggtcatagctcactgcagcctcgaactcctgggctcaagcaatcatccctcctcagcctcccaagtagctggaactacaggcatgtaccaccatacccggctaatttttgtatttttttttttataaagacaggatctttctatgttgtctaggctagtcttgaactcctggcttcaagcaatccttccacctcagcctcccaaagtgctgggattacaggtatgagccactgcacccagcctaggctttatatatttaaaattgcaaactgaaaattttggtgtgccaattggttgtcatgtttacataccaaagatgctttaaaaaaattaacttaagcctgggcagcatagtgaaaccctgtctctaccaaaaaaacaaattagctgggtgtgctggcatgtgcctgtggtcccagctactcaggaggattacttgagcctgggaggtcaaggctgcagtaaaccatgattgtgccactgcaccccagtctgggtgacagcaaggccctgtaaaaaaaatatatatattatagtggattttttcctgaaatgataacacggattggttgacatgatgacataggcttggacaatttttagcatgctacctaccaagttcttggacccagtgccatctcatgaacacggtgccatttgacagcagccagaaaacattattgagatcatggaataaaagtctttgtgtcaccaaagctcagcacagtgcctggcacataataagcgttcatgtgtgattactaaatgaaaaagtaaagagaaaaaatccaacactgggttaatgagttttttttttaaaaaagagattgaatctttcgagaaggttataatgtcacttttccaattaaaaaatatttaaaagtacttcaggacgggcgcggtggctcacgtctgtaatcccagcactttgggaagccgaggcgggaggatcacgaagtcagatcaagaccatcctggctaacatggtgaaaccccgtctctactaaaaatacaaaaagttagccagacatggtggcaggcacctgtagtcccagctactcaggaggctgaggcaggagaatggtgtgaacccgggaggcggagcttgcagtgagctgagattgcgccactgcactccagcctgggcgacagagcaagactccgtctcacaaaaaaaaaaaaaaaaaaaaaaaagagtacttcagcaacctttaagacagacttcttcccttctgagaatatttctttaaatgtactcaagtttcatctgctataatttaagcacagttccctcttggatggtttgtttactttttgcattttgacttcatgaaatgtttggctggttttgtgagtggtcagagccaaatacacctttgagaggggtccagctttctctaaatgatctgcttggtgtgtttcttcctatggctgtgatgacaccttccttttggaatctggccttggctaagtctgaatgcagatcataaaagaaaagatctggaggctgggtgcagtggctcacgcctgtaatcccagcactttgggaggctgaggcaggcagatcacaaggtcaagagtttgagaccagcccggccaacatagtaaaaccccgtctctactaaaaatacaaaaaattagctgggtgtggtggtgggcgcctataatcccagcaactcgggaggctgaggcaggagaattgcttgaacctgggaggcggaggttacagtgagccgagattgtgccactgcactccagcctgggcgacagtgtgagactctgtctcaaaaaaaaaaaaaagacctggaaccaaaatgacaaaatcttggatctcacagtcaagggtgctcctgcctgccaagtgtattgtggggcctgaatacatatccaaaattgtccacacacttttaactgacaagtaacttggagagaggctctctgcctggttgttgctgtgtggacagctgtggtgcccacatcgcaccacacatgctgtgggcactccactgggattgactgaataacaatgtttgctcctcctcttcaacactctttgagaacacatgcttgatatccaaaccataatcagtgtcctggcaacagtattcctttattaatagcatcactattgatattaattcatctaaaaccataccacatggtaagtgaaaatggtaaatgcgggattgaagaggtttgctattgctaagaattgtcgtctaaaaaaaaacccaactggcaggactgttgcttctatcctgaaatgtaattgtttgttctgcaacacttccaagaatgatttctctatacaacttggcttttgaagctcttcagggtctggtctcaatcagatttccagcttcacctcaatgggtctatccctaaaccttggcaataatacatttctcagcgtctggacaggctgggtctgtttccagcagggtgcccttgcatatgatattttctgtgccagaaagtcctttctccctttttcctttgagttactgttacctcctactccctctgcaggactgagtggctatgtttccctactctgtaaaggttttcccagctcccctaggcatcaatgatgtttcctcctctgagtccctctagcacactgcccacttctctattgcagcccttaccacgttaaggattggaatcatctaatttatccatgcaatgtatttttttctgttcccttgggaatatgcaggagttcttaaaactggtaactttagaatgctatcatttacatacgtatcaggttgaaaattgagaacccacgggggccacgcaagtagcatccatgagtgaagtgttcaggtataagcaaaacaaatgtgtaacattataaatggcagtagaccctcagctccccagccgaggggaaggaaccaaactggagaatcccactaggtcgaatgctgcttctccaggctagcctatctctgtacctggaaacaagagctcattattaccaaatcttttgattttttttcacatgaagccccaaatccttatgtttatatcaaatctcctgattttaaaatgctggtaactaatttgaaaagttttaacaatgaaaagtttcattgtattttagcaatgaaacacatttggtaaagaaaacacacgtgggtaagaagaggcctgtggggcaccattctgagacctctgatctatgtcccattattacatgttttgagatggctcaatataaaatagaaaaatatagagaccacaaccagaagaagttttacccactcaggaatttagactagcagggccagggacaaacaaggggtgaaccaaacactctcacttcctcagcccacctttttttttcttaaagtgaaagcaagtttattaagaaagtaaaggaataaaagaatggctactccatagacagagcagttaccaaacaccattttgtatttttttctttatttttttaaccttaggatttgtttttttaattttttatttccataggtttttgggggggaggggaataggtggcatttggttacatgagtaagctctttagcattgatttatgagattttggtgcacccatcaccctagcagtatgtactgagcccaatttgtagtctttgatccctcactcccctcccacctttcccccaaatccccaaagtccattgtatcattcttatgcctttgcatcctcacagcttagctcccacttaggagtgagaacacacgacgcttgattttccattcctgagtcacttcacttagaataatagtctccagacccatccaggttgctgcaaatgccattaattcattcgttttcatgactgaatagtattccatggtatatatatacaccacattttctttatccacttgttgattgatggatcagtccacttatttaaaaaattctattttgaaataaatacagattcactggaagttgcaagaaaaatagtacagagatcgttcttgtgcccctcacccagttactcccaaggttaaatcttatgtaactacagtacaataccaaaaccagaaaactgacaatggcacaatatacagttccttgtaattttatcacatgtatagattgtcaggcctctgagcccaagcctgcatgtatacatctagatggcctgaggcaataaaaaactgcaaaagaagtgaaacagccagctcctgtcttaactgattgaccaaccttacaacattccatgatgacttgttcctgccctgccccaactgaccgatcgacctcgtgacattcttcttctggacaacgagttccatcatctccccaccatgcaccttgtgacccctcctctgctgagaatagataaccacctttaactgtaactttccactgcttaccagccttgttgctcacacaaagcctgttggtggtctcttcacacggacgcgcttgacatagattcatgtaaccaccaccacgattaaaatgtagaactgtcccatcaccataaagatctccctcatgacacccttttaggagcattcacgccgacctctgccctctaccattcctaatctctggtgaccactcatctgttttccgtctctaaaatgctgtcattttgagaatgttatagaaacagaatcacatagttatgtgttcttttttaaactaaattattgagatacaatttattcatagtaagtgtccttttgagatgggccttttttcagtcgacacaatgtcatgagagccatccatgatttttaatatatccatagcttgtttctttttattgccgggtaggattccatggtacagacctttaaaggttcctctgttttttaaccattcacccaatgagggacattctggctgcttccagttttggactgttaagaataaggctgatatgaatatttctgtataggtttttatgtggatgtaaacgtccatttctctgggacactgcttccgggactttcaaatttgtcttttgtcttcagaattggactctgatgagtctgggtggggatttctttgagttcaccttgtttgggatttgttagcttcttgagtctgtaggtttatgtcttttgtaaaatttggcatttttaaagccattatgagtatgaatactttctggataatttccagcctcactctttctcttgtccttctggaactctgatgacacccacgtaagatcttttcttacagtcctgcaggtccctggggctctgtccttctctaccccccagtctgtttattctctgttgttcctatcaggcaatttctcttgttccatcttcaagttcagtaattcttccctctgttctcttcattctgcggttgagctcatccattgagtttttcaaattttggttatggaatttttcagttataaaatttctatttgccttttccttgtattttctgtattattgtggtgagaccccccctactttttcagttgtctcaagcttgtttttaattgcttactgaagcattttatgatggctgctttaaaatgcttgtcagataattacaacatctgtgttggtctcagtattagcatctgtggattgtcttttctcattcaagttgagattttccaggttcttggtatgatgagtgattttctattgtattctgagcgtttttggtattataataccttgatttttaaaaattattgcttgtttttgcaggcctccactaatgcgatgttggcaggggaagggagggttgtctccctacagttgtgcaaaggtagaagtttaagctccccactcaggctttgctgatggagagggggccacagttttttttccccccacggtgtttgtctggaatagggtggttattgtctacaagtttcccacggtggctcacacctgtaatcccaacacactggggaggccgaggctggtggatcacttgaggtcaggagttcgagagcagcctggccaacatggtaaaaccccatctctactaaaaatacaaaaattagctgggtgtggtggcgcgcgcctgtaatcccagctacttggaaggctgaggcaggagaatcgcttgaacatgaaaggcagaggttgcagtgagctgaggttgcgttactgcactccagcctgggcgacagagtgagatatcatctcaaaaaaaaaaaaatttattcttgctaggatatgaatttcctgaccctttcactacagagaactggctttcctgtggcttccgtctgtgcctactgccaggttgccagcttctccagcatccactctgtgctatacaaggaaaaaaggaaacctggggaagtcaccaccatgtcttttcctcaggcccgaaggcccaagctgatttgccttctccccgcctttcagccttattatgtttgttttatatgtaacatccatggagtttagctgtacttagcaggaggaagaggaaaaagtgcattaacatcttgtcccagaacaggcaaccacccacttggtatttagcaagtagaaaggaaccctctctcaatacttccaacctccagctctagttaattatctcaaaagctgacgaatgaaacaattacaaaagtctctgctatagttcctgcccattttatcacctagtcaaattaggcattaattcattcatttaaaaactgctattatgagaattaagctcagattttacaagggtgtataccaaacctgaaaaggacatgttaccaagaatgtacacagcctcgtgagaaaaatgactcaaatgaaatgaggctgtaaaaatgttaaggatagaaagttgagtgctttaaatgttatgttcatagtgaaacattctctcagtatatctgtgaggtaatgggctttccaggattccagttagctggggacagagaaatggattggaatatctaagtgttgactttgctttttccctgggagaggatagggttttgctgatgctgggttttgctcaagattgagttagagcctcttggggcacctggaatctgagctggtgcacggcacacctgttccagctctgtgggagcacctctgcctcagtcattccgtgaccttgcctaaataagccgaggacctcatctaaactcacagggtgtaagtttgtggtctttccctgccagtgtgtgggctacaaagcagcatgatcacagttatgtaaaaatatacacacagaggaaaaaaatgctggaaggatattcaaatgttaactgtggatatttttggatggtggaattatggggattaaatggtttttgaacttttctgtattttcaaaattctcattttcttttcaccaataaaacacatgacaccattttcaagtctacgtgattgtgggaaatgactattcatgtattactgaatttagcttgctcgcattttatttaggagtttagggggttgatattcacaggggaacttaatatttacatttacatattttacattttgggggagatttttggcaggttttgtatcatgatggttttagcttaaaagtataaattggatagtgttttaccttttcatagtgttctgggaaacgttaagtaatataaaagttatctgttccttgaaagtttaaaataatttgtcaccaataaaaccatctaatctcagaaccttttagaatggcaattctttgatatctttcacaatttattatttggttattggccattaattcttttgtcaatttttgaatttttttcccaaaagatcctatttaatttatattttcaattttattaccacaaaagttatataatgttctcttataataaaagcatggtatctattatattacttctttttaaatttttcctctttcttcattatatttgccaaaagttttctattttcaaagaaacagcttttgattgatataccataataactctagtattttctggctttgctgctacattttcatgttcatttataatacttttacaaacttcttgtgttgaatgcttgtttcagctatgtttactcttccttaataatagcagcctttgcgactatcattctgcctctgagtatacccgtggttgcaggcgatcatccttgttatgttctgtttttattttccttactttctaaatagatcattgaagtagtttttaagtcttgtttgatcaaatagtcatttagaagaatgcttttcaatacctgatgacatttcagtgggataaacattacacttaggtccaaaaataaacaggatgggaatgtataatagcttagcacatgtggaaacctcagtggtcagcagcttcagcccggggcaggaaccttagagctgttttgagccgatttggaaaaggtgagaggagggacaggcagcacagctcattaactctgaaccaggagtgggatgggagtagagaatggcctggggaagggattaggccataaagaagacttatgcaccactgtgatatcccaaagggccctgaaaccttctattggccgtagggaacaataaaagtcaacagaacctgccacatttagcagaggagaaactcagtaatacaggaggtccataaacttggacataaattaagtctcacatttcactgctgatgctattgtagcatctggaactctttcagttacaaaccaaagaattcaaagatcctcctgaccagcccattaggcatttacacagacatatcagggagtgaggtgctgaggcccaacttccaatttaagaacagtgttgagacacaaggcttgatccccaatttgagataccagagagcacagatgtcaccttgtggggtcctagttacttccataaaatgtcatagatgacaataagccattagttcttaaccaggtgctggatcccgtgctctcttgcttagaggggcgctttggcttggggaatctgttctaacactcgaaacatttcttagtttggaattcctgagtttatagcatcactacctgactactgacatttgctaagaaatacaatttcttttgttcagggttcagccctgcttttggatttatcagcttttctttttcagatgggtgaagaaccttctcttgtagatgaaccaagacaaaaaagctattgcttggagctctgggtcatattgggaaccaagttttactttcagttgaataaagacccacgtgtggccccaccaaagataaaggcatttcacaaataaagaaaaaatacaataatgtacagacattcattggttcccaaatattcctgggcttactgatagtttttcagagtataatgtaataatatatttatttaatactaaaagtccatcagagaacagtttctatacagctgtcttctctggacccagggctttgaatggggcagagccctctagcctgtccttcagatggaagtgttcttggagatctgtacatgtcactgggcagcatggaaatggctgccgatctttttatgtacgaacatgaattaggctgggagtccagatggtagagggccctggaggacgccaggcttgtccgctgtaaaaggcttctctgaaagccctgtgttggcttggccaggtcccctctgcaccacacagcttggcaagaccagtttgcagctgcacttcccgcctgtcctgggcactgtttgagagactgtgacaagcggcagctgccttctggtgatacaactcgcctccccactttcaggcgggtggtaccactagagacactgagttgaaaagcccttcttggcccagagagaacctcaagcagggaattcaacatccttcttcgacaactgggatgggagctgccatgtggcctgggcccagccatgagaaagctgagaacatccacttggacaactcctcccctggcagagggagctgaaagcgtggatggagtgactgccatctggtgggcgtgtgggagccagggtgcatgggatgggaggcgctgcctctttggaggctgagatggctggctggcgggtgggatggccgtgccaggggttgggggccattgccctccagctgccaagagtgagcaggctgccccagatgagcgaataacctcagcagtgtttcatctaacctgcttgcaggacacagcttccatatgcttccaacttcctctgtgtgctctccctgccactgcagctgctggatatgggcagggaagctcctactcgatggcttttcaggcaccaggtctatggggaaatgctgggagattctgggctaccagaattgcctgatactctgagcttctttctagccctaatctcagaggttagattcccagggactgcttatagaggtgaaatcatgttgagggcacctctgtaaacccatctgcttcctacctcaatcctggaagagagaggctctactgtgaggaacacctcttttaccccaagcaatgggagcgttttaaggcaatgtaacccattagagatcctgccacccatgcacttatttgtaatagtccttccatttattcatatatattttcagttcgaggaggccttttggatagtgcggcctcaaacttccatcctcatggaaactccataatccatatggcagtaacactctaccagagctctttgactttttttttttaaaaacatctttattaagataaaatttacataccacccctttaaagtatataattcaatgtattttataatcttcataggattgtacaactatcaccatgatctaattttaaaacattttttatcctcatttatcctccttaaaagaaaacagcactttgggaggctgaggcaggtggatcacctgagatcaggagtttgagactagcctgaccaatatggtgaaaccctgtctctactaaaaatacaaaaaaattagctgggtgtggtggtgtgcacctgtagtcccagctactcgggaggctgagacaggagaatcgcttgaacccaggaggtggaggttgcagtgagccgagatcgcgccactgcactccagcctgggtgacagagtgagactgtctcaaaaaaaaagaaaagaaactgtgtacatcagcagtcaattcccattcttcccactccaagctccccttgcccccagccctaagcaagcactaatctccttcctgtagctataaatttgcctattctagacatttcatagacatggaatgatgtaagtatgtggtcttctgtgactgcttctttcacttagtgtaatgttttcaagggtcatctatactgtagcgtgtatcagcactttgctgcttttcctggttgaataatattccattgtatgaatataccacattttgcttatcctttcattagctgatggacgtcggattgtttccattttgggctactatggataatgccactatgagcattcatgtctaagttttgtgcgaacatacgttttcatttctcttgggtatatacataaaagaggaattgctgggtcctttgttaactctaagtttaatcttttgagaactgcaagactattttccaaagcagttgcaccactttgcattcccaccaggagtgcatggggttctaacttctccacatgcttgtcggcaactgttattgtccatctttttcattctgcccatcatagtgggcgtgaagtggtgtctcactgtggttttgatttggatttccccagaggaaaatgatgttgagtatcttttcatgtgcttgttagccatttgcatattttctttggagaatgtgtattcaaatcctttggccttttaaaaacttataattgagttatattaattttctatatattctggatacaagttgtttatctgatatacattgtgcaatgtatatcagtatatatctctgtctgtggtttgtgtttttacttccttgatggtatcatttgctacaacacaaacatttctaattttgcggtagttcaggtaacctgtatttttcttttgtcacttgtccttacttgacttcgcttaatagtaacagatgtttaaatatataggattctttaactgttttcaaggcattttcttttcaagtcccacctctgagcctcacaacaaaccaaaggagtagaaaagtcagctacagttatgtctacagaaggcagagcagaggggtccagtgactcactctaggttgcatatcaggttagtggaggagagaggttgaagcccagatctcgggctcctaatactaccctgtgttctctcaggagtgaaactttcccaacaagtggggataaattaccaggcttctggtcccatttggacacatcaggtcattttgccccgtgaggcaggatggtgcatagtcagacagacccaggtggacgttttactgcctctgctcgctggctatatgacctttgggaagttatttaccctctctgagccttggctacctcgttgacatttaaaggggtaacaaaagtgacaacctcatagtgttgctaggtggtttagatgagaaaatgctcataacattctttttttttttttttttttttttttttttgagacagagtcttgctctgtcacccaggctggagtacagtggcgctatcttggctcactgcaaactccgcctcctgggttcatatgattctccttcctcagcttcctgagtagctgggattacagacactcgccatcatacccagctaatttttgtatttttagtaaagacggagttttgccatgttggccaggctggtctcaaactcctgacctcaggtgatctgcctgccttggcctcccaaagtgctgggatcacaggtgtgagccaccgcacccagcctcataacattcttaacatagtgcctagcacatagcaaatgctcaattaatagttaatattattctttaatttttattaactgtaatgcttcttccaacaaagtagcctaaccagtaagaattcttccagtttacctgcattattaactcacattacccatctggtcattttgcagaattataaatgttttctcaggaaggaattgaagagatcagctagtccaactccccagaaaacggaagtggtgtgtacaagattgcacagcaagtgagttttctaacacgacctctcagaagtctcctcttttgtttccataaacctggctgcttcagtgcaaagctacagatagctctgatcgattcattcattcattcattcattcattcattcattcagagacaggggcttgctatgttggccagggttgtctagaactcctggcctcaaacagttctcccagcttggcctcccaaaatgctcggattacacgtgtgagttaccatgcccggcccagacagctctgattttgaacaaggtcaaaggaagctcccaagagagactgcaaggacccagagagatggcagtgcccagatcttagtctggaatcacatttggctcctgaaaaccctctttctaacccagtctctgtctgaacaaaccaattccatttctctcctgtgtttaaagcaaataaagtgagctctgaatgtcagcagcatgtggtgtttaatttgcatctcaccaaggaatacaagacttaaggatgatgagcgaaaaagatttttatggaaaccaaattacagcatctgagacacaggcttgtggccatatcagctcaagctgtgatcttgttagctgtcataaaccaagctgggtttgttccctgggtgaggacactcagggcaaatgtgtaaaatattactcaggtgtttctgcagggagtgctgttcatccttttcaaaggctgcaccacagagcacagctgatagactgtgtctggtgacagggaacagggaccacaattaaaatgagtgaaaacacagtaagaacatgcatgtctcgccatcagaagcccctaaggaggggcgtgcccgggattgggtaattctgaggctcaggggccttaccaaggacttgggctctgtctgtctttccttactgacacccttggcttgtctttaggtggattcgcctcactcctctgatggctgctgcgattctcacacacagatgacagtgtccagagaaagggatattactgccctgtgtcccttgctaagtagatcacccctcactggcttgaatgtcaccacacgcccatgactaagccagttccacagcaagggtaataaggcaacaaatgctagcttaggccaattaacagtcaccccttaggatggaggacgaccaacctcccctgaagaccctggccactcagagtagagtgacccaaacgggttctctgtgaggaagtgatggatgactgctgagcaggcaatcaatggtgtctccctcatgcagaaggcctgctccagtaatgggatcctgggtattccagacaaaccagattagctagacatctgccccagaccaacaggctggcttggtgggtcatcccaactgagactccgggagagaggcattgggcctaggaacctgcacaccagggctctagtcacagctgtgctgataaccccactgtgggtctcagtgacccacatgaagagatgggcttggactagatgatttctgtggtccgtcacttctaatacccttcgataaatgtatacttaattaaaaagaaaaaaacaggccaggtctggtgactcacacctgtattcccagcactttgcgaggccagggtgggaggatcacttggggccaggagttcgagaccagaatgggcaacatagtgagacccctgtttctgcaaaaccaaaaaaatttgccaggggtggtggtgcacacctgtagtcctaattactcggaggctgaggtggcaggatcacttgagccaaaggagttagaggtttcactgagctatgattgtactactgcattccagcctgagtgacacagtgaggacctgtctccaaaaacaaacaaaaatccccaaagaccctctgaaactttggatatttgtcctgtccaaatcacataatctgagctgcattgttggaggtggggcctagtgggaggtgtttgggtcacgggggaggattgctcatgaatggcttggtgccctcccccaggtaatgagtgagttctcactttattagtttatgcaagagctggctgtttataggagcctggtacctcctcctcttctccctcttcttgtcatgtgacacacctgcttccccttcaccttccaccatgagtgaaagctttctgaggcctcaccagacacagatgctggtgccatgcttccagtactgcctgcagaaccatgagccaaataaatctcttttctttataaattacctggcctcaggtattcctttacagcaatgcaaatagattaacacaccgttttttaaattactatccctagagatgcctaacccgaatttccaactagaagctgtgttaatttctattttaattctttctgttcctcccatttaggctgatgagcaatggcgaggccaagaaaagaccagagaaccctggagccagagtcacagacaattcactcctgctaatcttcagttgactataacaagctgcctggggtttcctccctaaattcgcacacagcattgctgtgtaacagctgagcaagtgacagattcctggctttgctacctctaggagtctagataattctcatcataactaagtctgctatgctgtgctgtgggtagagatttcttaacttgctgtatataaagtggcttcaagggatctgcctgcgacctcgtccacccagagcattttggatttcaggtttaggtgggtgaggatttttctgccatgaagaatggtcggtgctccttgcctgtcactgttgctctgcaaccatatgtgcctggtactgttctgagtgtggtggggacagaaggcacaaggttaatcatgtccttatagttggaggacctagaataatgtttaagagaaaacagtgtatgtcaagcgctcaatgcggccataaaattcctagtcctaattcttagttctaagacttgagaggccagggggaagaacgaggagtagagtttccaggcaggaattcttggaggaagtggggcctgaaacactgagcaggatttgctaggaaaagagagaagggggcaagctccaggcaaagcgggtggaataacaggaggctgggatttgcagggcgagttgtgtgggggaagctgaaatagacgcaggccacggggaggaaccatttatccttccttcaattttatagcatccagcaccaggcagcccttctatttagatatgtgggtgataaggaagagagctgaaaaaacagactgggattgcctggtttcctatagggtgtgaagctgaaattctatgagcaaatctatgtaatttaaataagactacaccaactaggacgtgctgagaacaatacaggaccaggggtctccagccccactttggtacagtcactgctggagtggagggaaaatgagtcgagggtgggtgcgttctcctccaaccatggcaactcattctgaatgcactgcagaggctgtgcccccagaggaccctcagggaggtggtcctgatcgaagatggctcccacgtgcagacgctgagaatgagcccaacccatgagaggcaaattaccacgaacacattttattcaagggaaggaatgtcaaagccaggcctttgtttctttaaggtttgctgaaaatagaaaggttgttttatgggcaggctgagcaaagagagagaaggcagagagggagtggtaagaaaaagaagggggaatgaaataaactagaatgtggtcaatataattttatttgctttattattcctgagtatggtgccaataagtctgagttctgcgactcccagctccaccatcacagagaatgtgagcaatctcgcttccagaaatgagctgcccactaaaaggaaaagaatcaccacatcacagaacaggccaataaaactctcagctcagcccagcctgattggatggagtcctcccagcaggttctgaatgacctgtgcatcagtgctggaggacaaggcaggcctgccgggctgcagcccattctttcattgaactcagaccatggggtcagtggatgcagagtcaggccctggctgggcatgggcacaggcaggacgactcagacatgtactggagacagtccttgccgacagggagctcccggtggaagctctggttcatgtctttgatcagaatgactctgcttcaaacaaaggtagccttgcttttttccactgcagaaaagatgagtgagagagttcccaggagacttttggtggtcgaagggagagaggacaggaggaaggtatttagtcagacttcagagcacacctggcagcacgtgcctccgttaactccaaggagcaaaatgcatttgggacctccaattttttttgttgacctctggttctttttttttttttttttttaacttataagataggcctttcctgatgccaaataagggcaatgatcagcttccccattcctggagccaggacctgccacatcatttgcagtgcaaaatgcaaatgagagccccttgttcaaagagcaagataaaagtgccatcctaggcgctcaaaatacaaaggttcctcctttcttctatggtctgtcaattggtcaaggcattttaatttgctacttaatgtcatgcttgctgggcactggaatactcatgcggtgagtgtaggatcccacgggtatctggaggctcgccctgcaatttagcatgtgcaaggagctccccacctctgccagcccaggatgggcgtgtgatgccctggctggggtgagtgaggttgagccaggtatctctgtgtctcatgggcccaaccgacacgggagagaagacaatccccatggggactgcaacctttgaactgggacacatgaggcctctgggttagggtcggggagaggctcgtccccctgcccagccacccactgcatgtgcccttgtgctgtcagcttggggcaaaacgcgggtgccatgtctgggcctgtgagccctgtcctgacctggcatgcacccatgccctcctggggtgctgggtagcagcagttactgtgtagggtggaacaggcaaggccaggtggggccagggcagcaggctggagctggcagctgagagggacccatgggagccaaggctctgagcccaggcagatgctccatcatcccattggacttcacttaaaaaacacgaattcaaagataaagttattaaggatttcaatatgccaaccacagagcattaaactaagtaagaggccatcggcgtacagggccctgggaggctgcacagttcactgctcctgcctggagccaccgggttgcttctacctttgtcttcctctaaaagaaaatgcccaagccacagctacctccaaggttctggggattgttgccttctgaaggcatccagttcctgccaatcatctacccagctacctatctgcttgaattcccctaggtgcttgctagtagaaaggtggaagaaaatttcccagactatctccaggtaaccaaggaggtgacagtttgggaagcttacagaaagctccatggagacagaattttaaataagctggagtcccatgtaattaaaataattttgaattaaaactaccacttcagtaattgcttttatattataatatttactaccattgccattgtgtaacttacctcattagctactgttggagaaaagtcagtcaatgaataattaataggatgtgataaccaagggagtaatggtgtttaaaaacagagcttgaaagaaagtgtcacccacacgcagccccattaataagagcctcgcagtccaatgccacttgcaaggaggtgaggccctggcccgttgcctcctgttattagaggtcaatagaaaaatctcctcagcctcatcacagacgtgcacataggtcaggaattctccttaatggcagcaagaaaaagcttccactttatcaaagcagacagtccttggcacaagtaactcagcaaaaatacaaattagaaatagcacccaaaggccagccaggtgctgaggctgccagccatgcttcagagaaagtggcagtctcgtgtctgccctccggagacgaaggcgggagggcagcaagtgggagctccgccagatgcctccgacctgcatacggctccaccctaccgatttccaaacaggcccagtgcttgcagcaagcaccacacacacttgacacacacaagatacagtctctcgtggaaaatctggaggaacggttgtgcacagctcctgctggaagtgagatgcttattctactgcttggaaagagaggagattcattttcaaggaagctttcttgaagggcgagatagaattttgacttaagttgcatccactgtttgtatatagatggtctttcaagatcctgacattttcttatgcaatttccaagaaagatcaaatacttttagagaatacttttttcttaacggtctttcaatcaaaatatcgtttgcgtagggttgccaggcaaaatacagggcaccccgtgaaatttgaatttcagataaacaatgaaaaatatgcaatattagggacacatttagactacagaattattcattgttcctggatttttacttgctgaatctggcaaccttaagtttgcaatctttcttatccatccaacataaagatgtgtggtgctgagcatgtctggtgctgagcacagagagggcctttcttggaggggttgtgtatggattacttaaggaagataaatgacacctggaaacagcatcaacattaaaccatgtgcaggagatttcctgcttgaaattttgcaaagtgtcttctgggttgtatgacaggatactagacgaaatgacaagcgagaggattaattataattaatcacagaaggaaagtttgagggcctgggaattcatatttcaggttgccaaagctatttaaaaagcaatgtaatacaacagttgtaatggaagaacagtcagaagataaaagtaaagcactgataaaatatcatatgagtctatttcaaagttgcaaaattcaaggttaaaatatttctctttagagcttttgaattagttgaaggggatgaaaggcaagctttatgtaaccacttttccagtgaaataaaacctgtttacatcttggtgactgaaacaccttccagctaatttagaattctcaagtggccacatgaaaagattagaatttctataaaaagaaatgtcccagttgcgttccagttcaggtatagagaacgcagttactgaagggtcttcagttcatctgagctagctgagtgccacccatcggaagctgctgcgtttggacactagaacattagaagatgttattttattcaacagaaccagcttggtagaaatgttggaatttaataaagacaagctctctttgtggtgttttactgaaagaacacagtatctgcaaacctagagtccatttcccaagctcacgtttgttgttgccagttttatttttacactacagaaaaggtagaaaattcctttggaaagtctgcctccctcccttccttccttccttccctcctctctctttccttccttccttcctctttcctcccttccttcctccctcccttcttcctcccttcccttccctcccctccctttctctctcctccctccctctccttcccttccccttccttccttcctccctccctccctctccttctcttccccttccttcccttccctttccccttcctcttccttccttcctccctcccttctcccttctccctcccctcccctcccctctcctttcctttctttcacctttaaggtcaggggtacatgtgcaggtttgttatacaggtaaacttatgtcaccgggtttgatgtgcagattattttgtcacccaggtgttaagcctgttatccattagttattgtttctgactatctccctcctcccagcctccatcaactgacaggccccagtgtctgttgttctcctctatgtgtccatgtgttttcatcgtttagctttcacttgtaagtgagaacatactgtagttagtttcctttcctgtgttcgtttgctaaggataatggattcctgctacatccatgttcctgcaaggaacatgatttgttcttttttatggccgcatagtagcatagtattccatggtgtgtatgtaccatattttctttatccagtccaccactgctgggcatctgggttgattccatgtctctgctattgtgaatagtgctgcaatgaatatatgcatacatgtgtcttataatatgatttatattcctttgggtatatatccagtaatggaattgctgggttgaacagttctgtttttaggtcttcgaggaatcaccagtgttttccacaatggctgaaataaaatttacattcccaccaacagtgtataacgttcctttttctccacaacctcgctaacatctgtttttttttgacttttaaataatagccattctgattggtgtgagatggtatctcagtgtcgttttgatttgcatttctctaatgatcagtgatgttgagctttttttcatatgcttgttggccgcatgtatgtcttcttttgtaaagtgtctgaccatgtcctttgcctactttttaatagggttgtttttttcttgtaaatttgtttaagttccttagaaatgctggatattagagctttgtcagatgcatagtttgcaaaaatgttctcccattatgaaggttgtctgtttactctgttgatggtttcttttgctgtgcagaagctctttagtttaattggatcccatgtgtcaatttttgcttttattgcaattgcttttggcatctttgtcatgaaatctttgcccattcatatgaccagaatattgcctacgttgtcttccagggtttttatagttttggggttttatacttaagtctttaatctatctcgagttgatttttgtaaatggtataaggaaggggtccaatttcaatcttctgcatatggctacccagttttcccagcattatttattaaatagggaatcctttccccattgcttcttttgtcaaagatcagatggttataggtgtatggccttttttctgggctctctattctgttccattggtctatgtgtctgtttttgtaccagtacccatgttgttttggttaccatagccctgtagtatagtttgaagttgggtagtacgatgcctccagctttttgttctttttgcttaggattgccttggctactagggctcttttttggtttcatatgaactttaaaatagtttatttctaattctttgaagaatgtcaatggtagtttaatgggaataacactgaatctgtaaatttctttgggcagtatggccattttcatgacattgattcttcctatccaaaagcataaaatgtttattcatttgtgtcctctctgatttccttgggcagtggtttgtagttctctttgaagaggtccttcacttcccttgttagctgtattcctaggcattttattctttttgtgacaattgtgaatgggagttcatgatttggctctctgcttgcctattgttggtgtataggaatactagtgatttttgcatgttgattttatatcctgagactttgctgaagttgctcatcagcttaagaagcttttgaactgagacaatgggggttttctagatacaggatcgtgtcatctgcaaacaaagataatttgacttcctctcttcctatttgaataccctttctttctttttttttttcttttttcttgagatggagtctcgctctgtcacccatgctggagtgcactggcgtgatcttggctcactgcaactgccacttcctgggttccagagattctcctgcctcagcctcctgagtagctgggattacaggcacgtgccaccatgcttgactgatttttttttttttttgagacagagtcttgttctgttgcctaggctggagtgcaatggcacaatcttggctcgctgcaacctctgcctcccgtgttcaagcgattctcctgcctcagcctcctgactagctgggattacaggcgcgtgccaccatgcccagttaatttttgttatttttagtagagacggggtttcaccatgttggccaggctggtctcaaactcctgacctcaggtgatctacctgcctcagcctcccaaagtgctgggactacaggtgtgagctaccgtgctcagcctaatttttgtatttttagtagagatggggtttcaccatgttggccaggctggtctcaaactcttgacctcaagtgatccacctgcctcggcctcccaaagtgctgggattacaagtgtgagccactgcacccgggccctttatttctcttgcctgactgctctggccagaacttccagtactttgttgaatatgactgccttttgatcagttttgacccagtactgctctcactaggttaatcagccatttcagttaaggcttggccctgagtgacttttgtcagtgaagtctcaggatacaaactcgacatacaaaaatcactagcattcctatataccaacaatagctgagccgagagccacatcaggaatgcaatctcattcacaattgtcacagaagaacaaaatacctaggaatatagctaaccagggaggtgaaggacctctacaatgagaactacaaaacactgctcaaagcaatcagagatgatgcaattcctctgtagacccgattacatagaccctccgactgtactgagtgcagctttccttttttagaacaggcaggtaggatggtgtctcagtcggtttgggctggctataacaaaataccatagactgggaggtttaaacaacagacatttatttctcacaattctgaaatcttcaaatccaagatcaaggtgccagtggatttggtcccatggggaggctcctcgtcccggtgtgcggatggccatcttcttgctgtgtgctcacatgacctctcctttgtgagtggtctggtccctcttattcttcttataagggctctgatcccatgatgggatcctacccttatgacctcacctaaatctaatcacccccaccaaaggccccacctcctaatactatcacattggggattagggcttcattgtgtgaattttaagagaacgtgaacatttagttcataacaggtgctgagatagataagctagtgacaagtaccatgtttcactatagacccccttctgagggctgcctatgggggcaagtgtccccacacctcagaaacactaacatcatggaagggtgagctcaggaagacccacatttcttttacgagctttgccttttctaaggttttagcatcaagacttccaggagatgctcttcatcggaaagctcatggccagaggcaaagataacactggaagcatgatgaggatgcgctgcatgaagcttgcaaagggggaggttaacacggaaatgttaaatactaaccacagtgatggcagtggtgttagaaaacatcagtctacaatagctactgaacacctgtctcagaattaaagacatgactaggatacagtctttactgcttcctcaataaatttacaacaaaaatagagattaggccagagtgggaaggattacagtcccagggagaatcaacaggcatgctttcacatggttggggtacagcaaaggggcccctgccttggtggaaagagaggggccaggtatattagttcattttcacagtgctataaagaaactacctgagagtgagtaatttataaagaaacaaatttaattgactcacagttccacatggctggggaggcctcaggacacttacaatcatggcggaaggtgaaggggaagcaaggcacgtcttacatggtggcaggagagagacagagagtgagcaaagagaaagtgccacccttttaaaaccatcaccttgagtgagaactcactcacaagaacagcatgggggaaaccactcccataatccaatcacctcccaccaggtccctctcttgacatgtggggatgacaattccagatgagatttgggtggtgacacagagccaaaccatatcaccaggcgtgttctgggctcaccttgtagaagaagtgacgtagcagagaacacagggtttcaatggtcagtggagctgagacagaggagggcatttcagaaggaagcagctaccagctaaggctgaagacagggaaacactgtgagctgctgcagggaggcaggcagagcagaacacggagtggggctcaggcagggcctggctcctgggagtgcctggacgtgtgatccttcccctcggccgccaaagtcccaggactagcactctagaaatgcatgtgctcttctttcccaaagaaccccagccccaggtcaatgaaatggttaagctggacttctctccacaggtggcctgattcttgtgtgaactgccacctgtcatgacacccaatccagacaatgtcctttaaatttgtccccatctgcctatcaagagattacccatagtaaaatacatacaatataaaaataaccattttaaccaattttaagtgttcagttcagtagtgttaaagtacattcacactgctgtacaaccatcaccaacacccatctccagaacccttttcattttcccaaactgaaactcaataccccttaaatggcaactcccatcttccatcaccccaagccctggcaacaaccattctacctcctgtctctatgaactggactactccagatactgcatataagtggaatcatacaatatctgtccttttgtgaccatcttctatcatttagcaaaatgtcctcaagattcatccgtgttgcagcattgtggtagaatctccttcttttgtaatgctgaatgatattccagtgtacagatatgccagttttgtttatccagtcatctgctgatggacactaggattgcttctaccttttggctattgtgaataatgctgctgtggacagggtgtccagacatctgttcaagtctctgctttcaattcttttgggtaataaccaaaagtggaattgcttgatgatgtggtaattttatttttaatcttttgaggaactgccatactgttttccacggtgtctgcaccattttagttcccataaaaaatgcataaggttccaatttatccacaaccttgccaacacttttttttttttttttttttttttttagatagagtctcgctttgtcacccaggctggagtgcaatggcgtgatctcagctcactgcagcctccacctcccgggttcaagcaattctcccgccttagcctcccgagtagctgggattacaggcacccaccatcatgccaggctaatttctgtatttttgtagagaaggggtttcaccgtgttggccaggctggtcttgaactcctggcctcaggtgatctgcccgcttcggcctcccacagtgctgggattacagaagtgagccactgcacctggcctcaacactttttaattcttattttaagtagccgtcctaatgggtgtgataaggggtactgagtttcagtttgagaaaatacgatatctcactgtggtttaaaccaggacacttttaagagtgaaggaggcaccacctgtaattatacagaggcatgggcgcaagctggggtgacggcagctatggtccgtccagggcatcacacggggagtggtgccactggggccttctgagctccccggggctggggtttggaagaccagagcgccaggcttcgttggagagcagaatagccttcttaggggcccagctcctacctatcatctacccagctgcctgtctacctgaattcccctagttgctcactgaaagatagaagaaaatttcccagactatctccaggtaatcaaggtggagacagttttagaagctcaaggaggctcctgtggaaacaggattttaaattagttgaagtctcacgtaattaaaatgattttgattgtaatggtcacttcagtaattccttgtctatgaaaatatttaccagcattactattgtacaccttatcacatcagtcaccatttgaaagaagtcaccagccaccctaaccatggaggtgaagagttgagagtgaaggaggaaacggagtgtttgactttatcctttatcactcgtcaaggccaatggcgaatcatgtcgctttttgtttttttagtgcgactgtactacctagagacacgggctatttggaatcagctttttgttttacacgcctctttccccaaaatcatctgctaaggcttgacaacagtgctgagaggcggacgggtgactattactctctccacttgacagatgggaaaaaagactcagagaaataaagtcagtcagtcaatagtcaggggtacatcaggcaccgtacacgtgccgagatttgacaggcacaagctggggtttgctgtccatggaaggcaggaaatgaggtgtctcagcacagcagtgatgagggtcaccaaaaggcaagcagatggtgctgtgtggacgatggcaatgcatggagggcctgctgggggatagggtgtttaagctgtagcctaacgtatgggtagaaggtggccaggtaagctggaggggaggaaagaaaaggagccaggaaaggaaaacagctccagggagaaggtccagcatgtgtgctatagtttgaatatggtttttctgtcccccaacaaaaccagcattggagtttgagcctcactgtgtggttttgggcctggtgggaggtgtttgggtcatggctgtggtggatccctcatgaaaggctcggtgccgtcctcccagaagggagtgagttctcatcctggcaagatgggattagctctcatggaatggattagtccatgagggtgggttcttacaaagcgagtggttccccacttcctggcccctctttgcacctgcccacttctcctctgaccttctctaccatgtttggatgcagcacagaagccctcaccagaagccaagctgatgtcagtgccccacttcctgtacagcctgcagaactgtgagccaaataaacctcttttcttccttcctttttttttttttttttttttttgagatggagtctcgctctgtcacccaggctggagtgcagtggcatgatctcagctcgctgcctcctccgcctcctgggttcaagtgattctcctgcctcaacctcccgagtagctgggattacaggcatgtgccaccatgcccagctaatttttgtatttttagtagagacagggtttcaccatgttggccaggctagcttctgacctcaggtgatccacctgcttcggccttccaaagtgctgggattacaggcgtgagccactgtcccaggccacatcttttctttctaaatcacccagtctcaggtatccctttatagcaagagaaaacagacaagacaatgtgcatgcacaggtgagggagaatgaaacctctgtgactgtctgtagtcacatgaggctatggcagagctaagctgtggcttggcagagccaaggcttgaaggggacccaggaaatcactggtgagcccttccgattattcagggaatctgcatggtctccacagccctggagtttcacttcctcattgaggcaagggagttagatgactgaaggccggtgcccagagaaacaatatatgggcagggttcacattttaaaaacccatggcatacaaagttggtgtagagaagggagcaaaatttgtccttcattttcaaatgctagtgaataggtaatagttctccagtcagctggaatgaaggggaaaagcttcaagaaatatgtcttaggaaataacgttggcttggcactcccctccttcattatatgtctaaacacaaccattgcacttttcaagttttttttttttgtcatcttctatatttaagtgcagaacacagaaggatggttgaagtccccagatccacttccttggatagaacagaactagacgaggtgtgttcttgcaagcagcccccagcagaatccagccatctgggcaggagaacagagcagcccctggccccatgtgcagtgctcagacttgtgctgtgagcacgacttgaggcagagctggattctgtcatacacacacacacacacacacacacacacacacacacacatatggttgctgtatatcatgtatatgatatatatctctatgtacgtgatatatacacaacatatctatgaatatgatatatacacatatctctatgtatatgatatatacacatatctctaggtatatgatatatacacatatctctaggtatatgatatatacacatatctctatatatgatatatacacatctctatgtatatgatatatacacatatctatgtatatgatatatatacgtatcacatctatgtatatgatatatatcatatatacatatcatacatatacacatatcatatatgtatatgacacagggtcttgctgcatcactcaggctggagtgcagtagcacaatcatggatcactgtaacctctgcctcctgggctcaagcaatctttccacttcagcctcccaagtagctgagactacaggtgtgtgccaccatgctaatttgtgtgtgtgtgtgtgtttctgcagagatgaggtcttgccatggcacccaggctggtctcaaactcctagactcaagcgatcctcccaccttggccttccaaagtacagggattacaggtgtgagctaccacatctggccaattttgttctatttcaagggcactcaggttgatggaagagggatctctcaggcatctagctccatctgccaggccctccctgctgaaggccacaatgccacccctaaacctggctctaccccctactgtgttcattaaccttgggcaagtggctccatctctctaggcttcagtttccccacatgtaaaataaggatactgacatttgtcccctgggctgtctggggatgaaatgggatgatggcagcaagtccccagcacagggcctggggcagcaagcatgcaaccctgagagactacgaggtcacatacgccccccacatctgccaggaccacatgcctttgccagagaggggcaggttatcatctggcttggtgggaaccttccaacaacagcgaaggccatgaccacagtccttctgtaattccattaaatagtttagtggctggggccatgattcaaagagaacctggacctccttcacgtagtccctcagatgactacaccttaatttgctgtgcttgcattgggtccatggttatttttcttggcttcttagcaccagcattagccaggctgaataggggtttctgtctccaaagtaagatgaggaactgtggcctaatgtggctccctgactcactggctgggaacagggtgaacagggccacagggaggccatgtggggagctgccagggcttcagactcttggcctgggctgggcttcatcgaggccctgtccagtcggctggattggggccagtgagcaggcttactttgtctgtgaaatagaaaaaggggccatggactcacccttcacaagcagttggttcacttcaacattttaatggaaccgacctgaaattaatgagcactgtcacactgagtaaatactgcctctcgggatgagagcggcaatgggtagaaggcagtgtgacaattcaaacccaaggccacggacaattacatagaggaagtctgttcagaatttggcggatcgaatggctgtccccaaataacaggcatgcagatggctggagtctgatgctgcctggcgagggcagaggcagatgctgcattctgagggccagcaagaggacacgacgtggcagtgggccagccagccacagccgggagccagcacaggaaagggagttggacggagtcagaaggtcaggccgccccagtgaacagggagcacattaacctttccaaagccacgggggagcttatcaggctccaaaatgcagtcatcaaaggccagccagcccagtgcagccaaggctggcccggggctacctctgggagcaggtcacggggcggcagcctgtgagcggaggtgagggcaggccctgtgcccagagtgagcagctgcagggtggtgtgctccagctggctctgggagtcccaggctggagagtggaatggtcagggtgggactgttccaggggtgggaaaaggggggaaatggagaggacgggagtgggtagagggtgctggcctgaagggctcttaaagccagagagaacagactccatgggctttggccagttttctttactaaaaggagatgaaaaacagaacaaaacaaaacagatttgatatcatgactttaactcccatgaaaagtagttaagtagtttggttttaaacaaagcaaaacaaagcaaaacacctcagtctatctattggctttaaaaccacccactcatcacagatgcttttgcggcacggcctccgcccactgcaggcacaggcatgagtgatgaagacagtggcacctgtgttcagaaacacatacgggcactgaaatgcatcttttttgaatctttttttctccctgtcacatatatcatttgttgcgtttggattgcttttgaggtcagatctggctcaatgagaatggggacgacatatgcaaaattaaaaaggggggactaccaggtgtaccttcacatggcatcagtgtaaacattctaacagaaccgaccaccaattaaccaatcaccaaccaacacattccatgcagacagcaagtgcttaatttaatctaagtacattcaagaaggaacaggtgtacttctacttcagaaatagatattttaaaaaaagaagtagggtagacagcagtgacaaacactgaaaactatgctaattaagtcttctctctcttaattccaactatgagacgtcatgcgtattggatacttaaaatttttttggatgtaaatttaaatataagttaaatgaaccattatgcattagatacacagtgttatgttgtccttggtctagaagggacagctacattggcattcaaaaggagtgtgacatagtgacaaagactcaagtaaaaataatttatagcttagtgatttcaatattttacccctggtaacttaatatacttagtctgaggatgagttcagaagagaggtagcacaaagtgggatgacaacgggccagaaccagtatttttttttttttgagatggagtcttgctctgttgcctaggctgtagtgcagtggcatgctcttggctcactgcaacctccgtcttccaggttcaagtaattcaactacctcagcctcctgcaggtgcacaccaccacacccgactaatttttgtatttttagtagagatgaagttttaccatgttggccaggctggtctcaaactcctgacctcaggtgatatgcccacctcgacctcccaaagtgctgggattacaggcatgagccactggccagaaccagttgtcttttcactgcctctagggacagtctggttccctttggccctttcctgtgttcgcagactgcagcgaggctgggggactccggtggtgggggtgggggactctggtggtgcgggttagtttttctcgtctgtggtcacagacacctggctaaggagcaggggaggggtggtgggtggggctgtgcccagctgtccccccgcccacagaggatctaagtaacttgcaggaagtcttctccactagcagagaaggaaaggacgcatgtccaggctaaaactccagcacctcaaacccaggaaagagaacatgggattcccagcccaggcctatgagaaagggggcatctggaagaacctgggaaactggcatctgcaggatgtttgctcttaccccccaccgcctgtttttcctgtttttaattctggaaacatacacataacatcaaattggccaagggtgtccagttaggtggcattaagtacatgtatgttgttgtgcagcctagaccactatcattctttctgaaagagatcaaaactcttctaactgtgccccagatcaagtcaccccatgtgtttctgcaggctcgtgggaattgtgaacattgacttgaatgggttaaaactgaatttcacccggaggagccttgggctgtggcctccttaccagacatcaggcagcgagtctgtattagtcctcaggaatccctggccactaaaccatcttaaagggcaattagtggctttatacaactcgttatttatttactcaaaagactgtatcctcagcctgctctcttcttctattgtgtaaaatacatatttgggaccttttaaaatgtgtgttatgtacctgatagaactcaatggcttctctggagccattctgttttattgtggaaattagtactaggggggcttttaaaagctgatttttagacccgacagcctgcgtttgttcacgttaatgcagtggattgagctaacagccaccaaagggctgtgagggacacctctgtggcctctctgttggagcagtgaggccaaggggctccacttttgtgactatagatggtacttgctgggcctgttagagaggagaggactgcatggagactcagttggcacttatctctcttcacactgcccccgacagttctctgccagggctcccccacgttattgaacattactgtttgcttttgaaataataagtattatttactttgaaattataaaatgagaccaattctttggagattagctggaaaggtgtcaggatatgacccagggtgacttttttatgtatttatttttttaattaatttttttttttttttgagacagaatctcactctcacccaggttggagtgcaatggagtgcaatctcggctcactgcaacctctgtttcctgggttcaagtgattctcctgcctcagcctctcgagtagctgtgattacaagggtgtgccaccgcacccagctaatttttgtattttttttttagtagaggtagggtttcaccatgttggccaggctggtcttgaactcctggcctcgagtgaggggaatcctaaagtgctgggattacaggcgttagccactgcacccggcccaggatgacttttttccgtgagtaaagtaaaaagacaatgtggcagaaacaggtggtagcctcctcggaggcatgcaggagcctcacctgggacccaaagacccacagtttggcttttaggagaaaacaggctctagtaaaacatatttcaaaatagggatggcgtgagtaatagaagggatatttcttaggatttgttgatacttgtttttctataatatcaatgtaaaaacatgccccatactactagttatgaattgcttcagacattaaacccatactctgttatcttcttctcttggtttttaagcctcttggtaggacttaaatcaaagaacatcttatgatacctcatgcgtgatttttcttggtggtgcgatgaggtaattactatcatatggagggagaaaggaagcgcctcttctattcatcacctcttttaatctgtacataaacctaacaaggagggcattagtagcatcctgcttctgcaactgggaaagctgagacttggatgtgtaaatgctttgcccaaagtaaattccagaccaagttcaaggactcaaagtcctgtgcttgcttcacgatgtcttgtaaaaagaggagagagtagggaaagctgggccagagggtttttttttttcttttgctttcttgtctccttaatcatgacagcataaatgagtggcataatttgtattcttggtcttactgcattcaataagtcatgattgagcagtcattttgtataaagtactactaatagtcaagatgtggttcttgctctcagtagttaagaccagacataaataaaggaggcagagactgtaagctgggcctatgccaggaattacatgaggtgctgatggaataggagctgtgggcgctggggcagttggctatttaaggtttccgtagaagatgaggcttgaccccatgcttgagggatgcactgcgtaaccgaagatccctcccatgagttcttgcactggcagctgtctagagctggcttcagacactttctactcagatgcccacagccacagaggggaggcctgccactccctgtccaccctgcagcctggccctgcccaggccattccttctgtgttctcctcccttctccactcctgggtcacccgatgcttcctgtcctccacatgacacctcatatgtgtcctcccccttctccttcccctgtcagagagtagggtaatattgtacctgtgtccctccagtgacactgatttcttcatagtctgatgcagagggctgctactgaagtagctaagagcaccaactctggagctgcacagaccactctgtggctttccagactgggggtgaattacctgagtttggaaagcaagactcactaggattttagggagagtactttagaagatgaaatgaggccaggtgtggtggctcacgcctgtaatttcagcactttgggaggctggggtgggtggatcacctgaggtcaggagttggagaccagcctggccaacatggtgaaaccccatctctactaaaaatagaaaaatcagctgggtgtggaggtttatgcctataattccagatacttgggaggctgaggcatgagaatcatttgaacccaggaggtggaggttgcagtgaactgagatcataccactgtactccagcctgggcaacagagcaagactctgtctcaaaacaaaaacaaaaaagaacacgaaatgaaatgaaatggagtttcatggaaaatatctctttaaggccctcacattgcattcttccttcctcaccaagagagtcgtcgcgaggactaaatgaagtaaggtatgtgagatgctcagtacactaccggacctgcgactgttctaaggagatctatgactacttatgtgtatgccagcgttgtggtatactcagtatttatgcacaagcctacatgtcctctaccacactgtagattccctgcgagtggaatccttgggtaatgaatttttgtgtcttctatagagaccagcagaatccctaacattttagggattcagtactgtaaatattcactgaatgaatgaagaagtacaaatgcaaaacataagtatgaatagttggtgaagacagcacactttaagtcatgtcaacggtacgaagcacaaaaatgagggggcaggagagggagggaggagccagaggctatctggcccaatccccactcgctacaagagacttctcgatagcatcatatagttctcttttgttattgagttctaatctaattccactctaatttaattatactgagtggttttgatctttttttttttttgagactttcttgcctacttttggactgagtttttttctcatttttccatttcttccccctgtgtgtttggattctataacatccatacaagcaggcatgaacacctctttgagccactaagcgatgagcccctcatcatctacctgtgattcctgaggcatctgttgcaaggatggatagccacagttgcaaagaattatttcctcttttaagcccaaagttgccattattttaaccacaaagcattggtctagctcatccattcatttatcaaatgacttacggtgtctgctaattgccaggtactgtgctaggtgctagagataaaaaggttaccaagccagaaatattgttacgatgcaaaacgtggcccaaacctcctatctccgaccccagccaagctgctctattggtgcttgatgggaggcaagagaatcatactgaccaggagtccagggacctgggatctagtcctggctctgccacttgtggccctgggtgagttgcatcacctgttcgcggctcagttttctcatctgtaaaatgggccccatctatctttcagggttgttgtgaggatcataaaatgagacagtaaatgtgatagtgattctaaactctaaagctctcaaagtttttattcacaacttaattgtacatttaaaaataactaaaagagtataacacaagggataaatgcttgaggtaatggattttttaaaagttttttattcatatggcatacttaaaagattttttttttttttttttttttgagacagagtctcgctctgtcatccaggctggagtgcaatggtgtgatctcggctcactgcaacccccgcctcctgggttcaagcgattctcctgcctcagcctcctgagtagctgggattacaggtgcacgccaccacgcccagctaatttttgaatttttagtaaagatgggatttcaccatattgatcatgctggtcttgaactcctgaccttgtgatccgcccgccttggcctcccaaagtgctgggattacaggcatgagctaccgagcccagccctaaaagacttctttataaggagccatattgctttggggagaccgaaggctgctgagggcctcagggcagggttgatatgcacctgccagcacgccaccataacatcttcatggaaccttaacactttcttaaaagtgctccacctccttttttttgacccttaaagaagagaccaactattagtactgtgtggcaactgtgcctgtcctctcacatggccaggggactgggtgacacattacccagaaaggtacacttctgtgctggtggccactccaacacacttcctttgtttggctggagctcgtccacttgacaaggggtcaggaagatgaagctgaatccaaccccctacactgccaggtgggtacccgctgccctccccaccttgctatggaccatttctgatctggcttctggacacagaccatttcacattcttctacctacatggaggtgaaactcccttagttttaggcaattcctcatttacttaatttcattatatactccctaatgggcaacaaggagattggatgtgtgagatttatttgagaaagggcaaaactgagggcagcaaatgtgtaagccttgtgagtcctttctccttgcaaaggcaacactcgtctggctggtgaagccaagagcacagccacacggctgtttctcatcctggcacccccagccccagcacagcaccccacagagcatgctggatgcgttcagtaaatatttgtgaaataaatgaataaatcaatggcagttgtttggatttcaatataaatggatcttgggcctgagatactgccagatgggcagacaggttacagtctggtgatgcatctccaaggctataaaaatgtagccgttgctggagtcgcaggctgacatttcagatgattatatgcacaatttaaccacatggctatctgtgccctccaagtgccatcgcttcaacaactgttttcatgttggcttttttgctcgttcctctctctttttttttaagtcaagcataattttttgcagcctctcgtatttctagctgaacgtgatttattcatataaaattatgttccatttttataaaacccaagttactgcaaatgatgcttgaggtttcacagaaaatattaattcctgatctgctgctataaagcatgcctgctcgctgagagcagcgctgtcactctgagacagatggaagcagtccaagggtatgattaacttcttagtcctggcaattgcctagtgctcctcttgccctagatttcaagattgacctccagcttctctgcagacgcgcagttgctcagcttgataaatcacatgaatcccttttttgatcagagttatctactatttactactcatgaagggaagttaatcgtattcaaggcacttcatatgctgcacacatatccttccttcttcctaacggcactttgcatattttccacattggcggtgatgtggcttctttcgcagtgcagagggtccacaccaaagatccacctttatcctgtttgtccttcttctttgtctctactaaccagcatcaaatacaccgacccacaagaagaaaaaacacgagaggcacacaataagcagtgaataagtgagacgaattctgtccctttgcaaactgagattttcttgtaattggcttctttactttgtcaagaactttgctgggccgagtgtggtggctaacacctgtaatcccagcactttgggaggccaaggcaggcagatcacttgagcccaggagttcgagacctgcctgggcaacatggtgaagccccccctctacgaaaagtccaaagattagccaggcatggtggctaccatggcactgggcagggcacggggagagctgagatggcttgagcctgggaggtcgaggctgcagtgagctgtgatcacaccactgcactccagcctgggtgacagagtgagaccctgtctcaaaaaacaaacaaacaaacaaaaccagaaaagaaaaaagaattttgccatctcttcttgccctgtttgtctgcttttttcatttctgggggacataaatgggcctctggtaggccagttgactctcagtggtataaaatagataaaaaaattctactgtccagagtagaaaagaacagacaacacaccatcccactctcacacaccccttcttgtcactgctgggcgggaggcgcaagtgagtggggctgaagcccaaactccccttctgcttgccatggtgatccagtttcaacctgaagcacattttgcctatttggggtgaaccataaattaagtccattggtcaggcaaaaccaagcaagggaaaaggttttttggggatgatcacagttgatttttaaaatttatgtaacggaaatatcacagttttaatttatcaagatgttatattgattacagaagattctctgaactttaaagcatacagtctaaactgtcagatattggatttgtgctgaaatgccaatttagaaaataaatcaggcgactggagaaatggaaagacaagactgactttccaaagacatctggacattctctaacctccaacaacccagagggatgagacttctacccactccttaggaagggaaagggaaacacacccctttctttttcttataactggtctcatcaggtcagatctcaaggctttgaagttgggcttccttatagggaaacagataacaaaaactggcttcctacagtgtaaactcatgtccttccaccaaccccaagtcaatgaaatcctgtttcatcatcgatttgtgtatcttggaacaaaatagctccggccttgtctaaatgtccttgtgttcactggacactcaaggttgaggctcagtggaagtgaaatgagcccatggatgagcaaacttataggacactgaggttctgaaggaggataagacccagagtgtgtcacagacatgctcctccatgaggaaccagtgtgcatggccagagccagtacgggcttttctgtcctgtcccagaattatagaactcaggaagcaccttttgaggtctgaaaagtgcttctcccccaagaacaaagatgaaggcatgagctaatcattatgaaattttatataaagaggtgataacaggctgaaagcaaaaggtttagggaaccaggatggtttgtgtaaatgaatgtataataggttaataccaggctccaagtagccagagatattgggcctagaaccccactttgggatattcaggacctggggagatctttactcaattcctttcccaccctgaggttcctctggcagccagaacattaggcaagtcatacagtggtctgacttgaggcactcgggtcatttttctagaaaatattggtttattcaaaagaataagtaatgtgagagaaaatgacatctgtcacttgataagttattctctacttaaaaactagaaaatatgaatgcaattaattcagcaagtgttttaaaatcattattttgaagaagggttttaatttccatcttgaaatggttacaaatgcttatcacttatggggattacgtctgtggccctgaattagtagagaatagacaatagaaaaagaatggctgttattgaaaagtcaaaaaacaacagatgctggagagcctgtggagaaaaacgaatgcttgtacactgttggtgggagtgtaaattagttcagtcattgtggaagacattgtggtgattcttcaaagacctagaggcagaaataccatttgatccagcaatcccattaatgggtatatacccaaatgaatataaatcattctattataaagacacatgcacgtgtacgttcactgcagcactgttcacagtagcaaagacatggaatcaacccaaatgcccattaacgatagactgggtaaagaaaatatggtacacatatgccatgaaatactatacagccataaaaaggaacaagatcacgtcctttgcagagacatggatggagccattatcctcagcaaactaatgcaggagcagaaaaacaaacaccacatgttttcacttgttaagtgggagctgaatgatgagacccatgacggggaaacacacactgggtcctgccggtgaggtgtcaggggagggataacatcaagaagaacagctaatagatgctgggcttaatacctaggtgatgggttgatgggtgcagcaaatcaccattgcacatgtttacccatgtaacaaacctgcatatcctgcacatgtgcccctgaacttaaaatacaagttgaagaaaaaaaaagaaagaaagaaaaaagaaaacacacagagaaggtagctttacacaactgcactgctagaatagcaaagtcagctcgtcactttgaaatgaccaattctgaatagaaaaagtgctacagtaaagtaagggaaatgccctattacatttgaggataaagaaatttgtaagaagagtggtgacaatgaaaacctctgtttttgggtggggaatgggcttgacaagggattttttgtgaaaatatcagaaaaaaaggaaatggcattgttcatcattaacatccatggacattttctctttaggacaaagttgtatatgttttgggaagaaatcttcgaatgtatcagtcctagtttctgatgaattgtctttgtatttgtgaccatgtcttcaaaataaatccttattttcctaaaataggttttgattcattctactaaaggtcataatgaccttttttttcctgtatttatatgtgtagctttactaaaatataatttacattccaaaaagttcacccatttaaagcatacaattcagtggtctggtatacttacaaggttgtgcaaccatcaccataatctatttttacaacatcatcatctccaaaagaaatcttgtactcattaacaatgaccaagtttcccttgcgtctcagtgcattttgttgaaggaactgcttacttaagaagaaaagtcaaagacagaaaagaaatatgtataggaaagaaatgactatgttatattctacatgtgttttgatctagactctttcctcctcctactgacacattcagaagcagagcagtcatcagcttttgtgaaaatcccaaaagcaattccagaagatcatgtgccagccactcaggacacgcaggcttgtgtggttgtcatggggaaggttttgtaattgaaataaaaatactcatgctcagtctgccaccacacagaaaatgcttttcactcatgcacaccagataattcgcctaagtgacaggttttactttggaggaagcaccgagctaagctggtttacacagtcaatgatggctcattccatgaaaaaggaactgggaaggaaggcagggtggtgaaggttagctagacaatgtggaggtggctgccagccagtcagccaagggcacagctcctcctgctgcttctaatgctgtggagacacacagggatttcatctttacctcctgacagttcctcaaaacacgcgcgcacacacacacacacacacacacacacacacactctctctctctctctctctccaatcttagtaagtgaaaaaacaaaaaccaaaaccaaccaaaccaaaccaagggtctggtctattctagaaagtgactttacatacccacattcaactatctgtctacagcctttcagacaaagcaggatataaaatacagcctgtgtgtgtttcttgatgaggtttacacatctcattcagtaacacgcgccaggagaaagacgccaaagcaaggagtaaaaagtcaagcacgtgggaccgtgagttgttgggttatgtgcataaaatatttcaagagagagaatcttatcaaaagatagatagctcccggtgaaatgatatggaaaaagtctgaagaaaacatctcaaaataaatgaagtatttattgctgaaaaatgagcttagatctcagccagttccaaagttcagaatttaccgcaccactcaggcctttctctctaagtttcttgtctcttgtttcattgcacaacaagggattcttcatacttgctatgaaatacaacaaggcgatttttgcagtgataaactccacacatgcatgataaatccaagcatgcaaaatgtttaacatcccagttcagagatactttagggacaaaatccgattatgaattatatgccacaataaatagggctcaatgtttcataaagcaatttatagttcataaaaatgacaaaatgtacctgtcagagagagcgcggagagccgttctctgagctgcctgctggaagaaagaaagggcagagatgtttatttaatattctgacttttgaattacgtgctcaatgaacacttaaaaaaaagacccctgcattacacacatttttgccatgtggccaaattttaaacgactagcaatgaagtagagagcactgttgtaaaatgtgaaatgtgtgtgatgaaatgaaccttcacggacagttaactgaagcccggcaatgcacacctgcaactaggggatgagtttgtcgggggggcaaaggactgtacccaggtaagcttggacaggcctctggaaattggcaaagaccagagctacttctctgaaatcactttcccattgctttattgtcctttcctataagaaaacaaaaaggtctgttttggtttctttgtagcttctttcccaatgaaggtgtaatttttcactcggatttcagattgaaagtttccacagttggaatatggaatgccactagaaatctcaagggattattgatttgctttaggcatagttaatgatattatgacaatggtttttaaaattcacattgaaatgttaatggatacaattatctgctgttgggatatgctttaagataatacagtgggagggctgggtgcggtggctcacacctgtaatcccagcactttgggaggctgaggcaggtggatcacctgaggtcaggagttcaagaccagcctggccaacatggtgaaatcctgtctctactaaaaatacaaaaattagctgggtgtggtggcatgcgcctgtagtcccagtgactcaggaggctgaggcaagagaatcgcttgaaaccagaaggcagaggttgcagtgagccaagatcatgccactgcactccagcctgggcaacaagagtaaaactccatctcaaaaataaataaataaaataaaaaaatttaaaaaatacagtgggagaagggcagagtgggtgggcacatacataagacaagatggccttgggctgagaactgctgacgttaggcgatgagcacagggcaggttcttatattattctggccatttccctacatgaaatgaacaaaactttcattttgtattgaaaatgtattgatttgttttttgtttttttcttctactaaaattaatgtgtgtgtgtgtgtgtgtgtgtgtgtgtgtgtatgctgaaatttcccataataaaaaaactaaaagaaaaaaatcataaaaaaggctctattttggccgggcatggtggctcacgcctgtaatcccagcactttgggaggcccaggcaggtggatcacctgaggtcaggagttcgagaccagcctgaccaacagggagaaaccccgtctctactaaaaatacaaaattagatgggcatggtggcacatgtctgtaattccagctactcgggaggccaaggcaggagaattgcttgaacttggggggcggaggttgcagtgagctgagatcgcgccattgtactccagcctgggcaacaacagcaaaagtctgtctcaaaaaaaaaaaaaaaaaagggctccatttctccatcggattctcccaagttttgtacttgctttccttttctctggctattctatttttcacccatttgccttctatctctgggcccaatgaggccaaggaaggcagatggcacacgatgctctctgtctcagaagtcatgactggggaggtcagtagaccaggcctactcagcatgcaccgggaaacaaggagtgtgcaatggtcctttcctctttgcatgatacacaggtcatggttactgtttttttttttctgagacagagtatctctttgtcacccaggctggagtgtagtggcctgatttcagctcactgcaacctctgcctcccaggttcaagcgattctcctgcctcagcctcccaagtagctgagattacaggtgtatgccaccacacccagctaatttttgtatttttagtagagacagggtctcatcatgttggccaagctggtctcgaactcctgacctcaaatgatccacccgcctctgcccctcaaagtgttgggattacaggtgtgagccaccacgcctggcctatgtttactgttgaccaaggacctcacaatacttctcatgctgatagcccatcacatttagatatcaggaaaaatagaatcttcaggttagaaaaaaaagtcacctcagaaccattttctctgttatggaaataaaatacacccttggtgacagttccacatcttgggataaaaataaaagtagaagcagttatcgtcccagaaaagctccttcctaaggtaggagctggatgacctcggtacacttttagaataacatggacatgaaagattaaggcagggcagtgtcaggaaggtgcagggatgggcggccactcctcaaatggtgcctggaaccatgagccggtgtcagtacatatctgctgagtaaatgttagagggatgaatcagtcaggaaagccttccctctgaaatctgagcataattttaaagacaaggaaggatgtggtcaggagagagaaggcattgatagcactgggctagacggcacagcaggggcctgtcccagcctctggcagcagctctcaaccggggcacccatgactcccaaaccctgggtgtctggaattgatgagggtgtttctgtgcattacattcatgagggggatcaataatggcagtagtgtctggggccagggatactaaagcccttcaaagagcaggaaggtcccttgtataatgaagaattgtccccttaaaatgacaaagggtgcctgcagagaaacactgcggcagagtaggaatgaaaggagagcagaaagaagggctgtagggaacatgagctccagggcctggcaaagataaggggaattgagacaacttccataagtaatgcagcaacactgaattaggaaaaccatctagtgtgttgagccggggttggagagtccgacattctgggacaggttttgccattcatttgctatggaccttgcgtctggccttcaacctccggcttagtttccaaaccaccctttccttctctgaatagggtgctgaaagagacagtcagtccgtgtccaggctactatggacaatccaaggggttactgtcccctcctcattccctagattctgaatgaagaccccatgtcctggtattccattgtcataggattaccacaacagataaaagaatacagatctactgatcttcttgataaggagagctgagggagcagcgagaggcaggggaagaggaccggagcctgaggaacccacgcagacacctccagggatgggtgcttccctctcccctcagtccctctcctgtgctcttccatggagccagcgcagagcatgctgataaaacgcacccagcaggcaacaggtggcatcactgctggcaggtttgtctcctggagagtttccctctcactcagcaagatggctttcgctttaggccgcgatacttgaacttaatttaactccctactcctgactgtttggctgaatatacaagaagtatttttgaactgccccaaagaaaggtggaatgtattattagtattgtctcttaacatcatctcagcaggagccatgagagactggctcctcctggagtaacagaaatcataagaggtgtaactaaaagttcaatagaaaccttcaacatggcatctgaatttctccctagtcatggaaatagaccaaggctgtcaatattttaaaaggctattgactcttttctctcccacctccaaacaattcctgctgacttctgtgatacggaaacagcgcttgctgatgtgcagctggtcagaaaatgatttaaaaagcgaaaggaaaacaaacaaacaaaaagaagaaacactgctgtctggccgccaatggagtgcctaggaattgaggcatcccagtggcggcacctgttggcaatgccacaggactgatgttagccccgtcttctaatacaagctgagttggaagcttagagcaagggctgctttcctttagcagactggtgtgatgctgggaacaaaaggtccttctgggccgagagacagggcaccctacgaggcactaagcagtgttctctgttgattcttcactcttccaatctgtcacatgatgtatgctaccacgcatgcaacagcatggtacttagcaccatcaattgcctgcactgctttttttctttttttttttttttttgagatgttgtttcactcttgttgcccaggctggagtgcagtgatgcggtctcagcttactgcaacctctgcctccctggttcaagcgattctcctgcttcaacctccagagtagctgggattacaggcatgcgccaccaaacccagctaatttttttgtatttagtagagacggggtttcactgtgttagtcaggctggtctcgaattcctgacctcaagtgatctgcctgcgtcagcctcccaaagtgctggggttacaggtgtgcgccactgcgcctggcctgctctgctattttttaatgactaattttcattgtgctatttaatttgcagtcactctacatcattaaaaattttacaaaaactcaccatctattatgaaagaagaggagtatatgtcagatgttttaaataatttgaggaaaaaacccttcatggcattatattaattgtatatataccagagcaaaggccaccaagatgtttttactgactcctctctttaaaaaaaccttcagcttttgcacactattttattttactactggaaaataatgaaacgaataaatattggaattaaatggcaaagaaaaaattaggtgactcatgattgaaacttgaaaaagtactcatagtaaactagatgaattgcccaatttcattccttcaagagttatacattacagcaactatatttttctcttcctaaatctcacatcatctcttccttgcgacttgccttttattcagttctcagcaaaataggttgagagggttaagagaacacgtcattgatccttcctgagttcattattcattacgaatgattctaaactccagtctatgagacaaaacatgttcttttttttctgccagaaattgccattttcaggttctcctcaagagatgacatattttctctgtctttattatagcaagcttgttgcttgggaacacaatcagtagatattcaggtttcaatgtatgctaaatgaattacaagtcacattctgttattgaagggaaatcaaagaggaaattaaatgcccttattgtaattgggtcaagcactgaacaagctcatggatcctggagtggggaggaaaacaaagggagaggctgaaattcagagggctctcagaatgatctcatttcttacttgatagaaacagaacttacgcctggagaggtttgtaattcagtctgaagtacctactatgtgcaagcactggacttggcttaggtggcagtcacaacaagcaaagcccttgcaatattgtgcttagtgtctagaggtggggcagacatgaaaagctacacacacacacacacacacacacacacacacacacacacacacacacacacagcagtctacattccaaggggcatggctgaagaggacagggtgctctgaaaccaactaatgaaggaaaccttgtttggaatgagtgtcaaggaaggcttactaagtaagaaataacaaagctgaggcttaaaggataaagaaaaatgatcacatcagagaaatgggggtgggtggcgaggggagtgctctaggcagggaagctctagtttgggagcaaaggccaggagctggcctagatcctggctcagctgaagaactacaagatgtcactgtgctgcggttcggcaagtggtagggacagcagcagagcaagatgaggccaatcccaagggttttagacatcaagtgaagtatgttaggtattaacacaggacaatagaaagtcatcgaagggtttacattaggggaagctgggtgaagcatgcatggggcttgcttatatgttctttgcacttcctgtgaatctattatataattaaaaaaaatagtacggagggaggcaataagatttttcaaacatcttgctggcttctgcatgatgaatggaattgggtaggaagcgacaaagtttgaggttattgcagtgatgtgggcaagagaagagcatggtagtagtgaagatggagagagctagtgttacattgtgaaggtctgattgagggaacaggtgactgattggatgtggcaggccagggagaggcatcaggtgtgaggtccaggtttctggcttgggcacctggtatggatggagatccacttgttaagtggattaaactgggggcataagagcagggggcaaaggcagaattgagtgttgggtgtgtgaagttaaagttgcctacaagatgtttcagtggagactctgagtagctagctggatgcatgcgactgaagttattaaatgccaattaagtaagaaacatcaataacagtcataaaaaatggattgaggtttctggatctacattttgctactgttctaagagaaaaagatttaggtttcaactggttgggatatatctttgtgttttcattatggatgtcagtaacctccatttttgctatcaacagtatcagatttattctgctgacaataaaggaggtatctctgcacagggattttaatcagcttgttgcacctgtgataggacattgtatccatattcaaatacttgaataaacgcccttgcagccaatcttagtttgtgttttgctgttactgaagcacactgtaaaatttagacccaatcacatatttttatagaagttctatttgtaaagccttacatttttgctgttctttttcaagttgagacttgtacttattaatttatttcacggtttaatttccttccacatctataagcaattttatgtttcattatctgaacttttatgccattgttttccacttcagtcctagttaatgggtctcttaactttttatgttgtgggcttccatttagtatttttcaacccgtttagtaatatctgcaagacaaaggaaaaattcttactcctctctattttttcctcagcaataatgagtcttttgcattttcggattcctagaaataaatgctgcctaggaagcattttgttcggtcaactttgacctcatcccattctctataggggtcaggcagtcagggatgataatataatttatcatccaaataagaacaaatttgagagagaaaggggatgctaaccagactggagtcagagacaaaacgagaaaacctggctgttctgggcacatggggctgtacagtcgctctaatgaggactgctctgtgcaaatatgacttgctgcttataaaccctgttaaataagatcatgataagaaggcagacctcagggcctgaggagcatgccaataacgaaagcacagagctgaacggggtcagcagaggacgaatccttctaattcctaatgttgagtccaactgatgcttgtgtgattttctggctctctgtctatcagctcctccctctgttcacagcagacactctgaggtctagctcaccctttgtgttaagtgttaactcttttgtaaaagttctcaagctcctctccatgcactcctagtctgtaacatgaagtagccctggattctagtcatttttggggagtatgccgtctgcctcatgacaattttatttttggcttcccaagttccttaaaagaacattgatggcagagatcctagctcattttccctccacctaaaagagctctctctcaacccataacacttacaagatgtgagcaggtaacctcggggatgacaaatactactgtttgccacgatctccaatctaagaggtttgtggaaatacatttttttcacatctgtgtattatttccctatttgctttatttaaatacttggacacattttcctctttgaaaaatatttgactatcttctgcttccccacattacttaggtttgtttatgtctactagaaatttgatagacaataaaaaacatttattgagcacctagtatatcctgagaaaaatgctgattagggttgaccataccagatgaagtttgcacaggcaacattatctcataaggtggattctgttatcaacagagtgatctgggggccttacgtgaggccagattgtcagggacggctctaatttggcaagtcaaatccgagaggactgagagagacatacttatttttttgagcatttctaggacatttcactccctagagataaacccacgtgtgacatccacttcctggttctccttgctccaaagcacgtggctcttctagactctggaggcttttgccatcacaaatgaaaacgaaggcagatgctatcagtcagaagcaagaagagaaaggtgtgaggacaacatgagagggtgccgcagggactgtccctgtccaggtaaaggctctatggagggcatagaagatacatggcaccctgcagggcaggacattctgaacaccatgaaagcaacattataggtgagaggggccctgaaggatgcctggaggagggctgggggacacatgcctggtgtgggggtggtaagaggtcactctgaagtgggaggatgatggcaagaagaccatgaccatgtgtgaggttattagtgttcaccatgatgtggggtgggtgatatctagccctaagccagattctcggggcaactcagcctcagcctcctgagtagctgggattacaggtgcctgttaccacgcctggctaatttttgtagttgttttttagtagagatggggtttcaccacgttggccaggcttgttttcataattttatactaacatttatttatattcatagaaaatattttatattaatctactttaatatttttgtccagtgcatttaagatattgaaacagaggtccaggaagattagcttgcctgtggtctcagagccagtaagtaaaggaaccaggccagtgagggctccacagagcagccccattctgtcttggcctcaccatggactcctgtggctggaggttgaaagcaaaggggactaggtgaattctgaactgtggcagtttcagtgagaagaggactgctgggacactgggtggatgctaacagacactgggggaaacctttatctggggatgccagtgaaggggaataataggagtcacctcttagacaagtgttggcaaaggagatgggaggatttcaggtttctgagactaacttctcttctcaagagggttatatccttattgttgatcttggcccttgtcaaaatcttctggggaagaattctttttacctccagggctcaccatgacagaactatgtaaaggaagtagctgtctgggttaggtctgggtaggagcgaacatcgctgaagattcgcctggcagagcgggcaaacctactggtgctgttggatgctggtggaagatccaagctcagctgcctgttctcagaatcaggtggctgaaatgtggttcctgggactgagttttggcaaggcaactgtgccttctggatgtgcacacatgcatacatgtgcctgtctagctacaatttcaaagtgacagcaaacaaacaagagtagccatcagacccaacgctggctgagctgctaggagatacaatgcaggtagtatatgcatctaaacttctggttcttaggaatggaagtttaaatgtggagtgcagatggtgatgctggtcaaagtgaggaagtgatttatcttctggacagctgccttggcttccagatctcactagaatgggcaggtcttttctagaggtctgtgacatacaattttaggggaaaaaatagaaagtaaatcgccactaataagtgctaagttcgaaaagtgccagttgacttgtctttccagatagttccagccttggtggaatttaatgcagaagagatgacatgtcagagtgactggagcatgaggcgatcgtatgcacacgatgaagctttgcataaaggtgatactgacgtagctccttatcacagcctagactatttaggttctgcttggacaatggatcaagtttcctagcacaaaaaagacctgtgtgcgcagaaaccgctgcttcgtggtccaatccctccaccagatgaaagcactaagtactgcaggttccatcatgactctgtggcctgctcatctgggctttggtcattcacatgttcctggaactcatctcacagggcaatttcaatgcaggccagaccttgagcaaggccaagatggcgatgtccattaatggctttcatctttggctcagcaggtggatactgggattagtcatttcctattttgttcagtttgccaaatacattctggacctttaaaaagtccttatgctatcgcaatatgatgctttggtagagtcctgtccactttccactggccttggcaggtggttgagtaatatgaaagcaactagcgcctaaattgtgaaatacaaatgttactttgtttttgtagaaagaccagatgaaaataacacaaaatgttttggtatttttgttaaaaatgcaatctgggcttgaagaacttaaatctaagtctggctttatgtttcatttaaacctttttttacttaggcaaaatagcaatatttgaaggtaaaaacaggtttgtaatgattaggaaagattctcctaatttcttaattgcactttgcaaaccaattatacaagagaaagctgaaccagttctgaatgtgttattattgttatcaggatttttacctctcaagtgaacagtgctttacgatttatatgtgaaagtgctttcgcatgtaatgtataataatcacacagtcttctttgaaatgccttgaactttaagaacaaatccaggttgaaagaagaggtactcagagaaataatgtgaatcagatctctccagagaatcagatctctctactggaatccttgcgtgcagggttttctagcgtgcagatgaccatatctgggggcctaacattctagccactatctggtctgcttcttaaacatggtcttgttttaattaacacaaccttttggctgcagatctggtggggatggaattgggaagtgccaagggaccttgaatgatcacacatgatttttctccgtgtagaaacaacaggctaagagagtctcctgagaaaagctgggcttgtgagataaccagccctactcggagaagctttggaaaaagaaaaacaaaaactcaactttacaactgtatatctggaccaaacacctgagggactgtcggtaaatcctttactatatgacactgcccatgcctggaaatgagggatagcgtatactccaaggaacaacatctcttgtagggtttcacttcctgaaaagctactgaagaaaaaaaccattgaagtcatgggacaaagggctattcctctgagttaaataacaatgtcccctggagggagaattccacttcttctgccaaccagcaaccctgctggcagctgtgtttgagaaaagcgtgcctatcaactaatgatgcctaacccctctcctggctcctgaatggagagtctgtgttggtggtattgatacccaccattaacaaaaacttcgcttactttcaaaaatgtagatccttttatgaattcttcatcataacaaaggcaatggtttcccatttttgtcttaattgtatgtttgcccaaatttgatggatcatgttttggtttttatataattttctttttccagatttccatttagggtcctcaggctgaaactaggcatatcccatggcccaggctggttggacacaactaaatctacataaatctccattgagtctccgaggagattcgatgagaaaatattttaggaaacagcgttatgagtctctgtgctcagtgatatttaagttggctgaccatttcaattttggaaattatagtccattaacatgaaaaaaaggcaattacatgtttgtatatttctacctatgcttgtgctttttgcaaatgtttataaagagtggcatgataaaataaaataattttgtgtttgcttctggtgacagtaaaattttatttataaaatacaattactggccaggctcgctggcttatgcctataatgctaacactttggaaggccaaggcagggggatcacctgaggtcagaagtttgagaccatcctggccaacgcggtgaaaccccgtctctactaaaaatgcaaaaaatagctgggcatggtggcacacacttgtagtcccaactactcaggaggctgaggcaggagaatcgcttgaacccgggaggcggaggttgcagtgggccaagatcgcgccactgaacttcagcctggcaacagaacaagactctgtctcaaaaaaaaaaaaggcaattacttaactaaaagctttaggatggttaaacaaacaaaccaacccttctgctgaacatttgagtttcactgattatgatgggaggttcaaatatatgattacttcatatacggatatgaaaaaggtctgataggcagttttcaattagagttattgttctgtttccatattaatagaaaccaattagttattatgaacagattgggtatttagctcaggtacaacataaaatgcaagactaaaaagaaaaacgaacatacagtattctttttttctgtgttgctatgaggtttaatatatttaatatatactttttgtatggtccattggggcaagggatttcctggcattgaaaatttactcaaaatatctgtggttaagttatcataacgaatattactaatgtctaattcattaagaccaacaagccagcatcttacatgatgtttggtacttagtaggtatttgagactatactcagttttttgcaaaaactgtctagctcttgtttgcctacaaataacattgacaatacagttcatttctaatgtaggagaaacttcattttggagccttgcccctcaaacctggtcctgattactgcttcaactcctgtttatataattctacacaattttggcaggattcaagagcacataccagggtgttggcttttatgaatctcctgggatgtgaatgtcacgctgactggatgaaccctggccacaaatcccagacaagcacaatgattctatttattcagacttggctgcctgaatgcagattgactctgtgggtaataaattttcacaggccaagagcgtcaggatcaaccaagctgatcctgagaagaaaaatgcaactaaggaagtagagttgggctgcaaaaacctcctatgtttttattccatgtctgcatatcattcagctaattcatttagttactgattgacatgtactgtcaatgctttcagacattttaaaagctctgctttgtgttatgcaattgtcatattaaaaagaaacaagggaaaaaatgaagagcttccattacaattggcaatctgcttttaagagtacacccaaaactgatgtgagtcatccagtaatctctgtggtaaagagcacagaattgagatgggaatgtttcttgtgctgctccataggaaaccaaaggaaacagcaataagaactgcaattttgtgctcagagcaacctcacctacaatcttggtatcttgatgaagcaaggctttacattatttctaagagacacgactattactctatgcattataaataagaaaataattggctctttaatttgcagatttatgttaatgatctagatatctattaaattaattgcatgctctccaaatattgattggggattaaaaggcagcttttcattgtgcaagaagtaaattaacgccaatggggaaatttccctctacagattagatccaatgattgttgtctgtaaaattaaaatagtcagttaaaggggataaaccatgttcatttaaagagaaaaatgtggcaacagagttaaaataaaaagactgcccaatatgtttggataacgtaattactggaagctgcaggcatgtacatagccattcaatttagatccctggtcccttcctctccctaagctatgtatttgtcatctccgaaacacttgtctgcagttgacactatctcagctgctccttgctgaaagtcttaatcatgtgtccctgtcctcatgccttagctatagtaatgccatctacttatttgcttgtgtccaacctcccaagcttaccctgacttgagaggcagagctcatctttttgccaaatgggaagacatgcaatataattaatcagtcccttcctaatctattaaatttttttaatacttactgtcttaagtcttctaattccttcacattgtttcacaaaaacattggtctttggaattgttaaaaccaacagttacagaaaggagatcaaacaaattactccaggtatcacatacctttcatttactcagattaaataagaaagctgattctcagatattttgtgctatttccagttggaacctcatccagtgtgaaaatcataggtgcaaccataaggctatgcttccatttcatttatgtttgtaaactttctaaggaaacctggtcacaaccccagcactagaggctacagccaaaatttggttattcttgaaagggaaggctgtggagaaactcagtctcttggttttgaagacttctgtttgagataacttatgaaaacttgtagtttcaatatagcttgatgtaagcatccttaagaaggggctatagacatttccatggagatcggataaatgccttttttctcaaataggttatttgtgtattaatctatagccaatttaagatattgggccttatatttttgtcatctctgtcaatacttttgatgtttggacagaactcatttgaaaaatcatagagttcaggaaaaggaacaaaggcagagcaaaggtcatctttgatattgtacaatggacagtgggaaatactctcaattgaaggcatcactatgcatttatccacgcattcgttcaacaaatatttagcagttctgctgtgccagacacagtccctgccctcaggaaacttccagtttagctggtgtagacagatcttagaaaaagtaaacataacatataactaaaattacgatgagattcaggtaaaaagatgaaggatactgtgagacggactaactgggagttgattagataagagggaggtctccctgaggaagtgaaagttatgctgtgcctccaacatgagtaggtgttagcaaggcaaaagtgagggagtagaggcctatggaggccctaaggcagcagagctcagcttcctgcaggagctgggagaagggccgggccacaaatgagctcagtgtgaagatgagacgtggacaaagccagatggtgcagggtagtgtcggccatgctgagggctccgaatttgatcccgggtgggatgggaaacctatttaagattttagaccaaggaattacttgatctgatttttaaaagatcactgtggggaggctgtattacagagggcaggaaatagaaatacaatagtttataccagactggttttgactagctgggaatggaaagaggtagatggaccaatatttaattttggaggctgagtttataggacttagagatgaagtgactacctgagtgaggaacagggaatcatcaaggatgagtctgaagtttctaggctggaacagctgggcatctggcagtgctagttttggaaatgggaacaataacaagacgaacatgtttgtgtgtctgggtagtgatggcaaaggccagaagtccagttgggcacagactgaatctgaaatgtctgtgagacatccaagtggaaaagtaaagtaggtttgcggttcagaagagagttctgagctggggatataactttagaaattgtcagtatataaaaattgaaggtcataggaatgggtgagatcacccagagagcagacatggagaagaaaagtcaggaataaacatggaaagtttccaacattgggcagaaaatcagagtcagcaaaagagcctgagaagagaagccagaggggcaggacccaaaccaggagagtgtggtgttagactcctacagagaagtgggtgatgaacagtgttcaatgctgtaagtcttctagtaagacaggggactgaaaagagcccagtataattggctctacagaggtcattgggggcccaatgaggagcatttctggtaaagagatggggtcataatgagatcaaaagaacaagtctctatgtagctctgaggaaatggatgaactttggataggagcagggcagtgtcctctcacaacaggaggacacaggatgagtgaagatggaagcagtggtgcagatgtggtattgagaagtttaggtttctctgctagaagccagtcagccatggtatgaggtagggaaataaagatgaataagatacacggtgaaattcaggttgtttacttatgaagttgggaagacagaaaactacatttgtatcacctattattattcattctgtaacaaaggtaattataggatattaagggagaaagcatgcaaaatgacagtaccagcgaactgttataagttatgtatatatagtgtaatacctagaatagccactaaaaaagctgtacaaagagatacacataaaaatgttacagacaaatcaaaacagaattcaaaaggtttaaggaatacacagaaaggcaggaaaaagaaaattaaaaccaggaagaaactaaacaaaaaatagagtggtagacttaagctttaacaaatcaataattacattaaatgtaaatggtctaaatgtatcaattaaaacacagaaattggcaaagtgaataaaaatatgacaactattaatttatgctgtatataagaaactcatttcaaatataaccatattggtaggctgaaagtaaaagaatggaaaaaagttacattatgaaagcattaatcaaaataaagcaggagtagctgtgctgttatcagaaaaagtagacctcagagcaaagaaaatgaccagagacagagtgggacattacataatgatagaagggtcaatctaagaaaatatagcaatcctaaatgtacacacaccaactaacagagctgtgaaatatgtgaaaacaacccgattgaatagaaagaagaaataaacaaatccacaatgacagccagagacttcaacacctctctctcaacattagatagagcaatgagacagaaagtccagaaaagatacaaaagaacatcaaataagattaattgatattaatagaacaccctacccaacaacagcagaatacacattcttttaagtgcctataaaacatataccaatacaaaccatatcttgggtcataaaaaatcctcaacaaatgtataagaattgaagtcatacagactatgttctctgaccataaaggaaccaaactagaaaccaataaaagttaagattaagggcgatctctgagcacttaaaaattaaacaacacatttctaaataatccatgagtcaaagaagtcttactgaactgaatgacgatgaaatacaacacatcaatatttgtgggataaagtttatagcattgctgagagtcaaatgtatagcactaaatacttatatcataaaaaagaacgaatctcaaatcaataatctaatctccctcaagaaactagaaaatgggcaaaaatgtacccaaagcaagcaagaggagggaaataaagataagaaatcagtgaaactgaaacagaaaaaacaaatagataatattaatgaaacaacaagctagttctttcaaaagatcaatacagttaataaacctctagcaagactgatataaaaaagaaagaagacaaatgatgagtatcactaatgaaacgggctgacactatagatcttgcagtcatcaaaaggataataaaggaatattataaacaaccctatccacataaacatgacaacttaagtgacacggatagacttattactgaagaacagtgtaccacttatacccagtatgaaacagataatctaatagccctatgactattagataatctgagtagctctataactattaatattttttttttggctgggcgtggtggctcacacctgtaatcccagcactttgggaggccgaggcgggtagatcatgaggtcaggagatcgagaccatcctggctaacacagtgaaaccccgtctctactaaaaaaatataaaaaattagccaggcatggtggtgggcgcctgtagtcccagctactcaggaggctgaggcaggcgaatggcgtgaacccaggaggcagagcttgcagtgagccaagactgcgccactgcactccagcctgggtgacacagtgagactccatctcccaaaaaaaaaaatttgtttttgtttttctccccgagatggagtcatgctgtcacccgggctggagtgcagtggcttgatcatagctcacggcaatctcagcctcttgggttcaagcaatactcccgtctcagcctcccgagtagctgggattacacgtgcacaccactatgcccaactaatttttgtatttttagtagagactggttttcactatgttggccaggctggtctcgaactcctgacctcatgatctgctctcctcagcctcccaaagtgctgggattacaggcatgagccaccacaccccgccgggaaatagaatttttaagtttaaaaatctccaggcccatatggttttactagagaattctgctaaataattatcatctttttgtttttgtttttgttttgtttttttttcgagaaggaatctcactctgtcacccaggctggagtgtagtggcacaattttggctcactgcaacctccgcctcccaggttcaagcgattctcctgcctcagcatcctaagtagctaggattacaggcacatgcaccacgcctggctaatttttgtatttttggtagagagggggtttcttcatgttggtcaggctggtcttgaactcctgacctcagatgatccacctgccttggcctcccaaagtgctgggattacaggcctgagccactgtggccgacctaacatcattttttaaaagcataatctttttgagaaaagggcaggggacccttcttaattcattttataagatcagtattaccctgatatcaaaactagccaaagacagtataaaacagaaaacttccaactaatatccctcatgaacattaaaaagacaaatgtgtggtgaggatgtagagcaactgaaattctcttacactgctggtgggactttcgactggtacaaccattttggaaaatggtttgagataatttactaaagttgaacatgcacataccctactgctcagcatttatacttctgggcatagatccaacaaaaatgttcccatgtgctcaacaaaagacctgtacaaggatgaaaagacctgtacaaggataaaaagacctgtacaaggatgctgataagagcacactattctactccccgacccctgccaaaatatccacatgcccattagcagtggaatgaataagtaaattatggcatacacacataatgaaataggatacagcaatgaaaatgaacaaacttcaattacaggtaacaacatgggtgactctcataaacaatgttgaatgaaagaagcaagacacaaagagtacatgccgaataattccattgatacaaagtgcaaaaataagcaaaattacactatggtgttagaaaacaggaaagtggttattcttctgcagagtggtgactggtgggagcatgggggcacctgggtcatgtctgtattttcatctggatattggttatgtcatacacatataaaatcatttttaaagacatatcatttttataaatcatatacaaacaggctgggcacagttgctcacacctgtaatcccagcactttgggaggccgaggcgggtggatcacttgaggtcagaattttgagaccactctggccaacatggtgaaaccccgtctctagtgaaaatacaaaaattacctgtaatcccagctacttaggaggccgaggcagcagaatcacttgaacctgggaggcggaggttgcagtgagccaaggtcatgccactgcactccagcctgggcgacaagagtgaaactccgtacacacacaaaatatgcctattggatctggtgacacgaagatgatgggtgacctcaaatttcgatgaagtggcagcttggggatctagcattaattccaattttacaaacagagacactgaagcagagaacagttcagaggctgggccaaggttgcaaaactaagtagcagagtggggatttgaacccttgaagtggggccgctgtgctcttaaccactaaactagactgtcttttgaccttcaggatcacaaaggcaatggggagaaaaggaaacctcagataggagtgttcaaaagcatggagtctgaggcgatctgaggaagggcaggcaggtatagcaacttgaagctcttgtagacacctctttattacagtggcacatgggctggttgaaccaatattcacaaagacagccagatataatgtcagaaaaggttaaggatttttcatacactgtagtgtttactgaggcaagggatttttaaaatattttgggtttacggtgcaaactctgattacatctagaaaaatcatttatgttaaatgttcaattatctcagaatgccagggaatgagtgtatgtgtctgtgtgtgtgtgtgtgtgtgttcgtgcaccggctatgctgcttccgggataaagcatagtttggtcttgaagagaaaaaaataccatatcattagtcttgtttaaaagtatgggaattacaactttgtgattagaccaggttataattataggccaaagcaggacaacttaatgcaattactgttgaagcaataacttaaactatcatacgcaaaaccactgtctggagtcttaattaggaaaaagggattaatgtataaaaattattcattctgtcagttccttttattgcaaaaataggaaggtatattcacataggaattaaatgcaagaataaaggatctgacctgtacattcataacacaatattatcaatgagtacagaatggaagggggtagcttaaaaagcaaaatgagtcaactaaaagctcttactgccttagagaacatgtatagtacgtcattagtaatgtttattaaaattgagttttcattggaaatacttcctggaaatagctcaggaaattatttccaaatttaaaaaggtttgcagattgaaatagtctgtgaaccctttttctaataaaaagcatacacaatttacatgtttgatatgatttaatccataatctatgtatccaggccacttaatgggaaaaaacacaaagagttgaaatcatttgcttatcatcatgtagataagaagccaaaattaggagtgaagtcattctacatttctgctaagattgctgtgtggcagatatctggctgccctggaaacaaatcaacagatctgtaaaacactcgaagcctgagtggccttctttgcccagttaaccttcttccactgggtattctccacctgccaatctggtttccagactcctcaagctcttctccctttttcgtgcctcagtttctcccatgacatgagtaacctcttctgtgacctcatagctatgctctgctcactcttcctcgaaattctcctttgacttttatttaacctctgcttgttctctctgtaagttatttgtatttgcatgtctagacagcaaatcatctgcatagcatttcatgatacctttctattaattcactattccaaaaccaacagaacagcattattattttgtactgcatacaaaaatgacttattaaaaaaagcctctctgaattgtctttctacccatcacatgtatctaaacttgacaaaatacaacataggggatgagaaaaagaaaacagaagtgtagaaaaatctgtctttagtgtttttaaacttgctttgaaatacaaacatttcttgaaatgcagaagtgaaagtgatgaatgttaagtggatattttttcaccttaactgactgatcagaagagtatttataaccccctaactgatgtctcgagctgataaatcaacaccaggggagaatatttcaagcacatttatcatttaagacaaacagcctatactgagcataattactttttattcatcattttggctcacctctacatttgctccttctcaatgttaataatatctgtgtaagacttctcaatatttaatgttacggattgcctgttgcatgctgatgaggttaaggtcatatgtttgatctccagaaggccagttagcttctcacacacacacacacacacacacacacacacacacacacacacacacacacacatgaataaataaaaaagaaaaaaaaaaggctctgtctacttctgagggaagcctgatcttagcttccttgtaatacccattgctggtctcaatatcataaaaaattacagaattcaaggcttaagggaaattatgggcaagctattttaatatactgacccaactgcatagaagctcacacttagcagacaaaagaccagcagcctggagtgccaccattcagcttggttaacacccggcacagtccaccaggtaactgttaccagtgtcacctccaaaggatgatgacataaaagagaatcttacctgttcattctcctcttcatcactgcttagcttaaggtcatcttccagcattctgaaagaaggaacaaagaggtacaaagaggtacagatagttagtggattcagaataattcagcaccaaaatatcaccttaatgttgttattagagcaacattttggaaataagtctatttgatttcctattttttttctttccttcttatgcacttttcctctggtgcacttaggaaatagtagacagccccatcataaaaattaaccctcacaacagtcatcagctaagacgggcagctttcagaagatgctgtgttagcagggaaataatacttaacaataacgtattgtatatttcgaaatagctagaagggaagaattggaatgttcccaacaggaagaaaagataaatatttgaggtgacgaatatcctagttaccctgatttgatcattacacattgaatccctgtatcaaaatatcacacgtacctgaaaatagcaataaaaaagaagatgctttttttttttttctctcaaatacataggggcttttcccctgggcagtttgcattccacaattacttgtttagtgttttccaagctcccagtgctgggctgtgtctccgtgcctgccccaggggctttcatggtaaagagagatgagaaaaagagccataaagccataaacttgagttgtgagcgaagcttcttaggccatccatcagtcaaagagctggaaaagatgttgtccccaagatcctacctagtggggaaaaccaagcaggagggcgctttctgaaaagcctgtgaaggtgattccccagcccacccaggtccccccattcatcctgaggagacagcggggaagcacgaggttaaaagtgaaaaaaagaaacagaacttcagactctgttatttgttatgataacactgtattcttttcagcatggctaaatttttctttatagtagttttcagattaattcatttcaaaagaaatcttactcagaagtgcactgtataaaagcgtgctctccacgcagagacgctctgagggagcaggggagagcccacttctgagggaccctggggctccatacatcagtgtgaagcccgctgagcccttgtgctcaaaggcctcattgaagccagcttccaaaggctgtcccctaaaatgtacctagtgtcctttaaaagccggttgtaggcctatcactgatacatgcctctgaacattcgtaggagtcatttcagtcacttttggggcgaactggggggtaaagaactggcaggataaggcatggcccaggctctgccccacctgtctatgcatgtggggtgagtcgcttcacgcaccctgaccccatttccctatttgtgcagtgacgtgttatagagggcaatcctaaggttgaatcctgctttagattccgttgtgagtctacaaaataaatatgctccccagtttcgtcaaggagaaaaacccttctatttgctctagagaatacaacggagaaacttctaagtagtttttagggtactatttaaggcattgccatcagggcaccaaatctgcttcctcacaggctcctgctcatctcccagtgccgagaggtgtcgttcttctattatttaaaccacaagtgaacaaatgaacacgtcagcagaggctgtaaagcggcacccccaattcctctgcatgtctggcacgccattcatttccttcacctcacagacacatacgcttggcttcaaagagaagagacctcttggtgatttattagagcactgtttgggagtagcctagggaagtgggctgtgtttcctttgtccttgagtccccagtgaccagcacagtgcggcacagaacacaacgccagtttgctggctgggatgaggccccttccccaagactgttttcctacccaaaggcacagatttcttcctaatgaaaaagaccagagaaggggacaggtccttgcctccactcccatgccctcttttgggtaaaccaccactgcagtgtggtttaatctctaggactgcccagcaagcactgggtctttaaagggtgggtggtcctgctggtgggggtggaaagagtggggaggactcacacaatcatggttaacaacccccttgctgtcagatggaggctgtgtggctgggaaatttaatgtttaaatggacaatactgtgcgtggattggaaggccatcatcccccagagcaggaaagcccaacatggcccgaagtgagggagcttgggttggctgcaaactagccgtgcaactcagtcaccacatgagcctggcatggctgaaagtcaccacaacggtcaaaatgctgctgtgtgaggctctctttcaaggtagggaatgcagcttacttctgtttatttcaaacatgtgctaaacgcgtccacacgtaaacacgcatctgtttgaatctcagagccccttgcaccacaatcttgtgtgaggtgcacctctggggctgagcatttgtgcttctataatgagactcatctatctcatcatcatttccagaagaaaagcagtcagagttcaaccttgctttgtgaataatcatcactctgtcactgactttacctctcttatattaaaaaaatgaatttattgtgtttccggctgggttctaaatacaacaaatcacatgtaaaaatacactgccttcaagagagacttcaagagaagttcaaatctaactaaacttcagaatatttcgaaatatgagaaagtggccatggaaacacaaactcacacagcttatacaacattcccggagcaatcctgggtgatgctattcccaaaacatgaaatcacagacctgggagagacgaccacggccataccgcatcccagccccgacaggcacagaggtacaccctgaggagacccaggctccccgcggtctgagagcaggaaccctttgctttattctgatggtcatgagcaggcccttggctcaactccctagcaaacggcgcttgttcttgtctgtgaccactgcatcttcaagtccggtttaacattcacaaacaactccatgttgaatgctgaacatatccaagtggcctcttagagagcctaaggaggggctgaagtttatagctgaacaatgaaacatggttaggagaagagaaaacccgtgacactcacaggatcataggaactgtctgtacttggtgtatggccagcagacagcaggcatggccgccttcaccaaacacacaaatggcaccgtggtggtcatgggcccaacccactcccaaaccctggggaacatttttatcatttgtctgtttccctgtggaaacataggtatatcaaacaataaataaacaaacaaaagtgttcaaccaagagtaaaaggaagatgcaaattaagtgctgattaggctactggggaggggtggagatctcctactgtttttttttttttttaaagggaaggcaaagaccctgctgctctaaggggctcctgagggctaagtcatctgcacggaaggactagccatctgcatggaagcacagggcctgtgcatccatccacagcaccctggttacacccctactcctgggttcctccaggccctaccccagctgatggggcccccaaccagggccacccctttcacgttcccttagcccctccccttcatagctcttcagatccctcccaggggatgaagccctcaactcacagcagcagctctcattgtttaagggatgtccgtccgtagcagaccagctaagtactttctagatgttactttgtcaatccctgcagcaactcctccaaggtgggaggtgggtgctacagggggctgtggaccgtggtagtcagagcagggactccagcgtcacactgcccaggaagaatgctagctctgcctttcatctagcccagggccctgggacctgcctcagagggcttcctggagaacttactccacaatccttggatagtgctaagcacgggaccttacgccagggagcctccaatcaatgctcatttttatcaatgctcatttttaccaatattcccttttccctaggagggaagtgggcctcagagcatttaagaaactcatgtggataaacaagttgagactttgagatgtctttgtaatgatgccttaaaacagggccatttgctctattttcaggccattttgaaaagaaagggtcatgttcctgagagatggtggaggggaatatattttggcctgtaactgctgtcagctggtctgagtggctttatgtcgacaggacagtaaacacgcctatcagccccagtgcacggagaggtctgccctgggagctagcgggtggccacgaggccaggagtccctccacgaggagccaagggggtgttgccagatgacaatggggaagttgaaataaaataggtactaaaattgaactttttggctgcacgcggtggcttgttcctgtaatcccagtattttgggaggccaaggctggcggatcattgagcccaagagttcgagatcagcccgggcaatatagcaaaatactgtctctataaaaaatatataaaaattagacagacatggtggtatggacctgtaaacccagctactagggaggctgaggtaggaggatcacctgagccctggaggtcaaggctagagtgagccgaggttgtaccactgcactccagcctgggcataagaccctgtctcaaaaaaaaaaaaaaaaaaaaattgaactttttgaattgagaacagacctggacttcatggccttaacacttgaagagttatcaaactactgtcagggatactccacgttagcacctcatggtgactttacagtagagtctgaaccagctacatgagaactgtgacactttaaggacagaagcaagattttttttaacgtgcgattaagcgattgagattccacctatttttacttgggaacttgtccttacaatgattgttgggcatgttgtaacacccttcctgacacgcagacaaggagtcgaagggttatgagcccccagctgcactcgctcacgctttcatgcagggagagcgggccttgcaggagctccgtagaggaaaggacacaatgggactttcattcagaactctaaagagggagccaaagataaacaggcccatttgcagtttgccgagcactaccctggaggacctttttctttctgaaagggaaagatgaatggaaacatgcctcatcaccaccagcggaaccagtatccaaactcccaattgttgttttgttttgttttagagacagggtcttgctctgtcatctaggctggagtgcagtggcccaatcatagctcactgcagccttgaactcctaggctcaagcaatcgtcccacctcagcctcccatgtatctgggactacagacgccggctaccacgcctggccaaacccccaactgttgactcattcaattacttctgtgtccactgtgtggcaggcacctatccacagaaggtgtactgtctcccaggggtggttcccctcacacacgacattcaaatcagcattgtcattttacgtatttttaaatgccttcgaattgtgaagctctggcaaatacaacttttgcagaacccaactgtgtcatttgaaggtaaactcagtacttttcagaaaagggagtaattcagtacaacctttgcaattttaacatttgattaccataacttccctgtgtgtattgttttcttaattgagcaagtgataaatttatgttgtagctggcgcctgcatttttgaggcctaaaatttcttgggaagcagaaatagcagcctacacttaacagatggccaactgcttccaaagctcatctatatcttccacaggtattgcaaacgggcacgttaactacctgcaaatgtaatggcagccatttcacagagtagtggtttttaattaataggattttccctgaattagttgtcatttggggcccttaacagatcggaatcctttagtcctttaaagtcatttcattttgctttgttttaatggttttttaaaaaatctgagttttaattgggctgtttgattttcagatttgtttctatagctggtgctgctactatctccacctacgtgagatttaaagcctaagacaaatgtttatgaatctccattaaacatattcatatatgcaaatgtctattctaacaattagcattgcctgagagcctattcattatgcaagtgcatctctctgcagttattccccaagccatcatctccactgcttggaacacgggagggaaagttatacaactcatttcattctttctgaagtctactgctttgtcagggtcagtgctaccatctgcctgtggttattttcattaacaagtaaccaccttcttctcagcgtttgttcggaagaacttagctcatgccatcccagctaactgggaacagggaaggctagcatgggctcactctaggggttggcaatttagtgcatccaaggcacaggtgaactcacttagtctggaggcaaatggagaaatcaggaacaagatgaaggggtgctctacttgacctaagtgtttccaactctgatgttttaaaacccagggatctctacatcttttgaagcaattttggtccatagcaaggtggtatttgctcacacatatctccttcctggactccctccctcccggggagggattgtcagtgaaatcatccatgatcctgtaactctgccatgttgaacctggggtgaaggtgcactgtctcgcttaagtttatgaccttatttttagttagggacagcaacttctgatggtccttttctccactgacatgctgaatccacttgccaccttctctgcaggcccatcttccctgggggacggcatctcatctcctaccctagaagaacctcacaaaagccagtctcatttgggaaacctgccaaatcctggtgagatgctggatgatgtgtgtcttcaaaatctcaatcagtcaactgtctttcccaacagtaagcatatctatagtaatagaaaataagcagaaataaaaggaaaatggaaatcaacagtcataagaagaaacagtcagtggtacagagtctggggtggtgaaataaattttgaaatggcagcttggaggctagccagcattagcctgaattctgtccctaactagctctgtgaacttaggcaaatcacccacttcccctagacattgtttccacatctccaaagtgagagttggataaaacaaccactatatatcctcttattggtctgaattccttggttctgtgcctttaccaatgggtagaatgtccaggaagactgctggagaatgagatgatctgatactactcagcacattctaggtgctagagatataaaactggagaagtcttccttttcaagtgtctcactgtttactgggagcagcagcagttccttgaacatcccatgatgctttccagctagaaatatgtaagtgccacacacggtttgtgtgattgtgaaaatataaaaatgctccatcttttccacttagggcaatctaggccacagttatgaagtagcattctccaaatatattagactttaaaattgcttcctcctaaaagaattacagggaaagagggctggatatactctatcatttctatcaaaaaactgaggctttagaaagagcactttaacccggagtgctttctccctgaagatgggtttaaatcctgtctttgtctgttttaaggacttctagaaaattagtttctgagctcgatgttctcagtattaaagaattgagtttctaaggctaaatgaatgcaagtagtgtgtgaaagaacatgatcctttcccgggcagacagcagaggacaggtcagaggattctgactgggaacataaagtttctgtggctgtacagatttggtggtggacattacttaaacctctttgaagggggatgtgcacctaaccagaggggaaatgagatatgtacgtatttatatggctcaaatctgatgttgaatattgataatcagtaaataagtaagttagctgcctattctgtttgctagctaatggtgtgcttatttaataacttctgacaataagaatgcattgaatctgtaagggtcataacatacatcaggttaagatttgttctttggttggaaacatcagtttttgcatttttatggctgctgttattgataagttaattgctaaaagagtccctaattaagagatttgaacagataaactgttagaattagaaaagagaaccaagcataatctcctaattagcaaatccatgcactttaagctataccagcgttcacacattacctgaggatggcataacacagtggtttccaaactttattgcacattggcatcacttgggaatctttaaaaattattgatgcccagctccactccaaccccatattctgacgggataggtttggggtgcaatctgggcatcaggtttttttttcttttctttttttaaagctccctagggagctgattcatgggcctcagccccagatattctgattcacagcaatgttgggacccactatataacacagagctggactgactcataagagctgaaggtcatgaatagctctgcaccttggatcaagtcccatactctaagttttagtttgttcattaatataaggggatgatagttgagattcaaatgagacaataaaggtgaaagcccattgtaaactgtaaagcttcataggagttttcagtaatgggtttagcattacctgggatgttttgaaagatactggtctatgggccttaccccctgggattctgatttaattggttttggattggccacaggcatcaggacttctgacaagctgctatggtctgaatgttccgtgttccctcaaaattcacatattgaaacctaaccttaaatgtgatagtattcagagatggggcctttgggaggtgattagctcatgatggcagagctttcatgaatgggattagtgcccctgtaagagagacctcaaagagctctttcgactttgtgtcctttccaccgtatgaggacccagctcgtaggtgctgttgatgaaccagaaagcagtttctcaacagacaccacatctcgttccttgatcttggactccccgtcccccagaactgtgaggaataaattactgtcattcagcagcttcccaatttattttgttactttagcctgaggtatttttttttttacagtagcctgaataaactaagacatgaacatcctaagtgaatcttctattcagccagggttgagaaccactgccttaattctattttttttttttttttgagacggagtctcgttctgtcatccaggctggagtgcaatggtgcatcttggctcactgcaacctctgcctcccgggttcaagcaatgctccctacctcagcctcctgagtagttgggactacaggtgcctgccaccacacccggctcatttttgtatttttagtagagacagggttttgccatgttgaccaggctggtctcgaactcctgacctcaggtgatctgcccgccttggcctcccaaagtgctgggattacaggtgtgagccaccacacctggccactgccttaattctaacggaactatcaccttcctattaaaatcatctccaatccataggacagaattagtcacttcttatctaagtgaataatttgtacataactaatgcattatgttggaattttctaacttatctggcttcactctccccccatcttccattggaataagaatgcttgaagggaaggggtgtgtttcctcaacgcctaggataaggcataagcccatcattactaaggaattaccacgaggcattttagaattcttcagtagttgttttgagaaaccacaaggcagcgctggggaatctgagattccagcttgttcttcagccttggggaggaaacagaaaattttatgaatgccacacctttcaagctccctggagaagtccccacactttcgtcaagactgcataggatagtgtgctgggttttctgtctagtggcaacttggcatcatctcccctttgaagcactcctttctatcacaggggctggaggcctgggaactacatttccccagaatccctgccgatagggtttttggttaaatgttgccagtgagaggcacctgaatagggcttggaaaatcaaagattaacagaagcctttactactcccaggacagtgaagcaggtgcagaagcttcagcagatggcagatacgaggttctgtgagtggcttccaggcacccttctgtgaataatgcctgctggagacatctgagattactgttagcagttttctgttattcttgcatttattgatttcttgaaatgactttctgaactgatggctgatttcctgttggtcccccttccctggccctcctgatgggtttggaaggcactaattccctatgttaagtgtctacttgaaatacctagagtggtttctcttctccagatcaaactgactgatgtgtatagtaattaagagcatgagctctgcagtcagaaagcctggtttattgatttctatccagatgctgtacctcatgctagttgtgtccttatgcaaagaacttaaagttgctctgccttctgtttcctcatctgtaaaatggaaaaacgagagtgtttacctcctaggaatgttgtagaaaatgtagaaaacattttatacagtgtctggtatgtagtaattaataaatattcagtattctaactggaattttattacccattccatctcgtgacaacaactatgttacaatttaagtccatttttccttttctttttctttctttttttttgagacagagtctcactttgttgcccacgctggagtgcagtggtgtgatatcacagctcactgcagccttgacctcccaggctcaagtgatcctcctgcctcagccccccaagtagctggaactataggtggcccaccatgcctggctaatttttgtagggacgagaggttttgttatgttgcccaggctggtctcaaacccctgggctcaagtgatccacctgcctcagcctcccaaagtgctgggattatagccatttactttctctaacagagaagataaacttcttaatttctcgaccacctccgacgagcacattctaggtgccagagatataaaactgaagaagtcttccttttcaagtgtctcactgcttattgggagcagaagcagaaaagaaagccagcgaggtgataaatactatgggagcacagatgaccatcttttttccttgtcagacaatcccggcccttttatttttccttgtagttttattcttcagtctgtagttctcttctgtatctcctacaagttccccagtgtccttccaaatttatagtcacgtgtgggacacagtccactctacaggctctatcggcatggactgtagggggagaatgacccgctttatgttggaagtcaacagctctgagaattaaggcctaagactcataacttaaagctttctccacctaagctcatttagtctctccttccccaaatgtcttgaggaaaaaagccatctgcctccttgttcaggacagccatggggtcatttaagactcatcatggaattttaacaaccttatcctacgctgtgtggaccaagatgaccatctggctcctgtgattgcagtggggaccacattgtacctgggtattacagaggtgcagccatctcccctccccctgcagctgtccagttcctggaaaacgtgctcccaggaccttcagctgcttgtgactagatggaggctttcacactaatccactaatcctctctgccacaaacatcataagcagatcgtataaacgtgaagaggagaaaaagacttcaatgttccatattaaagaaaaagcatcctatgagctatttattggctggagattggtagatgatcctcacactaaggcatttccatgaattcatttttttttttttttgagacaggatctcactttgtcatccaggctggagtgcagtggtgtgatcacagctcactgtagcctcaacctcctggtttccagtgatcctcccacctcggcctcccaaagtgctgcgattacaggcctgagccaccgtgcccagcccatgaattcagctttaatactaccacttttgcagcactttgcatattttctctgatacttccagaatttttcattataaaatgaatccaggtggtttgaatatagaaatcaaataactctaatctcaaaaaaactcactatataccaggactttttctttctttcttttttttttttttggagactgagtcttgctttattgcccaggctgaggtgcagtggtgctatcttggctcaccacaacctccgcctcccatgttcaagtgactctcgtgcttcagcctcccaagtagctgggattacaggtgcccgccaccacacctggctaatttttgtaattttaatagagaccggttttcaccatggtgtggccaggctggtctcaaactactgacctcaagtgatctgcctgcctcagactcccaaagtgctgggattacaggcctgagccacccccctggcctttcttttttaaaaatagagttgaaaattaggccaagtatattgagagttctaaatccattgtcaggtacatacaactggcttttgcaatgagaaacctgattaccctgccaacatgcctctctatacaccaattacattctactgggagttgttcaactcatggtgacacagaatgtgtcaaataatccatgtaaattaagccttgccatatccattgcagaagaggggtgcatttactgggttggaagtggtgtcaccaggaccagtcaaggccactccttaagaaaggttcagcatttcgtcatggttttatatcaggtatatttcgagtttatataaaaaaagagtaaaactgcagaatcaagtcctttgttgccttcctaactttttaaacatattcatctatttctctttcagctggaagaaacgaatcttaagtgcaagaaaaaaaattcctgtgaaaaactctaagtgggaatgtacacttctgagataggatcagactacagaatcgtgttgcttctgcttagtgcttaagaaaataaccaggaaaataacgatctatttagttactatcctggaagtcatggtgtccatactgctaaagtgggtctattcactgatggaggacaggagagtagggataaaaacagacaggatccaggccgggcatggtggctcaaacctgtaatcccagtaggctgtgggaggcggaggcgggcggatcatgaggtcaggagatcgagaccatcctggctaacacagtgaaaccctgtctccactaaaaatacaaaaaaaattagccgggcttggtggtgggtgcctgtggtcccagctactcaggaggctgaagcaggagaatggcatgaacccaggaggtggaggttgctatgagccgagattgcgccactgcactccagcctgggcgacacagcgagactccatctaaaaaagaaagcagacaggatcccagtccaatgcagactttctgactttcctattttagatgagtcaagagtcctgatccacagtttcaattaaaatgacagaaagtcaactgatttcagagccaacaccaaataacactgtgaaggaagttgagtttacctttgaaaacccctaccacttcaggtgcacactccctctccaggactcatactcccatgtagactattcctttctgaccaaggaactggagctattctcatggtctggaatgggtctcctttcctgcctacttgctaaagtgtttctcttctcagtcccataccctttggattagttgtgagccagccatattgcatattgaagagttggtaagatttgactccttctaacaggttcccaagctctattgacctgtaattgcaaaaaaatacaaataaacaaaaccccaacagcaacaaagatcctgagggagtgacattaatggtagaatttttaaggtacagcggtagcccccaaatgggccatttttccttcgtctaatcttattgcatggcaaatatagacagcagcaggcattcctgactgagaaccctggtgatggcctgatggaagcagagatgagactgtctgatccactccaggcagcatggtccctaaagggccctctacagctgggagcctaccctgttctgtaataacagcacatcagcaacctctatcattgtggcaatggtaatcaattatttaagtcatatttcattgattgcctttatgtgccaggcatgttgccagccaatgcaaaccaatgatgaataagaaatggttcctcccttagggagctccagtctggaagggaactcaggctcactgaattttcttatccaggcaacaaactgtcccaggatcttttaaacagtttcctgagtgcaatgagtatgtaacattaaactcagaacaaagagaaggatctaggaatgcaatttcctatgtggccaagagatgtgttcctaccacaaacgtattcctggcttctgaggcactttgatcattgtcacccatgcagccatttttaatagtaaatagctaaatattcagaaataggcacttcacaattatttatttgatttgggtagtgtcaggctagggaaacactaccaggacaccaagacaagaagagaaatgtcccggtatggcaggggccagatgcgggagaaggaggaccagttttatcaaatgagccaggtgggtaatgggagtgagtgggagcttcaagtcatggagaacagacggagtgttctaagaactcagcgaggacactcttcaagccacgaggctgagctcctagaactctaggagacaggagctagaggagaggtgggctctcactggcctgtggaataaagaggctgatgaaccttcccaagcgagggtctcataagcagggaggaaagtatggggcttagagggagaatcaggctggtggccagtcagctgttgttatttataaatatgcttttatagtagttttagatttacagaaaagttaccaagagaacacagagggttctcgaatactccgtgtccagttttccttgtccttaggatctcacagcagaatgatacctttgtcacaatgaatacacctatattgctatgataacgtaagtccatttgaaatggagtcttgctgtcacccaggctggagtgcagcggcgtgatctcagcttactgcgacctccgcctcccaggttcaagctgttctcctgcctcagcttcctgagtagctggaactacaggtgcccgccaccacgcccggctaattttttgtatttttagtagagacagggtttcaccatgttagccaggatggtcttgatctcctgacctcgtgatccgcccgcctcggcctcccaaaatgctgggattacaggtgtgagccactgcgcccggccccagtcatttatttctatcagtatggactcttgcatgctttcttgctttggattataatccaatactagtcaactgttcctgaatcacatataaggtactacactatagtggtgcaggcactctgtacatacagcaaaggggcagaattaccatgtgctgcccatggtagtgatggacacaaatcaaaggcttatcattacctgtgcaaagtggttaaaattctggccaaaaagacattttcagtcccaacaatgcaatcagatgcttgaccagcaaaagcagtatactttccaaattataggtatctgcatatccacacatataccttaaaactactgggggcattcaattgccaaatcaaatggacaccttggtctccttgtcttgcttggtcactctgatttatgtgacatttcgtgtattccttcattgagctgttcttgtgcagcttctctgattctcgaggcgctctttcttttcctttgatgattctacccctttctggccacccttcagagctgctgtcaccctaggatccagcctcagttttcttctgaggtctctcatgtcctcatccactcccaaccatgacatccatgactgcttcctccaagtgccaccccctcaggccactgcgcctgggcatctctgcactgtggcttcctggaggctcgagctcatattttatctcacgggcatcttcagcatctaggaaaatgcccggcatgcaatcaccacacaatacatgtttgttgagccaataagttaatccctacttggatgtgcctccaccttgactggcctcaaaccagaacctattacctccccacctggaatccaacgagcacccacctggtcctctgcacgtgggttttgacttcctctctctcctccctacagacaacaaaactcctagcagtgtccatcttatttctcaagcttttcttggaattcctccctttctccatcccttgtgacgctgcttcggtttacatttcatttctcactggcataactaactcctctcttcagtcccttctccaggctctatttcccaccttgctgcagtccccctatgatttaaattcctaacactggctgcttcttagggtagacaaggctcttcatggttggcctcagctgactgcagctgctgcctggtcccagccctgtaactcaatactggaatgatgcaaagtctttatagttccacttctctgagtctcggcctgggctgcccttcctgcctgatgcccttctccctgttctcatttattactcactcctcaaagaccaccccaaagggcacagctttttggtgctcagtgaccttattgaattaccctctgctgtacccatgtctattagtgcacttgccactccacactggaatgattagtcttcatgtctgtctcatctgcctactcatgtgcttctcagttgacagtactgtctgagccttactcctttctgtatctccagtgccttggagacacaggtatttatttaattgcaaaaaaaaaaaaaaaaaaaaaaaaaaagagcattcaccccttcaaaataggagacaagacctgcaaagagcacagtcgatccacgactccaaatggaatggaatacatttaaaatacatctggagtgggcagaaaaagaaaaatgagctcaaaataagttataaaagcttactttaaaaaacaacacttagaggccaaggcaggtggatcacctgaggtcaggagttcgagaccagcatgaccaatatggtgagaccccatctctaccaaaaatacaaaaattagctgggcatgatggtatgtgcctgtagtcccagctacttgggaggctgggacaggagaattgcttgaacctgggaggtggaggttgcagtgagccgagatcacacgactgcactccagcctgggtgacagagcgagactctgtctcagaaaacaaacaaacccccccacccccaaaaaaaccccacaacacctaaatttataataaccacaatctttattattattattattattattattattattattattattatttgagacagtctcgctctgtcgcccaggctggagtgcagtggcgcgatctcggctcactgcaagctccgcctcccgggttcacgccattttcctgcctcagcctcccgagtagctgggactacaggcacccgccaccacgcccggctaatttttttgtatttttagtagagatggggtttcaccgtgttagccaggatggtctcgatctcctgacctcgtgatccgcccgcctcggcctcccaaagtgctgggattacaggcgtgagccaccacgctcggccaataaccacaatctttaaagttcattgtctattaactttaaaaacaaaggaatggttgggcagatttgtctattatggaatcagaccagcagcaggaagggctcaattggaaagtgctgagaatcccacggcttcgatcggttgtatgggtgcttatgaaataaaagttgcaagaatgagtgaacatgtactcctgttagaatccatgtacgactttttagccagagcttctcccagaaaaaatcagacttttcacaaatatattttggttaaaagtatactaacccaaggtaagaattttttttttttcaaaaaaagaaaatctaatgtgtattttgaagagtttatactcaggcatagtggagatcccttctttctgttttcttggtgggaaaggcagaagcagagaggtcaggagaaaggagatggggacggataacagcatggtgggcagtgccaggcatgctgggtgtgtttctgtttgaatgtccaggctgtgacaaagggaagtaaggaatgcatgttggagggacccatttctcatttgccctcatgtctagggcccagaggaccagtcacttaggacagctgaagccaagcaactgttgacatttctggccttgtctcctcttctccctcaccaaaatgatattagctgggacttcctcacctcctatccacaatgcattccctgttccagaaacatctcaggctgctggattaccaaggctggacccaaaccaggctgtgctcagtcactgctcattccgcccatgtggaggaaaaggttcaaggggatacttagagtctcatttgttcactgagggctccataataaagttctgctaaaaatgcatgttgctcctgaactcctgcagcctgcggtttgggacagagtgttattttggagcattcagagttgctgatgctattgtgcccttgtccccgcttggtgtccaaactggagcatttccttgctttcttagagctgccttcacttgaggccacaaaggactcgcactattaatgagcttgtgcaccagaccaactgctgcctcataatcctcaaaacaacctagagaattttttagaggtgaagaggctttagtgattatcaagaccagcagtttatcaactttggtcttgtttttggcaccgcaaccttttcttcaaaagagtcttaagtaaagttgtatcacttatccttcctgtggggatagagttgcaaaaatgcaagtgtcactctgatgtctcttgagtcaactgctcacctgctgtcagtgacagggtgtggggtaatgggatgagccctgcagagcccatgatcataggattaggtcaggaggaagacgaactccaggaaaaagctcccacaatagtagggctcttagctagaaggtggaaattcattctaacagaggtcttgttcacaagcatatttaattagtggcaagagcccaggaaaggactaaattcttgtaatttaggatggtctaaagtatggaaggctttatgtacatttctgaacagccttctcccccttcttggaggcagctgtttcaagtagcgactggtgctcagcctctggagctggcagcggagcccgtgggtgtggcgaggtcagaagagctttgctcaaagccagggtgggtgtggctgcctctgcagccctggcccacacccttcctctgtggactgaggcctcctcctgcccaaatccagagaggactcttaactcttcctcctgcaagactcagtcccaaggcccaggaaagccccagttgctaactctgatttggcccttgttgagctctccatggacatggtggcccctgtggacagggagacaggagagtggattctgctctcccccttcttcagcatcacgttcctcattctcactctctcatcttattaatggcggcaagagttgggaagatgtcacagcatatgggggcaggaggcaggggctatgcttcagacaggtgagtgattgcaaaggacaggctgatgaagggcctggaagaaggttaggaggggagtggggagggagcagtgagcctcatcccatggtgctgcatgctgggctcccacctgcaatgcctggcctccttcctctgccaattcaaatcctacacacttttgagagtccatcccaagtatcactcctctagaagtccaccagacattcctgccttccccgaccttccctcttctctgaaccctatggaggatatgttgtcttggactgagccctggcagatcttccttcaccagacttctggactgagatgatgcattaaactcctctgtatcctccagagagccaggttatcaggcactaacctaatgcagaaggaggtgacttagtcttaagctgtatcagcttcctgaaggctcaagtgccttcctgggacaggtggctctgtagggctctgagactctctgaacaggtacctctatcacagctcctgtcaccttatattgaagtgaccattctcactccagcctcgccctctgcagggcaaactgctgcagtcaccaatccatactcccatatgcattttgttatttccagggcattgcatagaattaacagggcaggaactcaacaaatggacagattcccaacaaaccaaatggaaattaagagactactgtgaagacacagaaaaaagaactggctgatgaataaggagaagtgggattttaaaaagttgtgatgcaaattccattataaactggaatcaaagtcagcattaactaatagtaacattaaaattattgccccaaaatgggtaattttaaatgtgactgtacaagaaaaatcttattttttcttgtgtacgtttaatcagattcttggaaataaactttctttctactcttggatactgcaaaaactggatatgcccaaatctaattttcatatggaaatagttgatatactattaggatttttaatctagtatcaccatttatagaaattttaaatttttttctattaaagaaaaatgcataattttttgagaagtctagatgatttcagccaaagaaaaatgaaagagttgatgagtattaatatagaaatggcctcctggatactgcaatttgtaagtcttagatttatggccggttccttaagagcagggaaatggctattgcatgctcccaggcatgattctttttatccaatgattctaatactttttctatctttcccttattaccaaaaaataatgtcattaaaatcttttttaaggaataaaagtgaaagccagtaggttttggttccttattcatacactcaggtttgtaaataagaaaaacaccccaaacacttcttttatttcccactgcatcattatttccaatgttaagttatcccatctaaaatctagccttttcactgtagaaatccacatttctcattccttaatactttttttttttttgagacagagtctcactctgtcacccagggtgcagtgcagcggcaccatctcggctcactgcaaccgctgcctcccgggttcaagtgatcctcctgcctcagcctcccgagtagctgggattacaggcatgcaccaccacactcggctaatttttgtatttttagtagtggccagctggtctcgaactcttgctctcaggtgatccgcctgcctcggcctcccaaagtactggaattacaagtgtgagccaccgcgtctggcctcattccttaatcctttgttagaactttctagtcaatacattagagataggtgctttagacgttcaaaggattttatgcacattaaggtcaaattctgactgaagggaagacccactgggcactcttgacccactagccagacaacaggtgtaaagacaggggcacatttggtgtgagctatgagcagtaggccacagtggcaggcagaggaagctgggtgccctagacatgagtgagggtgctgggtgtgtgctgaggtcacccaggcgccagggagaagccagggtggctgagggcttttaagaacatggacgcctactaatcagtgtgacattttttgcattgctctccgtaagtcctttccctgtcccaccccacacgctgaatcattctctagaacaatgttctctaacagaaatatgtgagtcgctatgtagttttaaattttctaggagctatgttaaaaaagccaacaaaaacaaaaacaaaaacaaaaacccaacgaatttttttgtttgtttgttttgagacggagtcttgctctgtcactcaggctggagtacagcggtacattcttggctcactgaaacctcagcctcctgggttcaagcgactctcctgactcagcctcctaagtagctgggattacaggcgcgtgccacatcctggctaatttttgtatttttagtagagacagggtttcactatgttcgtcgggctagtctcaaaatcctgacctcgtgatccacccatattggcctcccagagtgctgagattacaggtgtgagccactgtgcctggagttaattttaataatgatttaattattaatttaaataatataattagtaaattttaataatatatttcactcaatccaatatgttgtccaaatactgccatttaaacatatgaaaattacttatgatactgcttacattattttagtgcaaagtgttcacaatcatctgtgtatttcatacttaagcctacctcagctcagactccccatttcaagtgtttgacagccgcgtgtgcctggtagttcctggagtggacagcaccagtggccctggctgggccagtccttcgtatcttgggtgtttctggccccacgctcagttcttcactgggcgagtctcccagggtgggaccctcatatactcaaggacttcactgctgacagcttgattcatttaattcattagcttcccaacaaccaggggatatactgctggctcctacatctatgggcacacgtgtattctttttagtcgggtctcttgaaatagcctggaaatgtgcccttaaactgcaggggaaaaaaatctgggaaatgccttttcctgtaaaagctctgattttacatgcatgcccacagccaccacagtcagggctgccacacaggacagacagggaggggccgcccttccctactttgctgtgttataaatgaacatgttcagttccaacaaccttaataagcagaagatttctcaaatgcacaacacagtactccatttctacttttttattggtaagcgatgggatttcatttgtaatgtataattctgagaactcgtgggcacttacaagcactttaatgctctaagatgattgaggtgatgaagagactgcaataaaatatctctgaaaccaaagatgatcaatcacagggtcgttttccctagccagagagctctctagaatctatgaaaagattacttactggaaaaatgaaaaaaaaaaaaaaaaaaaaaaccaaaagaaaaaaccaaaaaaaaaaaaactaaaaacaaagccccaaccactccaacagggctctttaactgaacattagtcatccctttcccaagaaagacattcactcctcacagcctgacagcctcagacaacagttagctgtccaaacccattcagacaaaattgattatttttttttttcatgaggggtgcagataaaattctcaaatgaattgcctgagaagtcagtttgacataatatcccataaaatctttgctgcttggaagaactataaaaagtttcattaacatagagcttcattccactccaactctttgcaccaacttcatggcacgttagagcatcaaggctcaggtgatttacacacagggagcagaaatcattgcatctcagccaaagagtgtgcaattttaagtcggtttatctaacacttctattactcaaactctgcatttaatatttgcaaaaggtctaatgcagggtgtgcatcggcatcctacacagttatatctgcacccatgtggttttctacgaagagaagagaatcaggtcaaacttattattacacttgtattgctctttcttccttctgtattagacatggtctctggaagcccagagcatggactaacaagctctgccacatcttatagcacagcatgtgctttctaactatgtaataatgaaattcttttttttttttcttctttgagtcaggctcttaatttgttgcccaggctggagtgcagtggctcactgcagcctcaaactcctgggctaaagcgatcctcccgccatagcctagtgtagctaggactacaggcacgcgccaccatgcccagctaattttaaaattttttttgtagagatggagtcttgctatgttgcccagcttggtcaccaactcctggcttcaagtgatcctgctaccttggcgtcccaaagcactgaggttacagatgtgaaccagcatgcctggcctgatgaaattcttgatggctataggcagggacctgccagccttgcagtttcctttgctttcctcttctatcacccatttctttctaagggagtgaggcccttgtcataccctgaacgttttgaaggcatcaagtctcttaatccaacttctcttcccacctcggaatctcagtccagggcaaaaagtccacctagctcttgataagcagagactagaagaagtaggagaaagctggcgagggcgtgttttacaagagttccattcagtttcctgcagctttgagaatcctaaatgccacatggagtcctgccgcccattcagctgggcagcacggcaggtggggcgagatggccttcctgcccaaattctgcccaacttctgcccatcactgtcctgggtgtgggagattgggagggtgtgtatgtatggttgagattgtagatatcttactttgaaaaggactttccaacccaaagagcaactgtgaagagtccagagtttttacagagaaaaaaatgcaagtttcaggactacagagcaaatatagtgaggaagagcaatttgtaaaatactaaactaggtttctggacatacctctactgttaacagtaattctttatttaaataggcaagacattctgctcttgcagaaaggcccttgcgatcagaataagaggaaaatagatcctggtaaggacccaggttctgagaacaccttttagggtctgacatctctgccaggtgtgaagagctgagaatcagtggatctgagttctagccctagttctggtgttaactcctcagccataacttccttgtgctttctttacaatgaggataataaaaccagctttgtcttcttcacaggctattgctgaagacaacatgatataacagaattggaagtgctttcacaaacattgttttatgaacacaaggtaaggtagtgaacaaatacctgactttgtgaatttgcatgctgccaatatatgcacacctgcatcataaggtctcatttatgatgctctatgtttgttttttttcctttaaaaattttctgtgtattcccagctgttcaaaatataattccaagtgtgtatcatctgtagaattgggccactgcagagcactatgttgttcctgaacctaatccaaagtttcaagagctagcccatctctgaacttcccaccagcatgaaaaccctaatctaatctgtgcaacaataatctctagataggcatctctcacacttgcttttggagtactgttttagtagcttacttgtgttttttaaagttcatttctccacccacaggatagctccatatcttccagcaccactaatgagtaagtattagggccaagctggtatctgcagagtgctgactggccaagagtctgcctgtgactcatgccttaggctgtccagcattggggtgctggggggctgtagccataacatttgcaggatttggaaattccacctcaagctccaatcccagggtgttgattctggctaaccatgtttatgcaaagcaatccaagcactttgactcactttgggaatctggcattcttgggcttttgatattgagacagtggaacacttttgtatcagtttaggttctgccaataattgctatccatttaagcacttgattttttacatatttaccagcaatttccaaggctttaatggatagagttagcactcttctgcaaggagaaattgctccacagtgctaatagtcgtggattcacaggcactcagtgagaatattttaggcataagcttagttttattattgtaccttagagaaaccttgtatttttaactaggtggtaactttttactgtattagttaatcaaaagaaacataaatataaccaaaatgttatttttagtttgtactggattctataaaaatatgattacccattctagctttattttgatgttaatatttacatttaaatagaagaaaaacagtaaagggagcacatcaatgtaagaagtgtatggctttagtaaaatatataagaaactttggtaaacagggatttaaaaaactctaatcccttcaccaactcagaatgccagttccttacaaagctgcatacctgagcaaccacacatgtggtttctgtggatgagacatttaaatgatgcaatcattttgggataacagttatataatataaaggtttcacatgagtgtctagctgaaaaaccactgcgttttcctatgaatgcaaagaaacctctgctcaggtgttggaagctgtgcctctccagctgcctgccaccttccaccccttcacctgtggcttccgctggtttctgatgggcaccctttgatcactggggtcagttcaatttcctgggccactgggtcatgggcaggacatgaaaatgtaagaagagggaccatgcggttcacctaaatgacactcatttaataacaacatcaaaatccttgatgtgacaggacctatcgcctggcatactaaaagtggggagagcaattctctcatcttctgctgtagttaatgatatcttcctaaacctgcattaatcatcaagtgaacttctagggataacgtaacttctgggagaatttaaactgagattgaatttgtatctcagacggtagtgcccacagaggtgggcagtggcacaggcttccttcagcttgtgtcccaggtttatgggagaactcttctccctgtccctcaattcacacacaaaagtgcaaaacaggattatgggcatagggcatgggcaatttcatctacagcagtgccgatctctgcctcactctttgaggtcaccacaatgctttccttctgttcagaaccataatggtttctgtgtatcaattgtttgtgggcaactgctgaaagggaatcgagggataaacatgattctaaccaatcgcattctgtggtgtctatgggcttccacctgttaacatgggaaactttctgaatttaggttcatccccatcttgtggaattggatttccaccaagggttcctgctcctcatttagcgtggaagaaagtggattttgcaaataacattcatgatgttttgggcagtatctactctgcctgcaaggtaagaatgagtctgtgggagaacatccagctgctgcaacttgcttcaaagcctcctttttttttttttttgagacgaagtctcgctctgtcgcccaggctggagtgcagtggtgcgatctcagctcaatgcaacctccgcctgccgggttcatgcgattctcctgcctcagcctcccaaatagctgggattataggcgtgtgccaccatgcccggctaatttttgtatttttgatagagacagggtttcaccatcttggccaggctggtcttgaactcctggccttgtgatccacctgccttggcctcctacagtgctgggattacaggcgtgagccaccgtgcctggccaaagcctctgttttattggcttctctttggtgctcaaaattcccacgttcacattaccttgtttatttgaggtaaaggctttcatcaaaatcttcagttaagataaaaatggcaggaagataaaggtggggacttacaaattacattcttaaaagccacccacattttggtttatatctcttattaaatctgcagtacaaattggtttgtcagctctgtttacctgaaagtgtcctgagggaacagaacacatggcagagaagcctgtctggcagaattaaggactaggagctgggaagttccagagcttagaacaacgtccagaagacagacttgcaattgtgctgcagaaggacaaactgttgcctgttggcagaagatggggacagggggaaggaggaagcacagaaggaggaacagaaagggccaaagacaatgtctgtctgttgtgaggtccactggggctggccttggtcacctgcctgacctcctcggagtgagcgtgagacggtcacgtgtactcagggattgaggaggcccaatgctttcacacttcgtaaattcccggggaacactccacactcatactgaaagggacagtgtggccctgactgacagcatgtccaggaccagagtactaggcatgctggactccataggatttagaatgccacagtggccggagcagcaagctggcacactgggttagatggcaaagtgaggatgtgtgggtgtggacgtgggtgtgtgcgcaaggtggcggcaggatagactggtaacactcactcccatgcattttcagcttaggctacaaatgacaaatggcacaccaaagtgaggtgtggtcgtgcagacagaaaaagcaagggcctcctaatgcccaggaagcaaaaaggaaagaacgtctcttcggtacctcatgacttcctgctagaggcctgaagtcactggcacactggaggattctgttagtattctcatcaggtatgctgtttattagacagattaagactaaaagaaaatacacaaaaatagaaagctgcttctttgagaatgatgagtatgttttcaaaaactttaaattttaaatatttatagattcacatgaaggtgtcacaaaatgtacagggaagtcctgaacactcttcacccagcctctgccaaggttagtgtcatgagtaactgtagtaaaatgtcgaaaccaggaaactgacattagaacaatccacagagcttattcagatttcaacagttatgcatggactcatttgtgcatgtgtgtgcacgtagctatatgtaattttatcacacgtgtagctacacgtaacagtctaccacaatcaaagtatttaaccacaccatcaccacaaacgtctttcatgccagccctgtatagccacccctcaaccccaaccctaaccacaggtaaccactgatctgttctccgtctctatagttatgctatttcacaaaggttacatacgtggaatgtgaagtatctatccttttgaaattggctttttttccactcagcataaattccctgagatccatccaagttgtatgtattaaccgttcattccttttattgctgggtagcattcaatggacttttaggtagtttctggttcttggctattgcaaataaagctgctatgagccttcacgtacaagttgctgtgtgaaaatatatttttatttctctgggatatatgcccaagagtgcaaccgctgggtccattttcagctataaaaggaactaccaaattattttctggagtgtctataccattttacattttcaccagcaatatgttagtgagccagttactccacatccttgccagtgtttggtgttatcattattttagacattctggtaggtatgtactggtatctcatctcattgtggttttaatatgcattttcttttcttttttgagacagagtctcactctgtcactcagctggagtgcagtggcgccatcccagctcaccacaacctccgcctcccaggttcaagtgattctcctgcctcagcctcctgagtagctgggattacaggtgtgggccaccacactcagctaatttttgtatttttagtagagacagggtttcaccatgttagccaggctggtctcgaacccctgactcaagtgatctgcctgcctcagcctcctgaagtgctgggattacaggtgtgagccaccatgcctggccttaagttgtatttgctaatggctaatgaagttcagtatcttttcatgtgcttatttgccatctgtatattcacttcaatgaaatgtctgtgtatgtctttcatccattgttgtaactggatggtttctttaatgctaaggtctgggagttctttatatattccacatacaagccctttgttgaatatgtggtttacaaatagtttctcccaggccataatttctcttgacatcctcttagtaggtctttcacagagcaaaaggtttttaatattgatgaagtccaatttaccagtttttccttttatggatcaagctttttgtgtcaagtcagagaactcttcatccatttccaggtcccaaagatattttcttatgttttcatattagtttcctattgctgctataagaaattacacaaatttggtagcttaaaacaccacaagtatatttaccattctgcaggtgagaagtccaaaatcagtatcactgggctaacattaagatgatgcagggctgtgttccttctgaggcctctaggagagaatccatttccctgttttttccagtttctagaggcggcctgcctttctggactcatggcccctttttccatcttcaaagccagcagcatttccaaatctgtcactggctctgcaaagttccttctgccacgtaaggtaacacaatcacaggttttggggatgagcatgtgaatgatacggtggggggcattattctatcacagtttttttctagaagttcgaatgcattttgagttaatttttggatacgatgtgaagtttggattgaagttcattttattttagcctatgaatgtccgattgtttcaacaccattcattgaaaacgttccactccaccaatctccgtcttttaattgatgtatttagaccatttacattaaaagtaattattgacgtgttaggattgaagtctgccattttcttcgtttactgttttattccttttgtttctcatttctctctttttttttttcttttcttgccttcatgtgggtacttgaacatttttcttcttttttctttttgtttagagacagagtctcactctgtcacccaggctggagtgcagtggcatgatcatagctcactacatcctcacacatctggcctcaagcaatgcttttgccttggcctcccagagcactgggattacaggcatgagtcactgcaactggccttgaacatttcttagagttgcattttgatttacttataatgtttctgagtacactgctttgtacacagtttccttaggggttgttctaagtattgccatacacataggtaacttatcacagcttactggtgtcaatgttttaccacttccagtgaggtgtagagaccttacctccatttagatctctgtatcccctccagttttaaaatacaattatcttaagtatttcttccacatgcactgaccagcaccatcagatgtcattataacttctgcatcaccatttctttcatatgatgaaagaagctcatgagataaagaatagtctagtatgtttacttctatttttactcatcctgttctccctgctctgaaaatctcagctttgggcttttaccattttctttctggtggagaagttcctttagctattctttaagggtagatctactagaaacaagttctcttagttttcctgcagccatgctggagacctgcatgccttaaagtcatcagtggctgagcctcctggaagacctagcactacccacgtggcactctgtagacactaacatgtgccacttcagctcctggcaccctgataatggccaacaccaggtggcaaggtgcaggctaggctccccttgcccactcttggtcttgggcccaaggaaattagagttgaggcctattctcaagagagacagatcccttaggaggtcaatcaaggatagcagtgccgtgaaaactatcttcaatagctcagctgggtcagaacagtgttctagaagtttgagtctaaaatatgtgagccctgaaatccttcaacttctagggtgaccttgaggtgtcagagctattcctatatccagtaatactctattggcacaggccccaggcctgaaggtaccacatataacacaccctcattcatgaccaggggtgtaccttacaggaacaagaatataaccattcattagggctcagacctcagatgtcaaaaactcttagcagaaggattggctaagagctccaggaagacatcagagttagagatctcgatctgggaggcatctggacagagatgaaaattgcagctataggaatgcatgagatcaccatgagaagaaggtagaggaaaaaaaccaaaacagacccaaggctgaaccctggtaggaatatcaagaggatatagtaggatggcagcaaagaatagacggttcgaagaaggccttgtcaatggggttccatgctgcaaagaggtcaaggaagttaaagactgggaagatgtcagaggcttggcccaggggcaactaaaccatggaggcccacaatgcacagatgctgggaaccagctgtgagggaggaagggctggtgagaaattaaaggatgggaaaggagagagtgctcagtagtcacaatggttgatggatttgcctgtgtttgtattgtttgggaaaatatggaaatgttataagcctgagtaggaagaacaattaagaaaacaacaagagaggggctgggagaggagggggagagaaagaatgaggtcaacggcaccagaggagaaaaggatcaggcatttcttcctgaaatgggagagaagcaggcatgaatcaagctagaaataagtttaaggtgaaaaaaaaatagaaatttaggatgctgctccaaatgaactacacagctgactagcttatttttcttttgcattaaaaaacctttgggttggctgggcatggtggctcacgtctgcattcccagcactttgggaggccaaggtgggtggatcacctgaggtcacgagtttgagatcagcctggccaacatggtgaaaccctgtctctactaaaaatacaaaaattagcagggcatggtgacgggcacctgtaatgccagttactcaggaggctgaggcaggaggatcacttgaacccaggaggcggaggttgcagtgagccgagatcgtgtcattgtactccagcctgggtgacaagagcaaaactgcgcctcaaaaaaaaaaaaaaaaaaaaaaaaaacacgccctttgggttgctgaaattaatgtgatcctgttggggcaatggtggtttccaaatctgaccaaacatcaaaatcgattaagaaactttgcaaaaatacagcttcccaggccccaacccagccacacttaagcagaatccctggtagagggggcccaggaagcagcattttaaagtttcttcagtgatttagagggttaaaccaggtttgggacctctcgagttacgatgttcaaccatgtatgtatattagaatcataaggcaggtattggtagacccagactctccagattacaggtattaatatttttaaaaagctccacaagtgctctgatgtacaccctggttataaaccatagtcaggggactggtttggaaaaataaactatctggataggatacttgactttaccataccgattggtcctctgtcattcagattgcctgacaattaactttacacttttctcctattaaaacagcacctgcttctatccgggctgtcactggtgggctgatggttccctgtggcttctcagcggatttctccaggcagccaggcttgtgggcttaccatctctggccctctggaaagagcctggctttggaagtttttgtagtatctttaatgtaaagtatacaaaatttcattgttctttatctgaactaaccacacaatgcaccttataaaagaaacagtaagacacagaatggaggaaggactatagaaaaggcaataatagttcatatttcactgattagaaaaaaatattatcaggcagacccataattaatttggtgagaaaattccttgcaccattaggccgattttttgttttaaagcagcagtaacatcaccaaacaactacagaaatgagagtctcgcatatagctgtttggctttgagggaagctgtaagcccagccctctaaatgcctctcaaagaaatacaaattcttcttttatctaaaatgatggtgtgatccaattcctgctccagcagccccaacatatcatctgttggactctttaaagtttacggcacagacagaaactgtcagttcctctcctcttttataggacattcacatttgcatattcagcagacagcacaagcctcaaaggccatattccccagaatgtaatcatcctacttttgaaataccgaagatataatagtacaatgaaaatattcttaccccgatgaaggctggctccagttgtggcttagcaagtcaaaaactagtaaacttgcctgtaacaacatcctaaaattccaaaggttattcttccccatccacagttaaaaagccatctcctacagaacagtgtcatatctgtgacatgtccaagattaaaggaagagccttcttgcttttagtaatttgtctggttagagattaaagaaaaaaaaatcaatcttgaagctgtcagttaatatttttaaattaaaaaagccatcttcatgcttcatgggagaaatgtgtgatttttaaacagaggtaaattcctcttcgtatcaagtatcagataatttttttgcatttcagcacgaggcaaacaaacaaaaggttatccacgaagtttcaaacgcgtcttagtaacataaactgaagttaggtagccttctttgatattgaattaccaaagtatctcgctgaaaaaaaaatcccccttgcaattaataaacaagttgtggtattttaacaaagttccaaagctaagaatcttcacattccaaatctttccattcctggaagagctttggtatttagatgttaataggatgcctgccttttttttttttttctttttttggccaatcttcaggctaaagagtctgtgaagcagactttttccatcctatgacctcagttttaggatttctttcttgcaaaatttagttattttggttggcagattgccagaattcattcttattttctttctccttctggtactttctccctttacccccttctgtttctctcccttcttcacctatcttgtattattctctgaattgaattaagaatttaaagtccggttggtggactggactacagtctctatgatgtttggtagggttgttagaattagcaaatgaaaatacaggatgcctagttaaatttgaatttcaggtaaacaacaaacaaatttttagcataagtatgtcccaaatattgcatgagacacatttacactacaaattattttcaagtattgcatgggacatacatattgtaaaaaattactgtttatctgaaattcaaatttaactgggcgtcttatattttatctggcaacactactttggaggttcaatggaagggattttaaaaaaaacaaaggcatccatttacaactcctggaagaagagaaatttccactcctatcctcttgaacgctttttgtctagatgtaatgttcttgattacctcattttagtttatttttgacccagtaagttgtactaaaagctccacagagcatgtcacatccttatattaaagaagtccatcccaggtttcaggtctcactcggtgtcaggccaggccagagcttgcaaaattggtcccccaggcaacatgggaccttggcgcagtaacagaacaatgcaaatgctccagttttaattttttccttcaaaatctgaacaccaaatttagtacttttgaaggcactgatatagttttctctcctcagtgctcactttggggcaatttagcatgattagtaatagtgattattagaaaacccaatagaattcacatgaatgttgaaatgtaataaaatgatcactttttgggcattttgaaagggcagataaaaatattgatatgcttctgacatttaaagataagatgaagatcttaattacattaattattaattcaggtgtatttctgaacatctaaagaaacccaggagggcgacacataattccaaaatgccgttctcttatttagagacacattgatattcagtattttggaactattttgaagtttaatagctgaaatggaggctgtactttaaattcttaaactggactttaaattcttaattcaattcaaagaataatacaagataggtgaagaaggaagagaaacagaagggggtaaagggagaaagtaccagaaggagaaacaaaataatcacacagaggtgtgagaaaaagtatgggctctaggcgggtgcagagtcaggtgctctagcacctgtttgtgaacccagctactcaggaggctgagcagggaggatcacttaagcccaggagttcaaggccagcccaggcaaatagggagatctcttttttgaaaaaagtatgagttcaggagtcaaactgggttcaaaccctagctctgtcacaaactagctgtgtgaggctggtccagtttcctaacctttctgtgcacatattccttatctgaaaatggggataaccaccccagagagccgtaagagtatgagacaagcactcagaacagtgccaagaacacagtaaatgctcagtaagttttaggggtgaagatcacgtgatctagcccaaactatcaatagaaagataaaactcaccaagtcagagaatgtctccactttgataactgggtcatgagagaaaagatttttctcttgcagtcaaatgggtattttaaaaaaattataaatagcaatattttatgtatttactcattaaaaagaaacttctctttattttcagaggatacaacttccaaggttgtgtgaaattagcatgatactactgttccaagaagtgaagctatatggttatcagttctatccaactactggttattcttgtttcaccctacttattattctatttactcccagaaactccacaagcaaataaatgacactctttctcatccctacccccaaagccaattaatcgaacttgatcgtctagctttactgttaagcagattttcaaatgaaatagtcccaaatcactgggtttccagccatctggaaaccactttgaacttcatttgtttatccatgtttttaatgcagctcaggtgtctgtagtctgaggcagtgaggaaaacaagtgcttctgagtcaaacacctctggggtaaaatcctggcttggccatgctgcctacctgggtgagctctctctgccttggtttcttatctatacaatgggatattctaatgttgtctcctttctgagttgctataaagattcgaagagctgattcatgtatagggtgatcctatgtttcagcttacacttattgtccctgcagaattgttacactattacccttatttttataaagtatttaatacagagcctggcacacagtattcagtatttgttttttgtttctttttttgagacagagtctctattgtccaggctggagtgcagtgttgcgatcttgggtcattgcaacctctgcttccccagttcaagggattatcatgcctcagcttcttcccaagtagctgggattacaggcgtgcgctaccatgcccgactaatttttgtatttttagtagagatggggtttcaccatgttggtaaagttggtctcgaactcctgacctcaagtgatcagccttccaaagtgttggtattacaggtgtgaggcactgtgcctggccagtattcagtatttgttacctcttaatcatgatataccaacacctgcagtattctaactaaatccttgaaatcccatggaatccttatttttaaagcaagaatagccttttttgacacaaaaaggtgagtgcctgcctgaatgtgaaagtttggtcacctgcccattatctccacattccctgtccctttggatatttcagtcatttaagaagttaaaagtgggggtggaattctctgcggtagaaccttggaggcagaggctaacatattttacatgctttggcaggatcatgtgagcacagctttactaaaatacactctgccaacagcagaaggccctctgaggtgagcaggtgggacgaggctgggaagctgtcacttgacttctgccagctactcggaatgtcagatgaatcccagactgcagcccctgcggtttccaaggcccccatcactgcacagaaataccaggctcactcagcgacaggagccaggcttcctcctgtcgctcctccccagcctcctcacagcctcaagatgcaattctcttgacagtagggagggagggcagatattaagggcttttagggaaataccagccctttcttcagaaatggggtttcttccttaacatctctcccgtttcatgtgccctctgtgccaggccgcgtgtggtgtctccaagaggatctggagcaggcggacccagtcggaatcttggctctgcggctcatgactgcaaacccctccaggagccaactcacttctctgagacctcgtttttctcttctgtaatatgagatgtaataatgtaataatacatctcattggattgttatgaggattaaatgagacaacatgtccagtagactgcctggtacaaaataggcatctaaggcatgccaagtatctttatggtcccaggctgcctgagaaggggtcagcattagaggcatgcgggtgcaaagagaacctgcgatctaggggtggaaggtgggcgggcttcagtgtgcaaatatgcaagcttggcatttaggaggttttacatctcaactagaatccaaggaagagggagaacaaatccagctgatggtatttctgaaagaagacgcacagcgaatgtatgtgttccagccatcctttgtagtatcctgcattccttcatttattcatactgtacttgcttattgaataagtactatgttctcaatgctagaaacacttcaacacaagagcatgaagattcattaaagataacattgggaggaagcacaggcagtctgttaatgtcaggcaatatttattgattgcttgctgcagtcaataaatatggtaataccagccacaatctcccacagcccgggcgactcctcagaaaaacgttggcacctgttaaagccacagtgagtatggagtagctgaagtttcttaactcatgtctctgtggactgaagagctcattgcaaaagggccaaactcgcttccagagactgttccccaccttaatcataactgaagtaaaccattgcttatgtggtctaactggagtcactgaaaacttcccttctcccatgacatatattccaaatgcctacttgttgaacctatgaatgggtcctaaaatattctgggttgtcagttctttgggttaaaactttcctaggtcctactggaatgctcttgggttctccaaggggaatacttcagggagccatatattctagtcgcctcttggcagcgtgcaccagaggaaaggcctgtgtaggaagacactcactggctgagctctttcagcctcagtttcctcatctgtaaattgaggaaagacgagcccagctttcagagctactgggaagactgaagagatcatttacacaaagtgactaggccagggctagaaacatggcaggggcccagtgcatgccatttccttctccttcctcactcctttggcacaaagcatctcagaagttggtcagtaacctctactgtgttttgtgaacaggggctgacaaaagtgaacatgtgcaattgtgacctgcatttaaaaagatgaggaatagaaaatgtcagagtaatggtaggtgatctttgcgacacttttgcttcagtacacacattcacaaaggatacggtataaaatgtacttctgactgtgtaggttatagtcataaagttttgaggtgggtatatacccccaaaaattaagaacaggggctcaaagagataatgtaaacccacgttcctggcagccttattcacaatggccaaaaggtggagccaacccaagtgtccattgacggataaatggataaacaaaatgtggtctgtacatataatggaatattactcagccttaaaaaggaagaaaattctgacacatgctgcaacatggatgaaccctgtggacattacactttggaaaataagccagacacgcaaggacaaatactgtatgattccacttatatgaggtccccagagtagtcaaatgtaaagagacagcaatggtgattaccagaaatggggaggagcagggaacagggagttattgtttaatgggcacagagtttcagtttgggaagataaaaagagttctaaggagagggtggtgacggccgctcaacatgtaaatgtattaatccttgatgccactgaactgcacacttgaaaatggttaagatggtacattttatgttatgtgtattctgccagagttaatttttttttttttttttttgagacagagtctcgctctgtcgctaggctgcagtgcagtggcacaatctcggctcactgcaacctctgactccctggttcaagcgattctcctgcctcagcctcccgagtagctgggattacaggcacgtgccaccacgctcagctaatttttgtatttttagtagagatggggtttcaccctgttggccaggttggtctcaatctcctgacctcatgatccgcccgcctcagcctcccaaagtgctaggattacagacaattaaaattttaaaaaattaaattaaaaaatatttgaggaaccttgacctagataaccccccgaggaaaggtacatttggaaggagcctgggtgtagaagacaaagggtgggccctgggcaattaaacaggagacaggggaatatagactccctattttttttttttctagagagagtcttgttctgttgctctggctagagtggcaatggtgtgacctcagctcactgcagcctctacctcccaggttcaagcaattctcctgcctcagcctcctgagtagctgggattacaggcgcccgctaccatgcccggctaattttcttgtatttttagtagagatggggtttcaccatgttggcgaggctggtcttgaactcctgacctcaggtgatctgcctgcctcagcctcccaaagtgctgggattacaggggtgagccaccatgcccagccagactccctaattttataaactctcttttacgacctctgggaacccggaccttccaatgtcgtgccagaacacagaaaatggggttcgcagtctttttctatgatggtatcatttccaacagacattcctgtgttttagtgttttattctgagagcaaaacaaatacaacagcaatgcctaatcgccctctcaggtgaaactgacctttcctcctcacctcttctccttcagtaactctccccagcccaaagctgactccttggtaggcaaaggctggtcagtcttccttccttattcactgaataagccatgcccctttgcaggcctccagtctaatttgtgattctaactaatgaggtggggtctgaggaacttgaagaggccctttctattttattttttattcttggtttccaatagttggagaaacaggatctggccaactttctctagacaaaggctgtatgctaggtttttcattttcttagctgaaatgattgtggcaaatcacttaaacagatacaaaaaggaggtctctgtggacggacacctcatagactaaaagatcagccacagttcatcattttagacatatattgctagagccaaaataagtatcaggaaggtttcaagtttctctggaaaagaaaatcttttggtaacaattctcaaatcgaccttgatctctcaacttccagacactactctatgatcagtttgtgtaaccttattgttaaatgcacttgcataaatgatagatttctttatatgtttagcacacaattgttcctctgtattttttccctccatatttaatgttttctaagatagtgctacaatgagctaattaaaaaattttaatgaatattatatcaatgcagggacactgacatgaacatgttgcactttgcatgtttctatatgactccaagttgcacattatgtacctgaaagagcctctgggcatcatccagacctgctccaccaatctgtggtgctcacgtcttccaagacattttgaaatagaagtcagtggtggaggtgaattcttcagcctcctgcaggacctgcatccttcactctggggagaggtaaagccacacgcttcttgctgatggtcctactcttggagaaggtcctgtccttggagaagagctcactctggctggcatctctggagtagaccactcagtctttctcctcctcagccctagcttcatgagatcttttaaaactttctattaatttttgtttttaccacccttaacatcttcttagttttccacgttttagttttaaaaaagaagagaaaaattctagtaaagctctgatcagtatcaactgcagacacgaggctgttttatagcttttataagttatgaatattgttataacaggaggaacaatgatttatttagtgcctattacgaaacaggcactttccatatatgaattccaactaatatattaatttttgaagaaggaacatttcatgggtctgagcttataacagttataagacttataatgcggtctgagcttataatagtttccaagtcttttactgtacacctggctggatcattttccttctgcctcattttgtttattttttcctccgaggagttcaacactctctgtttatttctgatttatgtaggtcatttcaaatctttttttttttttttgagatggagtctcactgtgtcacccaggctggagtgcagtggtgtgatttcagctcactgcaagctccgcctcccaggttcacgccgttcttctgcctcagcctcccgagtagctgggactacaggtacatgccaccatgcccggctaatttttttgtatttttagtagagacagggtttcaccgtgttagccaggatggtctcgatctcctgacctcgtgatccgcctgcctcggcctcccaaagtgctgggattacaggtgtgagccactgcgctcagcctcaaatcttcatttattctttaaggctacagttactttgtacgattgagggttatctacaaatgtagaaggatatgctcttgggatctgtctacaagcctgtgtaattgacccttgacttgagagtggattttcagtggtggtaaatgtggattgagcaagcacagtgatcctgccaaattgtggccttcatggaatcttggaaatcttcatctgctcattattcctagaatttttctagtataggcaacagtctagcaggatgttgacctactgcttttcaggcattatttcaattacttgatcttcttgagatggttattgtctctagagaaacaatataagagctctgggatagtagcagaatgggacagtggttaagagcttggcttctaggatctgaatcttgggttcaaatcttggctttgccactttaagttaataaacacagggacattagttcgcctctttctactggtaaaacaggagtattactggattgctgtaagggttagagaggataacacatgtcaagtgccaagagttgtaccttgttaaggtaagtgttcaaaacaggttaattattatcaggtaaaaaagctgtcacataactatatatatatatatataggctgggtgtggtggctcatgtctgtaatcccagcactttgggaggccaaggtgggcggatcactagatcaggagttcgagaccagcctggccaacatggtgaaaccccatctctactaaaaatacaaaaattatctgggcgttgtggtgcttccctgtaatcgcagctactttgggggggctgaggcaggagaatcgtttgaacccaggaggcagaggctgcagtgagctgagatcacaccactgcactccagcctgggtgacagagtgagactccgtctcaaaaaaaaaatatatatatatatatcccatcatggcaactcccaatcaatccccagcctctcacagcaacccctgttgcctttttcttgaacttcacataaagcaaattttacagtatacactcttatgtgtctggcttctttcatttaacataagcttctgtgattgatccatgctatagcgtgagcagtttgttgctatttgattagaagtattccattgtatgaatataccacaactgtttattcacgagttgatggacattggggttcagttttgcacagttatgaatcaagtagctacgaatattcttgcacgaatctttttaatgaatatgtttttcatttttcttgtactaatgcctacaaatgcaatggctaggtcatgcaataaatgtgtgttcatttataagaaacaaacagttttcaaaaattgttaggccattttacactcctactagcaacgcatgagagtttaaattgctccatacacttaccatgatttagtggtattggtatttttaatttgagccattctagtgggtgtatactggtatctcattgtggctttaatttgtatttccctaaaataaacgttattagtgaaaagcaccttttcatctgcttattggccaatttgtgtatcttcttttgtctgttcaaagcttttgtccatttaagaaatttataattttgtcattgaattgtcagaatatcttatatattctagacacaaattatttgtcagatacacgtattgcgaatatattctcccggttcgcagcttgacttttcattttgatgagcagttatctttaaattttgatgaagtccaatccattagaactttctttcatgttgtgtggttttgtgacctctgtaagacatctctgtctgttcctagttgtaaagatactgtcttctgttttcctctagaaactttgttgttttagcgtttatattgagatctgtgctccctctcaattgtgtgtggtatgagattcatttttcccctgagaagttgctctggcatcatttgttgaaaagacccggctttccccactggactgctttggtgtctctgaggaaaatcaaatgaccatatccatatggatccacttctagactattttttctattgatttatttgtctgcccttatatcagtgccacactgtcttaaattactttagttttacagtaagtcttgaagtcaggtactgtaaggcctctaactctgttgttcttaaagactgttttggctacctcttttggttttctataaagattttagaatctgtaaaaccattttctataaaaatgtcctgcaggtcttttgatcaagattgtgttgaatctatagatcaagatgagaaaaatcgagatgtcaacactatcaagttttccaattcatgaacgtctctccatttagttaggttttaaatttctctcaaagatgttttgtaattttcattatacaagtcttacacttctttggctacatttactcagtttttatgttttttatgtcagtttaaatggaattgctttttaaatctcattttccaattgtttattgttgataaatggaaacacaatagatttttggttattgacctttataagtttacttactgattctagtacttgtttagtagtagtccttagattcttaggactttgtccataaacagtaattattttcaatctttatgtctactacttcctttccttgccttattgcctgaccaaaacctccaggacaatgttgaatagaggtgataagggtagatatcattgctgtattcctgatcttaggaagaagtgcttggaaattcactattgaatatgaatttagcagtaggtttttcaatttttttttttttttcagaaggagtctcactctgttggccaggctggactgcagtggcacgatctcagcccactgcaagctctgcctcccgggttcatgccattctcctgcctcagcctcccgagtagctgggactacaggtgcccgccaccatgcccggctaattttttgtatttttagtagagacgggttttcaccgtgttaagccaggatggtcttgatctcctgacctcatgatccacccgccttggcctcccaaagtgctgggattataggtgtgagccaacgcgcccggccttttttttttttttttttttcctgatggccatcattagaataaataagtttccttctagtcctagttggctgggagtgttttttttttctttttaaatcatgaatggatgctccattttgccagaagctttttctgcatctatttagatgaccatgtggtttttcttccttattctattcatatagtggaatacattaagtgattttctaatggtaaaccaaccatgcactcctgtgataaatcctgcttagtcatagtgaattacattattttcatgcgtcactgaatcagatatgctaatatgttgtgaataatttttgcatcagtgtttgtgcaaacattgatgggatattgtatgatatttttcttttcttatcaagtttatgtcaggttttggtatcagggttgtactgaccttatacaataaattgggtagttttccttctccctttattttctgaaagtttgtataagagtgttagttcatttgttggtgttccattgatataaatatatcttaaagttttcatagaatttaccagtgaccttttgagtattataaaatgtccttttttgcctcttatactctttgtcttgaagtctatgtggtagcattaatatggtcacgaatcagctttcttatgcttattatttacatagtttatcttttctgtcttctggcttcaacctacttgtgttttatttaaagtacgtattggccgggcacggtggctcacgccttaatcccagcactttgtgaggccgaggagggtggatcacaaggtcaggagatggagaccacggtgaaaccccatctctactaaaaatacaaaaaattagccgggcatggtggcgggcgcctgtagtcccagctactcaggaggctgaggcaggagaatggcgtgaacccgggaggcggagcttgcagtgagctgagatcgcgccaatgcactccagcctgggtgacagagcgagactccgtatcaaaaataaataaataaacaaacaaacaaataaataaagtacgtatcatgtagaccgcaggcagtcttaattttgtagctggtctgacaatcttttccttttaattggagttttttcagtccatgctatagtttggatatggtttgtctgtctccatcaaatctcatgttggaatttgatccccagtgtggtggtattgggagctggggcccagagggtggtgtctgggtcatgggcatggatgcctcataaacagattaatgtcctccctgaaggtgagtgagttctcactcttgagataataaattagctctagaggagatgaaagagttcctggaagagtaggttgttataaagccagaccatctcttaggtttccctcttcgcacctgcccatttcccctttgcccttctctatcatgttttgatgcagcatagaagtcctcaccagaagccaagcagatgctgatgccctgcttcccatacagcctgcagaaccgcgagctaaggatgcctcttttcttcataaaccacccaggatcaggtattctgtaatagcaacactaaatggactatgacagtccatttgtatttaatgcagttactaatatgactgggttcaggtttactatttttcaatttgttttctattgataccttctgtttttcatttctggtctttctttcccgccatcttttatgttaatctattttttagtattttattttaattcctacaatgacttcttagctctgctgcttttggatatttgtttttagtggtttctctgggtattataccacacatctttatcttatccccagtctatttagatttaatgtcatatcacttcacataaaatgtaaaaactttgcagttgtgtagaattccacttgccttcccttattgtttgtgctattttgttatatattttacatctgcatacatcacaaatcccacaaaataatattttgattcttacattaattaaaaaaagatttacccacatatttattatttcctataaatattttcttcttgtaggtttgagcttccatctcatattattaccctgtggcctgacaaattttctttgtcaatttattgtagtgtaggcctactggaaatgaattctctcatattttgtacatcccaacatgtctttattttactgtcaattctgaaggatatttttgattatttagaattctgggttgggtgtggtggctcatgcctgtaaccccagcactttcggaggccaaggtgggcggatcatgagatcaggagattgagatcatcctggccaacatggtgaaatcctgtctctactaaaaatacaaaaattagctgggcatggtggcacgcacctgtagtcccagctactcaggaagctgaggcaggacaatcgcttgaacctgggaggcagaggttgcagtgagctgagatagcaccactacactccagcctggggacagagtgagactctgtctcaaaaaaaaaaagaaaaaaaaaaagaattctggcttgacagttcttcctttttctcttttgtctttcagcaccttaaagatgcctttgcactgtattacatatttgtgatgagaattcttcagttaattgtatctgtgttcccctgtgtataagatattatttttctctggctgtcttaaagattttctttttctgtttagtttcccataatgttccacggtgtagttttatttgtgtttatcttgcttgcagcttgctgagcttcttgaatctataaattaatgttttcatccaatttgggaagttttcagctattattccttcagatattttttcaggtctattttgtctctcctctcctcctggcatcacaatgcatgtatatcagactacttgatattatcctacaattcactgaggctctgttgattgttttttaatctttattctgtttttcacattgaacaattcttactgatatgagtttaagtttactgattattttttcatttctatgcttcatttatttcaaatgttacatttttcagttccagagttttcatttggttattcttattggtttccattatcctgctgagattctccttcttttcagtcatgatgactatgttttcctttacatccttggacatattatagtagttgctttataattcttgtctgaaaattctaatatctaggtcacctcaagatctattacagtggctattttttctcttgattatgggtcacattttcccactcatatgtcttttaagttttggttagataatgaacactgtaaattttgttttagagattccaaactctcttcttttaaacaatgttgattgttttttgttctatcaggcaataaaatctctagctgattagcttgagcttttgggtacttagtgttatactttgttaggaaggatctgtttcggttttgcccttaatgttacggtgactcctttacactgaaagcacacaccccttctggggtttcaatagaaaatctgaggcatttaccaagcccctctaacttgggtgggattcagattctgaactttgtaggcagtagctgtaggcagtaggcagcagctgaaaagagtctctgctcagcatttttggctttctagttattgttttccactacgctcattggcatattccccacacatatgcagtttaggggttattcaaggattgatggaaatttatatacagaatggagggctctcttctttatggctcttttctttctgtgacttactcaattcccagccactctggcagccctaaactctatcccctgacacctcaagccattacagctgtggctttctccttgagttctaattgttctttgtggactggggcatgccttcatgggagaagctatataaacatagttctcactctttcaaggatcaaatgaccctctttcaaggatcaaatttcctacattctctgccttcttttagttagactatgaatagtttttttaacaaaagtattttgtccagagtttgtaacagctatctgcaggagagttagtctaagataggttcttccatcattaatataactggaagtctgtcacagacattttaatttgtgcttttgtgtgtgcacgcatgttaagattaaatcgctcctttcattgccctgaatgctcataggatcactaaataatatatattgaaggattactcgggtgttgtccagactgtgtcatactgccaagcattgaccatctgaaaccaatcatgatcgatctcccgtttttaaaggaggccatgaagaaagatgcttccttaggaaataagctcttctgtttggagactcccaaccttgtattacaatttaagtccatataatggctttaatgactcagggtcatagagttatacagacagagggatgtataggccttactgaagccacactggttccaccacaccatgaatatgagagaggcatctttcccagtgccccatgcttgctagccctgttttcttcgctctgctccactcctgcagctgccatggagcctattatgtttcatgttttacttaggctgtctccccttttcccattttcagaaatctgtgtacccctggttctgtttacctgacttctgaatcactctgattactctgccccttaatgttacaggccaaactacttcttcccaaaatttatatgttgaaatcctaacttccagtgcctcagaatgtgactttatttagtgacagggtctttacagaggtaatcaagttaaaatgacgtcattagggtgggccctaatccaatatgactgctgactatataaacagacacagagatagacatgcacagagagacgatgacgtgaggacacgttgggaggagacggtcacctacaagcgaaggagagaggccggggataactcctctctttacatctcccagaagcaaccaaccctgctgacaccctgactgggacttccagcctccagaaccatgagaaaataaatttctgttactttcgccacctacttgctggtactttgctctggcagccctaccagatcagtatgcttgccacttaacaaatcctctgctcccaattttcctacttgattgtgactcatggctttagtttgtctcttgagacccacaccccctcttggtatggaaaatgggcaaaaatcagaaggtttatgctctaactcctcacttcagtggaatgacctttctttttttttttttttttttgagacacagtctcatgctgttgcccaggctggagtgcagtggtgcaatcttggctcactgcaaccttcgcctcctaggttcaagcaattctcctgcctcagcctccccagtagctgggattacaggcgcatgccaccacactcagctaatttttgtgtttttagtagaggtggggtttcgccatgttggccaggctggtttcaaacttctgacttcaggtgatccacccacctgggcctcccaaagtgctgggattacaagtgtgagacaccgcacctggcctggagtgacctttctgatcctcagattccttatccataatatggggatattgtttctatcctacctacctaaaaaagctcagatagatgctgcacataagaatgtaaaatactacacaaatcaaaggcatcctgaatctcactctttatccgtaatgtactgtacctcatacccaattataacagaacctctgttagaggtctcttgagcggtttcaagttcagaattctccattcataggagagatgcttgcaacctgttatttctagtttaagaggcaggtgcctaagaaaccgttttgctcaaagaggcaggaatatggggtgatgcttcaagctcccattgtttttatatttccagagggtttaaaagtaattcctcagacaacttacctattttttttcttttttttttctgagatagaatctccctctgtcacccaggctggagtgcagtggtgcgatctctgctcactgcaacctccgcctcccgggttcaagtgattctcctgactcagccacctgagtagctgagattacaggcacgcgccaccatgcccagctaatttttttttgtatttttggtagagatggggtttcagcatgatggtcaggctagtttcgaactcctgacctcgtgatccgccccccttggcctcccaaagtgctgggattacaggtgtgagccaccgtgcctggccaacttacctattttcatagatgttataagaaataaggtacagagtaaagcaaaccagtgcttttaggcaataaactttttatttttttatttattatttttgagacagtcttactttgtcacccaggctggagcacagtggcatgatcctgggtttaagctattcttgtgcctcagcctcccgtgtagctgggattacaggtgtctgccaccacacccagctaatttttgtatttttagtagagacgaggttttgccattttggccaggctggtctcaaattcctggtctcaagtgatctgcctgcctcggcctcccaaagtgttgggattacaagcgtgagccactgagcctggctgggaacggacattttagaaatacgtaagggaaggagaactttagaagcacatccaactgccttaaccaaatgggtgcctactgaatgtgatttttaactatgtaaaattaaatgtaggatgctagtcactttccaacatactttgtatattctttgtcagtctttaaaataatttcattattgagaatttgaaaaaattgtttctacaattaaaacttttataaaataatttattaaaaaatacaacttcccccaaatagcttacattctggttgcatgaatttttatgcagtttctactgttactcaaaagaactgaattttcaatgattctacccttttcagttctctagaatgcctccagatggcattaaaagcctttcccattatattttacaacacaaaaaaattaaaaattagtaacattttaaccatttaagaccagtcacattcattataacatctgaaagcaggacaatggaactatttaaacttttagggaagtatcttaagaaagacaaacatataatcatatctcttatgaaatacacagctctcctattcaagccaaaggatctttctagacaaagaaacagattttggacaaaataagacactcagtattttaccacaaactgatttccaatcaacagcacttaaaaaatgctgttttttaaaatcctgatccccatacagataaattcacaaagcctatcttataataagaaaacacatgccactgctcataagtgataaaaataaagatttttaaggagcaaacctgttattgactcttatggaactaaaataaagtcacttgttagctcatgaattttttaatttaaatgttggtatatcaatttggcatcaaattaatcagtaaaaatatatttggattccttgaatattgagaagaaacagacaaaacatagagtgaggagcacatgttttataagggccttttcttatgtttttaaaactgcttttgttaattcaaaaaagaaactcttgagattccagagatatcgataattgtgcttttcacataattccaaggtgaggttgcagatggcaagcttctgaaatgaccttgttactgcacagctgtgtgggacagcatacctcccagtttaagtgtgaaaagttctgcaattcttaagatgatgctgaaagtctccaaccaaatccccccagcatacatgctcaaatctcattacatttctacttcataaagagaagcatttgcatttttcaagattcctcttactctgctaaagcataaaaaatgcatctgcacccaaagcatttagaaagacattatcatgagaaaagagaaccatgggcttccttccatcatcattattactattacaagatacttgcactatctcattttatgaggcatatttaagaacaggcatctctgatagaaaatgaaagaaacttacgatgtattcgatgtgccactgtctggactctctggctctgcatcacctttctcttaaaaaggaagcagaaaaaaataccgacatatgagtcttacagtctttaagatttaagagagattaaatatatttccatgctcctattaacaatctttcaaaatgtgtagcaggaggcttttaaaacatcttttattgtctgagaaccggatttgcaaaataatttcttttctgcaatgcaactgcccaggcacaaatctgtgagtaggtactgaggagctatttgcaaacaaccagaggcttggagtggagactttgccagaagatgaatatcttacagatggaacctgtttccttccacttcactttacagaaaatttcaggaaataaatccattggcattctatatccaaggcactttgaactttgattgcttctgctaacataagccaaaccaggtcaggctgaatcagaacttggaggaaagaattttttttttttttttttttgaggcagagtctcactctgtcacccaggctggagtgcagtggcacaatctcggctcactgcaacctccacctcccgggttcaagcaattctccagtctcagcctcccgagtagctgggactacaggtgcctgccaccacacctggctgatttttatattttttgtagagacagggtttcaccatgttggccaggctggtctcgaactcctgacctcaagtgatctgcccgcctcggcctctcaaagtgttggaattacaggcgtgaaccaccacgtccggccaggaggagagaatttttactgaacactgaggttgcactgtaggtcccaagatccccctattttataccccatagagagccctggtggcaggttttggggcccctagcttaaagcagaatgagatgtaaaccagaaatcctttctgaccatctgaaaggctagttaaggaaatgcttctgtgggctgtgatcactgaggaattaacgagttgtacgtagttgggggagcttggaaccagttcacttcttgtagtttacagtaggcttaatgtaattcctaatccttaatcaattggtggtttgaaccatgcatcctcattctgtaaggagtttctttgtatttccttgaggcttggagatggaagaagtcactgataactgagagcgtgggctcgtgtgtttcctgatggttgtgcagagccaatacaccccagagaaggctgtgagttgcaagaaataggactgtggtagtaacttggtttgctatgctctttcaagtcaggcctggagatctctagaatcccttggtctactgctcacgtccttgggcccacacattgtaccataccccttttgtcagctgtcaacattagcttgtcgtcacctagtcccaggaatgactccctaaattacataatgaacatatcccaaaggtattgcccaaactgaactcaaaagcaaactttatatgtccttctctttttcttataggaataaacagttgtgagaaaaagaagacacagtttctacagttcgtacatctatctcagacatttatccagtgccagaacagctatgagggactttggctaaaagctggtcagatgagggggaaaaacaaaaaagccacaaaatctattttaactgccttgataacaaacattgattaggcagggcctcaatacatataaaaccatgttggaataaaggctaaagtagcaaattaataaatttgctttaaagctcattcttgtatattttcttttgtcttccaggcaaggtctgtggtgcactcatttaggaggcaaataaggcctgttcaactggtttcagtgctggaaaataatttagtactttgcagaaacattttttccatggactaaccacaatccctcttgtaatcctaaaatagagagttataacacctgcattatataagacaaaactaaatggaagtatattttttttctcaaatatatggatcctttcccccaacctgctttaatttggtgaaactggttactttccccagtctctagcctgcagtagttaccacattccatcttaatgaagaatgtaaaacagcaggcttggaagcagcaggcaatggtaaaattcccaaacaatttatgtcagaaaacaggaaattgaaaataaaaacgaaggcattgtttggatgtttgaagaaatatgttttgccttgaccaatcatgctgcccaagtcttcagcatggggacagatgcgcagctgattatctttgctcttagcagcacttatgttgtggcaacagggcaaacagaataggttctggcaaataggaaggatatagtggggccaaacaggacatggtgaacagtctgagagggagtgttctcagcaaattcagtgctgataatgaatttgcctttctggggggaaaagtaagctggtcaggaacgagatgggattaaaactatttttgtccttcagaaagaataaaacacaaagcttcccccacatcttgaaattttaggtgatgaaatttctgaagttaacttgaaatgtttaagtgtatacaccactgagaattatggtctctttattaggacccaagggaaaatgatgaatgtaatggaacattctagaacattagtacaaatttttttttttttagttgggtgtgcaggagatgtttcccaccccgccccctgcccgccccaccatccaaagacagctgtctccagggtcctcctgtttgtgtcagctgttttcatgatggatatttcatgatggaccaatgtttcacactggtctctttgggagggaatctgcattggtcattaataagctgggtgcagggaagccattttacatgcggaaatacaattacagagaggaagaggggaaaaaatgagccacggaaagaactatatatgcaaatatatatgcatatatgtaaatatatgtaaaatctatgtatctatgtgtattatacactttcaatttgacagtccatatttgtctggctgggccttccacattgcctaacatacactaggtgctcagtatgtgtcttctgttctgatgccctgtcactaatacagaattccatgctgcagtgggaaaagatgcttaaggtaccctcgccagtgagacgaaatatacagtttgagatatgaaacagcttgctgactccaataggtcacttaaaaaattataacagttacctttttaacgcaatgtacagaggacttctatgttgggtgctcttgtgagcataaagataaataatgtggaattcatgctctttaaacatttaaatggactgcactgctggagtatcttactttccatcaatagtgtcatatagggactaaatatgttttttgaaaagaaaatcaaaataatcctgcattaaactgaattctgcacagggaagttttgctatactgcaactttttttttttttttttgagatggggtctcactctgttgcccaggctggagtgcagtggtgcactctcttcactgcaacctctgcctcctgggttcaaagcgattctcctgcctcagcctcccgagtagctgggactacaggtgcctgccaccatgcccggctaatgtttttatttttagtagagacgaggtttcaccatattggccaggctggtctccaactcctgaccttgtgatctgcctgacttagcctcccaaagtgctgagattacaggtgtgagccaccgtgctcggccatatactgccacatttctacacagttatatcaaaagcaatccatgtttatggttttaaaaaaatgaacagaaaagaaaaggtaatgactttgcttacttttattttaaattctgttagcccttcaatgattagtctaagtgatgtgtttttctttgcttgagatggagtcccagtctgttgcccagactggagtgcagtggtgcaatcttggcttactgcaatctctgcctcccgggtaatctcaagtgattctcctgcctcagcctcctgagcagctgggattacagctgcatgccaaaacacctggctaatttttatatttttagtagagatggggtttcaccatgttggccaggctgctctcgaaatcctggcctcaagtaatctgccctccttggcttcccaaagtgctgggattacaggtgtaagctaccgtgcccagccaatgcgtttttatttctagatgtaccaactttagacagtgcctaatgatttctgatatgaaagacaagaggcaaggtatttaatagtctcccctcccttataatttttattagttctgttattatttttagtgcctctagtgggcatttgtaactttaaatatatttaatcttatttctcttgattaatcaccttctgacagtatcttttctttcataccatgtaaaatgaggaaactcacccatctatccttccctcccacctccccgctcacagctatgtctttccttttatatcaccaagatttaaaatattcatactctgttcagtaattattgagtcatcctccttaatactaatttagttaataatttaatttttggtcttgcctataggtcaagtaaaaaatcataaaccaataatgagaatttgcaatattgtgacaatataaatattagtcactaaagaagaaagcagcttgagtagacctgaacaggaggcaatgtcactaaggtagaatgagtgcaaatgttcccgacatttatgtcaaatgaattctcattgttatgttctaccacgtcacaggtttgtctcaagctaaggttatgttctccctaaaatactgttaaatagagcacgcatttagtgaacataaaatgtatatttacatgaaatgtatatagacactttcaaagcattaaaatgaatgaactgtgaaaacaccttccaggccagggatggaacatcatcgaaagtgccttcactggctcccatctcttcccacccttcccaccagctattggtaaaagaattgtggctgggcacagtggctcacgcctgtaatcccagcactttgggaggctgaggcaggcagatcacgaggtcaggagattgagaccatcctggctaacatggtgaaaccccgtctctactaaaaatacaaaaaaattagccaggcgtggtggtgggcgcctgtagtcctagctactcgggaggctgaggcaggagaatggcatgaacctggagcttgcagtgagccgagattgtgccactgcactccagcctgggcaacagagcgagactctgtctcaaaaaaaaaaaaaaaaagaattgtgtgttaatcattctctttgttttctggagagttttttttttctttttaaccgcctatgtatgtattaataaattaactctgttttggtagttgttgtttctaaacttcatacgactctaatcatacctaggcattcttctgagactcacttctatcatgcagtgttatgaattttagatttagccatcatcctgcatgtagctacagtttgttcatcctcactgctgtgcaatactttattgtataaatataccagtttcttatttgttcttctcctgatggacatttagatttttgccatcatgaacaatagaactgcaaacattcatgaacacccttcctcatgcacatgttaggagttctgggccttaagacttccatatggccaactttagcagggaatccaaaactgatttccaaattaacactccccagacagtatatgagacttcaaactgattcacatccataccaacacttgttatgatcaaggttttaaagttttttctaatttaataatgtagaatataattttgttgtggtgtctgcatttctctgagcactaatgaggtaaatattttgtacttgctcttctgtgtcatttcttaaaaattattttttagtattaatttcttattcatagaaacattttattgtctcaataagagtcatacatatagtcgtgtgtgtgtgcgtgtataacttttcaatacatatataaaacttggccgggcgcggtagttcatgcctgtaatcctagcactttgggaggccgaggcaggcggatcatgaggtcaggagattgagaccatcctggctaacacagtgaaaccctgtttctactaaaaatataaaaaattagccgggtgtggtggcgggcgccttgtagtcccagctactagaaaggctgaggcaggagaattgcttgaacctgggaggtggaggttgcagtgagccaagatcgcgccactgcactccagcctgggcgacagagcgagactccgtccaaaaaaaaaaaaaaccaaaacaacaacaacaacaacaacaaaacttttcccagtgttagcctttttattttttctattatctttggataatgttaagttcttaattttaatgtactcaaatttatagataattttctttatttgacactttttgtgatttaagaaaaacatcagaaaaatgttttatactgtcttctaaaagtatatacttttactgatttttaaaaaatacctggattggtttttgtatatggcgtggggtaggagttaagtttcgtttttctccctagaaataaccagttattatggtacttgaagtccattctttctctattaatctatatcatcatctctgccatgagtccagttttcatacgcctgtggatctgcttctgggtctctactcactcactttcattgctcaatttgtctattactgccctcattacttagctttaatatatatttaaaaatattcgtaaggcaaagctccaaccttgctatttaggaacatcttggctattcttagccctttgatctattgtataaatttgagtatcatcagtttgtcaatttccacatacccaaaagttggaaatttgattggagctgtattaaatctatagatatctgaagagaacttgtatctttacaacactgcatcttccaattcatgtacttggtattaggcgtctccatttattttgatatttcttaacgtatttcaatagtttgttaattttctccatagaggtcttaacacatctcttgacagggttattgcttagtaacttatatttttatactaatattaaaagttttaaactataattttcagttgttagtgtagggaaatgaaattaattgtgtatacagcaatcttgctaaattttcttattaatcctaataatctgtagattcttttgagttttctgcataaacaatataatttgagaaaatgaatgttcttctcctttctaacaggtacttttttttcttaatttattgcctcgaccaaggatgtccatccagtataatgttgcataaaagtggaactcatgtcttgttcctcatcttgaggggaacgctgcaaatgtttcaacactaaataggattcttgttttgagtttttttggcagatactgttattgtgttaatgaagtgggcttctattcctgatttgctatttttcctttaaatcatgtatagtgaattttatcaaatgctttttcttaatttattgaaacaatcctatttttcttttaatattttaatataattaatcatgttaatattataaaaaggatccaattttgaattcctaaaataagtacagtttcttaattatgagttatattttaaaatatattttgtacttggctggatggaatttacaaatatttgacctagaatttttacatttatgatcatgaatgatacctgtgaattctttttcttgtactggcttgtcaagttttgatatcaaggttatactgccttgatataatgagttgagaactgctggctttttctaattctctgaagaagggtgtaggtttggaattacctcttcctgtgagtttggtagaattcttagtaaaaatgtctagccttgaaattgtgtggtggaatgatttttaaaaaattactgggccaattgttaaaacggctataggattattcaggttatatttatatgtaaatttcatataaaacatatacatatatacatgtaatacctgaaaaatcattttaatcatagtcatttcgtctagttttgaaaaaattttggtataattttgcacataacatatttttgttcttgatctgcatcacagtttattccctttttgattcctaatattatttatttgtgccttttctctttttgtcctgatcaatctctctgcaaagtttgtcaactgtattataacttcattgaataaacttttggctccattgacatttaaaattttatctctgctattttattaatttctgcttttgttttttttttgtaaatctcttttccatttgttttgggtttattttctcttctttcagctcttaagatagatgcttagttcattaattttttgtttgctagtatgagtcatttccttatttatttagagacggagtctcactctgtcatccaggctggagtgcagaggtgagatctcggctcacagcaacctccgcctcccaggctcaagcgattctcctgcctcagtctcccgagtagctgggactacaggcgcctgccaccacacccagctaaattttgtatttttagtagagatggggtttcaccacgttggccagactggtctcgaattcctgacctcaatggatccgcccacctcagcctcctaaagcactgggattacaggcgtgagccactgcacccagcttctagtatgagtatttcagatgcaaagctgcaactttccctctaatttagtttcttcctccagttttaatattaggtatttctattacctttcagtcccaaatatttactaatatctagagtgattcttaatttctaaacatgtgttttccctcctagtcatattttcattatcaatttctaatttaatcatactgtggttggagaccatggtaaatataatatttatcttttaaaatctgttgaaacttgctttatggtccagtagttgtcaattttcataactgttccctgtctgcttgaaaataatgcatattctgcagctgttgggtaatgtactcttgctcattgtgttgtttaaatcttatgtatccttactaatttttctgtttgcattatacaacagttacgaatttctgtttacatcttccattaagataatacatttccccttgtaatttgtgacttttacttttaaaaatttgaagctttgctatttggaatttacatatatcaaattattttgtccatatggtaagttgtatctttccttgggtagtgaccctttttaactgtagtaatgctttttgcttaaagtttatttttctggtatcagaataaacatatcatgcttttttatcaccagtatttggctggcatatattttcctaacctttttcctttcaaattttctgaatctttaatttctaaatgtgtcattgtaaatagcacagagctagagttttattttttaaatcaatttggtcaatatttgttattgaatcattgcatctaatccatttgtttaaattactgatttttttttttttttttttgagacggagtctcactctgttgcccaggctggagtgcagtggcacaatcttggctcactgcaacctccacctcccaggttcaagcgattctcctgcctcagcctcctgagtagctaggactacaggcatacgccaccacgcccggctaatttttgtatttttagtagagatggggtttcaccatgttggccaggcttgtctcgaactcctggcctcaagtgatctgcccacctcggtctcccaaactgctgggattacaggcgtgagccaccacgcccggcctttaaattactgatttaatttatgctaccatatttttccatatactctgtttcattttctcttcttcaattcttttggattaactaataatattcatattctatttttagcttggtttgtaagatgttctccacatttagtttgtaggttaaataccttttagtatagtttagtgggtaccctacaaattgcaaatatttacttaatttatcaaagcccaaagttaaaatttttatccttctccaaaataattacaggaacttagaagattttaattccacattctcatcttattttatgctattgttttgtggattccaattgtatttattttgattacttaacaatatattattactggtgcatgcaatcaacattgtttaaattttccccatatttactttcactgcatttaatctttctcgcacctcacattccttctgaacaaagtatgtcttttaaaatttcttttgtgaggatttactggtggcatactttcccagcttttgtctgaaaatgtcttgactcattaaattttttttttgcaagatacacaatcctaagctgatagttattttttcccaactcagtgatgcttcagcttctctgtttgcaggctcccactgatgctgttgtgaagtcaggtgtaagttggttgagttgttgaagatattaaagggtattttaatttttatgtgcactttagctataatgtgtgtagtgtggacttttttttttttcatttatccttggtattcactgggtttcttgactctgtggattaatgtctttcaagtctggaaaattctcagccatcaatcatcttcagtactgtctcgcttccctttccctttctgaaattctagttagatgcatgttagacttccccactttatctccatgtctcttaactaatttcctgttttccatttctgtctctctaggctgcattctagataatttcttaaattcaactttccaattcattaattctttctcagctatgtctaatgtgctgttacatctgcccatggaaattctaattcctattatattattttattcctagaattctgtttaacactcctccaagttttcttgctctttaccacatttccaatcctctcttttatttccagaaattaaagcaagggctctaatttcacattctaggcttgataaccccagtttctgaattaggagtctgattctccgctgtcctgtttgttcttgctcttgctcgtggtctcgtttccttttttgtaaggggttcttttctgattgtaagttgctcatttcccttagtgctctatttctgttattattcattcctctccattttctttttctgccaccttgactggctgtgtatcttcaatccctttcatattttccatctgtgttttgctttatactcagaaaaaaaaagttttcaactttatattcaacgtttcagacttcagctattatcatcccttctattgtttgtcaatcatatttttaattctcaagtgttcatttgttctgtaattacctctttttcataccaatctgttctctttttatttaacacaaataatttcaaatctttctaaggactgcaattatacttgaaacttttttcttctttaccttgaattagatttcctagatttcctttgggactagtctttctttttggcgtcactggttatatattcatatttttaaataaaaaattggttaacaaaggtagttggcgtggctttcctgtatcagtattccgatcaatttttctaacacacctatcctttgtagggaagagctgatttatggctctttgtaagtgggcagggtatgctgatgtgaaggattcatttagggctcaagagaagagaagcctccaggcaagctgtaagcccaagcccttcctccacccactcctctaagaaaaatataaagcactgtactttaggtgtatagaatttttgtttatttcccttgagaaatagttgactcttctgccattactccatgtcatctatttttaaggtctggtactatcttagaatgtattctgtttctctctttggtattagttctcagtgaggagtgaactgttcaattttttttttttttagcaaatattatggtactttttgtttttgggggtttttgagaaaaaatcatcctgaaagctctgtgtgggaatccgtgaggatgggggtggaggggtaatggttgaaggatggccaggtgttcccatcactgcaagcaattcgcacttgttctctcttggggtccagtggaaatgtggtctttcctggggctcctgggggctgttcccaccaccactaaaacttgttcctgtctgattcttcctttgctgtgtcacgaccttccctgttcaggggtatttttcagtagggttttattactttcggctttccagaacacaactaaatttctggtttgctgatggcacttattctgatggtgctattttggatttatttccatttctacagcttcatggctattaggtggggattctgaaggaaggggaaggattgcttaaatgcagtcactcaactgaacaggacgttctcataatttttaaaaatgtagacataaatcatccatgttaatattcaagtatctcaatgcttaataagcttccattttataatatcaagttcaattgatcagtaattcagcaaacgatctaccttttaaaagatttgtattgaaagtcattttctgtttatacaatctttcctttagtatctataatacagtctttctcacttcaaagagaatagaagcactggcctaaaataatgagttagtaatcaatccacacagatattttgtttttggtttctctgaagctcagtatttctctatttcttttttttaatttttattttattattattatactttaagttttagggtacatgtgcacaatgtgcaggttagttacatatgtatacatgtgccatgctggtgtgctgcacccattaactcatcatttaacattaggtatatctcctaaagctatccctcccccctccccccaccccacaacagtccccagagtgtaatgttccccttcctgtgtccatgtgttctcattgttcaattcccatctatgagtgagaatatgcggtgtttggttttttgttcttgcgatagtttactgagaatgatgagttccaatttcatctatgtccctacaaaggacgtgaactcatcattttttatggctgcatagtattccatggtgtatatgtgccacattttcttaatccagtctgtcattgttggacatttgggttggttccaagtctttgctattgtgaatagtgccgcaataaacatacgtgtgcatgtgtctttatagcagcatgatttatagtcctttgggtatatacccagtaatgggatggctgcgtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgctcactttttgatggggttgtttgttttttttcttgtaaatttgtttgagttcattgtaggttctggatattagccctttgtcagatgagtaggttgtgaaaattttctcccattttgtaggttgcctgttcactctgatggtagtttcttttgctgtgcagaagctctttagtttaattagatgccatttgtcaattttggcttttgttgccattttgacatgaagtccttgccaatgcctatgtcctgaatagtaatgcctaggttttcttctagggtttttatggttttaggtctaacgtttaagtctttaatccatcttgaattaatttttgtataaggtgtaaggaaggcatccagtttcagctttctacatatggttagccagttttcccagcaccatttattaaatagggaatcctttccccattgcttgtttttctcaggtttgtcaaagatcagatagttgtagacatgcggcgttatttctggaagcattccctttgaaaactggcacaagacagggatgccctctctcatcactcctattcaacatagtgttggaagttctggccagggcaattaggcaggagaaggaaacaaagggtattcaattaggaaaagaggaagtcaaattgtctctgtttgcagatgacatgattgtatatctagaaaaccccattgtctcagcccaaaatctccttaagctgagaggcaacttcagcaaagtctcaggatacaaaatcaacgtacaaaaatcacaagcattcttatacaccaacaacagacaaacagagagccaaatcatgagtgaactcccattcacaattgcttgaaagagaataaaatacctaggaatccaacttacaagggacgtgaaggacctcttcaaggagaactacaagccactgctcaatgaaataaaagaagatacaaacaaacggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctgtaggcatcacactacctgacttcaaactatactacaaggctacagtaaccaaaacagcatggtactggtaccaaaacagagtatttctccatttcttacatgtttactggaatcatgattcctaaccatatacaaaaacagcaagggaaatgctggtggggtcagttctcctaaagtttcaaatgtgctgtaaattgcagagaattctcagacttaataggaatattatttttgtatacatgtgctggggttttggagaaagatttatttaaaaatgaaaaaaggccaggtgtggtggctcacacctataatctcagcacttttggaggccaaggcaagaggaccgcttgaggccaggagttcaagaccagcctgtgcaacatagtgaaatgctgtctataagaaaaattttaaaaagtggtatgtgcctgtagtcctggctacttgggaagctaatgtgggaggattgcttgagcccaggaattcaaggttatagtgagctataattgtgtcactgtactctagcctgggcaacagagcaagaccttgtctcaagaaaatgaaattaaaaaaaaaatccccttactcctagaaaagaaaaagccaatcaaaaacctttcttggacaatgaaatgccagagggttttataccacacagggatagtgccacatcatgtcttgtagaagaagcatccgtttttatagaatctaaattgcagtgaatattatagcatgccataaaaatatgccgggtgcacacagaaatcacagcagacagtccttggacaataattcaatctcacggtgaagtgatagcagcagctttctgggaatcaacagagtgggatgaaaagctcgtgtctttggggcagagagccctgaattcaaattctagctgtcatttttttagccaggtgattaaaaaatgactcgttattagcctcagaaactcatcttcttcatgtgaacactgagatcatgcagctcatgcagctattgtaaagattaagtgaaatactgtaagtcaggacgctagcgcagaatagacactcaacaagaatttcctttgctcttctgtctgtcaaaaatgccaagctggcagaaggtgcatttattcatctgtgggattccccctttaccctgaacatttaaattcaatggtgagacacagggaggaaagcaagggtaactcttcaagacactctagtctgtggtgtgcgatgctgacgtctgtataccacgacgtggacttaaccaagtgtttcttctgatctcttttcttaggactaaattcatcattttcttcagatttcatgtcttttgtcattttgcctcatcgctggtgcctgtacccacagcaaatcccaacagagggtgggataattaagtgatattgcctccgcaccactgtgccatcaccccctccaccggcctttctctagctgcgcatgaaaattctgctgcttcccagtgcatttgccaggacatcttttctctccggcccatttgcctcacagatgcccagtggttgagcctcagttccacagacagatctacagctcagaggatgttcagtcttcaaatgcagctttgtaattggcaaggggtgctcttagcttgctggctggtcgtgaaactaacaaagcccagtctttgtgagtgtgcttttaggacacgagcagggtagcttatgaatttttaatgctcaagccaacgttaataccaattagtagtgccaaagaagagaattaaaacactacttcatggaatgatagcatcctctctttgacaaaaaagcccatgtgttttaatagccaccaattcaataaggaaactgcttcttagatagttgagtctgtctatttctggaagagggcacagtacatatacccagccggttgtgacttttcttcatggattctaaggtcaattatcttaaggtctactgattgattttctttgcccactcattttcctttaatttagacaaccaattatgtgccttttaagtttttttctccctccacatatactaggaacagccataataaagcatgaagttcctttctcttgggatggctttgaaattcaccattttctgttttggccttcctttccttgaatatgcacacttaaggtcatcataaatcttattcatttgggcagcacttgaacaaatggcccctttccccagttttttagtgaatttctttgaaacctactgtccaatgtgtgctcatcctccctccccttctgccctctgcccccaccccctgctccccagatgaaactccagagcgaagtctttcttacttggattattgtgtccagaggatacaagctgagagtcctgaaagaacaagaaatatcaattaattttcttattttgactttcaaaatccaagttaaacatgagatcatgtttaaaactggtcattcagaaccgattcattgctctcaatctctatcagctactttaatgagaaacatatacatgaaggtggacacatacatgttaagcagttctgggaatatacttcacaatcatttttcttttgtattaatgactttctgttttgtttattgaggtgaagttcacataacattaaaattaaccattttaaagtgaacaattcagtggcatttggtactttcataaggttgtgcaaccactacctctatctagttacaaaatatttccatcactctgaagtcaaatcccttacccattaagcagggtctcccatacccctgccctcccaatgccccagcccctcacaaccaccaatttccatctgtctcttggatttatctattctggatatttcatataaatggaatcatacaatatgtgacctttgtgactggctttttacttaacataatgtttttgaggttcatccactctgtagcatgtatcggttcttcattctttttatggctgaataatattgcgtcacatggatatacaacaatgtgtttatccattcatctgttaatgggtatttgggctgtttctaccttttggatattgtaaataatactgccacgaatatgcaggtatgtacactagttcgagtccatgttttcaatccttttgtgtatatacttaggagcagaatttctgggttatataactctatgttaaactttttaaggaactgccaaacgattttccacagcagtgaaaccattttgcaatccaacaatgtttgagggttccaatttatctacacccttgtcaatgcttgttattttccattaaaaaatgatagctatccttgtgtgtatgaagtggtatctcactgcagttttgatttgtatttccctaataactaatgatgttgagcatcttttcatgtgtttgttggccatttgtacatctttggagaaatatctattcaagtcctttgccattttttaattggtttgtctttttgttgttgagttgaatgagttcttgatatagtttggatactagactgttaccacatttatgatttgcagtatttcctcccatcctgtcaattgtcttttcattttatcagtaatgttctttgatgcacaaaagttctaaattttctaaatttaaagttctaaaaatttttaataaagtttagtttacctaatttttcttttgttgctcatgcttttggtgtcatcgctaagaatccattgccaaatccaaggtcatgaagatttaaacctatgttttcctccctgatacttatggtttgggttcttatactcatgccactgacctattatcatattgacttttaatctaacttttctttgaatgaacctttactgccacccatttcctgtagatgggtttggcaatcatcccaccagtaacactctattaaacaactgttgtcaatctcacgatggtggataaaaagattagtatggtatctacttatctgcaatggaataaagccagtactacacagtattttaagtttagttattgctcaggtaaatagagattgaatttgattttacttgcattaaaacaaaatgttaaaatctgttttgaggatttacatcctctttctttgcaaaattctcatttaatagaaagtaaaccacataccatatgttcttataagtgggagttaagctatgggtatgcaaaggcacatagagtgatatgatgaactatggagactcagaagtgggaggataggagtgggacatgagataaaaaaactacatactgggtacaatgtacactactcaggtgatgggtacactaaactctcagacttcaccactatataatttatccatgtaaccaaaaaccacttgtaccccaaaagctattaaaataaaaaaaatttaaatatgaaagacttacacaagaatgcgtgaataggaatgtaaaaaaaaaaaaaggtagcaggacataaaatccagcaaaactcctttaaaattttggcacatggaacaaaaatccattgaaattgaatgaacttctattacgtggcttaatgtattttaccagaattttgttccacgagtatagctgttatggggtaaagggtgtcatttgatgtgacttgtgttatattcaaatccaagtactaatgtctgctttaaaaagaaattctactgaaacagtataaaatgagccagtcggtgggcagaggttgggtaggaaaattgagacgggaagggattcccactctattaaacagcctgagtcatatgcagatgcctaataaacctctttcaattatggtaataatgagctattcaactgaagaaaaagaacaagctcaactctcaccctgagattcagtttttggaaatgattatatgaagatgaaatatcgttcctgaaatggactaaaatatcatctgtaagaatgattttggcctattttggatagatgctgtcactaagaagacatccacaattaaatcccccatgtagattggtacgttttccttctcttcaagggaattcaagagtttatatctggacataagttagttttaactttggcacgtgaaaatactttgagtcccatttagttaactctgctgtctgtagatctgggccatttggtggcatctgtactagggaggggaaatacacaccatcaaatggacaagaatggtaattgacatagtttccagcattaagcttatttaaaaaaaaaaaaagaaaggaaaaaaagaacagaattttttctaagactgttaacacaaaatataattattttatttacttatttatttatttagagatggagttttgctcttgttgcctagtctggagtgcaacggcacgatctcagctcactgcagcctccgcctcccaggttcaagcaattcttttgcctcagcatcccgagtagctgggattacaggcacctgccaccaggccctgctaactttttgtatttttagtagagatggggtttcaccatgttggccaggctggtctcaaactcctggcctcaagtgatccacctgcctcggcctcccaaagtgctgggattacaggcttgagccactgcgcccggcctatcttatttattttttagagacagggccacattctgttacccagtctggagtgcagtggcacgatcatggctcactgcagcctcaaactcctaggctcaagcgatcctcctgccttcgtagctggtactacaggcacgcgccgccatgcctagctgaaattgttaatttcttggtatgtcctaaaacccacaggatgattgttgatcacaagcagagaaccagagatgagcttacagatgacctgaattaggattacaaaccataagatcatgtatcccatagatagtaaactttaaattttaactaaaacacctgtgtgattaataaccattattatttctgttttgtgtgatagggagtgaagagagacttcaaaatggttgaaataattggtataaaaaaaatctctgtggaagtcttctgtaggagaggcaagaataaaatcaaagactttgtccctaatatatactctcatgttgctagctgatgttttcttggtggtacattgaaacaacaactgctagtgccaaagtaattggctataaacccagtgttctaaactgtgccactctgcgggtacaaataatgtcccattatcattcttaccggcatttggccagcctgcttgtggaggggtcagctaccttaccaggccactcccacattttaggtcctcttatcagacaccctgataaggtgtctgctggcaaacctcgggtcctggggctgcagcttttgaaggaggactgttcttcccagccagctgcaaaaccccaggggccccacaggctatgcagctctcttattcttcacagagccagagcaaggctgggtccagaacagagggagaccaaagttcctttctccaaagggaccacacactgaagtcctttccacttttgtgtctcctgccaccccatccagatacctacatatgtgtagcttctgtctcaccagccttctctccccttgcaaatgtcttctgtaggtaggtgcctggggaggtccagccccatctgtgcattggtattgtccccctctgggagcactctactaggcctgcaagattctctactaggctttttaagggttacagaagtgagtccagcaagttagcggtggaggtgacatgtgtacaaatcattagagcccaaggctgaaagtgatgtggtgactgccactcccaatacttccagctgtgtatcctgttctgatcccctccccctggaatgctcatcctgctgctttctgtttcctgcctggcaaatttcattcttccttcgaggctctgcacaggtaaactcaagggttaccctgtgctttgaaaccttcttgactctaatgtttttgctacactgtgtcatacttccattacagtaattattttttcaacaatgactttaaaaaaaagtataagtgacaataacacaaaccgtacatatttaaagttaacaatttgataacaagtctcacatgaggaaggctaccattattactttcttgacccaaggatggctctgtaacacctattcattgacgaaaaatcagcaaaagtgttagctgccagcccctggaaaccacgattctcctcactgcttctgtgtgtcgattttagattctacatataggtaatgacatctagtacttggctttctgtgtctggcttagttcacgcagtacaatgtctatgctgtgtgtgtgtgtacacatatgtgtgtgtatgaataatatatgatgtatcagaaatgtgactatagttaacaatgagggtagatctttagaaatttattaggaggtaatgttctcatcaccaaaaagagaaaagaaaatggtaactatgtgatatataacttggtaactattgatatattaattagcttgattgtggtgattatttcacaatatcaaaacatcaagttgtttaccttaaatacatacaatttttgtcaattacacctcaatagagctaaaaaatgaaatttttgtactaatgatttaaagtcttaattttacctcagaagtcaagtcattacttgcacttaagcatctacatgaaacaaaacagaacaaactggtacaatatttttggaaaagtcgtaataaactgtgctttggtatgtgcccagttatatcaaaagttgtacttataccatgatacctacacataacaaaaatgtctatgattctattttgggtctggattatcttggctagattacgtgcaaagattctaagcattgtgcattttattctaaggatggcagggtgccactggaagtacacactgaataaactgttcagttaaattcccctgtactcaatggaagggctagaagcctgggaacttcacatgggttctgatgtcaattccaccaatgagatgccacatttcattcactgaggtgttgcctacaaagccttaactatttactatatgatccttcactgaaaaagcttcttgacctctgattcgaacaatgaattcttgggaaagaattagataaacatgtcgaaaaacagaatagacagtccggagacaaatccatgtatttatgagaagctcaactattgacatagggtatttcaaaccagtgatggggtgaatgggctattacactgatagtattataataacttactgaccattgaaaagaagaaaacaagaatcctacatcgtaacatccacaactaaaacaaagtataagagaattagaataaaatagaggacacttagaatattggagcaggaaagatcttttttctctgacataaaaattaaacactttgctagtgtaaaagcacataaaaaaggtttgcaagaaagtagttgtatcatatataatagataaatgaataagagttaaggagttcctacaaattagtttttaaaaagtggtaatgggtaatgaacaggcaatttgcaaaggaaaaacagtcaatgctcaagcttagaagtaactgggaaaatgcaaatgaaaacaacaagatatcaacttttcattcatcatacagacacactgataaaaaacccagatgataataatcattggcaaagatatgtaaaaagtactttttttttttcttttcttttttttttttttgagacagcgtcgtgctctgtcacccaggcgagagtgcagtggcgtgatcatagctcactgtagcctcgacctcctgggcttaagtgatcctcctgctacctcagcgtcccaagtagctgggactacaggtgtgccaccatgcctggctaattttttcatatttttgttgagatggtgtctcactatgttgcccaagctggtcttgaactccagacctcaagcaatcctcctgccttggcctcccaaaatgctaggattacaggtttgggccaacacgcctggccaaaagtactcttgaaacacaatccaaagtaactgtggcttctgatgcccagaaccacaattcctactcaaggtatccttattagaggcattcaaagaggcatttgatctaacagtgtttgtaataataacaagccatacataatctcagtgtccactgaaaggaatctgattaaattatggtaaatttatacaaaatattttgctgctgttttgaagaatgaagaaaatctctatatattcacttgaaaaggtcttcaaatacgttttattgtaagaaaaatcaactcttagaatggaatttatctttgtgataacagcatgaacaattctttcaataattcaccttagaaagcggtgatattgacagttatttacttttttgttttgtttgtttttgaaacagtctccatctgtcacccaggctggagtgcagtggcacaatctcagcttactgcaagctccacctctcaggttcaagtgatcctcctgcctcagcctctcaagtagctgggattacatgcatgcaccaccatgcctggctaattttgtatttttagtagagattgggtttcagcatgttggccaggctggtcttcaactcttgacctcaactgagccacctgctttggcctcccaaagtgctgggattacaggaatgagtcatcatgcctgaccagaaagctgtgatattgatatttagtaacgatacatattgttgaaaaaaatcaacttttggaaaaaatgctcttactatacaacttaggaattggaaaaatatacatattttctatatataatgcacagggaaaatgaaatggcacataaactcctgatagtaatctctgggtagggaaataatctctggcttggagtgccagggatgttgagattttggtctcttcccatttgtataatttgatccttcataatgagtatgtagtatgtgtcagttattcaaatcaaagaaagcctattagactcatgtatatagtcatttattttgtggccaattttttggtgtgcttttccttagaaaatatagatatctttttttaagtcctagaaaatatcttaagctttaaaaaagatattcagggaaattaaataccacacgtcttcaatactaagacattgattttaagatacatcattaatttaataatagcttttcagaaaaatccaggacatacaattttatacatcacattgaatgtttaaaatgattataagatgcatttcaacttcatgaatgttttttagacaaaatgataattacagtagtatcacattttgcagagaagtgtaggtaagtaagattggaggcttgattctccccctttcataaatgaataagtatgcgcttgcaaattgtgaaggatcagattcacgtgcctctggcaggaatatttacagaagaaaagacaatcacgggtaaagcccactgcccactagaaatgcctgcatgagtgaaacatattcctcctgagggatgcaagatctcaccttatttggaaatggaaatttggttggttccactttgccaggtgcttgaatagcagaaagtggtggaagccaggtcatctcctgaaggacgggataaaaacaaacaatattgtgatacagacagtatttaaaatcagcggtatgtaaagcagctgtacaagtgggccttcataaggcagggaagggttaaaaaatgtacaaaggctgaaagaattttaaaaaaagatgtgaaatccacttttatgatttcatttcctaattttaccaattcttgactccttggctctccccatgctccctttataccttaaaaaagtttgcaaggctgtcctattttcacttcatttaaggtcctgagtaaagggacaatctagtagcaaaagttctatggaaaatgccacatgaaggggactcggacttgatcccacagaattcacagggtgtctccaaagaaatgcataaggtacttttaactttatgaatctttattagaggagttatttatacaattagaaataaagtatcagttctcaataaggcccacacatcactttggtcttcataaaatgtcattcacggagagtgaaaaaacaaatcacgcctatgaaatacagagacagaatgatgtcatttcttataacacagtattaagaacacaacatgagcttaacatggaataatttctcatccactttttgacacactttctctaagccttgggaaagggagagaggggttgttttattcacttccagtattcaccttcagtttcatctctggaagggagttccaatcaataaatgattacagaattacattgatttctgatgaccaggacgccaacttggagtttacgaattagatgtgaaccctattattattattattattattttttgagatggagtctcactctgttgctcaggttggagtgcagtggcgtgatctggctcactgcaacctctgcctcccaggttcaagtgattctcctgcctcagcctcctgtatagctgggattacaggtgcgtgccaccatgcctggctaatttttgtattttcagtagagatggggtttcaccatgttggccaggctggtctcaaactcctgacctcgggtgacccgcccaccttgggctcccaaagtgctgggattacaggcataagctactgcgcctggccgaaccctatttcttgatttgcctgcacttccaaacctaagcaagcacagaagcagtggtcgatccattttcagaaaagtgagaaattctctcgctcgaggtgaggacatttccttacctccctttggcgggtgggtgttgaaaagcgattctgtcaggcttttggaaggaaagagctcttgggaatggtcgggcaccttcttttcttgggtcattcacctcccccagcacctcagatagtgcagaacccacacaggaagccgtgggagggcgagtgtgttcaaagccatgtgggaaggatttactgaccccatatcatctctcccacaccacgacacgtgacacagacagtaggtgggttaggcacatacgcattctaggtgtcccttctccattctggtgttaccaaccaattgtatacaattttatacatcacaaagcaaagcaaaggtggatccagtgaccctttaaactgtccctctctcctcccatctctgccctgctggtgccttggtctccctttgaggaggctgataagcaggactgtcaagtttgcgtccacagtggcatctttgtccatggagtcaaggaactattcgtcattctcagagttgggccaccttgtctaggacctggtcagctcttacccagagtgttactacccgattaagaaagccatgaagacacaagtgggttttccataccttggctcccccatagggccatctctcctctacaaggtttctgattttatccttccattttcattactggagaggatatgtgattttgctataagtggcttcaaatcttctgtagagaaattattcatcaattacaaactattaaaccaattgtccttttcctcttttgttgactgtctgatgtgtccctgagtccatcccactgctaatcagccactcaatagcttcctttgcaatcactctttcgcttacacaatttacattgtctgatcctcaggggacaacattgcgaagtacaaactaattactcatgattaaacatcagacttacacataccaccccggtatgtctatgttaactttgcatacagactccctctgtgtatcagaatgcctcacatttgtgcaatttttctctgactgtagctaaaatccaaaaagataaactattatttcagcgtgtcctccagcaactcaagaataaataaaatgaaaagtccataaaaaatgagtaacagtactttcaaaagaacacttcctagaccaacagcttcttacaactgacactttcaggttcaaatctgtttaatacaccgtttatccaagagtggaatagcagacaaactttgagataccactaagctgtgattcttaagggtggaaactgtcctcctgatcttcgtaccttaatcagggtccatccctgagcacccactcatcccctgaacatttcctgaaaacttaccattggcaggcactgtaactgtgtcttatgtacacgaagtgctcagttcagcatctactgaatttgaaagttagggtatcggctctggctgtgtctattatcagtctttcttctctaattccagctatgcttgtaatcaatctttccatttctttctttcttccttccctccaactcacctattcattaatccaataaccacccaacctcaaaagcaatatccacagaaggcagatgacacattctcttagcttgctgtcctcatgcaaataccccttctcctttgaagctcttgccaggtggttttggaccctcactaaagatgagctgcatctttttctgtccactccactcctttaaatcagactaacggctccctccaaaattgcctcctgccctccctaccttcatgatattttcctatttttttttttttttgagctggagttttgctcttgttgcctaggctggagtgcaatggcgcgatctcagctcaccgcgacctctgccttccagttcaagcaattctcctgcctcagcctcccgagtagctgggattacaggcatgcgtcaccacacctggctaattctgtatttttagtagagatggggtttctccatgttggtcaggctggtctcgaacttccgacctcaggtgatccgcctgccttggcctgccaaagtgctgggattacaggagtgagtcaccgcgcccggcccctattggttttttaaaggcaactgggcaatcttatgggcacccccaagcatttcttttcaccttcttgacatgttcttcttctgagtccatctctgctcccctcaaatttttggcttcacaaccctgactttaactctgatctttggacttcgtcttgaagattcggaatcttggcttttcccagtctactctgagccagctcattccagggaatcgccaggccctatttctcatccggtaaaaatcggcatatcaaattgctcttgaaattcaacacccaacactagccaccttgcagacatcttagctggcttctcctacacaaggggagaatcaatggtaggtccatacaaatctggatcaagccctcatgtctccatttttggaccaagctctcattctggcttctctgattctatacttgggctccttaggaaaggtaactgtgcacaatggtgggatacagaagtaggacacggacttctctaaacttgggccctcctttccttctcctttgaggctcttgccaggtggttctggatcctcattaaagatgatctgcatctttctctgtccactccacccctttaaatcagcctaatggctccctccaaaatcgcctcctgccctccctaccttcatgtctttctattggtttttaaaggcaattgggcaatctggtggtggcttgggccatgtggcttgggcaatccttgaattcattcctagtctgttcctttttctgagttcctcaaacattctttccacattggtgatttttcttgagcctcactttgatccctgctttctcacaacaggtgaccctgcctcctatggcactgaataaacaaaggctcttaagtgtaaatgtttcccaaggacagacctgtgggtgttcatgcctgaccccgttgccttccttctggtctgactggaagaggcatgagttccaagctaatacctgcctgcaccctctgtctgttactctgtccttggggatccagttccatcagtatctcactggtattggtttaacatcaatctttccttctccactggctttttcccccaagactgacaaatgatctcaggcctcagcccttcctgacactgtattcctcctccagctgatcttcatttctctatttctcttgatagctaacactctcaaagaagtctttatacttgctgttttgacatcctcacctaccatttctatttttgacttaagattttttgttgcagattatacacataagagtccatataatattgtgcatgtgtgtgtgtaagcttaagattaatgaaacgaatacctgtgaactcatgacccaccttcacatttccaagaccttagcaaccactttcaatagaagcagccctgacataactccttctgttgtcaagggcattggatttccttgaatgctcatttccccctgactctcttcccccgtggctcccacgctgtcctcctggcccagctccactctcggagatctcatgctcattcttttttgctgaaacttcttttctctcactgttccttgggtgttttgtgttcagccttcctctcactacccttctttccctggctgatcttgctactgtggctttaaaaaccatgtggtatgctggtgatgcctaaaagcacatccaggtctaacgtgcccactctagatgtctactgagccactcaacctgggtgctcatgagcgattcaaactcaccatgtttaaagctaaacttacacgccacacaaacttttcttcttcttgtactttatatgctggttaatggcagcaacatctattaactcttcaagtcagcatacctggagttatgccagattccttctctttcactccctctctcataataataacaataattctcatttattaagcatttaaaatatattatgcacgattttaaacgctttatgtgatttgcttaattctcatacccaccctgaaaggtaggctttattattttcttactttatagatgaggaaactaagtcactaaaaggttaagtgatttgctgaagttcacccagcagctggacttaaccatatcctgggctacctctaagtggatccaagaccttgtatattctagccaactcctaactccagcctctcaagctgagatcccctgaatataccacgctttgcacatgctggtagcacctcccaacctcctattgtttgctgggttgtttactcatcagtcaagacccagctccatttcctcctttgctatgaagtcttctttggccaaaccaagccaccgttgactcaaccttcctttgtgccacatttcccacgtacaggtctcttttagaacacttgtcccctctattgtggttacttgtttatacatcagtgcctcccctctaacctgtgatgaacccctcaaggctgtgtattttttgtctggtggcccagcacctaatacagagcctggagcagaatgggtgctcacttcatttctgaacaaatactgaattgaacattcagcagtgaatctctgcagtgtgtctacctttctctcctttctgttacctgaactgccatcctaatcacaccttcattatctttaacctgaagtactcttatagcatcctgattggttctctgtcttctgttagcagtccaccctccacactgctgcaaactcaattttcgtaattcagaaaaacttcactgctctaaaaatcttcacatgcggtcgggcagagtggctcatgcctgtaatcccagcactatgggaggccaaggcgggagggaggatcacctgaagttaggagttgggagaccagcttggccaacatagtgaaaccctgtttctactaaaaatacgaaattagccaggcgtgatggcgcgcgcctgtaatcacagctactcgggcagctgaggcacaagaatcgcttgaacctgggaggcagaggttgcagtgagccgaaatcatgccactgcactccaggctgggtgacagagcgagactccatctcaaaaaaaaaaaaaaaaaagcttcatatgcatcatcacatcacaatgatgatgatgatggcaatggtgacgctgaagatgatgatggctcctattaagttttagttttcaaaatacttccccatgcattttgtcacttatgcccaatctttaacgcaacaattgccatctccatagtacagcaaggaagttaaagctcaaaaagattaactgattagtccaaggtcactcagtttctaggtttggccagataactctttactcccagtccagtatttgttttccaatctattgaatttaccctcagaatcctcaccctagtactcaagaccttctacaataaggtcccagtcttcagcttcatgcctttttattgctctacaaatactctacctacaagaaaaactagcctctgcttttacttacaccatccccttagtgtgtgaatacccttcctcatatgtctctgagtctctttttatccattaaggctcatctcaaacatcatttgtgtcttgaggcttttgcagatttcccttctatgccaatataataggatagttctctgctcatgctcctccaaagcacttatttctttttctcttacattctgttttgtgttatagttttatgaatatgtacttcaatctacacccaaccatttatctctctttgaatgctctttctccaatgtgaaataaaagcaatacttaggaatcctaataatctcttttaagagcattcagttttactaggcataatccccaaataggaattctaataatccctttcaagagcatttggatttactaaacataatcgcctaaagaagtaatataaatttcctctgagagggatatttacttatctttgtggagactggaacatcttacatagtaagtgctctatataaacttgttgaattgaactgaacatccacatttcaatgcaaacttgcttgctaattttgctttaattatagctaagtatttccgtgtgatttttccatctaacaaattctactaactacatgaaggaatagtaaagaaaatatggttacttaaagcattcaggtctgtaagaatttccaaaacctaagaattatttctatgattttaatacatttataatgtaatgcaaatacaaaatatgtaatatacatacaaaatgtaatttatgaggtacaatgcttttataagattgattatccattacattaaaatttcacactagaattgcatgggaaaatcaagggcgaatggactatcctgatttcctcttctatcacttgctagcctcctgagcttaggtaagtcacatgctcagtaaactaccgtgatttcaagctgtggactttacgatcaatcagatctcagtttgtggtaccttacaaccagaggaaatggggatataactatcccatggtttagtcataaagattaaatgagatcatacatacatacatatataaagaaactagtatagttcccctcccatttaagcattcaataaaagacagtactgattaatatcaagctgagtttctgaattgtctctaaaatgagaaatataacttcactctgagctttagttgttgggagtctgagatgagagaatatatggggaagagttttttaaataaaagaataagtatcatgcaaatgtagcctgtaattaagctaggattattaatgcaaactatgtattactaaaacagaaagatatttaaagagattattattattcctaagtatgatctgtactttttattggagaaaatgtccctaagttttttcatagaaacagatttctgacaaaataatagtcagtgggataatacgatttgataaaaatgtatttcatttgcacctcatttctggtaatgatttaaaatataagcaaaggtaaaatttatcattcctgctaaaattgcacttagcttgctccacattattttatcactgagaaacaatgctatttcattacaaggacactgatcccacgtcactgtagccatggtcctcacccctgcctgtgttccccacttcacccccaaccaccctttcattgctgctttgcctctattgacctactttggccatcctttaaccacttcccagaccatatgtaagacaggaagagaaatgtaatgtttaaagccacttactccaaagtctagctggcgaccttcggatcttataaactcccctgccctttctttgctttgtctgccttctctcctttttcattttcttgtcactcaggaataagcctgtaccctattcccctactcttgagaggtcctcagttttgcccttggggtttcttagtcacctgcccttttttttcctttttttttttgagataaagtctcactaagttgcccgggctggcctcaaactccggggctcatatgatcctcctgctttggcctcccgagtagctggaacacaggtgcaggctgccatgtcccactccttagccttttagatactccaggtgatggaactgagaatccacgtatctgcctcaacacagcatcgccagtcccttctccctacacagatgtctagttactcaagggatacgttcaggtgacttcttttttttttttttgtataggcttataatgccaagactctttatattaaatatactcacttttctcctaaaatgaaagaatagatggttaaatgataaggacacagaatattgctcttcataactggctaacgttttctctatcctccatatcccaattttcaggaggtcatgggcacatgggccagtttccattttcacgtctactctacagcaagactgacgccagtctccaagaacccacacactgatggtgcatagactttcatgtgctccatctgcacaatgccctccatgtagctgaccactcttctgatgccagctgcctctgcctgttttaggacaagtgacaggaggccttgggcatccccacctcacgtagcagctctttgttaccaaaggagagaagaaacaaaaatagaattttagcctcaagttaaatcttcgagttcagagtgtgcagctatgaagacctgcaaagtctgtttagcttacaataggttcaactagaaaaaatttaagccatgttttcatttccctattaaaacaagtgaggagaaaaacacttttcctggtctctctcccttgtctgtcactgccacaggagagttccatctcgaacacttactatgtcacctttgttccaaagtttccagtgaccccggtccaattgttcaagatgctctgtcacatggcaccatcaaggaccactgtggcattaccgcctgctgcttttctatacactgtcttccccaagcctgatgtcttacttcttgtcctgccccaggctttcctgcccccatcttgtttctcttttcctttcacgttattccatctcacttacctctgcattctttctcatcctggcctgtctgtgaaggtgacctgtgctaccctgagcgagccctctctaccctccacttatatataatcaatgccactttttttttttttttttcagatggagtctcgctctgtcacccaggctagaatgcaatggcgtgatctcagctcactgcaacctctgcctcccctgttcaagcgattctcccgcctcagcctcctgagtcctgggactacaggcacatgctaccatgcccagctaatttttgtattttttagtagagacggggtttcaccatgttggccaggctggtctcaaactcctgacctcaggcgatccacctgccttggcctcccaaagtgctgggattacaggtatcagccaccgtgcccggccaatgccacttatttagcaactacatgctactcagtgctgtgagctttcttgtcatgtgttaccactatcagaatatttttaaaatccctactagattacaaactcttcgagggaagggatcatgtctaataatgctcttgtaactcctcaaaggcctagcacaatggtcagaataataggaattaattgaacttctctgtaagtctcttttcttgcctgtgaaataatggtagcaagaaattacactggtttcaccaagcgtatgtgactgttgccaggattgaaggatctgcctggcagatgaccgcagttaactccagaattctttgtgctcagaaacttactgttttctaaacaagacacgggatgaattctgcgacttgggaataaaaatgcaagatgctcacgttgatgtttatgtgtggcagtggctgctgatcacagtgtgatttcattttcagtttctgtatcagaataatcattcagcttttcagttcttctcacacgtattattcgtgttatgacactcttatcagataagtgctgccaacaacagacatggtgatttttacaacactgcatctcatctaaatgctggcagctaatgccactgtacctggtgaagaggaaaacacccctacgggcctgtacctgggacaccaggcagtagccctggagtaagatcaagtgggagacacatattcctcccctaatgggactgcagtgtgcattctgcctgtcaatccattcctagcatttgtgggcaaagacccaacatccccctttaaacacagattccagggtcaggctggaaggctcagaactaggaagtcacacttaaaacctttaagttggcctctaaatcaacaaaaattcacaaacaaccttattttaccactctacagtaaaaaacaaacaaacctgtatagtttgaaaaataataaatataatgcattcatatcgattaatattaacaggccaggaacagtagctcacgcctgtaatcccagcactttgggatgctgaggtgggaggatctcttgagcctaggaattctaggtttccgtgaactatgattgcaccactgcactccagccggggtgacagagggagaccctgtctttaatcacaacaacaacaacaataattagcattttgatggaaatactactgattgaaaacttttaggaaaatggtagctgctgaaaaaagtgcctttaaaaaatatctatttctcatagtatagcataggctgctaaaatgccagaaaccaaaattgcaactgattcaaacacagatacaaaccagcaaataaccaaaaagactgcaaaaaagagggttaacaaaaatcgtagcaaaatcttgtttcttcaatctgaaaacccaggaatatgtccagtttgaactgaaacaggcctgagaaggggattcctgggagctgtacacgtgttttctggtcttataccgacccactggatgacaggatctcagaatgggacgctgattaatctacttcattgcagtgcctgagcttctgaactctgcccctgcctgcgatgaggttaatcatcaaaggataaaatgggggtaacaatcaatagaatcagtttgagaggcagctttcagttcaggttttgcagactgacaagtacgaaagtagccattcaaactggaaacactgagggtaactcagacctgtgcatcccacttgctccttggtctgtagattctcacttatctaaaagcagaggccacagggcatctggcctttcattacttcctttgcatcatcaaaagcactccttattgcagggaagtcaattccatgccactggagaccctacctttcacctccttgacttcagcttccctggaaactgaactctccacagagaggattagaacattgagaaaagtcaagatacagtcttcaccttaaaagtttgtttcatgctagatcccttaattttggacctttctggagaattcttgttctcgttttgcatttttccagctttcttttggggcagaggatgagagtcacctgtcttattatctctctgtgtcaagtacattcctgttctatttatttacttgaaacttttttgaacaataaaaatgaaacattaaaaaaatttattcttcgatccacctggttttcaatgttcattttattacttgtgtttaaaaaataatatgattctcattctttaacttgcagattgttcttagaactgagcattgcattaaaatattcaaagtagtaacatttagattgggtcttcagaattttaggaagatggttttgctgctgagtatacagctgcatggactgagtgactcttgttaaacccaggtgactccaacttcaccacggagtccctgctgcaatatacagacacctgctagtttctggcactccttcaaatctcgtgctcatgatgagaagcaataattggcctgattttaaattttaaaaatgctttttttgacaagcaaaaaaaaaattaaaacatttgaggggcactgagagaatttcccaaattctgaatctggggctgacacatcactgcgtcatttctgagccaaatcttgtcaaatcgtgttaactcgaggtttataaaaagtgagccaaatttctgatcagctcaggagaaaatgcacgttactaactatgccactgacactttatttctgactcacataatactttttagtggtagcacaaacacccagaagtgagccttcctaacagacaaatagatgatcgttgaactaactgtggcttgcaacaatcaaaccactctttcatatatacttaaaggaaaaaatggcattatttgggacagactggaagactgtggaggctggaaggagaagggggtgaaaattacattcttggccacgttttccacacaacccattcctgaacccctttccacagacaatttggaaatgtgcattcaataaaacccctgtcgcaattgcagagaagcagagggtagaagagatcgggcttggagtcagcatctgggaaaccttgtataattttggccttgccataaaccagcagaatgacctcgggcaagtttacttttccgattattagtgtccttatctgtaaattggtatcaatcattctatcttgcaggattacctgagtggttagtgataaatatacaaagaacctagcgtaatagctggcacatagtaggtgctcataaaaaataattattgctgtattgctacctttataactagtgttgacagcttctggattcgacctggtgaggaaaggggataaatatagaagacgtttatgaatttgttttttaatctattttactctttaattatttaatatttaactggttaattattcatagtcaaacagaaggcttaataaaaatgtgcttattaaacaataatttgcttccttaactcccttcaccactaaagcagcatgtccataaagggaaggaagaatgctatctcagggtctggaatttttcttcaaagggatagttactagaaatcagcatacatcctctttctagtttggggctctacagattagaagctttgccctcatgctatagactacccttgcaggcaccagcttgggtagtataggaggtgttaggcaagctgggagtgtagcgggaggctacctggctatgatgacagggcagtgattactgtccaggcaggtggctgagcaaggtgacaagcctgggcaagaataaaccctggaaactactggggccaggatcaaagttcccggtcaggtgggacttctggtttaccagagggaaggttaggacaatcctgccgaaggcacatgcctttctccctttcaaatgtttcccagctaaaccacttccaaatgagcaggcttctactaactttatgcaagtatttttctcagttttgagaggtgatttataaatcactgaatggcattgccctaggacagcagggatgtctctgggtcttaaggatgaatgtgaaggcaggatgactttataggaaacagaaaatgtctactaacatgctccagatattgacagtaaaatccagaggctggaggaaagctggttagccttggaaaaaccatcttttctttttcttttctttctcctttttcagaaataaggttaaactatccttaagaataagaaggaaaatattaaaacattcccccccaaaagttcatagatcttcaagaaaagagaagttaggaccaaaatataaacaggatgacaactgcttttatttgaagaaaatagagttttctagaagactgaatcagtatagcctgataaagtgcttatccattgggaaaagatattctatgggagcaaacaaataaagataaaagaggaagacattaaattaataatggctaaagaaggtgagagcctgaactcacttgctaaatgtgtctttaaagagggagccaacatgatctcacaagagtctctatgagaaggtgagaaggaaggttcttagtactcaagggcgaataggcaatctacaaatttcagaccaatgtttttatcccttgatgttcactgacaacacagacacagttccctgttttgaaaagaggtctaacaatcatgctgaacagtctgagacttaatagagccaatcagttcagtttctattagtgcacctgtacactcaggcatgcgttcaaccaaacacacatttagacactcagactactctaggtcttgggaaacaaagcagaatacaacagacatggcccctgctctcaggaggtgtaagcaccatgagaggagagaagcaataaacaatgaacaaatacatgtaaacgcaacagatctatattcgaacagttgctgcatggttctgatgggtctaattagcattttggcaaagaagaagcatgagaagggcatggattctgtgtcagacatttgaggggctggcttgtggaaatgacattatgtgtggtttaaagctacagggaagattttggttttaataaacttcctaacaatttctgtcactaaacattccacaggtgttttgtgctaagcactgttccaggtggctacattctggtaaaatgaggtagacagtaaacatgtatatgacactatgtaacatcacacgttgtaacccaaagcagcataatttggcataatgtaatataacatagtaaccattaaagctgtgcatcagtaaactggccatcaccatcagtgaaatggtgagctgcagctgggtgcggtggctcacgcctgtcatctcagcactttgggaggccgaggcgggcggatcacgaggtcaggagattgagaccacggtgaaaccccatctctactaaaaatacaaaaaattagctgggtgcggtggcaggcacctgtagtcccagctactcaggaggctgaggcaggagaatagcatgaacccgggaggcggagcttgcagtgagctgagattgcgccattgcactcctcgaggcatttgggatcacaagcagagtgggatgtctctgggaatccccagcctggagcagcttcctctgactttggtggagccacatgcagggctcagggcaacttctgctctctattcttaaccttccttaattgttgtgtctcaatattttcagtctcaattcctgactcaatgaagttcttaatttcatatgtgatccctggtgggtttgggacacatgatttcattttagtttttaattgaaaaagtatttattgaaaaagtatttccataatattttctgcttaaataacatatgcttctggttaaaaagttaaacattgcaaaaaaaatagcaaatgcaggagagtgaaaccccccaggatcctaacacctgcagataatgtcaatggtgaccagtgttaagcactgggtacttatctgatttttatatacatgcactaagatggggattatattaatatatgtatatttaatgaggtcatactgtttggtgatatactctttttcactgagcatctttcccaacacaacatacaaatgggtcttcttttttgcagttattattttggattggttcatcttaaaagtctttctacctaagaatagtttacacaccatagttacagtgttgcaatattctgtttttctgtgtacttactgttaccagtgagttttatgccttcagttgatttctggctcattaatgtctttttctttcagattaaatatctcccttcagcatttcttatacgacaggtctggtgttgaggaaattcctcagcttttgtttgtcttagaaagttttaatttcttcttcctgtttgaaggatattttcaccagatacactattctggggtaaaagttttttttcctttagcactttaaatatgtcacgccactctctcctggcctgcaaggtttccgctgaaaagtctgcggccagatgtactggagcaccatagtatgttacttgtttcttttctcttgttgcttttaggattttgtatctatccttgacctttgggagtttgattattaaatttcttgaggtagccttctttgggttaaatctccttggtggtctctaaccttcttgtccttggatattgatacctttctctaggttccgttattatacctttgaatacactttctccctatctatttctctctctgcctcctctttaaggccaacaattcttagacttgccctttagaggctattttctacatcttatacctgtgcctcactgttttttattctttttttcttttgtctttgccgatcatacattttcaaacagcctgtcttcaagctcactaattcattctcctgcttgatctgtttggctattaagagactctgatgcattcttcagtatgtcagctgcatttttcaactccagaatttctgcttgattctgtttaattatttcaatctctttgttaaatttatctgatagaattctgaattccttttctgtgttaccttgaatttctttgagtttcctcagaacagccattttgaattctctgtcacatacctctgtttctccagaattagtccctgacaccttatgccttatctagttcatttggtgaggctgttttcctggatgatgttgatgcttgcagatgtcaccggtgtttgggcactgaataattaggtccttattgtagtctttgcagtctgggcttgtttgtagctgtccttcttgggaaggctttccaggtatttgaaatgacttgggtgttgtgactgacactgtatctgcattagggggcaccccaagtccagtaacattgtagttcatgcagactcacagaagtactgccttggtggtctcggataagatcaggaagaattctctggaataccagacagaaactcttgttctcttcccttactttctcccaaacaaatggagtctctctttctccctgtgctgagcagcctggggctgggggtggggtgacataagcacccctgtggctaccacgactgggactgtgctgggtcacacctgaagccagcacaacactaagtcttacccaaggccactccctggctacagcctgtatttgctcaaggccctagggctctatgatcggcagacggtgaagccagctgggtttgtgtctttcccttcagggcagcgagttcccccagctgggtccagagatgctgtctaggagccagggactgaagataaaaaccttagaaatctacgtggccttctattccactctggctgagctggcactccaactgtaagccacagtccttcccatggtcccctctcctttccacaggcagaagagcctcatcccaaggccacgaccacgacaggcccacagggattactgccaggccactgccgatgttaacttaatgcccaaaggcccctcagtcaagtcgtggtgagtgctgcctggcctgggactcacccttcagggcagtagactcccctctggcccagggaaggcccagagatggtatccaacagccaaggcctggaatcagggacaccaagagcctgcttagtgctctaccctgctgtggccaagctggtacctaaggtgcaagaccaagtcccttttacttttccttctgcttttctaagcagaaggagtctctcactatagccaccacagttgggaatgtggtgggtctcacctgcagccagcagtctcagagtctcaccaaggcccatggcatatgacctgggtatcactgctggttattcagggaccaagggctctttaagtcagcaagagatggatcttgccaggacttggtccttcccttcaaggcagtgtctccttctggcccagggtgtctctctagaaatgttttctgagaggtacggcctgaaaatggggcctcacagctctgactggtaccctatccctctgtggctgagctgataaccaagatgcaagacaaagtcctctttactcttgcccctcctgtccttaagcagaaggaaggggtctcttttgaagctgggagctttgttgcctgggtttggaggaggggtagtgtaagcactccctattcacaatagcaaagacatgagatcaacccaaaggaccatcagtggtagactggataaagaaaatgtgtacatatataccacagaatactacgcaaccataaaaaggaacaagatcacgtcctttgcaggagcatggatggaactggaagctgttctcctcagcaaactaatgcaggaacagaaaaccaaacactgcatgttttcacttataagtgggagttgaacaatgagaacacatggacacatggatggtggggaaaaacacatactgaggcctgccatgggggatcatcaggaagaacagctaatggatactgggcttaatatctgggtgatgagttgatctgtgcagcaaaccaccgaggtacacgttacctatgtaataagcctgcatatcctgcatatgtatcccagaacttaaaaaatgaagaagaaaaaaaaaaaaaaaccagagcaattcacactcaacagcatgccagggaagatgtctcagccctggtgtcctgacaagagcagtttctgaataggaagaaggctggcacaaatggatacagcaacacattctagagatgcaaagttccaacaaaagcattttaaaggtcaccttgtttatataatatttatgttttaagaccttatgattcccccaatatttcaaagctctcagagacaaaagaataacatggtataaagaagtggaactcggaatgaggagacgtggactctggtttcagagccacaggaaactgtggaatctggaggtgaagacaaccccaggaagtgacgtatttctaaattttctgatgaggacacccggccccaagaagttctgtgagctgcccaaggcctctcagtcacttgtgatacagccagaatgcagggcaggggccactgtgtccttctatgttccttcagtctgcaaaacagcgataagaatagctaattggggttttctgagaagttactgtattggaaaccataaatatgtcatttaatgaagaacaatgagcttcggcaggatttcttaagtgtgaatgcaatcgacatgcggtattcctgccttcttggttctctcgtctcatactcaactctggtcccctttcccatcctccacctcagaaaacaagaagtgggacaaaataggaaaggagagaagaggaagaataaacaagaagtgggacaaaatagggaaggagagaagaggaagaaaagagtgacgatgagccccgggcgaggtggcaggggcctgagaggcagggaaggcaaatggggagctttgttctgaccaggccgtgtgcttggtctgtggggcctctggcttcccatgggtgagtcctgtgagaagaactgtgatagtctaagtgtctgccaaaagaagggagtgaattagatgcaacccattccaccctgcctcaggaacaatgtacacacaaatacatgtcaggattctctctgaactttacacagaaattgcctggctatgttcagctcttctcagggagagaaacagaaagtatttgctctggaaatcttgtatcaatatataaccaagatcttaatgttttcagacttgccccttcctttttctagcatttgttttttcttctgtatctcctcaggaagatatggtggcaattaaaagaaaaattattctgaacagcctgaagtgatatggctaagcctagcaccacttttatttcagagttaaacaaccatgacttaattctcaaattgcttcccaaccctgggaagttaaggtcctagtctccggctaattctagaaccatctatcattaaatgaagttgaacacaaagaaggggcgactgcagctaagggaaaggccgtcaatcctgacaccagattaatcttccccaaatgcctttcctgcctgagagggtttgtggctgcttgttagactagatccaagttctcagccttgtctcaggcctgcctggccattgagtgtctcacatgcttcccaccattcctcatgggagcctgggttcagaccggccaggttcccactcccgttcacaggaaggaggctctgcgactttcacctgcaggctctgctcacccgttgtcacttccccatccacatcctacccttctatcacatcttccttcaagaagactcacactgttcaggaaacacctgctcactgcctccttaagttcctttctctaaatgtctacagtgttaatagtttatagcactcagcccactgattgagaccacagctaagtttctgagggcagagaccccctctgtttagttcactgctccttccccagtgtcaagcttagccaggtgctcattaaagaattacaaaatgagcaaatggttacttgactcgtgaggtaggataagacaatgagactgattcttaaactacttgctgtaatataaactcatataattttttttgttgctacaaagctgtcatctaggcaggtgagtcttttattactaaaatgcttggagtgctcaaacgttttgggaattcttctttggaaactgtgctacgtcaattcctggggttggggttgaggtggtgggggtggaggttggtgtgatgggggtggggaatctcagagttaagactggatatgaattaacaaagagacaaaagtcactcagggccaagccttaactgaagtggctgattaagctagtgagagcagttctggatcaaaactgatcaaaagtcagtcctattcaacatagtattggaagttctggccagggcaatcaggcaagagaaagaattaaagggtattcaaataggaaaagaggaagtcaaattatctttgtttgcagatgacatgatcctatatctagaaaaccccatcgtctcagcccaaaagcttcttaagctgataagcaatttcagcaaagtctcagcatataaaatcaatgtgcagaaatcacaaggattcctatacaccaacaacaggcaagctgagaaccaaatcatgaaagaattcccattcccattcacaactgccacaaagagaataaaatacctaggaatatagctaacaggggaagtgaaggacctcttcaagaagaactacaaaccactgttcaaagaaatcagagatgacacaaacaaatggaaaaacattccatgctcatgcacaggaagaatcgatatcatgaaaatggccacactgcccaaagcaatttatagattcaatgctattcccattaaactaccattgacattcttcacagaattagaaaaaactattttaaaattcatatggaaccaaaaaagagcccaaatagccaaggcaatcctaatcctaagcaaaaagaataaagctggaggcatcacactgcccaactttaaactataatacaagactacagtaaccaaaacagcatggtactggtacaagaacagacatacagaccaatggaacagaatagagaacccagaaataagaccacacacccacaatcatctgatctttgacaaacctgacaaaaacaagcaacggagaaaggattccctatttaataaattgtgctgagagaactgactagcgatatgcagaaaactgaaactggaccccttccttacaccatatacaaaaaatcaactcaagatggattaaagacttaaatgcaaaacccaaaactaaaaaagctctagaaaaaaacctaagcaataccattcaggacataggcatgagcaaaaatttcatgacaaagatgccaaaagcaattgcaacaaaagcaaaaattgacaaacgggatctaattaaactaaaaagcttctgtacagcaaaagaaactaccaacagagtaaacagacaacctacagaatgggagaaaatttttgcaatctatgcctctgacaaaggtttaacatccagcatctataaagaacttaaacaaatttacaagaaaaaaaataaaccgctccatgaaaaagtaggcaaaggacatgaacagacacttctcaaaagacatacatgcagccaacaaacacatgaaaaaagctcaacatcattgatcattagagaaatgcaaatcaaaaccacaatgagatatcatctcacgtcagtcagaatggctattattaaaaaatcaaaaaacaacatgctggcaatgtcgtggagaagaaggaatgcttttatactgttggtgggagtgtaaattcaaccatcgtggaagacagtgtggcaattcctcaaagacctagaagcagaaacaccatttgacccagcaatcccattactgggtattacccaaaggaatagaaattgttctattgtagtgctattagcaatagaaaagacatgggatcaacctaaatgcccatcaatgatagactgaataaagaaaatgtggtacatatacaccatggaatactatgcagccatacaaaagaatgagatcatgtcctttgtagggacctggatggagctggaggcctttatccttagcaaactaacacaggaacagaaaaccaaatactgcatgttctcacttataagtgggagctaaatgatgagaacacatggacacatgtgtgggaaagacacacagtggggcctgtcagagggcaggaggaggtaggaggagggaaaaatcagggtgatgggctgataggtgcagcaaaccaccatggcacacatttaactatgtagcaaactcgcacatcctgcacatataccccagaacttaaaataaaagttggaaaaaaaaaaacccaagtcaggatgccattcctcatggctcatcctcgctctcaagaagaaagccattataggaattcctgaaagacgacaacatcattagaatgagtatttagattctcaagatgactatttcaaaggacagtagttccttgcatgcactaaaaataccccgaaacatgaatacttcttttttaaaatgaatctagcaactagcacacagaaggaaacaagtcaatacccactgacctagttgtggtagaacactagtttagttctgggcaaatataaactttaaaataaacccgatgctttaaaaataccaagcttctacagtagaacgataaaataatacaacagtaggagacatgtgaaaatgcatgactatctctcaggaggaaacaaagtgtggggaacttttaaaatacaactctcaaaggggtttcaaatggcatcgggggaaaaaaggaatgcacttgatgttcctggagttccttataattgtgtctctttggctcctaacaaagaaccagcagcagagtcaaaattattttgggcaaatttcaagaaattaaaacaaaggtttaaaaaatcacagaagagtaggggtcagtttgtttacctagcacagacagatggttgtatttctgtagttagaggagcaatgcagaaagacttccaaagttccagatgaggcacatttgccaagaaaatgcttcaggttggcagaaggtagaaaccctgtattggctaaatatttagcaacactgaagaatttttaacactaatatctcatttggagtggaatatgctttatggtctgaattctttccccactctgttttataagtgatgataaaaatcaaaacataatcacctgtcgaggatgaatcctgcacctgtgaaattatatttcaaacaagccaacttcctaattacaatggagagggaactggcatgaggaagcaagttatttccaccattccggcagtgggctccaggctcccagatgaagagctgttggtacaaccacaaaaaaactgctaaaatcatcttttattattcctgtctgcacaacaaatagctccatctggggctcaatggtagactccagccaaaatttgtaagggctcggctctgaggcatctgatagcagccctgcataaggcagaaaatcagaccaccatcagcaccaggatcactgtctacatgagttgatgaagagtttgtggggggcactgggccgagcatgtcaaggggcacagaaaattggaagcatggaccctgctttaaagaagcttacagggcagttggggagataggaatctacaaacacacatatgctaaagcacaacagtccctcagttatgtgtggcaaattccaaatgagggacaggcggtgatgcttggaattgagcaaagtcagagcccgctgtgagtggcagtagccagtgccacacaaagcaggcagggtgtgagcatcttctgagaacttcctacatgtaagtctccacgctgagttcctacccaggtcctctcatttacctgattccttcccaggagcatcctgggagagtgccactaggagaccacagttcttcctgcacagaggaaaccttccatttctccacaacgtttgcttgatcctacttgactccaggcccttcctgctgggctttaagccagttgataccacagtggctggcgcaactctgaagtgtgcatgttcagagtcctgagtccctagaccctgggcatctgcagactgaatgctgctgcatcccagggctcagatgctgagtcatggggagtggtctttgggcttttctcaaaggagtacaccgcactggatatttatgtccttagttgggttgggttaagcattcccatctgcgtgccctggtaagcttctccaatagatgttatgtacaaggctcttcattcataactctttcaaatatctcaggtaaggattgctagctcttcgcctccaacatctggcaggctttctacctggttcctttgctttctgcctctatgaaaatgctctgaagtgctggtcttggccaggcaagctacctgtaggccatgtcttcatgcacacagacaagttggctgccttctaccagctcccggtggtcccacagagcagatgcgccacaggctgtgtcctgtacaccctggccctgggagcgcaggctcagtttgcacagcattactgaagcagaccctggggtacttaaaaaaagcaaaagcaaaaaaaaaaaaaaaaaaaaaaaacaaaatgcaaaaattagttccagcactatcagttcaaatgggcaatgtgcatgtccatatggctgggctcctccaggtctgactgtgcaataaagacaggtttcagttggtttgttccaggcctgagagccagaaggcagagcagtctctgaagcactgaagccagagtgacccctgcacatcgcatcccttctggatcctgcctggagctctgtctgcccggaacacccttctcctcctccttcctctggtctcctcctccttctccttctcatctcttatctccttcaggtctgtggctttccccagcagtttacacagtacctggcactaggtgaagctcaaaaatatttgttcaaaacatgaagtaatgtacaattgatacaaggaagggatgacacaaggtgcctcagacaggcagaaacagaggggattaacagcacgcatagaaagcaatagatgtattcatgcataagcacaccagcaggatgccacccaactcccaccataactggctgggacaatgcttggtagcctgtctctccccactcccatctctagatgctctttcatgtgaatatcaatgtgatctatgtcatcggtctgccaatctatcttaacaatattaagtcttcctatccatgagcacagaacatttttctacttttttaagttttaatttctttcaacaatgttttatagtgttcagtgtacaagtattgcactttcttggttaactttattgctaagtgttttattctttggatgctattgtaaatgaaatttccttaatttcatttttttgattgctcattgctagtgtatagacacaaaactgatttttgtatattgatcttatattctgcaactttgccaaacttgtttattacctataattttgtgtgtgtgtgtgtgtgtgtgtgcgcgtgtgtgtgtgtgtgtgtgtgtgtgtgtgtgtgtggcggggttggctctttagggttttctatatggaagataatgttatctgtgaattagagatagttttacttcttcctaatttggatgccttttcttttcttgcctaattgctctggctagtacttctaggataatactgactggaagtagtgagcagacacccttgtctagctcccgatcttagggggaaagcatctgctcttttatcattaagcatgatgttagctgtgggttttccatgggtatctgttctagctggaggagggctgcctctgttcctggtttgttgggtgtttttatcatggatggttgttgggattttgtcaaatgctttttctgtatctattgagatggccatgtggctgttatcatttatttatagttagagtatgttatattaatttcaatatataaaatcaactttgaattcttggcataaatccctaagaaataaattcttaaaacaacagcaagatgataaatatgctcataatattacatagcagtgtggtgtttcacatttttcagggaattttcacaaacaaaaaaccctgggtaagtgaccacacagtcacagttattattcttattagtcagttacgtatttttgtgtatttagagggtacaagtccaggtttcttacatgcatatactgcgtagtggtgaagtctgggcatttagtgaccccatcacccgaagcgtaaacactgtacccagtagatagtttttcagccttcactcccctcccacctttcacggtctattattccactttgtatgtccatgtgtacccattgattagcttccacttgtaaatgagaacatgtggtatttgattttctgtttctgagcacacagttattattattagtcttcattttacaaggaaagaaacaaaagctcagaaacttctccaaggatacaacattggcaaatggcagagccacgacctggattcaggtcttctcatttgtggtctaaatagtcacatgcacggagagagtgttacagttatactgaaaagatagccgcacatcattataagaaaagataaagaacacatctcattcaaaactagaatcccagcatctgaaggactactgaagtgtctaatgagcatgtgttcataatccttttctatgggttgttctgatcactgtaggaggagcaggacttatctcccatctccaaacactctcccttgacctcacagcagactagagcaactatcccatttctctgctcctctttatagcaaaactctccatctaaactccctgtcctgattccagtctgtgcttcaagctgacgctggtctggcattcctggggctgattctcagtttcccgcctactgaacctctcagcgctctgtctgagtaaataattctctcctagatggatcactttcctcctggccatcaaaacatctactcttagcttctccttcccaggttcctttgtaagatccttctcaccttcctgatttttatatgactgtgcaacccagggtttggctctacaatcacttcccttttccagatatacttatgttctggatgatctcatcctggccacgtttaccctgccaaactacacctttcgcctgaatgccaaacttgtgcatctaactgcttcccagctacctccactctgatatctgaatagaaccctaagtgtacacatttaaaactcaactctcgagttccaccacaaacctgctttttccattgtcttccccatcttagtgaatggcaacttcattcttccatttgttcagatccaaaccctggactcatcttgacttctctctttctttcaccctgagcatgccatatattactgaatcctgatagcccaaccctcaaaatgtatcctggatctagtcacctgcgacctccaaggctgcccaccttagtatacaacactgtcatctctcatttgacttttcctgaggtctcttgcttccacccttgttccctgacaagcctcttctccctatagcagccagagggatcatttaaaacacaaaacagatcatgtcagtcttctgctgaaaaacttccagtggcttcttatcttatggagaatgaaacccaaggttcttggatctggccctggttccctccatgactcagtactcatcattctccccttacttactctactttagttacaatgattttctccaaacaaaccaaacaggttcctgcctcaggacctttgcacctactgttcccttggcctgtccacccttctccatgtcagcaatgccactccctcccttacttgatagatctctgctcaaccacgacttcagcagagagggcttccccgtctgccctatcttaaataacaccagcccagtcattctctattccctcaccttgccttatttttcttcttagcacttatcactgcctaccatttatatatttattggtttatctgtttattatctccccttgctaacatgtaaacatcatgagaataggaaaccttctctgtttgttcattgctatatcttagggctgggtcagcaaaacaatggctgccaggccaaactggcctgccacattattttaaacgatgttttactggaacacagccacaccacttcactcactgctgttatccatgggtgcttctgtgctacagaagcataattgagttgtcacatcagagactggatggccctcaaagcctaaaatgttgaccatttggtcctttccagaaaacgtttgctggctcgttttggggtctagaagacaatgctggcacacagtagaggcaccaaacacatttgctcgatgaataaatgaatgaatgaatgaaataaaagaagaaaccaagaagcggattaagaaatattataccaaaagggcatttgcatttgttaccagattaaccaagtatagcaaaatattagaaagagtgatttaaacttaacagaaatccaaataaagaaaaaaaaaatcttataattctgttttctataaattaagaattatatgaggtgagggaaatgctggggtgaatactgctagcctgtgtgacattcaagcttatacagaactttattatctgggggacttcagttcaaataaatgaacccacacacactaaaaacgatcgcttcagaaacctgaaagggttttttctttttcttctttacagatcttctttacattcaggccaatgttttgattttccatttccccttgggcatgaagacagttttcttttggagttggggtccccacattgtaataactgttaacagagtgcacctgaaaggcttaaaggtagaccctaccaaaagccctttggcccaaacatctgtaaatgctagtgaacattatcagataaagaagcaggattccctttttatgtttttaaggtaccaattctgccagcatgagagagagtagaaggaacagaactcaaaaagtacaaggtcagagttaaaattttaaaagatggtacaaagtccccagtgaacagttgcaggacacactgcctgagctgtgctgccgccataggaagaggggcctgccatagtcctgcaaagcttttccgcggcaatccatctgaaactgctcctgaaactttgtcaactttgacctgcaacactggttctcaagaaagccagtcaacaagcatttgctcaagtccttctatgctttactttgagtttaacatcaaaggctcaggcctctcttctgatatttgaccactttgactggtaattaggtttgtggatgaacaaacacctccatctcaacacacgtacaaatgcagtgttcatggcaaactcagagacaagacttctgcaggtaacattagtgttctaaaacccacaacaacacacaaagtattttaaactaatggcatttagaaatccagaagcaaaaaagacacaaattcttattttggcacatgagtgtgtagaggatctgttttctcaagcacaaatattttccaaacaaatagttttaaacatccaaaaagtctgtctttccttgctgttttagaaaagttcctagggcttctgagaattttatgagagattaaagacagtcaatggctgcttggtacctggcgcccaggctggacttatcttttcttcgcatatctttggcagaggatagcggtagataaaatccattattgacagaaggaaaacagacaatgagcagagaagtaaatgagaaagcttcattatttacccaactttgaaatggtaataaagcttttgctctatcccaaagtttgacaattgccatgcactgccaacccctacctctcaagtcccctttaatatcctcctccaaacttgaggggttccaactgtggagattctgaaaagctgttgcacaccacctcctcttctagagcctgcctatcccaaggggctgacgcactgtcagtgtctggggacgctgggtagacaatgcaaacgagagggtgtaaatgtaaattctgcatttgggtaccagtggctgtgctgcagtgtgagggaactcatccatctcaggaactctggcctctctcacgagagaagaaagatgccctgtgagagcagaggaatacacggcacaggaggattcacttctgcctcacactgtcctaaggactaagccatgctggccactgacgaaatacgtgttcttttattaaccaaacaacatctttgctcaaatcatctgtagcaaatcatttagcctgactgcttttctggaatccagagctgtctttctaaaatttgtgatgtggaagctgtcatttgcagaaacttccagaaaaagaaagaatggtcaggagaccatactgaaggtatatatccagccacttttctaaaatattttattcttgctgtggtacatgacagggcccccctggaaagggaaagtgattcaagagggtctcctatacctgacttgagcggtaaatcaacaaaccctttcagcacctactatgtgctaaacatagatattgtatttcatcaattatatattgcccgttgcaagtactttttgaagctgcattaactctctttgatcaaaaacttactttttaagcacatccaagtgtttctgaaaagtattcaaagaaaacactaaggtaacctctgcagatgccttgccgagaggccagtctgcattccccttgccagtggctctagcataagtgattagcaggggggttaagacccaaagcccctcagggaatctggatacagcatctgtcaatcagaaccaagcccagatagcccagttaccagaactttgtcctcttggatagtttcccatctagaaacaagatttgggtgagtctccacaagtctgccgttttcagcaccctcgtggatggtctggaggcattctttgggttgttgcggagcatgtgtgtatatttcagtgtagtagtatcctgccaaacctctgcaggctctaaatatgatagagcacggtagtctcgcaaagggaatgtgctgcacagcacagaaaggagatgaaaggtacaaggccttggagttagtccctctagaggcctgaaacaagcccagagcaaagggtgaccggatggcaaataaaagtgcacagctcagtaaattatgcaagttcacattacatgctagtatgatattggaacggcataaagctttgcgcagtattaagacattctgtttctcaactttaaaatcttaggctatcggcatttgagagaagaagctctatcaggcatttcgctgcaagagcaattttattctactgaataatgtggacttactttctcttagccactttttattttaggatatgaagtattaataggtatataccaaatgtaactgtattgtcctatcattcagtccatacctttcaggtgatctctataggctgatcttgaggtgagtacattttaagttattagagtttaaaaactcatgataacctgatcaggaggttgtgttcagcttcctctttgcaaatatgtctttgctaccgtggctggcgtgttccctcactccttaactccagctctgcaattatcctgacttgtttttaaaccattgcatgttgctgagtgtttgcatacagcagcgatgttgcgccctctgaggttttagtcacttatcctcatttatatccctgcttgtgtcccggtagccaggagagaatgcagatgtggaaagagcaggagagtgagttccagttactgcaggtcagcctgaattggcttgtctgttcttaatcgaactctggcaaagccactccaggttctaatctatgtggacctctataacagaaagcaagtgaaatcgagaattacagtcatgcagtccacgacaaatgaaaatctatgttactaccttagtgccacactcacattaaacggccatttccaaatttaaagtaatagcacagaagtggcttctacctgcctttataaggacagcgctagttcgaaaattatatccaaatctccaaaaattacctgtaaaggttacaactaccagagacaggaagattagcttagaaataataaaactttactctctccttattcctcttctctttttacaatgcaatctcatcacaggttctacatgaacaataaaagggggacatttttatttccccttagatttcttttacttaaaagttctaaaaactgttgtagataacaggcttttctgctgtctccttccagtgaatatgtggaagagtttagaactcttcagaaaacttcctacttttcacatacactcaagaaattctgagagtttgaatcagcatgaacctttaagtgatttttttatttttatttttagacagagtcacgccctgtcacccaggctggagtgcaatggcgcaatctcagctcactgcaacctcagcctcccgggttcaagcgattctgctgcctcagcctcccgggtagctgggattacaggcacgtgtcaccatgcctggctaattttttgtatttttagtacagatggggtttcaccatgttggccaggctggtctcgaactcttgacctcaagtgatctgcctgccttgacctcccaaagtgctttaagtgatttaagaagaacttgagttcacttagtgcctgtgccccattgacatagtctctgcctgatgccccatggccattcgttgagtgcggactctcaaatcttgcacaattacgggtgctttctgcaaaaggatggtagggagatgaagggtttgggctttttattctgactgccatttcttctctgtactcttgggaatgttgtttaatccctcaggctcagtttcctcatctgtaaatggggactggagattgataacggtatttgactcatgaggccaatgtgaggctccatgagatattggcactaaagccaccatcagtccgcacacactagctcagtgtacatccgttaatgtcagttgtggctattgcaatgattaaagattaacacggccataaagcgaaaggtagaatattgaatgttcagataaaataaagttcacctttaaaacaacagatgtttaaaaaaatcaagattttccaccttttacttcttgatcttacatggtaataatgcaagtatgacagcgcaatgcagtaagcgtaaggttgataattgtggctctgcccagaaatcaggggtgtgggggccagtaaatagaacagatactgaaaaacatttgtgggttttatgccgtagtgctataaagttgcatagtaaaaaaaaaataaactataacttcaaactaatccttttatgccagcatgctgtaaaatatttagaggattcgggctggctttagtgatggattcaatgtgccgtggagttttgtcctttcccaaactttagctgcaatggctgaattcccaccacaccatctgttcctgacacttggtctcattagtacgagtatttttattgatacacacagtaatgcttctcataccatcttagctaagcattatttattgtatctatatatacaacaatattaacacagtcaagcaccaggatcggtacttgagggcatcattaaaatcagccagtgttcagtgagagacttaatgatggatttaatagtattaaatgggcaaaaatgcccttggcctttacatgctcatttaaaaacatataaaagagcagtaattcaggcagttatacttctctcaaagattttgctctaaatcacagatggcagcgggaggccacggctgtgtgctggctcacaccccactcactccaaccgaagccagaagtgctcgttgggtcataattagcaaaccacccgcaaactcgactctttaaatcagaggccagtgactgccaggctggggcatagacgggagaaaacaagcagaaatggtcaaggtgctctctggagcctgccttcggatagctgtgacccccacgttaggcatcaagacagggttccacacctgcgccgccacccctgcagtgtgagcgctgtattttgctttctgagaaagcctcacggtttggctctttggtgcatgaggctttaaggcgatgtgccccctgcccagctgttgcccagctcccagcccttgccacagacagcatacatctctgttttagaaacaaatcatttagtcacttaatcatgaattcccgatgatgtacgtcctgcagaggtctgagctggggctgctggtctgaaagtctacgtacttctgactggagacttaggctaggctgggtttcaaatttggatgaagacggttttggctgagcagggagaagaaaacaaacaaacgaacaaacaaacaaacaaacaacaatccgggagcctggagtttgctgagaggctcagctttggggagatctggggctggccatccttggagtctgcttccttatcagcaaacgcctcctaaagttgttatgatacttctcagaactagacagcatatatgaaatcagataatgcacagttgtgcactacttggtgacattttggttaatgacagactgcatatatgagggcagtcctgtaagattataatggagctgacgtcctatcacctagtgatgcaatagccattgtaatgtcacagtgtaacacattactcaccattgtggtgatgctggcgtaaataaacctaatgcgatgccagtcatataaaagtatggcacatacaaaattatgtacagtacatactatttcataatgataataaacaatgatgtcacaggtttatgtatttactacattacactatacttttattattttagagtgcactccttctactcattaaaaaaaagttaactgtaaaacagcttcaagcagttcctcatgaggtatccagaagaaggcactgctatcagaggagaggacagctccacgcatgttaccacccctgaagacctcccagtgggacaagatgtggaggtggagggctgtgatgtcgatgatcctgaccctgtgcaggcctacactaatgtgctgtgcctttgattttagcccaaaaaaattaaaaagaaaagcatttttaatgaaaaaagcttacagaataaggatgtaaagaaactatttttgaatagtcgtacagtgttgtttgtgcttaaactaagtgttattacaaaagagtcaaaaattacacaactttaaaaatgtataaagtaaaaaggttacagtaagaataggctaaggttaatttattactgaagaaacagaagttttttaaaaataaatttagtatagtctaagttcacagtgtacagtagtgtacgataatgtcctaggccttcacattcactcagcactcactcactgactcacccagagcaacttccagtcctgtaagctcctttcgtggtaagggtcctatgcaagtatactatttttaaaaaatcttttatgctgtatttttactctaccttttctgtgtttagatacatatatagttatcattgtggcacgattgcctatagcattcagtatagtagcatgctgtgcaggtttctggcctaggagcaacagaccataccatatagcttgagtgtatagtaggctataccatcttagtttgtgaagtgtgatgttcacaaaacaatgaaatggcctaacgacacatttctcagaacatatccatattgttataccatgcatgactgcatatgaaatgcttcatacaaagcttggcattcataattttaataagttgttggccaggtgcggtgccatgcctgtaattccaactctttgggaggccaagttgggaggactgcttgaggccaggagctcgagaccatcctgggcaacacagtgagacctgtctctacaaaaaattatctgggcatggcagtgcatgtagctgggcaaggtggtacatgcctgtagtcaaagctacttgggaggctggggcgggaggattgcttgagttcaagagttcgaggctgcagtgagctaactatgccactgcacttcagactaggtaacagagtgaggccctgtcaccaaaaaaaaaaaaaaaaaaaaaaaagtagttgaggattcaggccactggttctgccttcttttccagacaccctagaaatcatgaaaatggaaccagaatgacagtatggctgccctctcccagaacttccaccaggcctctctgcatcccccctgggattaacctgcatggatggcagcccagcctcttcctgcctctggcctcaggagagactttcattttggaactgctgacaatcacatcaagaacaggtcatgtcaggagaggctgggaatgatattgctcgaggattcggaggctgcttccatgggaagttacagacctaactgagtccttctcacacttcttaaaggctttcaggaaaaataaacatcagtggcataagcgcaagctctgcaaattaaaagatggctacaaaatgatcttctttgcattttaagcaaattacagaatcattcaactaatttcaacaatgaaaggaatgtagatccagtgaaaattacacatgcatggaccctggtgatgatacctaaaattagattgttgatggcagctcctgcaaaaataaatgcaaagtgattgctcatcagaaaatacatactgagttcccatgtgaaactcctgcctgtgataaattcttccaacgaaatgactactcaagcatttaccaacctgccttagaaaatagtgcaagctaatgtttcttgtccaaaaatgtgtatacagcacagataagaaaagaaatgtgacagtaacagcagagtcttgaactggctgaaaagcccatacagtaagtgctataaggacatcaactaggaactgggctaacgtggtaactagtgtctgacagcagcacccacagcaagacaactcaaaatttattaataaaactaccacaggctttcaacatctacatacaatgggcctaaggctttgtaatctttgaatgaaatacactacagagaacctcctagtgaatgaatgaaagatctaagattttcttctctttgcaaaggaaccctgagctgtattcatgcatttgaggataagatgtttcctttatggaggagtttgcttttacaattttattatcaatatccattaagtagcaactgaattttatagcaggtttcaaacaggggcaatgtctggagatatgtttggttgtcataacagagtgggtgctactggcatcaagtgggtagatgccaggggtactgctaaacatcctacagtgcataggagagtcccacaaccaaaaattatctggcctaaaatgtccatagtcctaaggcaaagaaaccctgataaatatacaacaatctacaactctgataaatgtacggtgattgtactctgggtatttactcaagataaatgacaacacacgtccacacaaaaacttgcacacggcatagctttatgtacaacaacccaaaccgaaaactcgaaatatccatggcaaataaacaatggataaagaaattatgatatacccatagaatggaacgcttctcagcaacagaaagaacgaagcgagtacacaaaacatgagtaaatctcaaaaacagtttggtaagtaaaagaaaccaggcacaaagagtatattccatctttttctagacaggtgatgttctagaactggccatgccgaactaggctatacagaccacaggcacttcagtgatcatgttggcctggggataggagagtaagggttgaggttcctcttctttttctttattcaagatggaaatgtgttgaaaattagttggtaacatacagttgtccctcgctacccttggcggattggttctaggacccctgtggataccaaaatctacggatgcttatataaaatgatatacaatggtgtgtttccatgtaattctcctatgtactttaataaataatccctaggttacttacaacacctaatgtcatgtaaataccatgtagatacttgctttattgcactgttcggggaataatgacaagaaagatagtctgtgcctgttcagtacggatgcaccattctttccctggcgcctgaacgtttttgatctgcggttcatttaacctgtgaatgtggaacccacaaatacagagagccgactgtacagtcaaccttcattattcacggattctttatttctgaatttgccccctcattaaatttactgatgccccaaatttcatactcacagtgctttcctggtcattcatggacacgcacagaatggtgaaaaccatgactggcccaatgtgcatgtttccagacaaggctgaaaaaggtgacacgctgtcttcttgtttcagctttcctactgtcctttttgtggtatatttagtgccatattttttgcaattttgtgtttttcttttttttttttttaattttgctgtttaaaatggaccccaggcatcgtgctcagtgctgtctagtgatcccaagtgcaaaaaagttgtgatgtcccttatggaggaaataagtgcatcagatatgcttcatttgggcatgggttatagtgctgttagctgtgagttcagtgttagtgaatcaacaatatatgttaaataaggtgtctttaaacagaaacacacatacaacaaggttatatactgattggctgatgtgtgatcgaaggctcacagcaacttaactttgcattttccctaggttcagtatttgctaattcagtatgactctgtaaaacataataccatgaataatgagaatggacagcatatgtgagtctttttctagacactattacacagaactctgggactgaggctagaggatcactcgaagccaggagttcaagaccagcctgggtaagaagactctgcctctacaaaatataaaaaaattagctgggcgcactagcagtgcatgtgtgtagtcccagctacttggaaggctgaggtgggaggatctcctgagcccaggagattgaggttacagtgagccgtgattgagctgctgcactccaacctgcctgagtgacagagtgagactctgtcttaaaaaacaaaacaaaacaaaaacaaacaaaacaacaaaaactcaaacaaaatgaaattggcaagagtatatctttgccttagcatcttcggagcaaagcaatttgttcctttatcattagttaagctactataggctttttgtggataccctttatcaagctgaggaagtttccatatattcctagtttgttcagagttaaatatatcttaaattttgccaaatgctttttctgcaccgattgaaatattcatataattttatcctttattctgctaatacagaaaattatactgactgatttttgtacgttaaaccttcttggcattcctggaatactttacttattatatatttctgaatttaactagctaagttttgtgaaaggttgatatcagactaatgttagcctcatgaaaaatatatctgggacatgtttcctcctcatttgttttctgagtaattttgtacatggttaatatttcttcctcaaccggtaacatctgagtgacaccatctgatcacggtgatatggtttggatatttgtccccttcaaatctcatgttgaaatgcgatgacccctggtgttggaggtggggcctattgagaggtatttgggtcatgaaggtggatctctcatgaatggcctggtgccctccccatggtaatgggtgagtttctagctctattagttcccgcaagaactggatgttaaaaaaagaaccatggcacttcctttttctccagctccctctcaatgtgacacgcctgctcccctttcgccttccatcctgactataagcttcgtgaggcctcgccagaagcgaatgctagcactgtccttcttaaacagcctgcagaaccccgagcccaaacaaacatcttttctttgtaaatttcccagtctcaggcattcctttacagcaacacaaaacagactaacacacatggaatttgggggaattacaaattcaatttcattaacacagataggactacacagattctattttttggggtagatttggtcatttttatctttaaataaatttgtacatttcccctaagctgttgaatctattggcataaagttgttaacagcagccctttatttattcttctaatgtttgtaatacctgtggtgatgtcctctctttcattgctcatattaatcattcgcgttttctcttttctgttgtttagcccacttagaactttattaattttattgatcttttcaaaggagcagctttagatttcataaattttcagtatctttgtccattttctatttttaatgagttctgctcctatctttattatttcttccttctacttcctttgggtttaatttactctttgtacttgagattcttaaggtggaaactcaaggaacctgacgttcaacctttcttctttttctgttatgaacatttaaagctataagatttccttgaagaactgctctaactacattttacatacacatcttcattagggtcaatatttgttctaatttctctgatgatttcttctttgacacatggatttagaaatatgttgtttcatttccccatattgggggattttccagatatctcttttatttctaaattaattttgttttggccagaaaacatattctgtatttcagtccttctaatttattgagattggttttatacccagaacatggtctattttccttttgctatgggtcacatttgctgcttctttttcttacaattttggaatggatgcttaacattttggatgttggtaaatgtttttcttttctttcttcagagactgatgaagtttgttttgtcgagaaattaggttacttgtgtatcaaagcttatttttaaattgtgttagggtgtagccaatccctttattctagagatactttagctgtattactaagacatagctagtatctctacttaatgctctgggttgttaacagggtctttccattaaggcttgtgagaatttaaatgtatctttgctgtatgtgagttctggggattgttcatctagtagctccatggcaatttttatttgcatagccttgtggaatttcatattatgcatgcaaggattagtattcagctaaagactcaaggggtcccctatgtagatttctggaactcttcctctgagtatctccactttagtattctgtcttgcaaactccagctgcctaggccttttcatagtctattttccctcaactcagtgagacttctagttctgtttaaagctctgtctcttcactacagtctagaaagcagctctgaatataaatctgagatgactacagtagtcacctaatttatttcccttcatgggatcatgattctgtactgactgttttccaatgtctgaaaacagtgatttcatatattttgggtagttttctagttgtttatggcaggagggcaaattctataccatttattacttcataagaagaactagagtaatcactcaaaagtacgaacctgatgatatcactctccagcttaaaacccttccatgctgactatataatttgctgtctatactggtatatttctgaagtgctaaaatgctaaccagaagaagtgctggtgattcacaatagcaatgatatggaatcaacctaagtgcccatcaatggatgattggacagagaaaaagtagtgtgcatataaacacacacacacacaccatggaacactactcagccatgaaaaagaatgaaatcatgtcttttgcagcaacatccctggctgcactggaggccattatcttaagtgaaacaatacagaaagtcaaatactgatagtctcacttataagtgggaactaaataatgtgcacacatggacacagtatgtggaatgacagacactggggactcagaagggcaatggctggggggcaggtgggagggcagtgagggatgcgaaattactaatgggcataatctacattattcagatggtggatacactaaacgcccagattttaccactacacaatatactcccataacaaaacagcacttgtagtccttaaatttatccaagaaaaaggtgtggggataatgagcataaaccaggatgatcacaggaaaactagcacttctgtcactgctaaactcctcggctcggcttctaggctctcattacttcccctcctcatttccctcccaccttcattcctttagcttgaatgcctctacagtgctgtatttcttacgtgtagcaactctcctctcctgttcatctagtaaactcctcttctgccctccaggtggttgaaacattaacttcctctaggtctacacggtgctttgcacctgatttggcttgcacctcatgctattctattaatttatttgcatgttgcctcctcttctagactaggtttttgagaaagtgagagaaaaatcaagaaatctgttttagaaaaattaatccagaaacaatatttgtgaaaaattggataaaggatgaggaacaggggcaatttagaagattgtttagtatctatattcttatttaacagcagccttcagagctaaagaagcccaaaggcctcttaacacctaatcacccatttattcctcttaaactctcacctgcaatcaaaacctattcagaaaaccagaattttaatgtaaagatctcagtatgaaggtttttggtattttatgatctaaacaaaccttccaaagtctggtgaggctcaagttggcaaaccacctgcaatcttcccactaaactatatttagtatcccactgtagcacccactgcaactgacatatgaatacactgtgctaacaaatacattacttaatacaaaactcttcaatttattacattgtgtcataaatttgttttgctttataagaaaatagattttaactcaaaaagtttcttatttggaacaaatgcatgaagcaaaggttttcaagcactggacatcaagcaaccaacaacttaattcccaggaaatgaaaaactgatgaggcaagctgtatgactgccccagcttactgcactaagaacttctgggctatagcacagggaggggaaaccatgagaaagcccagtgaacacactgagctgagagtctggggagaacaagttgacttgagtttgctgctcaggacacaagagcggagattgctgtacagagagaatcttgaatatctgcaggtcttccttgagtattcagcagagttctgagtggcacaagtacatgaaaaaataacctgaggctagggaaagaatcatctgaaaggattacagaaaaaaataccaggtgcttacaaggccaggaacagaaattgtgctcaccagccagactgtaaaaccttataattaacagggcattggatagagcactcaaaagaatcttgcctcagaactaggcaataattagccatagactaaatgatgctctttctcacctgacaaactgtggagacaaaacccaaaacaatcacactatttccaagtaacttaactacatcccagaacaaagcacagggagatctgtagaaacacaaaaaagcaaaactctgtctgggtccaaccaaagattaccagatagacagatcaccatacgtgcaaagaagcaagaaagtgcaacccatagtgagaaaaaaataagacaacccagaaaggccacaggtgtcagacttattggacaaagatattaaacagttactatttgtaatatgtatgtccaaaaagttaagtagagacatagaagatataccaaagacccaaactgagttttcatctagagatgaaaactatatgaaatgcaaatatacattgaatgcaattaatggtagaatagagattgtaaaagaaaacattagtgagcttgaagacataacaacagaaactacacaaaatgaaatacagagagaaaaaagagcataagtaaactgcagaatgacttcatgtgtgatctaatgtacataaaattggagtccctacaggagaaaggggagggtagaaaatatatttaaataaataatgaaggaacaaaactgtaacatttgataaaaaacataaatctacagatgtaagagactcagttatgataggtacagtaaacatgaagaaagctacaaaaggacaaagtataatcaaattgctcaaaaccagtggtaaaagagaaacatttaaaagcagccagagaaagacgaaacagagattaggattacaacagatttactgttggaaacaatgcaagtaagaagacagtggaacaacatctccaaaacatggaaagaaaataaataactccaaaatatatatatgacaaaaatatttgtcaaaaactaaggtaaaatacagacattttcagatatgcaacagctggaaaagttcataaccagcagatccgcactatggaaaatgttaaaggaagcccttgaggcagaaggaaagtgctaacagacggaaatataaatatacccaaagcaataaagagaactgaaaaatggtaagtctattaaacatattttataatttgaatatgtttaaaatataattgattagttaagaaaaaaattatatttttggagttgataacatatacaagtaaaatgtttgacaacaataggaaaaaggtggctggggaaggagtaatgaagaattgcaaggttcttacactgaacatgaagtggtaaaatattacttgacagtaagctaaagatgtctactataattcctaaagcaaccactaaaataacaaagcaaagagtaatagctaataagacaacaaatgagattaaatgaaaacaaaaaaataactcaatgcaaaagaagacaggacaagaggaaagggcaataattattcaattacattaaataattgcattcaatgctaactgcattgaattacattgaatgtaattattgatacggttaggattgtctattttccatcctgtttttatttatccaatcagataaataataaataatatatgtaaacactataaaatcccagttaaaagacagaaatgagcagactgcattaaaagatcaagacccaattatatgctatttataagaaatatactgtaagtataagaaaaaccaaatagattaaaataaaatgatagaaatatatattacatgctaacattaatcaaaagaaagctgaattggctatattaatattaaggtagatcttaacgcagccagggataaagaagtttatatcacattgtctaacggaccaatcaatatgacgtaaaaatctaaatgcttatgtgcctaacagcagagcttcaaaatacacgaagcaaaagtgaatacaacttcaaggagaaatagacagtcccttaattatagtcagagatttcagtatcctgccctagtaattgatagaatacataggaagaaaattagtcagacttttctgactaatgtagccttgaacaacactatgacaccatggtctaggtagaaaatgtaatgaaatctacagaaaaagctactaaaattaataagttagtttcacaaagttgcaggatacaagatcagtaaacaaatataaattacatatctatatgccagcaactagtaaatataacctgaaatttaaagataaatgccatgtatactagtatcaaaaataaaacatacttaggaataaatctgacaaaagatgttcaagtcctgtatattaaaaactataaaacactgcagagagaaattaaagagatctaaatctctaatggtagaacagagattataaaagaagcactagtgagcttcaaggcataataatacaaactacataaaatgaaacacagagagaaaagaatagtgaaaagagaaaaaaagaatataagtgaacggtggaatgactacatgtgtggtctcacataaaattggagttccctaaaggagaagggggagggtagaaaatatacttgaataaataatgaaagaaaaaaagacccttaacatttgatgagaagcaaatagagagacataccatgttcatgatttggaagaatcgatattgttaagatgccaattctttctaaattcatttgtagattcaatgcaatcataataaaaatcctaataggctttttatttgtgtggaaattgacaagttggttctaaaatttacacagaaaaggtgttaaaataaccaaaataacttgaaaaacaagaataaaatcgaaagattatactatttgatagaaaatcatacagctatagtgaccaagacagtgtgataccagtgtaaggactgacaagaaccaaacagagaatccagaaatacaccacatatctacaaacaactgattttcagcaaaagtgcaaaggcaattaagtggagaaaggacagtatttcaacaaatggtactggaataactggatactcatgtgcaaaagttgaatttccatccacacttcacaatgaatcttaaacccaaatgtaaagtctaaaactgcaaagtgttctgaacctaacatagaaaaaaatccattgtgactttagattataccaagatttcttagccacaactccaaaaacaagaaccataaattaaaaaatgtaaaacagaacttcatagaaattaattttttaacaaagtttgaaagacatgtctttacaatctctaaagacaagccccatacttagagaagatatttgcaaagtatgtaaataacttgaatgtagaacatataaaaaagacttttcaaaaatcaacaatgagaacaaaacaacctagtaaaaaaggccaaagttttttgaacacatcaccacagaagatacatggatggaaaataagtgtatgaaaagatgctcaatacaaccaatcatgaaggcaatgcacattaaaaccacaatgagataccactacatacctattagaatgtttaggattaaaaagatcaagtgttggcaaggatgtggagaaacaacaactctcctccattgctggtagagatgtaaaatgatataagcactttggagaacagtttagtgggtttttaagaaaatgttaaacatactcctattatttgatccaaacattccactcctaggtatttaccccagagaagagaaagcacaaagacattttgtgtgttataaacatgtgcacaaatatttataatagcttttatgtataactgcccccaaatggatacaacccaaacgtcctctgacaggttaagggataaacaaattttgttatgtccatacaatggaatacggctcagcaatgaaaagtaatgaacaattgatccatgcaacaacatggataaatttcagaataattacacagagtgacagaagccaaacaagaaagtacatgctatatgattctacatatataaaactctaggaaaatgcagactcacccatagtgacagaaagcagagcagtggtggcctggggatgagtggggtgtgtggagaagggtaggagggatcaattacaaggggtctgagaatgaatttggcaatgatggatacattcattatcttatcaaaacaataataatgcaaattctatagcatgagttacttacatataattatacatatgtgatattttcaccggtatataccaatgtgaaagcttaccaaattatctaaatatgtgcaatttacatgtcgattatatctcaataaagaaatgtgaaaatgatacttcctatttcttcctaattccatgcaatttagacttcatacatgtaatactttctgtaagctcccagcaaggtttctttcatcaacatcagctaaataatttggagaaatttatcagaaatttcaaagtatgtcaacttcaatttcttcttgtaatttcataggttaactttcttctctaaccttagtccaaatgcactacaaaatattttctcatgctttcattaacctggtcttcagtgcttcaacagattttggtgattgtaatatttacagagtcaacaaagtgaagccaatagcactactgattggaaaggcaggggtgggcccctaagcaaggtaacccgcagaccaagcaggagactgtcctgagcagatacttccccactctgaagggagtctcaagttcccactactgaagcacagaacttgtacttcccatttccttcgggacaatctggatgcaggaggctgctgtgctaaaaagttttcaccatgtcactagcttgacatctacttttacgacctctcattcttaattatgtccctgaatcccagctcctgagctcatgtatttatctttgtccagaaaagcggaaattgtaaaaacaaattctatagcatgagttacttatatataattgttatgtggggtctctattatttcaagtcattaatcagccaagttccattattttctgtaagtcaatccttttgccactcttcccataagcacctcccaatagaactatttcctttgttaaatgcatgcatatgcaggtttttacatgtatattatgtatcaattatcatataattacataattactgtaatcggatttaactgtataattagaatgtgtaattacataattaaaacatgtaattaccaagtttaaaaagttatggaaattatttcttttaaatgaataatgcatgtatgggagacaaactttcaaagctcactacttaggccttctaaaagtcattttaactaaaaacacaatttaaaatccactaagccagttatttcacatgacatgttgaataccttaaacttttttaatggatttttatcttaagagaatattagaaaccttcaagggctcagcatctggatgtaggaaaaggagacaaaaaggcagctctcttcaagtgatcatgaagtctgactgcatttttaacctattcccacttacattaaaagttttcttggctgggcgcggtgcctgtaatcccagcactttgggaggctgaggtgggaggactgtttgagcccaggagtttgagacctgcctgggcaagatggtgagaccctgtctctacaaaaaattttgaaaacttagccaggtgcagtggtgtgcgcctgtagtcctagctactcaggaggctgaggcaagagggtcacttgagcccagtagtttgaggtggcagtgagctatgatcatgccactgcactccagcctggccaataaagtgagactctgtctctaaaaaataaaaagtattttcctagggtgtctttttttttttttttttttgcagctattgtaaaagggattcagtttttgatttgactctcagcttggtcactgttggtgtatagcagtgctactgatttgtgtacatgaattttgtaacctaagactttactgaattcatttatcaaatctagaggtcttttggtggagtctttagggttttctaggtgtacaatcatattaccagcaaaaagagatagtttgacttcctcttttccaatttgaatgccctttagttccttctcttgcttgattgccccagctacgacttccagtgctatcctgaatagaagtggtgaaagtgggtatccttgtcttattccagttcttatggggaatgctttcaacttttccccattcagtatgtgtgggtttgtcatatgtggcttttattattttgaggtatgttccttctatgcctagtttgttgagggtttatatgataaagtgttgctggattttatcacatgcttattctgtttctattatcatatggtttttgtttataattatgttggtgtgatgtatcacatttattgatttgtgtatgacgaaccatccctgcatccctagtgatcatggtgaattatctttttgatgtgctgttggattctgtttggtagtatttcattgaggatttttgcacttatgttcatcagggataggaagtgaaagatctctacaaggggagctacaaaacactactgaaagaaataatagatgacacaaagaaatggaaatacatcccatgctcatggattggaagaatcaacatcataaaaatgaccatgtggctcaaagcaatctacagattcaatgcaactcttttcaaaataccaacatcattttcacagaacaataaaaaaaatcctaatattcataaggagccaaaaaagaggctgaagagccaaagcaatcctaagcaaaaagaacaaagccagaggcatcacacgacatgacttcaaactatactataaggttatagtaaccaaaacagcatggtactggtataaatgtagatacacggaccaatggagcagaataaagaacccagaaataaagccaaatacttacaaccaactgatctttgacaaagcacacaaaaacataaattggaaaaaggacaccctattcaataaatggtgctaggaaaactggacagccacatgtagaggaatgaaactggattcttatctctaaccatctacaaaaatcaactccagacggatcaaacacttaaatctaagaactgaaaccagaaaaaaatctagaagaaaacctaggaaaaacactgctggatactggcctaggcaaagaatttatgactaagaacccaaaagcaaatgtaacaaaaacaaacaaacaaaaaataaatgagacctaattaactgagaagcttctgcatagcaaaagaaataatcatcagagcaaacagacaacccacagaatgagagaaatatttgcaaactattcatgtgacaaagaactaatatctagaatctacaaacaactcaaacaagtcagcaagaaaaaccaaataatcccatcaaaacataggcaaatgacatgaatagacatttttcaaaagaagatacacaaatggccaaaaaatatatgaaaaaatgttcaacatcagtaatcatcagggaaatgcaaattacaaccacaatagataccaacttaccacagccagaatggcagttattaaaaagtcaaaaaacaattaatgttagtgtggatgtggtgaaaagagaagacttatacactgctagtgagaatgtaaattagtaccacctgtatggaaaacagtatggtgatttctcaaagaactaaaagtagatcaactgttcaattcagcaatcccactacagggtatctatccaaaggaaaataagtcactatgttaaaaagacatctgcacacatgtttatcgcagcacaattcacaattgcaaatatatggaaccaatctaagtgctcatcaactgatgagtggataaagaaaatgtgatatatacaccacaggatactatttaaccatgaaaaagaatgaaataatgtcttttgtagcaatgtggatggagctgggggccattattctaagtgaagtggctcaggaatggaaaaccaagtaccctatattctcatttagaagtggaggtaagctatggatatgcaaaggtatacagagtgggaaaatggactttggagactcagaggagggaaagatgaaatgcgggcaagggataaaaaacaacacattgggtacaatatacactacttggatgacaagttcactaagatctcagactccatcactacacaatgcatcttgtaaccaaaaaccacttgtaccctaaaagctattaaaataaaatatatgtattttaacaagttttcttagtgtaattgacagcaaataatgagcagtgatgactagtacaaaagtcatcacccagctgatgttttggtaaatccaggaaatggtatatctgattcaatcccatgcttggtttcaaaggcaaaatgttacttaaaaaaataaatgttgactatatacctgcttgataataagaaacattcacctctcttcgtttaagttcaacttaaagaagaaacatttttgaaaagtgagaagtgtgttacattggtggtattatgataataattcaagtgtgcttgatgctggggataaaatgacaaatcagatgtgttctctggccttgcgttgttcagacaaacacatgagccaataaataaaacacaaagagaatatggacagtaatggctttcaaaacttaaaaaaatctaataataaatcattacaatttgttgcctgaggaaataatcctcatcatgtaaaccagaagtcaattattgatttttctgaccacaatcaacaccacagccgagtatgctctgtgcaggaaaatccctactcctcttcagacctgcctgtaacactctatacatatttaatcattaataacataacacttatcctattgcttcacaattatgtatatgtctatttcttcttttgaatgtgagttccaggagggcaaatgcttagcgcaggaaacatctgcctgcaggagtcttacacacacacacacacacacacacacacacacacacacgatgaaggaacatttgcccgctcttttcatggaacaggatgcttttgtttttgtctcttcacatcacaagtaaccagcacatctttgaaaactcaacagtttaacctggaaatgttcataaagatcattctcaaatgacaacttattcttggacaaaataagaaatgcaaatgcaaaataaaagaatgtgtcccacagagatgatagaaaaaaaaaagagcagaacagttatagtaaaccacaggctaaaccctcatattatgcattgcatcagccatgataaataaggttcgcatttgtcagatccgatcaacttggtttctagggtagtccaatttcagcagactgctctagcactaatcatcttgtgaattcatctgtggtaggttaatgttcaattcattaattaattactcccatcaacattcattgagcttctgtctactacatgtgaagcagcatgtggggtatgggatatgcaacacagagcggaaaatagcccctgctctcatggaattcatgttccaggaaaagggcagacacgtaaacaagcctaacactgcaaatgctcagctctgcgatgggagtgtgtgccaggaccccaggagcatggaggaggatgaggacccctgaacaaattcaatgcgatgcaccaggaatctcgctccctatggctccctatttgtttcctctggggaaccactccagacttgatggggggaaatcccagttgaacttgatatgacagagcaagtaacttagaacaacactgattctgcagaacctggactagcagacctactagtcacaggagtcctatcccttcttcatatacctgtctccacgcccccaccctcattcaagataaaacattcaccagcattcctcttaatgcatctttgttgggaagatgactggagcccagcacagtgtatggcaaacagtaggcgctctgtgttgaatgctgaatacttacatgaataccactgagaatccacagtaaaatacatttgtgtgttttggttttgttccaacagattttcatcatttctgaagaaagagacatactcctggaatgtggcacatggaaacttcctggtttatcaggagttgatcatgacctctaagagctcaaagctcagctgaggcttttgcagaactgggaagcatggcattcgtctcagcctaaccccccacattccctgtgttgcttgtgtggtgttactggcgccaccagggctatcccttgcattcatcaacagataccgagagaaagttgctgttcccatgttcatgaattgaacctgtcacccatgaatgcacttttggctcatcagattagctggttgtcacctcataaatgaggaaacagggtcctggatggaagaggatggtgcataggacaaggcagagaaaacggagtggtgggtgggttgctgcatggtctgttggctcccgaagtctaataagatgacagaatctggagtttggaaaggatcctggactcaccatgtacctaatgcatgaattcctaccaacgcacccagtttctgttcttcctgggatggagaactgtcacatcccctaattgaccatttggctttctgatatctcagctggtggaaaggtctttttgatattgagtcccaattcataaattctactccgtggtcctggtttttcactctgaggtcaaaagaaccaatctagtcacctgatgctgtgatcttagtcctgaaattaagagtcaatattacttgctgccttgacatctggtaaaataaggcaggcctcaattggcctaactgcaagttctccccacactgcccctatggataaagtcttgtagcaaaacaccctctttagcagggggaccaggcacagttcctgcttatcgctgagtggcgggtttagctccctgccagcctgtggaattagtcaaacaagccaatcacatcctactgtgagaaccaggggtcaacctaccctcttgttactacaaagctggcctctggcagtccccgctggctcactctgttcctgaatacaacccctctgtgcccctgagccccttcccaggctgtgagtatatgtaattaataagtgcctgtcaatctcatctgttcattgtcaggggctgtgtgttcagccatacccatcaccatagggtaggaatccctccctcgccaatggggtgaaggggaggcaaccaaaatagctacgtcttagaacgaggctctgggaaccttagaagagtgggttaaagagaggccggaagaactctgtttgattagaatttaaaattcccatttcctccctctttccacctttcctaaacaccactctcaaggttttctcaagtgactgtgggtatggaagctgatgtaacacaatggcaggaaacaagaacaagaacaagtgaacaaggcagaatcaagagagccatactttaggaaaaggtatacaaagaaatattctgggatcccaggaccatcaatgacagtaaacttactctagaaaataagtgtcattattcactggattcaccagcacactctattgttcttactgtagttctttggctaccagatgcccaggtaccagaactctatttgtctctgtatgaaaatacagagtgatgaacaagaaaactagtgattacaactaatgcatgtgttctagttacaaacacaaacctgcccctccccctcctctgagctaatggatgaacctcaatcaatacactcaggaaagactgcagaatcaataacaaggcttatttaacagaattaagaagtggctttttaaaaaacaaaagaaaaaaaaacaagaaagtagacacaattgcaataactgcattcttatgttgcctggcaacaagatataaaaatgatgtacaatgtcagtgacttattttcacatagagaagcagccccctgccttggcaatgctataatgtactttcccccaactagaactccacagagactattaatgctaccattttccataatacactgttaaacaatcatgtgtttttgttagtgcattaaaacactgaatttacttaatgactactcagtgaggcagcggctacagaaaagggaggagtttttgtttcctttgcaagcacaggagttcgttccctgggcaggagaatttaacaggtagcaatggatatgaatcaaagcactggaattcacatacctagagaggaaggtgcactcttacgtcttttcaagggaaagcagaaaatgaagtcgaagtgcagtattagtgttccttgactttaaaaaattttctttagaatatgaaagaagtttctggaaggcagaaagcctttgaggttccaagacatatacttggacatgggagtgaaggttcaatagaaaaggaaagtgacagcagagcgctttagctgagaagaagagaagaacaaggagcggctacagaggcacccagctctcagggtctacggggcaagccctcaacgcggggggctggcgctcctactgcagcctgcacctctggcagtggggagggggcacaggtttgcaccctgctgggggtcacacatacattagctcatttcatccttctatgaaagcccattcaatagaagcagaaaatagattcaatgggattaggtgattacccagtgtctgtcggctagtgaattggaaagctggaatttaacactaagcctgtctgtcctcagagccaccacacacctttgcctccattggctgtcactaatttccagctgtaggggatgttctgggattgctgccatttagtgcccatggagcacaagtaaggaggaaagctatttcctccaaagaagcaataaaacaaataaaaaacaagaaaccactttcctgatgagtcccacatcccactgcgctgtatttatgtgcacatttgttaacttgcacacttccatgattttttgcaagcttcttactcattgttcactaactcctttggtacagggccaggtgttatatttttataagaaatagttttaaaacaactgttttctgctgaatagagcattttattcaggagacctccagtaaatactgatggacaacttgtgggtaagggaaaggtcactttgttttacaaaatctttgggaaaaggaatctgtcttattcacagtgctatcttcaacacctgcactggactacagtaagtgctcaataaataggtacaaaatcaacatcatgcactcaggaatttcaaagtcttcctgatatgctgatggaccagtgatttttactcaggatccttgggggcttgaaccaatactggtacctcacagcctaactgaaatgagcaaaaaagatggataacgtgaagtggaatgctgtggttatggaaagggcagacaattataggcaaagacaacttgatgtcagctcagcatcctcccggttgctatgcaaccccagagaagtcccttgtcttacctggccgctttaacctcaccacacctgttcccccatctgagagataattacaacacttactgtgtcaggcagtcaacaagtatttatggaatgcccacagggcacagagcaataaacctattgcttacttaagccaggaaatcaagctacagcaaagcagaggattagtacaaatacctgggcaaacgtgccacccgcagaagcattaggttcttaaatcctccaggtaattgtggtcacacattagtcttggctttagggccttttaaagtagtatctgaaatatcttgtctatccactttagttcaagtgtgtgagtgtgtgtgtgtgtgtgttggctttccatctccgcttaacaaatcacctcaaacttagtggctgaaaacaacacagatatatgatcttagagtttgaccgctaaaagtttaaaatgcatgaaaaccaaggtgctagcaagaccacgttctgttctggaggctctaggggaaactctgttcttgctccttgcaatttctcagggccatcacattctttggtttgtggcccctttttccatcttcaaagccagcgacactggacaagtctttctgatgctctcatctttggaattctctttcctctgtcttcctcccccacatctaagggcctttatgattacattgtacccatccagataatccaggataacctccccaactcaaggtggatgattagcaactttaattccctcttgccatgttacctaacatattcacatggtctgcggattaggacatgggagggacgtgcttttctgcctaccacatgtgtgtctggctgtaattatttatctattgagagcaatgaaaggtcattcattctatgggtacaactcaggaccttatgtaagatcatctattgccttcagaactttatgctctcaggaaggtgataagtatgtaaaatattaacaaccaaaaccaaccctgtagtttgcaaagcactttgacattcatccttttggttagaacctctcagctactttgcaagacaagtaaggaaactattattatctctgaatcacagatgagtaaactgaggcacagaggttttttggtttttttttcccttaaggacagaaaacagcatattcaaaccgaggcatgtgggtttctggtctggtgctctttatcctccccgtactgcaaacacctttacagtatgtgtcatattgacatatgttgccaaaagaagagatcctgctcctatttcatgaaaggaaaacagatgtgaggttgttcagaaactcaataaagtgcataaagtatgccccttgcagagctgaggcaccagattctccctccattaattcagtcttatccctgatccatgcttgcaaagcaagagacaagggaacgaaaggacagaaagaatttctacaggttgagtcaccatttggacgcagaacaacgtggcaatgtgggcacttcatgcacacagttaaaataagtcacacgctttatgtctgcatattttctttgtatgaataaaagaatgcagctgtacgatggccttggccttgtgtggacagtggtagctacgtacctgaacacagacaatgagagaagttgagaactttcattaaaatatttcagtcatgtaagccaatgagcattattttagtctccataaagctgcattgtttcaatagagaatccaaggccagaaatgtgctcattctaggcacaatctcacagtttgtcctgatgtcttaccttgagggggtgtgggcaatgattcttgtgcccaatgcaaagagatgccctgatgattagtgtaaggtggccaatcctgatgaccaggttcagacatccagagcctgccagccagcaaatcaggccctacattttctccctctccattttttcctttcctttccagaagcggtcagcttctagaagccacccacagtggcctctacaaataagatgttacttctgaagtaagatcattgtcttccttccgataccctctgacgaaacctctgaaggtgaaacactagcagaggctgaaaagtcatgatcacctgctggtaatgccccacaaaggcacggaggacacacgtgctgagcagtacctgatgcagcagcctctggagataagactttccccagaatccccaaattctcacgtacacggcatcgtccatgactctgacagtcatattgatgacagatacgaaaaaacatggtcgttggtatcatagaggaaactacataaatgtaaatgcataaagggaagtcgagtgtgactccctttcttaattgtctaacgcaattcccactagatgcataaattgcagttcctattaacggcactatgaataataatcggtttactttctgacttgtatctaaatatactttctatatgatttcatcttttattcagctgtttaaaagcagaacatctaattacagttcctattagtcaacattaattttttttctttttgccatggagcatgtgtgatgactgattttctaaaaacagaattctttagcatatggaacaaatcgtgttattattaatgcattcccagatgactctgcatatcaattctcttaattatttagtcattgctgattatgtctttttataattcattaccctatttctcgcagtgcaggcattttattcattaagtgtcaaaatgaagggcttgacctccaaaaaaaaaaagataatcaggaaataccgacacagttttacaagtctgcgcttcccttctggaacattttcatgctgtgtgataacatgctttaaacaacttttccaaggacatcagtaggtacacatgacagggttgcaggcagaggttggagggacgtcgagcaggggaggctgtggagttgctcacacgaggtttttctaaagatgagacggcaccagttccaactacagctcaatcacactgccatgttctcattctaaacaaaaatgccatttgtgtaatagatttttataccagttttattcaaaagctaacaggatgcttccaaaagagctctttaagtagtagtactgggaagtctaggataagaaacatttactaaattaaaagaggactaggtcttaataagaattcactttgccttcaggctgatcctactgaagttatgaaacctgacctggagtacataacaaggcctgtgtactacgatcctcatgctcatgttggctcattatttcagtgaggtctgtgcaccttgtctgagaccaaattcattacttagaaaaggcaaataaaaaatatgaaaaagaatcaaggaagctgagactgtgaggagattaaaggagaacaaacacacctacttctacctggttagagccttctctgtatctaagatgtcagcttcacacagatggaattttgggaagaatctccccaggcttcctcaacaactctgctttatttgtaacctagatggtagccactacagtagcaaagatcacagtcacatagaacaaaacagttcacctgtttataaagtgcaccttccagctaaacacatggctgctgaccctaccaagttgagtactactgagcaagttgttctaatgaaacccattctgtctgttttctgactaagagcaaacaatagatgccaaatactcaaagaaggggtgtacctaggcacagccaaccttgcaatggaggggtccaagaagagtgttatgaccttcagctcaatacccacctgagggtctacaagggttgaagctgaagaggccaagaaagaaactttcttgggggaaagttgctgtagtatgtggcatttttcctcccctatctgtagtgggtaaggggatgacagatatttctttctcacctctagcctaagtaaaagagcttctaatcacacaaaccaccaccaccaccaccaccaccaccctcaaaggactttatatttgttctgggggcttggggataactaactgaagcctgaaaaagcccacaggggaaaggcaactgaatggcctgagatatagcacagaagggtatactggatgtgaactgcactcccacctacagagagacaaaatatactactgcatgcagaagctgagttggagcacgcatagggaaggaagggcaggtcctggggaagattgaaagggaggcactaccttcatcaagggagctacagcttgacattcacatggggaaaatctttctggaaccatgaaaacatcccacaagaaaaagaaccctccaatctccaatgccagctcacaggaatagccaagtaagattgttccagccccttaccactcttttatcacactagctccggctcctggaggagccagggccccagctaaaaaataaaagaaggagaaatacaaggcagtggaagagagaaggggcaaccatgtccctccacccctcccaggattacagcccaaagaaggcccaaggtggaggaaggaaaaacttgaagtttagagctttgactatgccatatgatttggcattttaattatacttttttttttttttgagatggagtctcactctgtcacccaggatggagtgcagtggcgtgatcttggctcactgcaacctctgtctcccaggttcaagtgattctcatgccttagcctcccaagtagctgggattacaggcgtgtaccatcccccccggctgatttttgtattaaaatgacacatttttgtcactaagagtgactggagaacttttttattatataacaatgtctagaaacaccatggaagctatgagatttcatccaggggcaggggaggaagtagcccacaaaaaaggtctagagagacaatgagaagaaaaatagagttgctttatgatcatgaattgttcagtcttattccttggatgtatcagttgcattttttattatagcaaaatataacaaaattttaccactgtaaccatttctaggtgtacagttcagtttaagtatgttcacactgttgtacgaccagcaccaccatccatctgtagaacttctccatcttcccaaactgaaactccatactcattaaacaatatgtaatgattgcattttaatgagcaaatagaagaattcagcacaagtcccggctcctgcctttggcacttactccatgctgctgctgctgttttacttttacttattcaatttctgatgctcttattttctttgtgtagatctgactttctgactatatcatattccttctgcctaaaaaattgcctccaacattacttgtagagtatgtccactagcaattaattccctcagtttttgtttgagaaagtatttctccttaacgtctgaagcatatttttgctgtgcatagaattctgggttgagagttttttttttttttcctctttcagcatgttaaagatgtcaccccactgttttcttgcttgttagtttctgacaagaagtccgctgtactacttatcctggttccttctctctctctctctctctctgtgtgtgtgtgtgtacatggatatttaccttgcaaggtatcctcttgagtttgagcttctggggtatgtggtttggtgtctgtcactaattttggaaaattcttggcccttatttcttctgccctgctgtctttattttcccctctgtgattccagttacatgaatgttaccatttgatattatccaataggtcttggatgatctgttctttttttttttttttaaatctcattgcatttcagtttgggtaactttggttgacttatcttcatgctcactgattgttcaatgatgtccagtctattgatgaactcattaaatgcattctttatctctgttttccattttaaaaattttttatttggctctctcttgtagtttccatctctttggcgacatggcctatataatcttgcatgctgtttaccttctccataagagccattaacatattgattgtagccatttaaattctttgtctgagagttctaacatctgtgtcaaatctaattctacttctgatgactgctttatcccttcagactgttatttcttgctgttttgtaagtcttgtaattttttgttgaaagccaaacatgtcatctaggacagtggattccaggtaagcacattgcatgcttggagatgaggatgccttcctcctctgttagttcttcagtgtggaggtttctgttaatgtggtcaggagtctagttgtttgtgaagactgctatctgcttggctatgagtgtccctccttggctttgggtctccctttgcatggttctccaagttgtattccactgttattcttctcaaagcttgttagtgtggtggttggagagtggaggagagaagatggtatctgatgttccgattaagcctcagcctcaggtaggcactctgaacaagagtcttggtggtgtgtccttcacaagtgttcctgagctttctccagatataccgtaatgttaggtagcacacattcctgccccttccccatgggtagagttttttgtgttcttcttttctcctcctctgggtacagtgagtttccaccaggaacctcaggatacattttggttgcccttcctcctgtagattagggcatttgtttcttaggaatgacagggaatatgattctgagttgaatattgctagtggttgccattcttcttccccttctctagagggatccaccagtgccctcaggctgcagttctgtatccttcctgaagattaatgttctagtcagtaggagagatgaaggacatgggttcagctagaggttctgcagtggctgctgttcaacttcctcggtcaagaccacaggaaaggcttctcgagattctcccaggtcttcccttggggcacctggcagaggagacgcctacaacaaagtacaaacctccccgggtctgccaccctctcctgcgagcccatgttcagcctttagcaatttgtttaaagtttctagccagatcttcttactggctcatacggtcttgtgtggtgttccccatgtaagcaaatgtccaagtcctgcttcttcctgacacgtctatctctcttcatatttcagactgttgttttccatgctatttcagatctcccaaaggagttttctgtttctttggctttttttcctgttctaagagggggattactgctccttccagattactgcctttagctctgagttgaaatattgctgagtttttattttgttttgtttttagagatggagtcttactatgttgctcaggctggctttgaactcctaggttcaagcaatctttccacctaagcctcccgagtagctgggactacaggtgcatgccacggtgcccagcctgttgctgttttatcagcactttaccaagttgtgtgcaatctttaatctctgagctaaacaactagcctgggtcaagcacatgttgcagcttccattgtcggagaagaaaatgagttagaaaacttattactgtatttactacattgaatatgcatgaccaatccttcattttcaagtaatcacagtgtcattataaactctaaattcactcagaagtgacttcttatcagaagtaaaaaaacaaagtttataattttagatgcctttgccttcttatgaagacatatgcagaattccatctctgactcgtttctggaccctggaaataactggctttttatagcaataactcaagggactgaatataatttaaaagtaatatacccaatacaggttgagcataccaaattccaaatttcaaaatccaaaatctgaaatactccaaaatctgaaagtttttgagcaccaacatgatgctcaaaggaaatgtttattgtagcatttaggattttagatttgggatgttcaactggtataatgcaaatattccaaaatccaaaatctaaaacacttacactcccaagcatttcagataagagatactcaaatcattaaagtacttattgagactattaggtgggtgctacaaaatcatttcccgacagaaatgtagggaatctcattctaatcaaattaaaactgtacatcaatgaaaaatacaacgttgaaaccgacaatccttcatccatggtaaatgaatgtcaatcaatttcccctcctgtgtctttgtttaaacgtctatgtaaagtctggagattttctgagcctatctctttggcaactcccactattttaattcacagtcctttcaagtccaagcaaatttctgagtttcacattgctctcctagttggataaatctttatatagaaagcacttacatttcagtaggagggtttagtcatttgtcaataaatgagatagctggttcaagcaatctaccaagtttatttctatgtgaaaatactgctagaagttagcaggtatacatgatctacatgattttaaattctttgtgaattctcaaaataaatctttagaaatatagtatactagaacatgtattataaaaattactttgcctgggtaatctaattcatcattgggcatacttagtatagccatatatacatacttataaacacaacttacaggtataagttgacataaatgaacataaactgacaatcaactaagaaggcaaagacatttaaataagcacattgtatttaaagagataaaaagctatcaactacctatcaaatgaatgttccaccagggggtgtagtatgcatttattatgtctgcagccaatttacctggcgtatgcacctaaaaacagttgaacaaaaagtatatttttgtagaatgatttatgacgtcccactggctttcatttttattccaaggaagctttgtctgtatattttattgcttttcaattaaatccaaagttatttccaacacttttggttttcaaattaaagctaagttgtaaagaaaactgtaaacaaatatctagattcttcagggaagtctgctattaatgctagattaattctttcctatagccaagaatcttttagcaaagcaattgtttcttagcgttaaatacaatctcacaaatattctacaaatggattttataggttgagatttcctttaagtaaagctcgtcgctaatgaatctggaaatattcagttattttaacaagaataatagcagctaacagtcattagtcccaaaataaagtgtttccttcaatctcagatttacaaaattggtttacctccacaaccacatttgatgaatgaaaacattttattagatatgttgattcactaagatgtgcgtattcacaaatttatccagcaatagatgtaacaagcatatgaaataataaatgagaacagtagcttttttccttgcaaaatgtacactctactgacatctatattgggtcagcatcacccagccactaagcaccaaagctgttgttgaacgcaggagtggctgatgctaaggctcaagctctggtgaaaacccacactgtgtggtcaggggagccggagcttctgccactgggaaactcttggtttctcctgactctccatctttaccttccccctcctggggaagaggacagccttgcctgttgttgctcttactgggggtaatgtgggaaggatgcctccaccaggaggtgccagtcatcatagagctccatggaaggcagcacagcacaggcggatgcaaaaagaatccaacatttcgagatgcattattcagtaactaggttacacatgaatacacactcaagatcaatttgtaaggaactatcaaaggcacagtcatgcatcgcttgacaacagggattcattctgagaaatgcgttgttgggtgaattcgtcgttgtgcaagcatcatagagtgcacttacacaaacctgggtggcacagcctgctacacacctagcctatatggtatggcctattgctcatagcctacaaaactgtgcagcatgttactgtactcaatactgtaggcaactgtaacacccctgcaacacacgggtaagtatgttgtgtatctgaacataccgaaacatagaaaaggtgcagtaaaaatacagcataaaaggttgaaaatggtccatctgtatagggctttttccatgaatggagtttgaaaaactggaaggtgctctgggtgagtcagtgagtgagtgctgagtgaaatgtgaaggcctaggacattaccgtacactactgtagactttataaacactatgcacttaagctacactaaattaataaaaatatttttctttcttcaataataagttaaccttagcttgctgcaccatttttactttatgaacttttaaagtttcttaactttttgactcttttgtaataacacttaaaacacaaacacattgtacaacacattgtacaaaaaagtctatatcctcttctgtgacctttttcctatttttaaggtttttaaatttttttcttacttttaaaacttttttgtcaaaattaagtcacaaacatacatattagcctaggcccacacagggccaggatcatcaatatcactgtcttctcctccacatctttttttttttttttttttttggatagagtctcactccgtcccccagactggagtccagtggcgcaatcttggctcactgcaacctctgcctcccaggttcaagcaattctcctgcctcagcctcctgagtagctgggattacaggtgcacgccaccatgcctgtctgatttttgtatttttagtacagacggcgtttcctcatgttggccaggctggtctccagctcctgatgtcaagtgatctgcccgtcttggcctcccaaagtgctgcaatcacaggcttgagccactacatctggcctcccctacatcttttcccactggaaggtcttcaagggcaattatatgcatgaagttgtcatctcctaggacaacaatgccatcttctggaacacctctggaaggatctgcctgaggctgttttacaggtaactttttaatatataagcagaaggaatatgctctaaaataacaataaaaattatagtatagtccaggggtatccaatgttttggcttccctgggtatactggaagaagaacaaaattgtcttgggtcacatataaaatacactaacactaacaatagctgatgagctaaaaaaaagaaaaaaagaaaaaaagaaaataaaaaggtccgtgcataaaactcatgttttaaaaaagtttacgaatttttgttgggccgcattcaaagccgtcctgggctgcatgcagcccgcagattggaccagcttggtatagtcaatacataaaccagtgacacaatcgctccttgtcattctcaactgttctgtattggacatacctgtatgtgctgggcttttatccgactggaagcacagtaggtttgccgacactaacatcaccacaggcagtgagtaatgccttgtgctatgacctcgtgatgaccaaaacattgttatgcggcacatgactatttctaagctcactagggcccctcgtgtcacacaacaggcatttgagagcctcagtctaacttctcacaagcaatctgcagcttctcaccaatgaagaaacaaaggcagccagggcacaacctttcatttccccaaggctgtgagaaagaggtggtataaacacaagtcttgtgtccccaaaagaagaatttattccttcttacattttggaaatattgatattttaaaaaaattactctgtgtgattttaggaatgtgagctgggctctgggaggcctgagtttaaactccgtctcttactcgctgtgttaacctctctgcatctcagtttccttctctgtaagacaagatgacgtcacaagacgcttcatatccctgcgcctcaaagaaaggcagtcatcacgcaatactgacttaatgggcccttcatcattttttggggataagaggtccaagacacatcttttgtgggaagatgagttttcccagtgatgctaagacactgggggatgggggtggaggtcaggttgggggtgggtttggggtagggaggtggaggcacacattaaaaaaaattgccaaaccaaatttattgctgatctcattttctcagcatttcttctacattcatcaaatattttagccactgccttttcatttcattttcctccagttgcacgtgctttgcttttgatgtggcacacactttgaaaatacattattaaacagatgagcctgtcacccctggagctggcactctgtcccctgcttattcttaacaaatctctctttgtgttcttttgtgctgaagtgattaatcatttccactatccaagggctgctgacaatctttctagatggctccgctgccatgacccctccccgcatccacacagtttgaaacatgctaggaatctgctgctgttcccggggctttattcccatcacagtgggctcctcatccatacggtaactagccaacctccaaaagagctccgcttttatttcttgcctttttccagagttcggggtgggggtgtgcgtgaaggggctcctggcgacttcagcaggaaaacaaggaaactgtaagttaaaaagtcagaatgataaatgcttattttgtagaccagacaggaggtttttatctcactgtctggacagaacctgctgcacctcatttttctgggcagtatcctcctcttcactgcactgtggctgggttttcttctccccttcatgctttccctctggttatctgtaacaaagttttcaaatggctccatattgaaagcccaggctttgactcaccaggctctcaatctgtaatctggtttccagagctgcagcctaggtaggttttgggaagttgatctttttttaataagtgtttacaaacatttttaaactaactttaaaggtactattttaaaagcctatccttccccaaccccccgcccgccccaagcatgcactgttaaactgaattcaaaaacatgttcaaagaactgaccaaaaataccattaggtcacaagttactgccagagaagggaaagctacaatgattcagaaagtattaataaatgtgcagaaataagtattctgataatgttaaggtaattagcatagaatcccagggtgatttttaaaaataatatgtactttacatgtagaaataaatctatatttgagactattgaaaagatatttacaagcacttgaggaatagttttaaattaatacattataagtgtaaaataagcatgctgatcatatgattttaactaggtttcagaaatgtaattactgttcatagaaagatacttaaaaaaatgagtagtcatatgttctttgcagtgctattcacagtagcaaagacatggaatcagtctccatgcccttcaacagtggactggagaaagaaaacgtggcacgtgtacaccatggaatactacgcagccacacaaaagaatgaaattctgtcccttgcggcaacgtggatggagctggaggccattatccttagtgaattaatgcaggaacagaaaataaaataccaggttctcactcataagtaggtgctagacactgactacacagagacatcaggatgggagcgatagacaccggggactaccaaacggcaggggctgaaaaaccaccgatcggatatacccaggctcactacctagatgaggggatcacttgtaccccaaacctcagcatcatgcaatatacccatgtaacaaacatgccatgtaccccccaatctaaaataagattaaaattattaaaaaagaatataaaatccttttttttttttgagatggagtttcactcttgttgcccaggctggagtgcagtggtgcgatctcggctcgccgcaacctccacatccagggttcaagtgattctcctgcctcagcctccccagtagctgggattacaggcatgcaccaccatgcccagctaattttgtgtgtttagtagagacagggtttctccatgttggtcaggctggtcttaaactcccaacctcaggtgatccacctgccttggcctcccaaagtgctgggattacaggtgtgagccacagcacccagcccaaaatccttaatatttttaattccacagaaccacagatctctaattgtttgaagtcacaataaaaaaggcactaaaataaaaacttactaaccaaaaactgcaataataaagaatgaactgcccataggatataacttttataactttctaaggaatccaggggagagagaaatacacacacttgcatacataggtgtaccttattagtgtgtgtatgggagttatgataaataaaatatatcagctagtgctagcatatgataattcctttcaaacctagtatctggagacacatgaagaggtccacctaccctgagctgtcatcagaaactgaagctgcttaggaacgtagtgctggcagagggagggtctctagagtgtggaggtgctgcacacggcacttttctagaatttctgaggtacaagtgggcccaggaatggagttctgggccaatgaaataatggctcatgttcaaaaaacagttaatttaggagtctaaacaaccccagcggtgggttagcgattgtgaaattatgggctgtgtggactgcttccaaaatcagaacaaaacaacatgcaaataaatatgggagcatgctggaagagttctggaaataggtctgagttccaaccctgcattttcccaatacttacattccactgaatccaatgagcataaaaacaaagaatggcacatccacacatcagatttatcagaacgtataaaacgatggataaatgcaatggcaaaggagaaattaggtttctgaggttttttaggttataatgaactaaatgattacaagactataaaaaggtaattatgtcttatttaaaatatatgattattatctagatagatgttctaatttttcaaggcttatattgctttcatcctcaaatgatcattttctaccttagaaattattttctaagatctgtgtgtgtacaatagtaatttgcagcaaatcagtgtaatttcacaacccttaatttgaaaaaataacagaggacactgtatgtgattttcatgataataaatacaaatttaaaatgtatgtttcgagttgatcactttggatagatgtgttttaattgttccaagaactgctttacacagagcatattagcagtggaaacagttttgacttccagcccttgattctaccagcagcaacatggtaattaaccaaattatccctgcaaatgtattagcttgatttcttcaacttgtaaaaattcattacctatcaaaatgaaaggcttagtctcatgaaagatactcaggataaaagtggcagacacaaaaagtctgagttttctgacacacactttagcaggagctgctgcactccctcctgtttctagccctcaggggttagcatgtgaattttcttctctcttgcatttgtgccaattgtacaatgtgttctaatgcttccaggtagcacaacagtcttggcagtccttggagagctcatgttttaggggatggtaccttgaaccatttgcttcaggactagaaggacaaaagggtgaagagcaagaggtcaaaatcattcattcattattcttcatccatttattcacttaaaaaatttttttttaattttttgagatggagtctcactctcttacccaggctgcagtgcagtggtgtgatttcggcttactacaacctctgcctcccaggttcaggtgactctcatgcctcagcctcctgagtagctgggattacagtcccccgccaccatgcccagctaatttttgtatttttagtagtgacggggtttcaccatgttggccaggctggtctcgacctcctgaccacaggtgatccacctgcctcggcctcccaaatgctgggattacaggcgtgagccaccccatctggccatttattcactttttattaaacatcaactaagtgccggtcatcgtgctcacccctggaggtagataacaacagcccaggagaaaataagaaagaccattacatattaagtattgtaataagaataaagtgtaactggcagacatggaagaggaacctctaactcagactttgggaatcacaaaggcttcctggagggagtgacatctctagtgaggcttggaagatatgcaggagtcggtcagctaaatgtgtggtcaggggtaggcagagcatgtgccggggtggggaagagcatgagttgcgcccagaggtgatggtgagagcagtggttacgcctgcagaagtgcagcatggagtgtgaggggcaacgtggtgaaagatgagtctggaagcatacgcacggccacagcatgtgcgactctgcaaaccacgtctgggggtctctggcctgactctatcctgaactcaggggagagccacgaacaggtttccagcaaacctatgctttggaaagtggattctgcctccattgtggagactagtgggaggcagagggctggcaagcaggtctctggagtcatgtaggaaaaggatggtggatgaacaaggagatagctggaggtaaagagaagtggacccaccggagggagacagagctgacaggcttggtgaggaactgaacatggtgagtgtgagggagaagaagaacccaacagcatggacagccggggaatgaagataatccaagctgcaggaaaagccggcagaggtgtgagatgagttaaggtgcaggtgtccatgacacatctaagtggagcaatctggtggccgctgggcaggtgacagaagttcaggaaacagagctgtgtttgagacacacttgagacccatccccacacagatgttaccagacaccatggaagtacagcatctaagtagagaagagtcaggatgggaccctgaggaacaccaacatcaagggggacttacaggaagacaggtccacgtaggagacccaggagaaaggaccacaaagtgggtgaacccaggagggtgtgacagagacaccaagggcatgagcattttcacgtggatcctgcagtcagcaacatcaaatgcctgccagagatcacatggggaaatgctctctgtacttctgataagcaagcctggggtggtaacctcagtaaaagccatttcaggaaggaaggtggtgggagagatggcagttggttgaaggggaaatgaaagtgaagacacagagagactttggtctggagagtctagttaggaaggaagaaagagctgcaagcaatgtagcactgaagatatatatatatatatgtatatatatacacacacatacatatatacacatatatatatgtacacacacatacgatggaaagaatctgtatgtgtttactgagaatgagatgccagcagagaggcagaggttagaagagggcagagagaggaggtgctcactcctgtgctggcttcagtagtgcctgtttcactcacccttgtacccccagcgccgagaacagagcctggaacagtgactgtctgatgccactggcccaggggtgctcattggatggcatccatctctctggggacagagaaggtgaagcgtctgcggagggtgacgaggacagtgacaaggaggtgctggtgtcacaggtgtgcagcaagcagggatggtctaagccaggcattcccaatgggcaccttacaaaattggttcttggggatgagaaaaccttactctgtgtataaagcacagactcacataccatgtacaaacagacatgcggtatctctgtggtattagaatttcatttgggaacaattgggagaaaagtgtcttaaaggttcctgagggggttgataaagtcaatggtaaaatgactgaaggatactcttcaagtcagtaatgctggtgaacattgcattgatggtgagctccagcggggaataagttacccttcaaggaagagagcatagtttggttactgtgatcctgccctggcagtgagatccagcataaagcagacgtcgcaaccggctggctgcctggaggggtccgcgatccagacctccagcactggctgctggagagaagcagcctggactccaacctgtcagtcctggagcaagtcaggagcagtgcagaccagaaagtggacaagcaaggcagcaagcacgaacgtgtagcgagctagcagagaccgccacgagacggacccacttccaaagggggccatgactcagtataacgatcccagccacaggctgaaaccagcaaggcttttggggagaaacactgtagtgcccttagggaatttgatggaggcagtaatgggactgaaaggtctttggtggcttacactcgaggacctgtttgcaagaaccagctgcctgatggaattcctaggtcagagtgaaaagttaaaaatgttgggtagagctgaagttcacagagcccttcatgctagggattttatggcacaagaattacacacacacatcacacacgtacacacattcacattccaaaaatacttttagtagaatcttatttgccttcatattttaagtactaatatcacttcagcagatattttggtgtctctacactaagtcctcacttaatgtcatcaatagggtctttgaaactgaggcttctaagtgaaatgctatataataaaaccagttttaccataggctaattttgatataaacaagagttaagttcctacagcacatttctgatcacaaaaacatcaccgaacttctccataaggtccaaacacttttaatattaaacactgaaaaaatgtgagctatgcatacattaagaaagattaataaaaccagaaaaataccattcaggacataggcatgggcaaagacttcatgactaaaacaccaaaagcaattgtaacaaaagccaaaattgacaaatgggatctaattaaactaaaaagcttctgcacagcaaaagaaactatcatcagagtgaacaggcaacctacaaaatgggagaaaatttttgcaagctacccatctgacaaaggtctaacatccagaatctacaaggaactgaaacgtatttacaagaaaaaaacaaccccatcaaaaagtgggcgaaggatatgaacagacacttctcaaaagaagacatttatgcagccaacaaacatatgaaaaaaagctcatcatcactggtcattagagaaatgcaaatcaaaactacaatgtgatatcatcttaggccagttagaatggagatcattaaaaagtcaggcaacagacgctggcaaggctgtggagaaagaggaatgcttttacactgttgctgggagtataaattatttcaaccattgtggaagacattgtggcgattcctcaaggatctagaaccagaaataccatttgacccagcaatcccattacagggtatatactcaaaggattataaatcactctactataaggacacatgcacaagtatgtttactgcagcactatttacaatagcaaagacttggaaccaacccaaatgctcatcaatgatagactggataaagaaaatgtggcatatatacaccatggaatactatgcagccataaaaaggatgagttcatgtcctttgcagggacatagatgaagccaccattctcagcaaactaacacaagaacagaaaaccaaacactgcatgttctcacttataagtgggagttgaacaatgagaacacatggacacaaggaggggaacatcacacaccagggcctatcagagggtggagggcaagggagggagagcattaggacaaatacctagtgcatgcagggctcaaaacctagatgaccagttgattggtgcagcaaaccaacatggtacatgcatacctatgtaacaaacctgcacattctgcacatgtatcccagagcttaaagtaaaaaaaaaataaaaataaaaataaaaaaacaagaaaccaagtaagataattacttacaccattctaggtgaatcagtgagtgactgcagttgcagtggtggtggtttccatcaaagaataaatgtctgcaaagcaaaaattgtaaggagcacctcctcctgccacgaagtttaaagataatcacgggccaggcccggtggctcatgcctgtaatcccagcactttgggaggccgagacaggtggatcatgtgaggtcaggagttcaagaacagcctggccaacatggtgaaaacccttctgtactaaaaatacaaaaattagctgggtgtggtggcgggtgactgtaacccagctactcgggaggctgaggcaggagaattgcttgaaccaaggaggccgagattgtgccactgtacaccagcctgggtgacagagtgagactttgtctcaaaaaagacaaaaacaaaaacaaaaacaaaataaaacaaagacaatcacaacaggacctgctcacctagtgctttcataccatgctgtttattgttgtgcatctgtatgactattgtagacttgaagatttgtatgttagaatcatttctattcattcattcattttcaggccacttatcctagttcagtggggtgggtggctggagaaaggcaggcaccagccctggccaggatgccagacagcccctggcaaggcacgctcacacacacccacactcactgacactaggactgtgaagacatgccagtgaacctaaagggcacatctttgggatgtgagaggaaactggagtcccagagaaaacccgcacagacttggggacaatgtacaggctccacacatggtggccccggatgggaattgggtttttttctcatcaaccttataacaaaacaaagttgaatgaaatgatgttatttgagcatctgctgtatgcttcttaattagcattctaaaaatccttttaaatgccttaaaatacaataactataaaagtaatcttcagttctcatctccagtaagttttcaaagtctgatgaatacgtatggtgatattaagtatgggaacaagaaagaaaaaataaaattgcattggttctcttaaataaagttaacaaatgacataaaccaggttagctggctagtactgaacactagcatttcactgtcggagaagaacactcaaatgaaacccagattgaaaataagttaagtgtttggggaatttacacatttgaaggtactgatagatactatgatttgacatgtattaaccttttcaactctgtacaattaaaaaacactgcaatcgaaaacctcattcatggataaagataagaatttgcacttattgttctatgtgattcacatttaagcccttattttttgaaaatgctcactaaaatataaagaagaaaaaactataaagatgttatgaaaatgtgaacggactatatggatgacaatgtgtagtccaatggcccacacacatacgaggccagtaaggttgttatctctcagctccaatcccacccttctaccctcttgttttgtgttgctggggctggactctctgcaaaccacctttcaaggacatactgctgttgaaagaagcacacctctatttgttttctcctctgcattcctcctgtaactcactaatcccacccgctcagtgccttctgcatgtggcagctgttcaaaggtactgagtacatctacatttgacgtacttgcgtcagtcctctagtgtagtgctgaagttctccaagtatctccaagaaactatgaaacctttgcataaaatattgacaaacgccccgtgaaaagatattgactgcagtatcagaacccgctttttactgttagggcagaagttataatctcacagacttttagatgcttgggctgctaacatgcccttcatcttctaggcatatggttctgcaaacaactttgtgatttctaatgacgtgcatcaaaatgaaacaggtaagtatcaaagggcgaagctgttcattctcaacaggagcttctggacttccagtattcctttacccatcaccccaaagcctccgggctcagaacagattctgaattaaggtggtctcttgtcccacctctgctagaaaatgaacacctccagagtcactgccaagtccacagattgtagtcacagggccctgcaacatagtggcaagctgttggccacagcttgcaggcaccagggtgcccttagcaggtagaagtggagccctttaggaagggcttttggtttcaccccaaaggattagcataatagcatttatgaacaattaatctcacagatataaaatgagatataaaagtgtggtatttctgtccctaaccgttcagatggctaaatgcaaaacgaaaacacaggactaccaagtcaactaacttatcttggctagacttattgtaggtttttctcagtgaatttctctagccctccatcgggctgacttttgttttgagtttattttgctacagcaagtaatgggatatattaatggcgcacctctacagttacacctggattgattttgccattggtgggcttcatttcatcactaatgatgaaatctttgctcttggaaacaaatgaaataacttataaaggaaacagtatgagctagaaaaaaaagcctgcctggtctgaagcagggaagatttgacctaggtccagctctgcaaatgacccaaataggtcactgaaaacaagttatctctttgttctctaccttccagtaggcagagaatggcaagtatgttttcatttgattgacatttgtgagcacaaggcttctcttgtcccaccatccggggtctgtacatgtgaggggctatcatgatgtgcatttcccaagtcagtgccctcaactcacaaatctcccaggaccacaactggaaatcatcccatccaggatgctcctgagtttctggaaaaccaaggaaaaaatgagttccctttatttgcctcaagtttgttccactataatgtcaggaaactggctgaggtctccaaaatttaaacaagtactacttacccccttcagataaacagaaaatgcaactctatgtaaatattccttaagaatattttgcagcacactggaattaaattagtgctaaagatgatgagagcaagaaagtaatctgctcagatgttacactgaaattgtctctaaattcattccttaagtccaaaccagaatctcaaacactgatctcttattacaaaggcactctatgttatgagtgtcttcaacaaatgccatgtaaagctgtcttgcataaaaactgtacatcctagattccagcccagcacccccacccattaagttataaaccaattttatttgctgaacaaatgttaatgccattctacgttaatggataatgctatgaaaagcacctaagtattacagcactggaacatttaaggataaaatagagtgtaacttggaaaactgcctgttacaaacatatgtcagccatgaagccttctagccctgatcgcccatcctcacagaactctgttttaatttctccctcagttaagagaattttgcaataacacacagatttattaggtcccaggaataaaactctcggagtaaggataaaaaataattatatgttagaacacaacgtaatattcaaatgacttgaaaacagtcacctcagcaaaaataaggagagaggaagaagttaaagatgaggttgataacactggctataaaacctctgaatttaagtgcataaatgcatgatctggcacttccgaatcataaacaggtagaaacgggaaacctcccattcacaatgaattgcctgactggtttcgttaatgagccagggggacgtcttcatctagtaagtcagtacaatgttaagagaggttgctgtgcaaggcgtcttcattagaatcccagctctaccacttgctagctgtgtgaccttgggcaagttgtgtttaacttctcttcacttcagtttcctcatctgtaaaatgggaatgttaccaatgcctacctcatgaagcagctgtgagggttaaatcacagcttagaactgtgcctcacacataatgcatcctcagtcaacgtcagctcttcatcacttggtggttgttattgtatgagggacgtattgcaattggaaagggagctgaagggaagttacagcctttcctcccaagaagtctctaaattcactgactgcattttctgttttctcgagtttggcttctgccccctctactccaccaaaagggcacttgcaaaggtcaccagcaacgtttctgtggtctaatccattgtgtggttttagatcctcatctttctcgtcctctcagaaactctgaacaccactgagcttgaatctcattccttggattccatgacttttcactgtcataattttcccttcacttttcttgtcactctctctcacttccacttgccagcggctattccttcccttagtctctaaaagtcagaatttagattctcaatgttcctcggtctccagtctctctccagaaaaatttacctatttctacggtgttattaccaatggcatgctaattaatccaaaatgttggtccaacacctcagacctctgctctgacctcctgacctccaatatgttgttctatgttctctgtgtttacttgaatgtcccaaaggcacgccaaactcaccatgctcaaaaatgaatttatgatttccgcccttcccgcaaaccaggatcttccctaatgtttcccatggccgtaagcgcaccaccaagcatctctgggctggactcctgcaatagcctcccactccctcttgcttctccttttcccggtggatccctctccatagcagccagagtggtgcatttaaactgctaatgtgatcacatcactctgctcaaatgctcagctgatccgcatcttataggatctacgacctagctctgtctgcctctcctgcttagctttatctacctgctcaccaactattctgcctttccctctccttggagccacaatcttggaggaagcctggtgtgtcacagatacacaataaatactatgggcggtaaccaagagtcctggtgcttgcgtttggaggtgaagaggggtagaggatcttggagaatgactaatgtcagtgaggcaggcatagacagaaagccattccaggaaacactgggaacactaatgcgatcccctaggagctccccaaataccaactactactactaacgccttaggctgacaagtagggagagagagtaaaaagctccaggctcaactagcgccaccatcatctctctttcctcctcgtccatcccacctcccctcctgactgctgctcataggctaggaagagtggaatttggagctcagttgcctcctaatccagccaccacctccactgccctctcgcacacacatgcagacttcagccttgcatatggacacaaatctgtgatccggtgggtccacgttctctctttgtttcaggcctcatccaaagagtgttgtggcacaggtgcagcactggcggtgggagggaggggaggactggggcgagaggggcatgaggctctcatcagctctctttagaaaacaataactataaagctgaatgagcttttgattgtgacactcagttttattcaaattgaattttgctttacctaaactctatccttttggtgtgtgaattactcaagtctttattcaaacttcaagccttgtatggagaacagaataggaaggtcaaaggatggatttcttccatatcctcagaagggccaagagagaataagaaggtagactttttctacttagggaaaccaaagaggggattggtgtgttctagtattatccttttgtggacataaacactataaccagttaaaggaagatggcttaaaaatggaatatgtgaactgcaaatatgaaagtatgttgaaagagaaaaataggaaaagttatatcagcatcttaggttgattgttctttaactggaaacaaagccccagaatagagacaatatagatataaaatatactatgtattttatttaacatatacttatataccagaaatgaagctgcctgttttgacaattgctttctctataaatctctgccagaaaaaaaatcattatgaattcaacaaatcacatctcaattagttattctggtcaacttgagacttagatttatttatgaaataatgctttccagaaagaaaaacatctggccttttaaaatagttgttaatgtaaaattttaacccaagtaattgtattactgtaactcactagcaattaaaaaaaagtgtgtaggatatccaaaagaaaggaccatattaaattaaaataaagtgtttttttttttacagtaaaattcataccatctggcctaatttgtcttggtgttttgcccagtgtagtatcagctttttgagaactataaattattaggtaactcccctgaaaaaatatgagtgaagaaaaaatatgggttgatgacgacatcctgattatatgtctgaatatttgggaaaacactgatgtggtggaacagcccaacctaagtcaatctgggcacgaaactggttcagggagggaacccacactagacacaacggtgatgaaaaggacgggctcacagagggtgacagggaaaataacatgtgaaacaatagagaaataacagttccagatcctgaacattacctctttgtcaagtgcttctgattccaattaagtttacaggaaaaataaccaggcaacccctgcctgactcaaaaaaatgtacagactattaaaggatgcttttaaatagcagggtgataaatggggcatccacatgtgagcaccagcatatttttcatctaaattctgttcttctgtcttccagctgatcactttaatagggtgtcacctcagcctgtgcagaggtgcccagagggggtgcagctcctagattgttaacagaagtgttgtttcaaaaacttatgtgactactctcagaaaaggtaaatgtcaaaccacagactatgggctcctttatcatggagccgcaggtttcctttctatttagagtctatgtcccacagattgataagactgtttaaagaataatcttacccggattatttcttcaacacagctgttggtttctccagatctactctcctgaaagcaaagaaaaaaaaattaagcctgatggaatagattgatgaccacacagaagacatgcaaggttccaaattagtcccccccaacaaaaaaattcagcgagttacaggttgaggggatgcctgacctgggactggcagacaggctcctttccctaacagccggctcccattgtggctgctgctcccccttctctggctggagcaccacacacgcaccccagaggctcaactgtggcccctccaaccaccctactttaagtggggtgggctcctaggggtacagaacgtgacctgcaggtatgagctccatccaccttgggtgccattaacgtgtggaaactgtggcctccgctacaacagtggatccaatttatccaccaaatatatgccgtgggcctaccaagtaccacaatggttgctacggcttaagtaaaagtctggtagttccaccgtcctcaaagccttggtttactggtttgataggcagaaaactgaaagaccaaaaagagaaacatcctctggatgttggactggcatgtggggcgtcacgctcaagtcacttgttctgtcactcagcctgccctgtgctgtgcagatgttccgaggtgcagtggcttcaggtcacagccgactctggggagcattttaagttccagagatgctgtgtgggtcctgctggctacacagccaagagtgcaggatgtgggtttgtggggacacagaagcagtggacgctggtgaaagtgcctacctgtggtctcagggagatcacttctcttcgtcctgcaattcaaggatgtcaacctgagagtagatgtcactgtgacatcctggaatgaggcttttctccacagtctcttctccaaggccactctcccttcctcctcactgttctctctctaccaagaatgctatctgcacctttcctggtttttctagttaatttcctagttaattcctagttaagtcatccttcgaacagcagcttatccacagcttcctccgagcagccaccctgaccctagagtgcttgcccccagcagcctccacttcttcaaagccctcaccacgacggcaattcaatagtgaagtctccagcaatatctcctccctctaaaacatcagctccctggattccagggctccctgtcttccagcaccgtgctccacacagcatggggcacccccaataactattggctggtggtaggtgtatgaataaatgaatgagtttacttcctgcagttctgaggggcatgaggctcatcagaatcagcactaggactttaaaaaatattatgaaggctctaccagtgaccgttccatcacactctccatgccctgtgtctgccagctcattccttgtcctggggtagagcatttcctttgaaacactctacccttcacttgagttaggcgccaggctgaaggaaggtatgtgaggcttgaaaaggtcacacacatgattgagaccttctcctacccagaattaggggatttatccaagtctcccacctgaggcccagaaagtttacacaacttgccgaaggccacacagagttaccatatggtaatctctgttttaacttttttttttgagaccgagtttcgctcttgttgcccaggctggagtgcaatggcgcgaccttggattactgcaacctctacctcctgggttcaggcgattcttctgcctcagcctctcgagtagctgggattacaggctcccaccaccatgcccagctaatttttgtatttttagtagagatggggtttcaccatcttggccaggctggtctcaaactcctgacttcaggtgatcccctcgcctcggcctcccaaagtgctgggattacaggcatgagccaccgtgcctggcctgttttaactttttgaggaactgtcaaattgttttccacattggctgtaccattttacattcccaccatcaatgcatgaggattctaatttctccacattttcaccaatacttgctattttactctactttataatagctatcctagtggataagaaatgatgtctcattgtggctttgatctgcattttcttttttttctttctttcttttttttttttgagacggagcctcgctctgtcacccaggctggagtgcagtggcgcgatattggctcactgcaagctccgcctcccaggttcaagtgattctctggcctcagtcacccgagtagctgaaactacaggcatgtatcaccatgcccggctaatttttttatttttagtagagttggggtttcactatgttagccaggctggtcttgaactcctgaccttgtgatctgtccgcctcagcctcccaaagtgctgggattacaggcgtgagccaccagatctgcattttcttaatgactaatgatgctgagcatcttgtgtttactgaacatttgtttatcttctttggagaaatgtttattcaagcactttgcccatgttgtaattgggttgcctttttattgttttattataggagtgctttgtatattctggatatcagaagactcttagcagatatatgatttacaaatattttgttccattctttgggttgttttttcacgctcttggtagtgttcatggatgcacaaaactttaattttgatgaagtccaatttacccgtttttttcttctgctgtttgagcttttgagtatcatatctaagaaaccattgctaaattcaagccatgaaaatttccctttatgtttgttttctttcaagagttttacagacagttttagctcttttgtataggtctttgatacaatcgtctgggaacttttaggtgaagtttattttcttgtggattatttggtgaattttcgttaaaacaggaatgttatctttttgcttcattctagtctcatcattaaaagaccaacaacaaaatgtgcaaggcacagccactgctactagtagtgcatgaagacaacatgcactacttggcttatccttataagccaagaaaaatagtgttcaatatcatgacaccaatgctttcactaatacttcacaccctttcctatactcatccttccttctgttttcccaaaagcttcagttggccacatacttattacaagctttcactcccattcccaattccttaccacaggactgctctggaaacatcaccattctgacactctgatacaactggatcagagagctcttttggaacctgatccttttccagggaagcctgaggtgaccatcacaaaggttatataggaaagtctcagtcgggccggggggcttgatggtcacttggaaggatttcctttggcgttcatggtgggaatgagtggtctgaattagaaaatgtaccgtcaaacctacagaatatcattaatcatgactcttatcctacttctaagtcccaaccatttcctactgcataatatgctggcagggcaaatgctgaattctcaatgtgctttctgttttctaccacaaaacaattaatcaagaaaaacttgacctcaggtcctcctggtggaatcacccagatataacagcacactacaaatactcttaaaattaaacttcgggtttaattccttaaagctaagcttccctgaatatcacactttaatttcctttgatgtagtttatataaatgacaggttgcttttataactatctcccttataatcctatacatttcaactattctactctgataaggaaatgcgctgagagagaaatgcaggatagatgccctattagatacttctctcatcactggagacatagatgtaggatctttacactaagtcatctctaaggcagctccaaccagaagccttgatggtctggacagacatcaggtcattccctactaggaaggccctttgtaaagctaaggaggcggcagaggtgaggccagggtgagggacttctaacaacagtctcaggaagtcctggccttaaattacagcatggacagtctttggcagaggaacctcttgagtcttttcagaacactgagaaatgttctggggactcaagaagagtaccacattggtttgaatctccaggaccccatttagattggagtgaatccatgggccacagtatcgtagaaaatctgaatgggaaagaactttggagctcctttcagcccaagtcaatgactttaacagatggagatgccatggctcagagaagtgaagggctctgtccaaaaatcattctgacagcaagacacagttgaggcagaatccactcacatttcaacaccagctcattgagttctctactatctcatgctgtcttcctgcagctcaatccctagagctggctcatgctgaggtaacttgcatgctcacagtatgaaaataaaagaatgcagatagtattggggtaaatttcctcctccttttccacgtggcacattactcagcgcttgatcattgcctctcactagctaatctccaacactacacgtgtagaccaaagggggaagagaggagaggggaagtagagagaaaaagtcaaatctactaccccttctgtgacattaaaaaataaggggtaagggtttgtgtccttagaagtaggaggatggaattccaccttatcttttccaaattacagaaagcgtaggtagataggtagggttggggttgggggatctggggtacgtttaccttcttgaggtctttctcaaatctggtttcagctgcagttgtgtgcttactttgattatatttacattttgaaaactttccatgtttatcaacaagattaaaatatgcatgtaatttacatctccaaattcgtgtttatatttttcacaataaagttattgctttccttggaaaggtacccactgagaaggaaggctgcacaatgcacattttaattactctgtattttttgacggtttgtagctgttgtttcatgctgagttgctgagctgttgctccgtatttactccaactttgaggaacccacctcattttcctatcattacattttgaaatctgtcataacagtctcacctcattgaacctccaactaaacttcaattaagagctagcaaccccagctgattctcctcttctacagcactgtctagcatgtgatttccctaaatcctaccatttaaatgtacatgccgcacactgccaagaaatgtacagaactatgctgtgggtaagtgtagctcggggaatagccaggagcatcccatccctgatggtggaagtccctaattaccatgccaagcacagaatatggggagaagcagggcttaaggaaaaagagtgtgatcaaatcagtgggaaatggtatttcattgcagagatgggctgcacaagtcctcatttttgaaaatagtttaactctttatcacacacatttcaggtggaacttgcattctaaaatactactactttcaaatcacaatgcctttgtttatcttcaagcactcaaaagaccctcaagcatttagaaattgtgtatcccatgtacactcttaaacactcctgcagaaatatttttaaatcaatctattcttgatttatcacaaacctgacatacaaaaagttaggtatgctgtcaataccacaaaagcattggtgagaatctgagctcagatgcagggaccatcataattccatgggaagtccatccctacaactgtgtctcctgccttatctttaaggatagggccacctgtgaacagaggcagacagccagttctctcccaaattcagcctgtctcacacctaacctgtaccatcccctgtcaggggcttcactctgctcccaatccccaagctagaagcccagctgcctctgagcctcctctgatcctcctgtctccaccatcatctatatatgtagatgaggaaaatgcaaaggaaaaatacacaaacagccagggctttaacagagcatcaaaatgagatatgctaggaaaaaggaagagaaatataattattatagttagaagtatttaatccatccctatttttcctaacagacaaaggatacaaaagctcagcttcaatactcaattttagggtccttttaatgtattgtatcaccaagggaaaataagtcaactgtatttatatcagcttacagagtgtttatcataaatccagaaaaactgaaactcactgttattttaaaatcgttaataattatattagttgactataaactaaacagtcaaatctcaatagctcttctgtgtagcagtaaacaatttaaaaatatttaaaaatcccatccataatttaagaaaaataaataaggataacctcaacaagaaatgtttgagatttgtttttaaaacttcagagttagccaggtgtgatggtgtctgtagtctcagctactctggaggctgaggcaggagaatcacttgaacccgggaggtggaggttgcagtgagccaagagtgcaccactgcactccagcctggatgacacagtgagactccatctcaaaaacaagaacaacaacaaccaaaaagaccaaacaaaaaaaaggaaaataaaaaacttctgcgttttactgaaagatacaaaaaaagacctgaaagggactgagctagacttctcagatacctcccaattctggtatatgatataaagccaaatcaatgtacgaagaggagcaaaccacaaactacattaattttaaaaaaattattgaggcaaaattcaagtaacataaaatctaccattttaaagtaaacaattcaggggcatttcgtacattcacaatgttgtaaaccattatcacctctatttggctctgtaatatttccactgtttcaaagtaaaaccctgtaaccaatgcgtaatttctccccattccccatcaatacgagaactattttttcttttctttttttttttttttttttttgagacagagtcttgctctgtctcccaggctagagcacagtggcgccatctcggctcactgcaacctctgcctcccgggttcaagtgattctcctgcctcagcctcctgagcagttgggattacaggcatgcaccaccacaccctaatttttgtatttttagtagagatgatgtttcaccatgttggccaggctggtctcaaactcctgacctcaggtgatctgcccacctcggcctcccaaagtgctgggattacaggcatgagccagcatgcctggcttactttttacaatgattttactgtattaaaacattttacactgcactgaaaagaagaacatgagaaaatgttcatgggtaccatttgcttgtactggtagattttccagtggatgtgctgcctctcatttacgtgtttctgaccagttcctagcagagaactcagtacaacagagcaggcattcgattatatttgttgaatgaataaattaatgaccaatacactaaaaaaaaaaagactatttacaaaatgaaagtcctaaactttataagaataatgccggttatctacattacaaagaaatgtctttgctttatccaaaaactactacaacagcagcaaaccaccaatgttctaaattcttagaacatcaacatttatttacttcattaaaattaggcttatatccattaagtacagaaaccattaacaagtcatttgacttccctaattcccacattggtacctgtaaattagagagtaagtatcagtcttctattagcagacaatattgttaaagagctaataattttctgtcagatatttagcactaggacaaggtatttcaattatgttattatttttatgaacagaaattagcgatctgaatcagagcctatagttaaaagcatatttggttttcagaaagttaagtggtctgtcagtgtgctgacgatgtcaagaacctattgatggcatgaagagatgggagatgagaagcagacagtgatttcatatcctgatgactaattgatattgagtgcttatccatggggtcatgtctcaaaaaagtaccacagtactgtctactggggtcgtctttcacactgctctgtcaacactgggtgaagaaaccatgttacagggcttcccacttgcaacttgacattgataagaatactttaagatttctgtgttctttcacctaaaaccctacgtcgttaattttaccaagaagaagatcacacaggttcaggcaggagtgacaatgctgaagtcatttaatcctcacattacaggcaaacttcagtgagattttgcaaatgtaccatttcctcttgaacattttcctgaatctttattttaattaaattaattaattaatttctttattttgagacggagtcttgctctgttgcctaggctggagtgcagtggtgcgatctcagctcactgcaagctccacctcctgggttcacaccattctcctgcctcagcctcccgagtagctgggactacaggtgcccaccatcacacccggctaattttttgtatttttagtagagacggggtttcaccacgttagccaggatggtctcgatctcctgacctcgtgatccacctgcctcagcctcccaaagtgctgggattacaggcgtgagccaccatactcagcctatgtatttacttttgagacggagtttggctcttgttgcccaggctggagtgcaacggggtgatcttggctcactgcaacctccaccttccaggttcaagtgattctcctgtcccagcctcccgagtagctgggattataggcacccaccaccatgcctggttagtttttgtatttttagtagagacaaggtttcaccatgttggccaggttggtctcgaactcctgacctcaggtgatctgcccgccttggcctcccaaagtgctgggattataggcgtgagccactgcgcctggccgaacattttcctgaatctttatacaattccatttatatgatctaatattctttttttaagggatggcaggaaatgtacacgaaaacacatctgattatcacttatagtcagttttctaatcataaaattctgaacacaaaagcttgcaagacaaacagagtaatctaatgtggctgaagaaactaaccacttaaagatcctacttagcaccactctaatttgtgtcccacagtaagatggataatcaattcccttttagccatgaatggaaatgaccattgtaaatggcaaaagtgctgctgcgtatttgacgatattctatttggcacattctattaattttatttaagcattttgctaaaagagcagactcacaaatcacccttcctatgtcatgttctttatggatctttctctccattatcatctgaccttccccacggggtctcagctcttcctgaccctcagaacagggttcattctgcatactcaacatcagccatttctatgtatgctctctgaggtgatacgctagaaataaatgctgaataaataaatacagctaaaatcagccagagcacaggagagaaggcttatctgagaggtgggagcaggtagcactggaaaacatgagtgagaaactggcactttttttgttggctgctgaggaatttttcaatactccaagttttatatttttaaatcgatctacctacaacaccctattttaaatttatgaacatttatagcattttcattctttttgagacagagtttcgctcgttggccaggctggagtgcaatggcgctatcttggctcactgcaacctccgcctcctgggttccagcaattctcccgcctcagcctccagagtagctgggattacaggcacctgccaccacgcccagataatttttgtattttcaggagaaacggggtttcgccatgttggccaggctggtctcgaactcctgacctttagttcgtgcctgtaatcccagcactttgggaggctgaggtgggtgcattttcattctttattctactggtgttgctttactgttagtcttggaaaatatttgcaggatatgaagagagctattatagtggcaatctattttatcttttcccttctactcccataaaatgttcagagccttgaaaaacaaggtgcgtgtcccagtaaaaggcagagtgagtccttctgcttgtagaacttggggtatctggggctgaactcagatattaatcctcacatgtgtcccctctcgtttttcagagctggcttcagaacgtctcagcagtgactgctgaccactgaattttcacgtaaaacatcaccagataaagttagccccgggtgatcctgctcagcaactcagaagggaagggagcttcagaactgctttctatcctcattctaaagcctctgggtgggacccaaggtgaagacaatctctctgtatcttgacgcccacactattattataaaactccatggtattgtaatctaaagggagaacaaacagttgtacaaaacaaaagggtcaataagaaatagacatcagaggctgggtgcggtggctcatgcctgtaatcctggcacttcaggaggccaacgtggggggatcacctgaggtcaggagttcaagaccctgtctctactaaaattagcagggcatggtggtgtgtgccggtaatcccagctacttgggaggctgaggtgggagaatcgcttgaacttgggaggcagaggttactgtgagccaaggtcatgccactgcactccagcctgagcaacagagccagactctgcctcaaaaaaataaaaataaaaataaaataaataaatgaaatgaaaatataaaaaaagacatcacatgtaaaatatgctgagattattctggcatgattctatctggacagaatgcagatattcctgcttcaatgccacctaacactgtgtatgagatccgccacgtacagggaaaagctgcaaagaaaaccatgtgcttaggccactttttggcttcacaacctttggcttctctcaagagaatattagagtatagaattgatcataaagcaaatttctgcaccaagaatttacctttccaatggagaaaagtttgtgtttactgaatataaaataaattaattaaaaaggcttgtaatccaactaaaagacatccaagatgatgttggaacaatctaacaaaaaatgatcattttgtgataaacacccataagagcagtcaaattaagtcagtaagtataaacgaaaaattgtcatggttattttctatctaacgccatgacttaaaggcttacagaaaaataaaataaaaaatcattcagttatctctcgaatctcctctccaacataatcacgctaaggaataatatgcttaattatggacttgatttctagcactgggaaagtagatggtttttagaaactacttccattaggctaaaaaaagaggacactcggaaacctagcagtagtaaaggagtaaatgatacagactacttaatgtaacatgcaaccaaatgggggacttggaagatgtgccaggtagtctaaagagtgaatgtaagaaaagactggctactgcttaggtaaatggtgtagtgtgaaatggtacaaaatcaatggatgacagagaaaagcatgattccacttctacctcacttctgcctgcacaccataaaccatcctcaaagttacaagcagaacaaattaagagaggactcaccccagttagatggcaatagtaagagaatgttttaaccactttacatggcagccccagggaaaacagcacccatggcattggagggactggcagatacagtcacagaacaactctctaaaagaaaccacagccagaaaaagcaaatgtcctagctcttccctaagataggatcctcaaattgcagactaatttgttgctgggtcctcaaaatcaccagaggttgtgtggcgcagtaggcaggaacatggacctttgcaaacccaattctgccattagttacatatgtccctgcggtgggggcgtcatctgatttctctagaccatacgtttttcatttgtagaaccgagacagtaacagcacctacgaaatgtgagggctaaaaatgaggcaacgcatataaagcatttacaaggtgcctactacacaacagctgatcagtatataaatacgattattttattttagaattacataaaaagtattttcgtatttagaaaagaaagcaatgattactaggaggcaacaagagttcacaagaaccagatgatgttatctctaccattctcctctggtttttaaatataatgtgtttagatttctgcaagattgatttcccagtgggtagaaggaaatgatggattggttgctcatatagctggacggactggtagctaattgaacagccatgcctaaggagtattgttcaacaaatacttcattgtgcttactatgtgttcagcatgtcctatatgctaaggattcataagtgaataagacagacaaaaattcctgtcctcatggagtttatattgtaatgagatgaggcagtaaaataataaataaattataaagtatagtagaatatggaatgttatagggaaaagttagaccagggtaagggtatgggactgtgggatggggctttatgcttgtaatctgtctgttaaataagcatgctatctgacatccaaaacacagtataagccccaggctgttagcctcctcccctcttcctacttataaacctgtagtattttttccttccactatgagaacttcattactctgagtcataattgtgtgtttaatgtttacctttgtcgctaagctgaaagctccagagtctagggagaatggcaagaccaaggaagggtctcagcatttgaggaatggctgcagaaagtgtcacgggaaggagaatcaaatggaccacactggatgcctcgtgtttttaaaggacattgttattaatgggacagggttcatactcattctgggtcattccagacacgggagtttgaactaatgggggaaagtccagggactagtccagcttcccaaaagttctttttcacagttagaataatctacaaagaaagtaagcatgattgatttcatgttcaatcagaagttaaatgattaagtggaagttacttattaacctacacttctaaaatgtaagattctaactttaagactataattctggtcatttccaacaattttattaataaaacgttgaatggtaaatttctgtattttctgggttagtgtagtagtaagtctatgacttctttgttaagaaaacccatacagagaatacaaagattatttattctaaaagtaccaatctaaaattatgaaataagagtcattatagcagctaacaaattaaatggattaattgggtagagatttgagagattataattaatgataaatcaataaagtattcaacatgaaaatctattacaaccctgtttatgttatttaacttcaagcattcagttctgtatgcttctaattagcaagctataaaagatgccatccataaaaacataatgagaagaactgtttataatgataattaagattcatttgctcagagagaagggttcacacggctacaggttgcagcaaacaaagggttaagctcattattgaggaaaatactacatttaggcagcatttattagacatttaaccctatcaggcagagccttgccttagaaaatacatcataaataatgcttcttacaagacaggcaagattttccaaagtgaggtagcaactactgggagtccatgacattctgtaactttgctgggcttgactcatccaactgtgttagtaataattaaactctagctgatggcttttatgttctctttctggtttctcaagtcttccctgcattgatgttttattaaaaatatattgtgtattgtgaaggccagtggagaaaaaattttacattttccctttccgcctctgggctggagtttgccttctatagcactttgtctcatactccgagcactgtttgaggcttctcatgggcttgccagtggcaaaattgaggctcagaggtgggaaacataaacccataatacaaagaccctcactttttagatccttttgtaattctggctttagaaaaatcaaagttttcattcagcagagaagaagcttcttccccctttcacagaaactctaatatctataaagacccactcagtgaagcccaaaatgctttctagacacataattgtagcaataaaagtgtgtcttcacctcccactgtacctctgagctgatagatacaatttgttactccattgacaacctgccaacacttcacaataattagagccaatggtccttttctagatatagcataatgtaaccttcaatattaacgtttttttcccccatcagtgcaggcctaagacagaacaactctaagactagtcctagcctgaagtcacagagacctttaatgcaggtcacgggcaggacagcaatgatcaagggtaaactctaacacatgaactggtaacccagcagtcagccactgtgtggcctgctacattaaccgccctctgagccaagcaggcaccccagcggtcctcatttaaaaagaaaaaaatataagaatcttaatagagagattggggggcttatttttcatgatcatgtgcctttaaaaggaaagtcctagagtcagccctgatcaatacagcctctcctgcttcctgctttcaatctgttaagcaagaaaatgctttcatgttggcactaatcccactgtgcccccaaagaagagaaaaaaacctcccgagagactatttaatatccacacagtcggtttttagaaaaacaaaacaaaacaaaaaacccaaggaaatgaagactatcaggagaacactcccggaaaaaccctcctgaaaacatgcctgagtaaaagaaaagtcaaaagactagatagagaaatgatgtccagggagctcataatctgcctgtgcaagaattctagtttctagaaagtcactgattaataaattcatgtgctcattcatccattcacagataactgctgggcaccaatgctgtgccagtaccagggataccatagcgagcaaaacccgtagggcctacctctcagggagcttgcacattctacgggggagcaggcaaaaaacaaacataacaattttagatagtgacaagtacttgcaaacaaagtaaatagtgtgatgtaaaaaggctggtctgatcattacgattcctttcagcatgaaacttccctcatatcacaaggtataatgaggacttttagtcctttggatggaagtcctaagatgagagactatattaatcataataggtgtaaaagacaaaaatacaacaacgtaaatttcaaatgaagaagcaatatgcaatctcaatttctaccatatccccaagacccttggaagaacctatttatagctttatcgcagccattttgaaaaggtagagaaaaaaacatcacaggtttttgaaaagaaattttgcaaataacatggcagtattgcaaaatgcaaatggaaatgctgctgagccatctgctcaatattacagcaacattgggaaaaggctctgaaagaaatgatgtttgaaatcattaaaaaaataacatgtcaagtttaaaatactcaagaatcttaaaaccagcatcaacacattcagcaaccatatggccctacagcaggttaaaaaaataatcgccctgcttgcaatttctacttcaacccaatggtttctaaaacatgtttctttttcccatttgagtaccttttctttccattgaattccttggtgtttacagttacttgaattatacctggagcataatttttgtttcaccctttctgaagtagaaataagatagtaaggaagattaaaagtcacctgttcaagaaaaaggaatgtgcagatgactctatataaattgttgaacacatcttgttttaggtttattgatttctccatcctgatctcactgtctcagtaataactgctaatctcatcgagtatcgtaattttccaggcactctgctaagtgctttatagtcattatatcatttaatcaccacaaatttataaagttgatgctgttattatctacattttctagatgcgaaatttcctcaaggtcatacaggtaacatgcggcagagccagagtccaaacaactgtgggagccacgtctgtgctcttaactgctattatatgcaacaattcagtgttcagatgtttgtgctgacttctcaaggttaaaaaatgggcaacatagcaagatcccatctctgcaaaaacattgtaattttttaaattacaaaatttatgaaggcccagagaattacaaatttataatggaaatccttggtgtttcaaatgaattaaaaaagtagtttcattcaacttactagcttcacatagtagcttgtggatacagtaggaactcaatacatgattactgatagcagtattaattcacatataaaaatattacatcaaatgatctgtgtctggtgcatgtattttaaatgctaaagttccttttgtatctggatcataagaagactttttaaaattacaaataatatttaaaggtgatgattagtttagaacggacctgagggaagtcaggcagtaggaatatctgccaaacacttaagttctctaaatgtagagatataaatgaagttataaatgtaacactatctatagcaaaaaaaaaaaaaaaaaggaatagatgagcgttactgatgtgcatggcctcatgcaatggtctcagtgcagaactttatttggtcttatgaaacactttaccaaaactttcacttggcattcctctgtctgttgcttttgcctaatgatcttatctcttcactgattagcaatctcgtctgtctttagcaaccctttaaatctcatgcagccaaaagttataaataaaacaaagcaaataaacaacgtgggtaaaataaatcagtgtgataagcagttgtgaaattacaaacttattacggaaaaatccatgtaaacaaatccactaaacacatagtcattaattacagctcacaacctcccatcacttctgccttctgttctctaacgtggggtgcttggtaaatctctggtctagagtggcattttatttttgcaatccttggctgtaggtagagcttggcctcttttccactcaacaggaagtcttgaaaacaaagatgctaaggtttagagtattataactggaaatatgaaaggcattttgcaatattaccaaaaacttgaaatgaaggttaagaaatagatctgcatataatgatccatttatttttgatgaaaatgatttgtcaaaaggtaactcagtgaggaaaaggtaatggttttaaaaatggttctagaacaactggctacccatatgcaaatagatgaaccttgaaccttgccccatagcacataattaaatcgtcccaaactggatctcagacctaaatataagagccaaaatacaaaatttctagaagagtaaacatcggtgaaaatctcaatgattttggggttacgaaaatatttcctaaataagacacaaaaacacaaactacaaaaaaatcgttaaaattaaatacttttcttcttcaaaaaactgtgaaaaaatgaagatataaagggtaaagggtttcttttgggtgtgatggaaatgtttgaaaattggttgtggtgatggttgcataagtctgaatacagtaaaaactgaattgtacattttgaattagcaaatggtatgatgtgtgagttatgtcttataaagctgttacaaaaaaattaagagaatacacagtctggaagaaaatatttgcaaaacatatatttggcagaaggtttgtaaccagactttacaactcttagagctcactaagaagacaatcacctcaataaaatgagagcaaaaaaaataccttgatggagtatgtcaaaaggacagatagccaatagaaagaacttctaatggctaaagctagaacaagaaaagaattaaacaaagtagcattggattataaggtgaagtattaaaaaaattttcatgatcccatattgatataaatgaatgcccaaataaataaataggataggataaatatcttgcgcataagaattaaaataatttacgtagctactctgccctcaagaaggtggagcgtaactccccagtccttaagtctgagctgccaatggtgacttctttccaaagagtatagcatggaaggagggaaaaaggataattctggagtggagaaacctgtcaaacactgtctctgccaagtgattaaggttaatgtcaactgtgctaagtcatattgatagtatgtagacctgatatgatatgattagactggcactttgcctgtgtggtcttcctccctaaaactcataatcccagtctaaacataagaaaaacatcatacaaatccaaattgaggggtagtctataaatgtcagaccaatatgccttaaaactcaaggtcatcaaaaataagggaagtctgaaaaactgtcacagtctatggaagtctaagaagatatgacaacgaaatgtgtggtattctagatgaaattcaagagtaagaaagacattaagtaaaaactaagcaaatctgaataaaatattgactttacttaataataatgtatcaatatttgttcctttgttgtaataaatatacaatactaatataagatgttaacaatatgatttaaacaagaaccagaattttattacacaatattcaaaatgtccaagatataatccaaaattactaggcatacaaagaaccgggaaaatatgaactcacatggggagagacaacagatgccaacagtgagatcatccagatactgaagttatcaaattcattgaattgtccatttaaaattggtgaattttattacacataattatgcctccaaacaaaaggaacaaaacagcagcaaaagttttaaaaagagtacagataacattgaagcattacattagtattagtttagcttgagagtgagataaattgattcttatggactattctggaaccaaataactactattcacaccattatttcttagataaattacgttttaagtttcaaacaatcagcttacaaaaaaccttctggcgcctaatcctttcttaagtggatggccaagcatttcagaaaatgttgaactccagagaccccatttaaacccaggaacatgagacttctgattatttgggtattaaattatatataagtatgttaatgttattcatatctctcaaaggattttggagacagtttggaagaaaggattttagaaaactctctaaaatgatgactcggctgacatggggcatataggagagaactattaaactttctcccttcctctggcattgaaattactgttagaaatgaatgagttctgcttttatagagtactactcattaagttcctcggtcctttcctagaaagaaccacagagacaaatagtgttctaatttttatctttactttttactaaactatttgcataggtacataggtttcaagaagattgctcaaatgaatatttattttcttacagagaaacatctgtgaaactgatcatctttcactctaaataaataaataatcataattggtatctgtttgagagctcatttgcaaactgttcctataattgtgccactcatttacaggcacaacagagagaatcagaacataatcctgcaccctacttatttgcattaattgtgatcaattgtcacagtttgtttataagactgaataatttttaattctaaaataattatgctgattatcaaatgattctgtatgatttagtttttagaacatgtttaatacaatcattgcattctcagatgtttaactacagggctgtttatttcactgtatttgctttacgtccaagaactgagaggtttttccaagtcattctgtcaagagttcattagaaaaataaactaaagtgaatatatgctgtgctttttaggtgtaataaacattaagatataggaatgtaacattggagctcatacacacacaaatcccagcttgcagcagatcaacttcctgtgtctgatggtgaaggatcccactcatccttcaaccctactcaattcaaccttggtcctaaaaataattaatcattctcttttatattcttccaaagtactttgtgtctccattgtcacatttttccttgactacctttaagttagggaagtccttctcctcaaattgaccttaaacccatggaattcaagatctcattaatgacttttttcccctgacataaactaaagaaaaatagctggtttaccacattatactggattcctgttcagaaaataattcactcccctcctcctcccactgtggatggaatatcctcccctaccccttgagtttggttggtcaactaacttgctttgaccaatgggatggactggacatgacagcagctgaggcttaaaatgtgcttgctcagcagggctcaccagcctgaactcccaccatcatcatgaaaaggacatgccccaggtagcatatggttgaaggaggactgacttgcagatcagatctgaattcaaccttcaacatggagctgggcccaaccagttccagcctgggctggcaggcccacaacggaagcaaagtgaataaataattgctgttttggcagggcgtggtggctcatgcctgtaataccagcactttgggaggctgaggggggcggattgcttgagcccaggagttggagaccagcctgagcaatgtggcgaaaccctgtttctacaaaaaaaaaaaaaaaaaaattagctgggcatggtggcatgcacctgtagttctagctactctggagactgaggtgggaggactgcctaagcccaggaggtcgaggctgcagtgagccacaatctccccactgcactccagcccaggcaacagagtgagaccttgtcttaagaaaaaaaatgcagccacaaaaaagaacgagatcatgttctgtgcagggacatggatggggctggaggccattatccttagcaaactaacacaggaacagaaaaccaaatactgcacgttctcacttataagtgggagctaaatgatgagaacacatggacacatagaggggaaaaacagtcactggggacttttggagagtggagggtgggaggagggagaggatcaggaaaaataactaaagggtataggcttaatacctggttgatgaaataaactgtacaacaaacccccatgacacaagtttgcctgtgtaataaacctgcacttgtacccctgaacttaaaagttaaataaaaaagaaaacaaatgttgttctaagccccagaattttggtgtggtttgatcttcagtaatagctgaccgatacacctgctttataaacatggaactttattctccatgaatatggcttggttaaatcacattttggaagaactgccaaaataaagcagctccgcttctcctgtcataagcacagtgctaaattgagtttggatggctttcctctaatagaattattttacacttgcccacatcaaagctaatgtttctccttgctgcccactcagtctttcaagattttcctgtgagttatcctcagcactctggtgcactactcttcagaatagctggagctatctgcagacatgccactctaccctgccttctagaaccacatcctttttagcatggaatttctttttcttttgagagtggtctgggaaccaccggcggcacaagcatttagaactgctgttaaaattaccaattgctgggcccactccagacctactgagtcagaatccctggggtgggatccaagattttacatttttaaccagctccctaggaaattcttatattacaaccaggtttgcgaaaccctgatttatgaatatgctaactaaccagatcctaagccaatacctaatcctagaggatttcgatgattatccaccatcatctagaaatgcatttgtttattcctaatttttgttttctatgtgttcattttctgtctacttcaacacgttttcttctcttcatttttcatcacatgaaaggtcaattttttaaaaaagtactcttggtacagaatattttcaaagcctttgtctgaacaagagaagaagttgcaaaattctgagcaagcaccaggaaaaatcatctttgatcagttggttgtaacctacaacatgctacagaagggccagacgaaaccgggagcttaggcctgggggtgatcagccaggaacacccagtcctagcagaccaggctcctagaactttcagccaataaagcttatggtcgccccccgcaaaaaaggataacctaaataagttatttcagtggttattctttactaagaaatgcatatattctctcaaaaatgtgatacttgggttagtcaggtattttccatatagaaaccacactctccgttcctcaaagtgttgtccttgcacttttaactttttaaacttattaacaaatttttatattaaaatatttaattgtggctgggcacagtggcttacacctgaaatctcagcactctgggaggctgaggcgggaggatcacctgaggtcaggaattaaagaccagcctggtcaacatggtgaaaccctgtctctactaaaaatacaaaaattagcagctgggcatggtgctcatgcctgtaatcccagcactctgggaggccgaggtgggcagatcacgaggtcaggagattgagaccatcctggctaacatggtgaaaccccgtctctactaaaaatacaaaaaaactagccaggggtggtggcgggtgcctgtagccccagctacttaggaggctgaggcaggagaatagggtgaacctgggaggcagagcttgcagtgagccgagatggtgccactgcactccagccagggcgacagagtgagactctgtctcaaaaaacaaaaaacaaacaaaaaaattagccaggcgtggtggtgtgcgcctgtaatcctagctactcaggaggctgaggtaggagaatggcttgaacccaggaggtagaggttacagtaagctgagaccacatcattgcctagcctgggcaacaagagtaaaactccgtctcaagaaaaaaaaaaaaattaaattgacagataaaagtagtgtatataattcaaggtatacaatgtgatcacctgacatatgtatatattgtgtaaagatgatcacaataaaattaacgtgtctgtcactacccatagttatcatgttctgtgagtttgtatacatgtacagttaagacacttaaaatctgctctctcatcaaatttcaagtaagcagtgcagcattatgaatagtcaccatgctgtacactaggtccccagaacgtatccatcttataactgaaagtttgtacccttaaccaacagctccccctttgaatttagtgattctctcctttgtggagagaatcagagggcttcagatggaagtgactcacaaatccaaattctttaggtttcttatggaaagaaatcatactggtaacagaccagattttcagcaatgttgccagttaaatgatgggttttggtcaacagctccaaaattgatgttgccactgactctgtttcatgtgcagcttccaacattgccaattcaaaagatatgttgatcctttcaatgtaagaactcatgcaaacttacatgtaggctctttctatggtaatacgatatggggagtagagaagtggccaagaacaagggctttagagccaaactacctggatttgatcctggtcactctctgtgtttcagtttcccccactacataaatgagggtaataacctaccacacagacctgtgtataagatgggttatacacttaaaataaatggttaaataatgtctcatgcactagaagaggccaagacttgaaagttgttatcattcttctgaaattctggagtgtattcttggcactgttataaagctttggttgagctgctctgtacttaaccacttcctctttttgttttcttatcttgaaacgcatcatacataacaaaagaatggacataattaatgtatatgtaccttgtagagaataacagtaaaataaatatttgtgtacccaaacagcgtaaggtacaaagttataacaataaatgtccagagccactgtgctcttcaattatctcatcaaacccccttcaccatcctaattggtgtttttgtcattcttttgcttttctttatagttttactatatatttgttcatcactatttttaaagaaactttgcaagttgctcaaaaattctcttatggcctattttcttgtttacactccccatctgccaccttttttaggcttccctgctctcctcaaccagggaactgctgcagatttagaaagatgttttagtctccacattggccaaactgcttttcttcactgattagtttttgaagtcttcccccacacttcccccacccttccccaagacctcatcattgtgatcctgggtagctaatgataaatgattttaaagtttccaggttttcttttaatatctatacttcctattttttttcctaaaagctgaattttactgcattttctcttaaatctgtcaaaacacggggtagagttctctggttttgctgaattcactggaatggtccagcttccggccagggactgtcctctgcagcacactatttcatccatagataatgtccggggtgttttctacttactggggccaaaatgtgctgaactttttgggttctgagtttcatgtttcagaaacaatcatatgacctacgtacatgccttactccagccaagaggacttttctcaaaccctggatcactaaaattccattttcacagccttatctaatttttcaggtgcatttacagataatgccccacatcactaggtctggcccagtgccccacggtgtggtcctgatgttggcccaaattactgaggaaagggaatttccacattcctagcttgttcctttatgctcttcatcctgtgtaagaaccagtgtaaaacaatattttacaaacataaaagggacctttgaaacttatttgatgtgttagcctgccaaaggcaaagtcatcacgaagtggaccgaatgaggttgtggttaaacttcctcaattttctcttctaaattaaaatctagtgccagacaccaaaaggtttcctcttcctgtccctcttttattaagtagttacaatggcaattaaaaagacccctttggtcattccacactactctctactccaaccacttcctataatctaatgatgctatcttggcaaactaatattataaagattttttattaaaataaataggttttagaagaaacactcaatcaagtatctcagtggatgtgtttcctgcaaaggcaatggcagcacagaaattaaaaactaattcatccttctagacagctgcccaccttgctcaataaagactctactattcattccttatggccattgatttttgcaagtaataacagaggttgagaagaaaagcgtaagcttttttacagatggatgtttctatcatttgccaacagcttctgcattgtctatgtaatggggaaaatgtaaaaatttatcttgtgctaaaaggataactatttcagagtaaaagtaatgcttttgggcaataaagataactatttcagtgtattatattttcttttgggctatgaagtcagatgatgactgatttaaaccacacaaatatcaacagttagactattctatttgtctcctctttaagaaaaaaaaaagtttcagagaagagtttgcataatcccaaccctaactcttcagccactatataaagtatcttaaataactatgacttagagatactggaaaaatatttggattcctctgatttatgatttttacatgcaatgttatagagaacacttcaaaaaatcagctgttgatgtatacgtgatgctctgaccccaagatacaatcaatattatttaatggagactaatttacccacacggcagacccttcttaaacagggtatatccagaagttattgggctaagtgcggcaagaatgcatgagtcagctggtggttagcacccaactgagcagccctgggccagattaggatggatacagcagatgaaagaacatgacaggttcatgctcagttttcatttgaaatgcatatgccacaaagatgtcgcttctttcacaatggtggagcaaactctccatgttggaaatgacaaagaagggacaaaagaaagataacatgaggaccttctaagccatcagaatatcaggaaacagaagcagacataaccatctacttggtgcctccattccacagaatcctccaaaaggaagtcaagaaagtccatcgttgccacagagtcctgagcaataattcaccactactggcaacatctgattagatgagctgcttactaatctcagccactgtggtcttgcagaattgcagcttatctagctttcccgtgcttatgtgatccaaggaacctgatgatggctgcataacacaggcaaaaaacagatggggaataagttcaaggtctattctctgggactgtcacctttaccaaaggtgtctgatcccactggtggacctccattctgggtccctgataagtttatctgctgataaaagtccctacatgtaccacctactcttttccttgatgaggaagccaggagtggcaaaaatgactgaaccaacaatgtctccaatgtgcctgcagtagagccccagggtggctctcttgtgttcaatctattttatacaatcatttttaaaaacacaaaaatagacttgtaggctgggagaactatccatctagtcctttgggagagtctctcaagttaacaggctaccattgtcatgaaaaggcctcatgaccagccattcaagggctgcctgcccacaactgctctgaaagacacccatattccagatactagaaacactctgctgcgactggtacccgacaaaccaacaatgagcaatgagaagctgaagtttaacatgttagccaatgccagggaacactgcaagtaaccaaagggcttcatcggggaaagagaactgaaagctttgcctgaattctgcttcacagtccaatgtgttcactgggcataaaatagtaagggctaggtaatatgttctttgggagtgtgataggcagagttcagcatcatgaagacctcacaaaattcaaatcaaacaaaagggcagagtcatgctttcttggcagttggagactgagaggtgacatgaatgtcgcatgttgctcctgaggcattttaatcagtgtcccctatgaacttcctttagcactgaatagaaaggaaagagattctgaaacagagccaatctgacaacactgcaacactcagtgtatttgctgagcccaaactgctgagaacatgtggtggttggatggaaaccagacagttaagcaacggtcgggtgagatgctgaatggaaatgaatataagctgggtgggtggacaaaatcctctaagggcacaatggcacagcttccattgccatggcccagccatcaggtgtgggggaaagcaacagttggacgatcttagccagtggaaatgagacagcttctttgagtggactctttgaagccttcaaggaaaacagcaggcagctttggcccatgagcaataggctctagagacagagagtggtgaaataacaagccaaagaataatttacatgagcatggaaggtcctggctgtcaaattgcttgggtgagccacacagagttcacgtgtttgacgacagaatcagattcagaaagatctcggttaagctggatggaccaacccagcaaaatgaaatgtaatagagataaatgggtattatatgtaggtccaatgatgaaactccaagaacatatatatgagtggcagcttagcagccctgtgtgtctaaaacttagaagttatagttgggagccatcaaagaagcaagttgatgaaaaattaatttgattaataatgtaaaacaaagaaggagacaaccctgtttacagaccaaaggctccagatgtcatccattaggaaggtgttcaaagaagaggaatacaggaagtcactgacagcatttattccgggggtgtgagaactcaaggacataaaggcttacattttaaagggttatgatgtggacaagagattgaagttattctataagcctattatggataaaatgagaagcaatgatggacactacagttcaatcattcattcaacaaatatgttaagctcctacgatgtgtcagccattgtgctaggcagcccgattggcagttaaggaaaactttcgcaatactcaagctttccagaaataaacagggctaccttctggacacaattcacacatggttgctgaagagagtaaggcaaaagttgaaatttcagtcttagactggttggaaatggaatgcatgcatcttaagctccccacctcagagaggtttacaatcatctgtgagttacactatgtacctctctttttcagttcttccacatttcaagagagatgctaaccaactccacatggtgttcagtagaaagcagccaaagccaacattggcaaatttaaattgaaatgaatggcattttaaagagaatactgggtttcccatagactctccaggagacctgcaaaaataggcttgaagacctcatcatcagaaaaaaagcccagccatgcactgcagagctggtctgggacgacgcctctgcagcgaaccatgagctcacatcactgtcaagggacgctggatggtgctacaggaaaacagcagcctggaaaccagaagaaactgccaccatcatcaccctcctcactggaagggattccaatcattctccaggtctttgtgtcaccagcctccacaagaaagtctggtgaggctgaatcagactggaagagtctgggtcacgctgggtcatggctctaagtcctggcttcaaggcgggataaaaaatcaagcactggcggtcgggcgtggtggctcacgcttgtaattccagcactttgggaggccgaggcaggcggatcacctgaggtcaggagttcgagaccagcctggccaacatggtgaaaccctatatctactaaaaatacaaaattagctgggtgtggtggcacgcacctctaatcccagctacttgggaggctgaggcaggagaatcacttgaactggggaggtggaggttgcagtgagctgagatcacaccactgcactccagcctgggtaacacagcataataataataataataataataataataataataataaaaaataaataaaataaaaataaaaaataaaaaaaacaagcactggcattttcagtttctataggtgggccctgcctcacaagaaaggggattctatgagtacactagatgctgagtttcaacaccttaacaaagaccaaaaacattcaacataaggtgtagccattcttctcccactactcatttaacaaagcccaacacttgaagacaaaaggtgagaaaattaaagttagcaacataacttccctaacttgatgaatagcatttgcttcgaaggatccttctttaggaagaattctgatggtcacagtcactcacaaatggggttgacattgactgggaattgtcccagtgggtttgagataaggcggctctcccctgaatggaactgacaggaggacaagctgaggagaaaccaggagtttcagcttgtattacggcagatgagttttcaggtcattctgctgggaaactaagtgaccaggaataacttcctagtatcacaggagtaagagaaacctccagcagtcaagaaatccaccacacagtctccccaaggcctatatttctatattaaaaaaaaaaaaaaaaacatagctggcagccccctttctccaaaagccttgagagaaagtcatttgataagtgagaactgcaggtgttcggaatgttccttgctaatgtcttgttctttctctccatatccccccaatccccgggagtgaaagcagagtggagtggaggggctcaccatctcttccatccatttccctgtggtttccagaagacagtgctgaggtcagagccaggataacctctctggctacacagtgacgcatccactggggcattccagactctgggtgacacttcattacgccagacttcctccaggaagtgtgagcaggctaatcacgcccctgggcgaggcgggcacgtggagggagagattagcgttcccccacagctgtcaagctgggcccctctcattaacacccacgactctctttctttcctttttttttttttttaggtcctttgacggcagctcgtgtacttgaagtatgtcactgaaaaacgcacagatgggatctaccagatcatgagaatgctttcacagcttttgaaagagtgctgggtttctttccttcagaagaaaaaagaaatgctgtattctcaggtctacccattttccactctcttcctgctttagaaataaactattgcagaagccaatgtagtaataaccaacagggcaataactaaaatctagatcttttgatttttttttaatgctaaagtagctaattgtatctgctaatcatgtcttcatagttcacagagagggtacagcatctgaaatatattcaacattagctgcaacctactgaaatccaacatcaggccgggaggggagacagcaggccaggcgagcgagtgtctgacagattgtgccctgagggaagatgtgtcccaaagcaggaggaagttgctcagggaagggatcttttatcttgctataaaagttctggacaagggtctgggtgctttaacatggaagcagtaagacaatgaggcctggaggaagaggaccaagaactgtgagtctgtctcggatgatccagaggctttttgagcattttaaccagtatcatctatgatcctctgaacaatatcaaagaggaaaagaggataaggttactattctctgggtggtcactgtgttctcttttgtatgaagctgtctctttgtgcatagaagaaaaggagctatgccaaggcccaacagtcctattattttctgttttagagatagggtctcgctctgtcacccaggctggagtgcagtggtttgatcacggctcactgcagactcgaccttgtgggctcaagcgatcctctggcctcagcttcctgagtagctgggactactgatgtgcaccactgtgcatggctaacatttttattttttgtagagatggtctcgctttgttgccctggctggtctcgaactcctggcctcaagtgatccctctgcctctgcctctgcctcccaaagtgctaggattacaggtgtgagccaccgtgcccagcaaacagtcctatttttaatataagttcctagttctggacttccaggtggcacctgccacacctactgcacccagtcagcttagggctttcaccaaaaaaatctgacaccaagaaaagcgggtccccaggaagcggtaaactacaagaaatggacgggatttgcaatcttcccagaaaatacccaacagcatttatctgtaaagactttgctgctgataatattacagtacttcttaaatctcagcaaaggccttccataaaaagaaggcattcactcaataaacatttactcagcaccttctatgcccatgtgtcagctgtagagctggagggtgggggtgggaagagaggagggaatctaagatgatttgataggctcgctactgcatagaaccccatcatttaaaatgccactaatacaatcttggaaattatgaagtttggggacttcacaggactttgactgataagtaatattgaaaaataattactcaaacatgcccatttatctccagcccagtacagccactattgtgcgtcctttcaagggacatcagggcagcagcacagcttaccctggggtccccctgggcaccccagcataagcagtgatgtgctagacagccaccaaaaccaaagtataactacaaaaccttgttccaaagggttctgggggagattcagggggaaaagttacatattcttaaaattttgatcactggtggatgcactcaaaatcctgctcttctctgggagcgattttcatgctgttcctgaaagctcagaaagaataggaaaattttatgttcagtgatagatgggctagacaatgggaaacctgcactgaaccagacacaaaggacctagcagaggtgacgcctgccagggctgtgcacctgtgtttccttaacatctgctgggaccccattagtaagtttctatgaaaatgaattagactgtgtgccttctggtcttgcgggtcagtctcttacctcaacaccagtgtctgaactgaacagagcttggcagattctgattccccctccaacctctgccccagccttagcctctgcaccatcttcttggctctgctctggtgtcaggagcagcaaacagtgcagtctgcagttagcaccttgtcactgctcagccataagcccctagacgtgacagaattactcctctgagattgaggctgtagttggctatctggacaacctgcatcaacttcctacacccacaaccctctggacctagatttctaccctgactctgcagccacgtaggccccttccccacagcaggtggaggagagggcaaggtcatgtctgccctcttccatcatgtgtgaaactggctgagaaaagcggggttgtaccctcagcatcctagctctgagaagaacctgcaccagccctgctggatctacccatgcagaccccacccctgtgatctcctggagagctacttcctagataaggaggtaaaactcatggagaagatgggtgcccacctgacaatcctctgcaggccagcaggccccctggcaggctgggcaagttcccccaagaaaataattgaaggcactttgtaaccatcttggacccttctctcttaagctgtggaaaaagtgcagacaatatagctttttgttggaaaaaaacagcaaccataagaaacagaatttgacaatttatcaactacaccaagaagccactctgtggtccctcaaattgatttaaataccataatatgtcatttaaaatgtggactctggaactgggctgcctgagttcaagcctctttgtatctcagtttgttctcctataaaataggcaatataagattattctcctcataggcattttgtaattacagattgcacatccctaatctgaaaatctgaaatccaaaatgctccaaaatctgaaactatttgaacaccaacatgacacacaaggtgaaaattctacacacaagcattaacacaaactttgttttgtgcacaaaactactaaaatattgtataaatcaccttcagactatgtgtacaggcatatatgaaacataaatgaatttcatgtatagactcaggaaccatccccaagatatctcattatgtctatgcaaatattccaaaattcaaaaaatatataaagtcagaaacacttctggtcccaagcatttcgggtaagggatactcaattggtttcggatggacagcaaagtgcctggcatctactgagtgctcatctaaccaagtaaatatgagctatcattatttctattaaatatttatttaaatcacggaactatgcttggttctatttctcacctcaatgaattctctatgatccatcgcgaaaatagattaaaaacccagataaggtgataaaattactgttcacctaaggaaaggctcataaaactggcttattttgcagatgtttcttcaaggctgactcttaacaactaatcgaaggccgtattgtgaacattgttactacacatggaaaatatattttgagaaataaatgataaaagttgtaatgtgaaccctgaaatcataacaattaactttaaaaactctgtcacattaaaatctactggtcttagacactggggactccaaaacatgggaggaatggagggggaaaagggtccaaaaactacctgtcaggtgctatgttcactacctgggtgatgggtttagttgcaacccacacaatacatgacaaagccctcagtatcacacaatacatctatgtaacaaatttgtacatgcatcctgccctcccaaatctaaaataaatataaaaagggaaaagtgggccaggtgcggtggctcatgcctgtaatcccagcactttgggaggctgaggtgggtggatcatgaggtcaggagatcaagaccatcctggtaacatggtaaaaccccatctctactaaaaatacaaaaaattagccagtcgtggtggtgggcgcctgtagtcccagctactcgggaggctgaggcaggagaatggcatgaacccgggaggtggaggttgcagtgagccgagatcgcgccactgcactctccagcctgggcaacacagcgagactccatctcaaaaaaaaaaaaaaaaaaaaaaaaagggaaaacggcacatggcaagaacatctctaattagtgatcaccgtagaaatgccttaagaacttgatccatatatgtgcttttgcctctgagtccaaacctatttgtctaaataccacattttgggagtttgggggaacagatttcaaacgatgtggagacaagcactgagaaagaccaccacagagcgaaggggatctatacacacagacaggcaagcacagtgttgtctctgcctaggaacaatccctccaacccgaggagaaatcctaggtctcattttaaaaatatccttcagaaaagaaatacctcttcaacccacacagttcccaatgaagtcctatgcaaaaatgcttcttacaaaaataaaataaaataaaataaaataaaataaaataaaataaaataaaataaaatttatcggtctatcttgagctctaaatgaatcttttacacatgaataattttttaacatcatgcatcggtcatttagaaaatcttggttcactgagttgtactgattttgcaatataacatcgttcattatacgacatttaaaaagcccacattcattaacattaccactgatctcatcaaaaaaattctttaagtatttaagttaaagtagttgtcaaactcctggtggcagatacaagttttctaagttctaatttttgcttaaaagctcaaattttatcattaacaacaaacactgtcagttgttttccttgaagtgacaagttcactccattcatttctgggaaaaggtctgtcaaatactcaagtttgaaaatcatagtctgtctcttacccattctttaaagtgaaatagtgtttcgtgaataaacgtagcttttctcaagacaaccatcctacctgaacaggcagaagcgccttgcacatatttcatatttatagagtattagaaagcacatactccactgttgagatttaataaaattggtaacgtttgttacttcatcaaggacattcttaagtgaaactggcattttttaaaaactgggtgttcgtggcagaaaagaacaaaatgactgctaatagcgtttggtagcaccgctttgattcctgctaagttgcctgcagtactgtcatccattgtttttacatctatctaatgtattatcaacacagtgaaaaaagacaaacaacatttttgtattattatgaagatagttttgatcttgggtatgcattgtaggcatcactgggctttcaaagactctacctggaaaatcactgccttaggtagactccttcacctctgcatgcctcagtattctcatctgtaaaatggagaggattcgcagtacatgtcctgcagggatgtggtgaggactaactggaataaatcatgtaaacaatgaagaacaaagctggcctatggagatgccatctatggactggctataaggagatcagacatcatttgaggctcttggttaatccaggtgtgacaaaaatcaccatcttagtggttttttttttttttttaaagagcatttatcagctatctccactgcatttatcaattatgtccactgagaacattcctggttattttcctgagattgttagagacaccaacaggtcagagactctttcaaatgccaaaacaactagacttctctttaagaagctgggccgggcgcggtggctcacgcctgtaatctcagtactttgggaggccgaggtgggcagatcacgaggtcaggagatcgagaccatcctggataacaaggtgaaaccccgtctctactaaaaatagaaaaaaaaattagccgggcgtggtggtggacgcctgcagtcccagctactcgggaggctgaggcaggagaatagcgtgaacccgggaggtggagcttacagtgagtcgagatcgcgccactgcactccagcctgggcgatagagctagactccgtctcaaaaaaaacaaaaaactctactcactgtaatttcccctgatgtggcctgagaacattacctagcccacttctgcagacttcagagcatgtcttcttaggggctgtcgctcaaaaacactggaggaaaaaggtggatgtttatattcatgtccttttgtgtgtctgtgttctcaaaatattgtgacaccaagagacagaagagaaattgcctggtccctgaacctgatgtgcaatgtcagttctctttggttcaacgtggttttcaaaaacggacagactctaaacaaaggtatctgtccctttagtcaacgagacagggaactgatttggggggttgttttttcctaatgatactaggttgaatttttaaaaattaaagcagatgtggatatattaggaagtaaaataaaaacttgtgtgatttttttaagacaattttttttttgactaaagaaacagaacttactgaaatgtatgattctggatcacagggcagaaggttggggcatgggaagagctacaagaatcttcattaagaaaactggtgaaatgtgaatatattctgtggattatataatagtattatatcgaagttaaatttcctgaatctgaatgattgtctgtgtttatgtaagagcttgtccttgttcttaggaaatacattgaaatatttagcagtaaaggggcatgatgtctgcaagttactcaaaaatgattaggaaaaaaacattagagtgagacacggagaaaaagaagtaaatatggtaaaatgtttaaaattgtggaatctgaacaaagcgtacataggaattatttgtattatgcttgtaacttttctgtaagtttgaaatcataaaataatcaaaatagaaagttttaaaatgtcatttaaaaaaaggacaagacattcttttgagtttcttgtgtcacttattaatgacagtgctccccaggcaatttgctccctgcttatctgtttggccttgtcctgtaccatctccttgtccagctcagagcactgcaacctctgggcccttgtctctgaccctcaagtgggccccgatctgcccccgaggcctgtggttctgggtgctccctagtcctgaccactctccaggctctcctcctccagggctgcctgttatcaccacctcagaggcctttcctgatcctcctatttaaaggagtcccctcacttccacttctgtcactctttataaccacttctattttatttatctttcaaataatattaccactgcccaaaattgctttatttacagttatctatcttcctccaacggattattctccatctgggtagagaccttgcatttttggtcgctaccacttgtgcttggaacattgtaggcacgcactagatatctgttagctgaatgaatgaacagatgtccccaggatctggcagtgggcattcaagctcttcctccaccaggggtaccgggcatggcaagtactcaatatagatgtgttgattgaatgacaatatgtgaatgagtggataaattagagaaagtttctaattctaaaaaggactagttctggaaggccggtgagctcagggattatacagagaaacccacatgcagcctggctcaatatggtctcccaggcatgcactttgacatttaccctccaaacagccccagtctggcttttgttccattgctccacaaaagccgtccctgcgaaggccattcacgatctgcatgttgctgaatccaacaggcttttccatctttcccttccatgtcactctaagcagcacttgacagagtgggcccctccctcctccttcagtgactattcctcaggcttctatggcactggcgacttccagttttttcctgattctcactctcctctgccagctcctctccaatcacttaagatccctaggggttacaaagaacccagtcctgggcctcctccacttctcactccatgctcattccctaggacatgctatgaatcccggtggctttgaagaccatttgtattctaagttgagtcctgaatgtgcatctccagcccagatttgctggctgacctccaggtacctttatccaaccgcctagctgatacaaccatttggatatctcacagaaatctcaaaatgtctcaagctgaactcttgatctttgctgctaaacttctcctttttccatccttcccgcctcagggaacatccaccttataaaccccctggatctgtccctctcacattcacttcatcagtaagtcaggacaattctgcctccaaaagatatcacacatctacgataccccgatccatctccagtgctgtcactgtatcctaaggtaccatcacctctcccccggcctgtgtcccactttccattctcgctcaactccactctttacatagaacccagaggagtctctgtaaaagaggaatcagatcatgtcattcccctgcttgagattctccaacggctttccatggccagtagaataaaaacaaaaattcttaacatagcctaagtggtcctatacgatctagtgcctccgcaccctcatgccaaaatactttctcttggctcacgaagctctagtaacatggatcttccctcagtttccctaaaatataaagacttctcctaccccaagtcctctgcacatgctgtttctcaacctggaacgtatttcctccagcttttcagctctctaagtcatccacaggctctcattcatattgaaaggttttaagaaggaaaattgcttaaagtcgagttggattttatagtggcaaaagagtagaaactgaattggagtgttgctggacataagggcaggttggtagagtgggtggaggctactaacgctgagggagagaggaagataagaaggtctaacctaacaacatttccaggacagtgaggaatacacagattcttgggaaattcctgtctcccaccattcttgggaaacattccttaaggacaatcatgggaatcagctggacatggtagccagcatggaaatgctgaagatgccctctcagtttctgggttggatgaatgactcgtcaaacagtgaagccactgagaagtgggattgagggggagatgtaatcggtatgaagggcaggaggaagatgatgagctcagtttggggcatgcatttgggatgccagggggccttcaggtacagatgtctaccacctgctgtgatggggacttgggaaaatgctaacaattggaatcaccactatgagaaatgagactgaaagtgattagaagcatgaagaaagaggctgtgaggcccatgggtggtgaaagccattacaactgatggcagcatagacagggaacctcctttatgacgagactgtcactggcactttattaaagaccatcattctatagtcagaagttcagaccatgttcacaaaacacatgaagccaggatgattatttttggaatgcaatgaaaagattaaatgaaaacataaaactattttatgagcataatatactactttgtttagaaaaatatatactgcttgtttgttactagtatgaaggttgctaaatagagactagacactatctagactctaggtgttaatttttttccattccaaaacaaagtaattcacaaaaacgtgcactattcattcatgcaataagtattactaagtcccactgtgggccagatgctattctaggtgctggagagagagtagtaagaagtactgaaggcactaaaaaaatgcatgttggatgaacacatcaaatcaaatcactctattattacatcacaccctcaacactgctccccagttccacagacatgatactatcagtcagcttaccttgattagtaatcattaaatgttgcagaaacacctaacagttaagtcctatgttgaaaaaaaatagacatccaataaaatgcaaatttgtggtaagcagtaggagaaaacaagaagcggaaagaggaaggttgcctaacctcgatggcaatattctctaggtcatccgtgagctttgagttgtgaagaaaaatccaggcaggtcaatttgaccttggaacagaattcttttggttgaatgttaagtggctaaattacaactttggggagaaacagttcttgcaatggaacgctcttccctgcctgattagacttaatcagacttttttgtactttagggtcagggaaaattttcaacctgtaatcatgtacttattgggacacactaagagttcatgatggatttttaaacacccagagccttccaaattaactcaaagtctcatgatttctccctttaatatgttactttataacaagtagattttaataaaaattaagggaaaaaaatttcaggtttctgccaggaggcactgacttgtatttcttccaagtctcatgctctctgggggtatgcatctactgaattcataaaataaaaacatagtaaatggtaaatgtaaatgtaagaagaggtaagacatttccatcaattccctaagaaaactatcaccaaactcttgatttggaaataatgaagtctcccaagtaaaagtaaaaggagggttggctaggggattcccaatgcctgccaacaaaacctggtttagactttctgttttagagcattctggccaataaacttcacagagatttaaacaatagccctttggattcactttggattccttaagtccatggactgtctttcaaatatctaaatgaaactagacagaagttagaaaaaaaacaactagataaccctaaggccacaaaattaggtaacttcagagagaagatgtcagaatttttttatgtgcatcaagtctatactcatgggcagcccaggaatctgcgggtaagaagcactgaagtgataactcatagggttgaaaaaaattccggagctgatcacggtgaaggaaacataaagcacgcagttctaaaactgttttccagattgtattctttaacaaagatacctattatttatgcttttgaaaaaagtcagtgacgtccctacacagttcataatgagttctgcagattcatggaattcctttcttgaaatcatttcctttccctgaacttctatgtttataccatccatagtatcacatccatcttccagcttatttaaattctgactgtgaacagggaccatgtttgtatcttctgggctgtgctcatcaacttcctagtagctccataaacgtgtataacaacaatattaataatattaatgaagcactacattaaaaactacagcgtgtgtatcagtatttcttctatttccttgaggtacagcaagcaacctttgtagaatttctctatcacctcgtgggtaggagaatgaaaagagtttctctgtcaagatgatttggagcttttggatagtttgctccaagtcaacagggtataaaagaatggtccttatactcttgtgtattttgccaaaggcagcaaaataaattagtcatcatttcacacgtggccaagttcacaaaccatcacatcttgccaacgtgcccaaggaccatatctgtgctctgcgacctaaatacagaaaccctagtcttaatgtccaccactttcttgagtattttatgtcctttttgattactattaatgtccatgggaacagataaagtagctacaaactcttttaacaggtatgagtatcagctatcactgtaactttcattaaaatataaaaacagttaaaaaccaaacagagcatcactttttaatattatctaaaataacaataaaggtggtcagatggttacgtgttcatttaattgctaatgaagccagaccaataagtcaaagctggattccctgtagaatatcgatttgaagtattagcagcaaggatcgtttggtaagacagatttaaaataggagtaaagattttactttccaaggattcatctttgaattcttgtgggtggttgttttatttccagcctgctaaaaaccataatatcacctgaagcaagcaggcatgagcctggaacgggagtgaaatgacaacgaaacatttgtacatgttattaaagctaatgaagcaagacacgcactgcctggttttgtgtcacgcgcccctggagagcccaactgtgttctggggctggctgtggcatctccccaggatatggctcaccctgaggcctctgattcagcggcagagctgtttttcccctcgggaaagaccaaacagacacctgaccttttataaaacctctaggatgaatcacaagtaaagttctttggcattctgaggtggtgggtggaaatcaaggcttgacaggcggccatgggatgggcagcgtgggctggcgctatgggctatgccatagcgtggagaatccctcacactaggacccctggcctgcatgtcatctggcatccagaactcccactcaatttccaaaaggtgctacccaccctggaaaaaaatctagcccactgagtagctgggaaaatccacagccagggagacagatggctcaggaagaagcaatctggaataatagtgagggtgtgggagttggagtgtaggctgggcaaggagatcagagaggaaagaacgggcatctgtatgtggcgacagatgacggagtgctgtttgggacgagcagttggaggaggcaaaggaaatggaagtaatgtacttatgcataagggctgtatcataattaggaaaattccccttctgtctaccccgcaagtcccacttggttcagatgggggcagacagcagagagcacttacttcacggaggaagcagaggctacccgctattccaacaggctttctatttctgatagaaacaaatccaaactgagctaatttgtgtacagctgcaggcaatataaacacggctatttagaattctttatagagtataggcctttgtactctatacttcatggaagttaataagtaggtgtcaaactctgaattaaaattcccagaagaggacacagcacaaaggacaataaaaatgatttttaaataatcatagggataaatagcatccacttctgacaaatgtaagtgctggcataaaatgttattaggctacagagattgtcttttgttcaggaagtatattttattctcctgcctcatcattcatcatcctaatgagccctcaaaatgtaaattaaatagcaaagacggattcatttgaaaagcatcttttcaaaaaaaaaaaaaaagctaggtgttaaaccattttttctacttttattctatatattgtttcattttttcattgaaaaaaagccctcagtacttgaacactttatggggtaagttcatgcaattcatattttcagtaaacagttcattcattctccagtactatgggattggtgatttgaaaagaaaaaaaaaatcgcattttaaaatggtatgccctgtaaatgatgtttgatccggaaaatctgagaaacctgtgcacgcattcacttttttgttttattcagaagtgatttggtccagggaaaccctcaatggaaaaggattagtgaaaatttcaaacagctttagtttactgaactgaatgcattaatggctaagcaaacaccagttcaaccattaatgataaaagaagaaggtcatgagccaaattagttgcaatttcttgttatgtattgataagaacattacccgttcctatgatgaatagagaaatcagggttttgtacttgacctgaatttatgcatgagcacacacaacagaagtgactgaacagctctgctggggaggcacccaggaaaaacacgctgggaaaggaaaatagcagcaaatcatgtctcattttggcatgattggtcctcatttgcctgtctctctctctctctctctgtctctctctctctccccctcactctccccaccctctctcactgcaacccataaatcattcttcgcattctttggctgttcctgcttatgtgagagagctcagctcccagctctctgtgggtgaacatatataaaatgaagacacaagtaactgcactgttgaggtttgcctgatgtccagggaacagccattaatctgcacaagggggtttcaaaagccccactctgccgaataaattatcgttaaccaatctaggcattctaaagacactatatttttatgaggtcaaatgttgcagaaatatcccagagggagggtagaaactatccagctgtgaaagaagctagtgacagcactgcacagaagcctggggggtcctgcagtggctacagaccggctgcagccctggctgaagcacatcctcagtctgcctggttcatgaggactgctgcatttgggaagcactcatccctcacagcagtgcccaatgcaggctcacctctagagaaggggcatctctcttggaaggtctggctgatgaaagagcatatcatgacagacaggagctcatggtaaagcctgcataatccactggccatcctgttccagtttacttactcagttatttttaatggagaattttctttttaatgtgacagaactgaactcaatgcaaggctcaaggctgtcgtcatgacagttgcccacataaagaaactgtagtctgggcccaaggcatggccctagcaatttcccagtaatgcacattttgacgggcacatcaattggtttatgatgtaagaacaacactaattagtgaggaagaagccaatgtcctgtgttgatagggcccggtgcagtttaagtgatgaagtgaacgttacttctaacaaaggaaaacaaggtattattctgcacagatatttaactctgaagaagtgttgaacaatgatagatgtattttaaagtggaattgaagcttcatccacagtttaggaagagaactggctaggatatcaataaattgttttatatttgaccccaggcaggaaaaacaacatgcaacccagggaagggatggtgccttgctgtgaaatatgtgcattttaacctttgcaatatgttaataattaatatgaattcacaccaatacgatatcttcataaaaacacagaactctcatgtataaaacctttcaagtataaaagaaataagctaccccctaaaggttttctgaaaaaaattcccattaaagaaggttctcacagtctgaatgtagagacttttaaccagacctaaaattcttgcgaataagccccatgctatatgactgacagcaccattaaaaacgctaaaaaataaaatacacgcttcattagtctcccagctgaactcagaatctctggcccagaataaatcttagcctttaagaataaattctcttctgaattaacatctcagagtcattaatctttggagtgacccttcaatttcatttggagaactactacattcctcaaaggtcttttttcttttggcaagccatgatttcatggagagaaggaaaataacatgatctttcttttatcatttcctcattctcgccctcagggtggcttctcttcccttcccaactgaaacatcctaaatctaaaatcaacagagagccttctactgagtcagcaaggaactaaaatttaactttagggatacgtgaaaataaaaacaagactaggcagaattattattatacatttcaggaagaaaggaagcattatcgtgaacacaattttaccaaattaaaaatggtacagactttattctctatttcaggggccttgtttattaagcagacagaactctgcttgattattccatgaagtcgccaaccattaatcatgcacatttgtttaacaggtcaaatgaagagaggaaatttgtgtgcagtcacggcaaatactgcctcattttacccactgtgatactaaaggtacagacatcatgttgtaactacattaggagagattggtccataaagtaatttgattataattccttcttgagcagacaactatttttgaaaagcaaataactatttattttttgattatttatttttaactgataaaaagtatacgtatttatggggttacgatgtggtgttctgatagatttatacattatggaatgattaaatcaagctatttaacacatccatcacctcacgtactttcgttgtacggcttgaacatttaaaatctgcttagcaattttgatatatacattgctattaactatagttaccacgcttatttgcttatgtatgtatgtatttatttttgagacagactctcaccctgtctcccaggctggagtgcagtggcatgatctcggctcactgcaacctctgcctatggggttcaagagattctcctgccccagcctccccagtagctgggactacaggcacataacaccacacctggctaatttttgtattttttttttggtagagatggggtttcaccatgttggccaggctagtctcaaactcctggcctcaagtgatctgccagccttggcctcccaaagtgctggaattacaggcatgagccactgcacccggcctgcttattaatcaagattttcaaagttagatgtttaattaaaggataatatgtctataccactcatccaacaattttcactgtgaagaccacattagccagctcccagaggagacacattctggtgagggggtggctgggttcaccatattcgcttctaccatcctccaatcccagcctctccctctacctgggggattcactggaaccatccatttgtattcccacattttttgtgttcttaagccagaaatgtctcccatatagcttgccaactgcccaccgcttccaaacacctctatcctctactgccacgtgaatcttaaaatagagcttccactgttcagttctccagactcaccagccgttaatagcccctcatcacctagaggataaatctatagtcctcagagccaaaagcagccctgccctcagccttctcatctggctcatttgggcaatttcttctgaacagtctacaggcgttcctattgggaacatctgctcatccatcccacctgcaatgcctttcaaaatgtgattcaaattcatccactttaccctacctcacacacaaaggcctttccctcattttccccctcaaaacccaatgaccacactgtcttgcttgatatgcattccctcctgtctcacagggctatttaacatttcacttgtttaagtcttatccatgtttccctgagagcaggaattgtgtttggtactcacatgcacacagcctgcatgtaacatcacaccttacccagagtaaagactaaaacaaaaatgtaatcatttaaaacttattttcttgttcctactttcaatcaaggaatcatgagtctcagagatactctaggcccctaaatctatatttgtgcccaggagttgctgatttcagggatgggagtttcaaagagagggtgcagggtcttttttaagtcttgacaattccatccatggccccttgtaagttttagaggttgtgaaagatactgaatccttggggttccatgaacttgtctgtagtgggtctgtgcattcactccatcatactcttggttggcagagaagctcagccacttgggccactggaacaaggtcatttggagggcagaactcagctctggggcagatcatacgcacaggattggttttggaatctatcatgtgatagagcttctccacctaccttctcttactacattaacccataagagaggcttacctgttaccaactagtttcatcacatactgtctggagatatgacaggagatactggaacaaggaacacgcagacagtgaaagtttattgattcagtttacatttaatgattgattggtagaaagagaaacaagtcctgaacaaagtgtgcccctccttcttgatgccccaaaatgcatttaaaaatctctttcaaatatacctcgtatgtaccctctgcctcatacctaacactgatcacattttgtccagttagattgcacctttcctacctcagaaaggtttacctgaccttacttgaccatgctagcgaggtctgatcaccatgttccatgcacatattttaaagttggtggagcacttactttgtccctggccagctcctgctggggaaccttgtctttaaatggactggccttagcctgtcccaacatacacatgccccaagatgctgacagtaaattacaacatactcactcgagtcattacaattttttttttttcaggaataaaggaggtacgcgcaaggtcagagagcctcctaaagcagtttggacacatttccatgatgctctctgcctgagagcagagctaaaatcatccacagtcctctactgcctccccctccatgctacaaaaatgtaaaagatgcacatttgccattaggaaaactcctcattgcattttggacttgaagtccactggagtagggccatttaaaaatggtctatataccacgcttcatgaacaagttttattacccaaactgaaaaaaattagtgatggaaaaaataaggcagatgtatattacatcagaataactgctgcagaaaaaattccaacatcatatttcatttgaagatttcttgaatggccaaagagcagtatttgtgaaaatttttaccatatgtatttaggatactttcttaaagttttattttttaaagacttcaatttaggaaaaccatgtttaaaatgcattgacttcaactcatacctagtgctgtaagaagtaatgcatctcccttaacgaaatgtccagttactcctaatttttaagatttcatcacttctctcttaacttcccttaatgagaaggctgaactagctcgcctagctgaatttatcagtagcccatgcttgaaagagaaatggttctgccctctgttgggggcaacaggtgtgctgatggaagacagatgagctaatctgttcacctgaatcctctctgtcatgttcaatttagcctcagtctttagaaacacaacctaaaaggtctaaggcaaatagcagctgtccaaatcagagaccaaattagagaccctgtccctgagtccagaaagggtaaacatactctattgtttcctcaccatttgtttttggaaacacaaaattataggagggggaaaaccttattgttattagaatcatctttcagcaagaaagacaataaattctaagacccttagccttttgtataactgttcagtcaggggagtgttagcactgtgcttgttaatttagaatctagtttatgaagctgattatctttttaaagcaacacattatccgtgctcacaaaatatcatagtattactaggaatgtagttatcacattatattgtaattatcacttaaatatctgcgctgtttaccaggaaatataagctcttcaatgtcaggagttactcctttttcaaaaaaatcatggttcataacacaacatttgaaacatgtttagcattaaataaatatttattattgctatacttatcattaaactacgctagtagatatcaactattgagttcttattgcaaaaggcatcgtgctcaactctttccatacattgtctaatcctttatggcatccctatgggacaggtattaccaccctctgttcacaggtaagcaaacaaggcttagtaaggtaggtaattgctccagatcattcagctgtgtagggaagagacaggcttccatccagggccacccaactccaaacaggcacgtccctaaatgctacactaaatatccatggacgtccatgattctgagaactagctctctgcactcactatttgtaatcaaaatcagcaagtgttatattaataacttcagaaacgctgtcatagtcaaaaatttgcatcaaatgtcttagaaatgagcctaatagtcacaatacttttcatcatccccaagaaagagacgaaaaagtatattcccaataaaatacttggatggaaaggcacaactcgaaaaataaaacattgtaaaacttcactgtaatatgagaacaaatgaagagagcagatgatgaaggtactggaataaattaaagagagctcatctataaagcatagatatcgaggacaaacttacaacttcaaatgaataaaaactgttaattaaacaggagcttcagtatacatataatgtttgaactttgtcatttaaaaatagcatttcgttttctgcaccactagaaactacattttgaacacattcaggatttcacagctacaatactagaaatgtttattccaattaaatgttacaattactctactgtgtattatcttttcctttatttctccctatttcatcaatttctttttaaaaattgtgtaagtcatgcagtttttgaaactcaccatcttacaatgacttttattcttaagtatgtcagatggacatttaactcgatgtgactttaagaactctttcttttacgtaatcaatcacttgtcctaaaaagactaaagcatgtgcatcaaaactgtatctttttttttttaagcatgcagctgtctttgtcaagcactgcatcttttcaaggaaatgtcagcaatgttattcttgggcctccttctgcccaagaggccaaggagggatgaacaatgacggcaacaagacacttaatcaatagcagtcacagcaccattttttatcctccagaatcttcattttcaatgaggtttacatcattaaagtaagaaaacaggaccgtcaatctccattggcttcaagtggtggacggaagaattaatttgactgccataaaaataatgatgtagctgtatgctttaaacctttaaaaatttatttttaggcttaaaacctaggaggaggacagacatgttgcctagaaataaaagcactgatttatcaattctttctttttcttatattctagacagattttttttttaaattttatagatgtggtctcactgtgctgtccaggctggagtacagtggctattcacaggcgagatcatagctcactgcagcctcaaactcctgggaccaagcaatccttcagtcagtctcctgagcagctgaactacaggcctgtgccatggggactgactccacacagatttctaacagatctgaatcttgtaaagaaaggcaataggtttcaatccaagtccttttaaggtgttatgaataatccatttgaaatatatttattagcagaggtacctgtgccattgtttttgaatcatgttgacacatgccatctccaacatgtgttctcactatgacagatttatatgaaaggagtaaaaacatcacaagcacccgcataacgccttcccaggggcagaggcaggttatctgggcccttaaaagctataatgctatctttaaagaaaaaagcaaaattatgggtttgaaattaagtagagggccttagaagaggacactcaaccccggagccctgaaacttaagctgtttttttgagacagagtctcactctgttgcccaggctggagtgaactggcgtgatctcagctcaccgcaacctctgcctccagggttcaagcaattctcctgcctcagcctcctgagtagctgggattataggcgtgtgccaccacaccaggctaattttttttatttttagtagagatggggtttctccatgttggccaggctggtctcgaactcccgacctcaggtgatccacctgcctcagcctcccaaagtgttgggattacaggcatgagccaccgcatccagcctgaaagttagacttctttaatggtaaatctgcccctgcctcatccaccagaaaacacaggtgcccttttgcgtgtgcacaggcgagttctgaaataggagggctctctgtttggtctttttgttcccacagtgttctcccccgagtgccccagacattctgtgtgaatttggtacatgtaccagcatacgcctggagtggtaatgggacaccagctcagccagcggtgctctgtgaattttctggaaaactacaggtggccacttccacccaatgaggcagcagcaagggaaatggcaggacaggtgaagggttttgattggtacaaaattcagggaacacacaggctctgtcattaggtgtacgttctgggttctcatgcctagctctatacattcaaatactttgcttctaatcctttagttttggtattcacttcaactgaacattcatcagaaatgcaattaaaaatacttttaacaaatgattgagatacatgcattcccagctcattttcaattatgacaaaaacaaaacaagccttgcctggacagtcacgaggcttgaccgggcacactgaatgctcagaggtcagagtgggcaggagccccggagcaggaggaagaagcgggcaacctctctgagttctgcactttctcccaaccagcactctctcacaggctgcacactaactacccctccgtgcccctgtccttcaaagggcaggactgtgggggtgttgggggcaggctttgacgtgcaccacttctgtctgggcacagtgacctctgcatgcccctggcctatcaggtacagatccacagcctgtcagttgcaccctccctgacaccaccaccgggacctgcacagactgggagttcatttccttgctcactggggcctgccttccccaggctggtgtcttctgatagccaaactgaggggtgggaggtattttgaaatgcagatttaattattcatgtgtggtgaggccaacagatcaggagataactgccactgaaatgatagtttgttacacacagttcccaatgggaggggacatgccacacacggtgggggtcacacagggaagcaccaaggtcagctgggaggtagagggagccagggagaaaagtgggcaagagcctttattgttttccatgggagggaacggacaaggatttgagtaagtaggtttaggattggctatttggaataacttcagcgagatctggagcacagaggctgtcctgagttatctggtatgtgtcctggattgattagggcaggagacaggggcccagagtgtgagagcccagaaaaggaggtggggtatgggctttggagcagttgtttgtgggtgaaaggcgtgttcccagcagcaggccaggcttttgctgtctccgggaattagctagcctttcagggtcagtgaggccctaagatgtcaaagcttcaaaatgcagaataaaaagacatgatcagtaaagaagcgaacaaggagcaggcaggtgagcatcacagcctccagcagaggcagccagagtctgcccagcccggcaggatgctgaagctggggaagacagacttctcttacccctgctgcaggtgcgggcaggcgggcgactgagctttccactttggtcctgtgacaaatggaggacagctgcagatggatgtttcacccaacaccaagcaagcagacataacctcactgtgcgaggcgatactgcctcactgtacagatgaagacacagaggttcagaatgtgtggaagggcttttcccagggtcccacagctcatagttggtagagccaggattatctccattttctctctcaggccctgggcttaaagcccaccagcacattttttttttttgagacagagtctcgctctgttgcccaggctggagtgcactggcatgatctcagctcactgcaagctccgcctcccgggttcacgccattctcctgcctcagtctccggagtagctgggactacaggcacccgccaccatgcccggctcattttttgtatttttagtagagacagggtttcaccgtattagccaggatggtctcaatctcctgacctcgtgatccgcccgccttggcctcccaaagtgctgggattacaggcatgagccaccacacccggccaaagcccaccagcttttgaaggtctcgcacaaatgtttcagacctttagaaggaaaatatatgggctccaaaataaaaagagaaagcaataatgtcaaaattaataatgtttaattaaacgtctaaaaacatattaagccatttttattcattgttacatttagttttcattacaaaattcattacacttgaaaataatatgtagcttagattttttcccacattctaagaattcttgagtttgcctaatgataactgagaagccaactataaattaaatgaattactcatagtcagataactccaaaagcaaaattataaaagctctttataaagagctttataataaactttataaagtttaaagaattttttcaactgttgtatttaatatgggatgtgagtctattttaatctgtctcccaggatggggtggggcctctgaaagaaagcaggcctactgtttcggaggtcttcaaagggccctgcctgcatcaacctgctctcaaattccagctccttctactcgcattccctccccagcaacacctgccctggacggcagttccagaggtcccttcagagcaggcccactgctgagaatggctcaggggctctgcttcctgctcaagacagcatccgatctctgtagcactgcaggccctgactgctcccacagagtgttatggcctctacgcacaccaacatcctgagcaccagagggaatcttgggagatcaatataattgtggagaataattctaagattacctcccagctcgtggtggggcccagcattcaactctgggtccttccatcctagaacagcatagagggaaggtgtggacttggggggtgaccaatgccagtgaccaaggagaagctgttccaagggtgggcaaggaagggaatatggttgcttaattctcacctccctggcgctcccacagatcattctgtgcccatgaagaagacatcacagggtgaaccatgaccattaacagctttgctaaaaaaatccacgtaactgtctttgttacccatggcaggacctgcctgctccctggtgctggggccaccttctgctcaggatgtgacaatggtcacaccttctcagaaccttccacaacaggaatatatctgattatatgaatatatgtgaagtatttcacagagtgtgctacacagagcaagcatttaatacgtatgactgactaggagcctgacagtctctatttagacagcactgtggactcaatgcacgtttttcctcaaaattcacaagttgaagccctaaccccagtgtgatgggatttggagatggggcctttgggaggtaattcgggttggatcagatcaggaaggcggagcccttgtgatgagtgtccttgtaagaagagacatcagagacacagcacaaaggtggctgtctgcaagtcaggactggggctctcaccaaacactgaaccctgcccggccctgatcctgagcttttcagcctccagaattcggggaaaataagttccccttgtttaactctacagtctatggcattttgttacggcagcccaataatgctcactgatggttttataaactagagaagaacatcaactaacactatttgattttcataaattgagaggggctagacacagaaacttccaaatacctttatcactatccttaaattctatttgaaatttttatctatcagtatttaagggactcagaaactgagaatctgggttcagactacttgagtttacatcccgttctgccactttctaagttttgaggctccatgtatctgaaccacaatcttcttatctgtaaactggagctaataaccggccttctctcatggaatggttgtggaaattaacccatttatgccagaggttgcaaatttctttttttgtgcaaaatcagacctttgcaatgaccttgagtagtaggatataaataactcccacaagcttagcaataatggaaccagtaatggaacactaggcataaatgggttaaacaggatgttcctcacaaagcccagaaaaatacacattgatatggtgcctggatgcctttttttgaaaaaaaaaaaaggagggaaaataaagataatatttatggctacatgtgcatctgcttaaagaaaactctagaaggacacacaaggtaatactaaatatggttgtggtgggttgaatgttgagggaagggaggagagaaaaaagggaggaggaagggaagaaagggagggagggaaaaaaggaaggaaccagaagcagtgtctggtacttcatcagcattctggttgtttgacgttttttctgatcagcgtcaggaattttttttttttttttgagacggagtctcgctctgtcgcccaggctggagtgcagtggcgcgatctcagctcactgcaagctctgcctcctgggttcacgccattctcctgcctcagcctcccgagtagctgggactacaggcgcccgccaccacgcccggctaatttttttttttttgtatttttagtaaagatgaggtttcaccatgttagccaggatggtctcgatctcctgacctcgtgatccgcctacctcggcctcccaaagtgttgggattacaggcgtgagccactgcacccggccaggaaaatacttttaaaatgcttaaattacataatacataggtgtatgcttttagaaacatcacacagtacaaaagcacacagatttaaaaatgtaagtccctcttctgcttcagtctgtatccaaaattaaccaattactaatagctttgtgtgccattatttaaaaataaaaatggaaccacgctatgtacaggtgtggcagctgcctttcattcagcatttctcgaggccttttcattgccagcacacataggttggctccattttgtgtaactgacacatgagaaaccacaccatgattacaccacgatttactgaacttcttctgtataagaaagcactggggttgttgacagtttttctgtatatgagttgatgcatgagcatggctatttctactggatatgttctgagcaaggaacatcaagctcgaagggctcacactttcaaattgtatagatactgccaaattacattctgcaaagacaatgcctgtgtccaatcccaccaacaaggtgtttcccatactttggaagagatttatgtaaaaatcatgtaaacatttttaaagtgttttttaagttgaaccgcaattcagaaacattgagtagaagtgtgtctttgattttaaaaagatgatatgctgaaatttagatacgctgaagtgcagagacattcttgtggaatagggatcagagccttcccttatatattattgaactgcatccatttacataaccttctgaagtcagttttataaagaggccaccaggctcatggcagacaggatcttacccctgataaaggctgacctctgacactgcaaagcccctcaccaccgtgccagccacagtgagcgtccgggctatgctctccatccttgctgacgaacagacagagcacacagcagggactcggtgggagtgatttaaagtactgaactgaagaagggaataaaccatatttgcacattctccatagctgcttctacacttataaaaagctgtctcggatgggcgtggtggctcacgcctggaatcccaatactctgggaggctgaggtgggtggatcacctgaggtcaggagttcgagaccagcctggccaacatggtgaaaccccatctctactaaaaatacaaaaattagccaggcatggtggcacacgcctgtagtcccagctacttgggaggctaaggcaggagaattgcttgaacccaggaggcggagattgcagtgaggcgagatcgcaccactgcaccccagtctgagtgacagagtgagactccttctcaaaaaaaaaaaaaaaaaaaaaaaagctatctcattttttcttttttcccctaaatttcaatggagaaactggcaatataaaactcaagaaaactctgtccaccttaagtttctggataaataactagggaggcctaagttggttgtataataagtagggcatttatatgaccttgtaaatttgtatgaaactgtgtactatggaatgcaccaaacattctgcattgaggagtttcctactactatcagggacctctgaagcttccccatctaaagactcacctgtgatccccaaattccagaaatatagaaagccatcctgacccactcccatgctgcagccacctgtccataagcccactcctgccacttctgcaggagtctctggttcttggagttatcttcctgggtcagtgcctgatgccttttgcatgaactgtcacccaagaacctgtcagaagtttccagctgaagtgaagcagatttaagtgaaatgactctaaatttctagtcaagatgtttcatttgatcatttacttccctgtcaaaatgcttttttttttttttttttttttttttttttttggagacggagtctcactctgtcacccaggctggagtgccgtggcacgatctcggctcactgtgacctccacctcccaggttcaagcgattctcctccctcagactccccactagctgggactacaggcacgcaccaccatgctcagctaaatttttgtatttttagtagagacggggtttcactgtgttagccaggatggtctcgatctcctgacctcgtgatctgcccgcctcggcctcccaaagtgctgggattacaggcatgagccaccgcgcccggccctgtgcattcttatttcatagttctctctccatcttcccaggtgtacatgaactgttttgcaagtacaccccgtgaattttaaagaaatggtttacttttattagttactacatataatttttttaattgtattgtgaaggctttttaaaaagctgaacaatagttggttactttatctactaaagttaagtgaaatagatatttactacaaaataaatgaaaggtgaattcaactaatttaccataattatgattgctattttgggataacaaagaccaatatttaaactgaatttcaggactttttattcagcagcaagtataagacaaattggatggtaagcatatatactttgaaatttcattttcagtcacatgcaattaatttgaaaataaaacacccccctggctcccattctctccccctaaaacatcattccagcctattttcatagaatcgtaggagtgaaatagagtcacacggactgtggctatcaggccccctcagacttactcaaaatgtctctttggccaggtctgcccatcctttggtggaggcctgctcagacccactcgggtctctctgctcatgttggtcatctctcctcacactgacctcccactgcccacaccagaccaccttttcaaaacccggcttcttatctcaccttgcaaggcctctgctgaggattttagtgcccggttctaacttccttccagttctggagagctcactgtctagaccactcctgttagtcctcattcacttaccgtcttctatcatcatttgacagtcctttctgataagatcctttaggagtgagacacacatatattgttttatttgaccagtaaggtaatgaatatgtagttagcaaatgccaataaacactgaattgaaatacgtagttgaaaaaaagatgtaggcaaatgaattttatgcacttaagagccccagaactctaatgcaaaattataatctgccagtttaataaaaacacattaattgtgaattgataagaagaaacaaagcctctcaagtgattaccttctgaaaaatactggagacctcatctgataagctgggttgacaagtcttaaggcttttcaaagtctagctccctctgtaatttccaccaagtacacgacaatgttatatgagaaccacagaaaaaatgtggctgcttctcttccttcctgttattaacaaaaatgtttgcagagtggaagatgtctgagtgctcattcccttcatttctgctttagcttcttaaagaatggacattttttccctaaaggatcttcaaaataataaccactcccatttactgggcacccaccccgtgtgcagcacaacgtcaaacgccatatgggatcatctcactttaccatcactcaagtcatagaggccagatcctccacaaggacactgaggcaccgagagagagtgggtaccacgatgccatctcgcagccacatccttgccctgctgccaggctagctcttgatgctgaccacagctctccaagcccatcgcctaggagaagctgtgggtgcaaacttcaagaacaagctcttcctcaggaagagtgcttctgtgagccactggatctggggcaacttctccttttccatcatcttctctgccccgggcatggcatcacagtcttgtccacagtcctgcacttgctcacgttgacactgggggctgccatgggtcgcctctggcccacctgctgcacccggatactgaggaagcccattccccaggaagcctcttgcggccacccactctgatcacctcctgccaccagaccaatttttcagtcatacattttcatctcagcataaaattctaagacagtccccactgccttcaggcctgacatcaaaggctccactgcctggggctctctcgctttggccaacgctgactcccactttgccctgccctcacagggcctgtcctgcctcctccccaccagcagcccagtctccttcctgtttcctgtcctccactccttgctcccactcttccctcaaacctctgcttatgctaatctcaccttctaaaccaagaccactgcaaatgccgtatttctgctacagccattgtcacagggctgggcacacagattgtcttaataagtacctgtggatttgacatgtctggattttggcaacacaaatggaatgcaaaatactgaatagataagaaaacaaaaatgcctacttctgaaaaaatacctcttcctactttcacgccacattcacaaatatacacaagttcttccaactctcctaatcttggcaagtttaaactacagttttctgaaacaaaggtcacttgctcagctacagataaataaaaattcacaagcatctccaggaaaatcaatacaggtactaaaaaatctaagttgataataaatttcagttccccttgcacatagctcaggaatgtcactatttactggaatcactgtaatatcagatatttcagaagagtattgatttggccactgaagtgtgactaaagggataaataaactgctcctggggtcaatcgatccatttatcttcactggtattttataaaaagtcaaagtagcataaactttgataaataaatgttatcatgaaagaagtattgctgacataaggatttgaaggaaaaaagaacagacagttccgctacctgaacgccacacaattggcttcacattttagtagttttaatagtagctaccgacatagaaacattctttttctcctgccctacataatccatggggccaggtcaaagtctgagccacatggccaagaaacagaggggccacaagtcaagtcctaatgaaatagaaaggcaaaggaaataacatttgtttctgccttattagaaagtaactgctagggtctccaaggtagacacatgtctttggatattttgaaggcacgtctggaaatggcagaactatttagacttagaaaatcaggatggtgtgcactctgaagtggctttttagggctttattgttaaaccatgctgcaccaataaccacttaactgcactgcaatgatcccataagatttcaatgcaaggccatggagagctcacaacatcgtggctgtaataggatattaaggcttgagaagaattttaattcaaatgtaggaaacgtgggaaccctgtgaagaggctgtaacttaccatgagaaattatactggcaaggttttactgcagttgtagggagacagtattaccatctcatgatgaaacaaagtgatgatgatgaaagtacatgagttgatactgtaatttcagcccaataaagacttcacttaaattaccataccccaggggaacgcacagctttcaggatgcagagactgttatagatcagaaatttggtttgggtcacctctaagagggctctcaagctttaaaacatttccaatccaaatatgtagctctaagactcgggcccacccccactccccttctcagtgaccacccagggctcattcagaagctccttattttaattcttgccttcacacagaccactggaccactgccgccttcaaagacccctgcccatagcgacaacgtttttcagggtcccattggaggaaagcccactcagcatttggtgaggcagctaaaagggctgtacctcctgcgggctggtgcagtgcccagcaggacacagtgggccctggatacaatggcatttactgactggaagtgtctgggtggccagaccaggcctgggattctctgaaggtcacagaatgttggcaatgtggttctagcagctgctagagctactctgggcaagaatagagcggtagccatgggtacagtcaaagggggaaatgcccatgacgaaaggctgtctggcaggtttgatgatctccgcaaaataggtctggctcaattccgtgacggcaggttgctagaaagagtccacagagtgaacaatgctactcattttcctccttctcctaaagagccgcaagtgcaggattagccacaggctcgtaaaaatgcaggtcccctctaacagcaggttgctccatgtcttttgaagaaacagactgtgtgcgtacatgcatgtgtgcatgcctgcatatgcatgtgtgtgcatgcatgcaatctggctatgaacgcattgcaaaaagtctctctgatgtcatgacactaaagaaataaggtgaggttatctttgatgggatgtctcttttctcttttttacccctcaattcttctgaggtgtgctgggatccctgaagatacctccccaaggcattatgtctgcgtattttgagcctgctctttctctaccatggatctcctctacatgtggattatttagtttggctacagaaaatctaaacatcactgcagctttgtctgggtgcttgggctgtgcagcaatctgtgtttctcccgctgtcaagtgggttcttccaaccctgctggcactactaaaccattgccctcctctctcttcacagccgaagggacacctccacttataagaaactcattatcgtgatcccaacctgctactcttcaggtgttcactatttcagagaatggctggcaactccacccttcccactggccaaactgggaatctggggcttagcctctcctccctcctcatttcacccccatccaatgcatcctccagtctttctgaagagccatcttctctggagactcctctccgttgctgcagtactgagtctagctcaagcttccactcattcttatcaaattgttgcagtcacctccctgcatctgctctttctccagtggtttcccttgctgcagtcacagggatgtttctaaaacaccagtctgattatgttgctccctgcttgagacactttgatagctgtgccccccagagcagaaggccaactgcttgtcacagctaagaaggcatttcatgaccggtcccacagtcatctctttcagctcctgtcacaactccacgttccggcctctttccacgctcacccacactttgaggctttgaaaatgtttttccctctgtgcctcctttgcgtctctgcttggatgtaattttctcctacttagaggcagaggtccctcctgggtgctcccacagaacccttgtgtgcgggtgaatactgttcatcaagtatagatgtctgacatatttggaagtatatttgcttatgactgcttaaactgtaggctcatggactttaaaacagtataaactttaataaatagtataaataatttatagccctgtaaattcttaaaatctggaagtcacatgctacaattagtattgacttgttatacatatacaatgaaggaaataattcttttttatggacaaactaagcatttgtttaaaaccaatgagcgataaactctgatttccagtgtgcggctcttctgaacgttttaaatgcataaatacacaaacacacaccgcgcactcactacatgcttgggcatattcagcagaattcaactgtcatctcaactcaatgcaggtgtccctcgtcaaggcaggtgtacctcatcaatgcaggggtacctcattttacatgataggcattcttttaaagtagcatgcaaactcagtttttgtgaatcaaagttgattttaagtgtcccatttgagcaaattctatggtaactgtatgttcaaagggaagaatcacctccaaatttaaccttcttgagtaatccagactttcataattggatttacttaaagcagtattataaagtaattaaattgattttaacgaagaataaaacacaaagaaaaaacagtaagatgtgtggatcacattacacactgccaacatcctacataatgcaaacactgagatgattaagctgtctgaaaggcctcccatgcataatgatggaaaaaatataggaaagtttagagtttatattcttgtgaatcccattttatctactaattcaaatttttctttctcttttactctcaatttacaactaccaaggacacaaagagcattctatattgaagccatttctcctccagaggcataacaatgagtttcatggaagaagaatctcaattttctgaataaatatgaataagtaaatagttgcttaggtacaccagcatatatgtataatattattatgtaattgtaccattacaccctatttcaaggattcttagatgctaccagtataagacactaccacgttgtgtgccatttagagagaaaaactgccaaccaaattatgacacgtaatagattgtaagacacagtccaatttcagagctattaaaatgtgagaaatgtgtatcttttaatcaatgatatatggtaacaaactctcttctgctttatctccagcatttggaaaagtgcttggcaacagtaaacactctatcaatactttttgagtacaggaagaaataataagtgaatattcaaaacaatgaaataggtatgtatcttgcatttaagacaattataaaatgattggcactgatcaaacgttttaaagagcagtagttgctttatataccagattatctcttctttaaaattagagttcaagaaattggaatatcaataataaactatttacagacttccatcacatagataacatcatcaagtttaagataaataaaatcagatatgaatttaatgagatttttaaaaactagatggtgaaaatttctgttatagtttgaaatatatttgtatttgtctcctagttgacttatctctcaggtctggggtatcttaatgttactagacaccctataggcttctgtcttgagtcacatccatttgaatggaaaatgccattttatcattgctaacaacctgctgatgctgccaattacgaaccttcttcctaaatacattacaggaagtccactctatttatcttctctatctgacatccttttaagacattcccagtagacagcccttttctaaatgaagagagaatttaataacatctcattcctgcttaaatttgctaagtttaaagcaactgttttatatatcttctttattaattttatcattcatctgaaaactcttctcttttcttcctcacttgttctgccttcctgggctcatgagtatgaaactggaaactagatacgtcatttctgatagctttaccatctgacgctcagctggaaatggaagctacgatttccccaagccttgatctccatgtataaatgctgggcctgtcaggtctgagataaatctgtgtctcctctgtgcccaatacacaatgcaaaacagggtccacgcccctggagagtagctaggcaaggacatcatgttctatctttaaaataaaatgcacatcctcccattaaatggcaaatccttcatttctaacggttgaataggatggtacttacaaatgaattccacttggttaaatttagagttcggaaaaaaaaaaaaagtcctatccaaaaatacactctgccttggggccctttttgtctgattttgaattaatgtatttacaccctttcctctcagtatcttgtgagacaaacactagttgatataacaatatcagactctgaaatctgaaacttgaatactctgatttagttccttgtacagttatttatttaaagggggctttctttttattaatatgcttttcagggagggcactattgaaagcttgtgtgtttttcattttgtttgtttcttcaataatcaaccttccctttgccgcttccccagacaacccaggagtccctcctttcccacagggagaggggaagataatcccgaatgagaatggcccgttccatagcctgtctccttcaagattctctctgcaaaactaacataggtgggtcctctttttcagggccccttaggtctagagttcgagccgttcccatattgctggtgcttgcagccctccccacagcagtgctgggctgctccaggatggtgcctaggtgcccagtggccccatcatcctgactcccctttcctccaatctccccactgctgctcccaccactggcttcttcctcctcatgccagactttgtggccttctcctctgtggctgtcactccagcttttcctcctcctgctctctctaccacctctgccccaatgctgagacagcccagaaacatgctacccatggcagcatcaagggttgtgttctggctgctcacaactttgtgggaatctgatggcgcacgtctgttctggaggaacttgctgctcttgccctccgtggagcccacgtcttcacagagttgccctggagatgcctgctcaggttcttgctagcctaaccctgcctgtctggggaaaggcttccaacaagaacttgcataagagctatcctggtcatggtgaccatcaacacagaaggccaaggatggtcacccatgagcctgcctcaaattctcagtccgaatactttttgtctgcccctctgccctcccttcctcttgctcaaaaattaagactatatcatcagctacagtttcttctcttgttgtttcagatgctggttattgtaaaatgccaaggaggaaccacactggcttattgtttgttccctttgctctcctgtgtttattcctagcttcctgcatttctgcgtattggcacaaatataaggcttttgtttgaattttatatttcaaaaactataacagatattcatgagtttaatttaactgtctacttactagcagccatgcttgttaagggctgcaataaaccaactgaaaaattaagcactccacttcctcacatcctaagcaatgcattattttaagagtcctgtcattaggaattcagttggtactcataccagcagcagcagatcctaatgactccatttggtattcatacagatgttatcatgtatcacgccctccactgccatcagagaatcattcccattcaatgttttttttttaattccctgtgtttgataaatacgctgataatctttgctctgcacaataaaagaatattaaattcaggcctgactaatgcatggctggaaacataaaagaaactttcataggtcccaacaccaaaatactctgacctattcctactactccagccagctgatttttaggcattcttacatttctggacgccattctaaataatgcgaagataaaactctctaaattgaatcttaaatcttaaaatgtaccaaaccataactacctttgactgtttacttttatcatgccagatattcacttgattgtcttaacagccccatgaagccagcattattaacctcattttatgcaggaggaaagagaagcaaagaggttaggaaacacgcttggccacagagtgaggatgtggcagagctgggcttcagattcaggacttctcaactaccaagtgggtgctttcggacctatgtgtcagccagcaatgtaaccctacccctatctatctgggatggtcagttctatatgtcaatgaggcaagacctcagtccccagtcattcaatcaaacagaaaggttattcaatccaggtctttctgtgaagttattttgtagataagatgaaagtcgataacaataataaaaaaaagtctatcatcagttgactttaaggaagagcatcccagacaacctgggtgggcctgattcaatcagttaaaaggttctaagggcagaaatgaggattccctgaagaagaagaaattctactggtggacttcagcttcagctccggaccacatgtttctttctacactgctcttcctgatggcctgtccacggcttttggacttgcctgctagccccatattcgtataagccaacaccttgcaatcaatcaatcaatcaacctacctatccatattacacacacacacacacacacacacacacaatctatgtacacatccatatatcgcctactgtttctgtttctctgttggagcccatactggtacaccactgaagggcttttactgacgactgaagagctctcaggtgctaatactatgccaggcactctcacctgttaatgtactacaagtctatatgtgtactacatgccaggcaattactgaatgagccacagtctttaaaatcaacctccctcaaccccttaatgacaagcaatttaattctagcaacactcatggctatttctccttttgtaagctgggcctctttttatcctaacggaggtggaaagttacaacccttcctcttcacaatctgaagccactcgtgtttatcatgtcattgataaaaagatgataaaattatgtaaaacctgtaagttgcctaacactgtgccaattctgttcactgtgtgtaattttattattttatataattaacaagttcatgcaaaactcagtcattctatgtgcaagattaaagtgaagtaattcgagtattaccaaaatattattccttagacaccagtttagaaaagcctattcttctcttcaggttaaataacccacgctttcttaatgcttcactgtgaatcatgcacccagacttggaattacctcccttgtctgctgtggagcttttactattctttttttttttttctcattcaaagtagctaacattgcctttggtcttttaataaatgattctgaattgttgaggaattctggtttttttcttcttgttgttgttttgttttttttagatagggtctcaccctgtcacccaggctggagtacaatggcacgatcccagcttactgcaacctccgcctcccaggttcaagcgatcctcccacctcagtctctcgattgcaggtgtgagccactgtgccttgctggaatgctactcttaatataaaacaaatactatgtttactaaccacattcattcttgggttcactgtatcctttttgtcccactagagtctaccttctgattctccccttccaagcaaagagaatcttgatcctttactgtcagtcttgattcgagtgaatgagtactggcctatgaccatgggatgcgtacaaattatctggtctttaacaaaactgtctgcctgatgcttgtttccattcaggtggcttatgcttgcccaactttctcctatttcataaattttaatctgttttggctatgtcacctcctgcctattggtctaaaccaataactggtcacctatttgccactgaacatagttttcaacttttcactcatgtcattgatcaagagatgaataaaaataacctttttttggaataggtggggaaagaattccctatttaataaatggtgctgggaaaactggctagccatatgtagaaagctgaaactggatcccttccttacaccttatacaaaaattaattcaagatggattaaagacttacatgttagacctaaaaccataaaagcgctagaagaaaacctaggcaataccattcaggacataggcatgggcaaggactcatgtctaaaacaccaaaagcaatggcaacaaaagccaaaattgacaaatgggatctaattaaactaaagagcttctgcacagcaaaagaaaccaccatcagagtgaacaggcaacctacagaatgggagaaaatttttgcaacatactcatctgacaaagggaatatccagaacctaaaatgaactcaaacaaatttacaagaaaaaaacaaacaaccccatcaaaaagtggacaaaggatataaacagacacttctcaaaagaagacatttatgcagccaaaaaacacatgaaaaaatgctcatcatcactggccatcagagaaatgcaaatcaaaaccacaatgagataccatctcacaccagttagagtggcgatcattaaaaagtcaggaaacaacaggtgctggagaggatgtggagaaataggaacacttttacactgttggtgggactgtaaactagttcaaccattgtggaagtcggtgtggcgattcctcagggatctagaactagatctagaactaggaataccatttgacccagccatcccattactgggtatatacccaaaggattataaatcatgctgctataaagacacatgcacacgtatgtttactgtggcactattcacaatagcaaagacttggaaccaacccaaatgtccaacaatgatagactggattaagaaaatgtggcacatatacaccatgaaatagtatgcagccataaaaatgatgagttcatgtcctttgtagggacacggatgaagctggaaaccatcattctcagcaaactatcgcaaggacaaaaaaaccaaacaccgcatgttctcactcataggtgggaattgaacaaagagaacacatggacacaggaaggggaacatcacacaccggggactgctgtggggtgaggggaggggggagggatagcattaggagatatacctaatgctaaatgatgagttactggagggaggggggagggatagcattaggagatatacctaatgctaaatgacgagttactggggggagaggagagggatagcattaggagatatacctaatgctaaatgacgagttactgggtgcagcacaccaacatggcacatgtatacatatgtaacaaacccacacgttgtgcacatgcaccctaaaacttaaagtataataataataaaaaaaaaagaaaagaaaaaagaaaaagcgtttctccacagagtggagaagttcttttgggtctcggtataggccatgtcagctgcacagtgaaaaccaagaatgtggcattccttgcaaagaaaggagattcattttgaaattgcttctcaactttcacgtaaattatgcccaatattttaacacattgacaatatgatcagctttctacttcagaatgtgctgagttttttccctatctttatgcagttgtgaagtacctatgaaaccaagtggataaacacagtgttatgggctgaattatattctgccaaaagttcatgtgttgaagtcctaaccccagttcctcacaatgtgacattatttggagatagggtctttacagaggtaataaagttaaaaagagctaaaaataaataaataaataaccttcttatgtatagccgcagtatgttcaatctgaaatgaactttgaaatacaaaatgtactgatttggattgaaaagagcattactacaatgctatcccctgcctcagagactattcgctaaatattaattctattaaaatgaccattcaggagaaaagcactcttaatacctgatttgagaataagcatacttctgtttagacaataatagaaaacaattctcccattatttattcactaagcattggtagttagcatttttattgctcatttgttttcatttccaagcagatttttcaaaactagacttgattaataatatactatattatgtagtagcatttggatattataaaacattaaggaaaggtctagatagaggatacaaatatgttcttcctccactgctactgtacttcattttgatcactgcatgtgcaaaggtatgcatcagaaacttctagatgaaaactgctaattattacaaggatgccataaacaatcttgccttctgcatcactgtgtaatagtgcaaacaggaataacatgtcttggaccaaagtgtaaggaaaactgtgcttctctaagttgctaagttgatatttaaggacaatatgactctcaaagcccttcgagtttctcttttaacttcagctgctaggaagctcaaatcctgtctacaggctacttttacttacaatgtaataattgcatgaattttaacaagtcaccttacattcttttctaaagaaggacataagaatagcattgtagtttggaaggctaagatatatgtgatcatttcgggagctctgaccagcttcgctgtttggctggacaaatcacataattagagctaacattagacacttctccacataggaaattaagactctacaatgccttccctcttatccaagctcactctgatatttggtgaagtttaactgaagaatcttaaaagaaagcttttacataaatgctaaggaaggcataaaaaatgcttctgatttgcgcacacatgccgtataataacccagtgcagtgtctgagtcagagctgctagggtgtgggcttcctggggcggagcaccttagtccatctattctgttagttgtctgatgctttccttttgacaatcgattgacctgttttgtaggaaatgtggcactatgggtcttcatgattttgcatgattagccgggcatggtggcacatgcctgtaatcccagctactcaggaggctgaggcaggagcatcacttgaacccagaaggtggaggttgcagtgggccgagatcgtgccactgcactccagcctgggcaacagagtgagacttcatctctggaaaaaaaaaaaaaaagaaagaaaatgcactttttatgctgagggacaggcagtgcaaaggatgtgagtctggctgctgtcgcaggttctgacccctttgacatggaaaaattccaagtaggaaggttcagtagtcatttggggtttccagtgccctaggactcatactgaactttactgatcaacacttgaactgcacagaaatgcagcttgtaaatgcaggtattatgtattatttgcaaaatggtcctttgaaaaattaagctgctctcctcagcagcagctgccatcatctccctgaaagaaggctcagtggtaaacgaatggcagcccaggggctgcaaggaaagacttgtatcaaaaacatgtgcaccacagacacaaaacccactacctgtgccaggtgttagagaactctgtgttgttatgccataatgtgaagtttcaagaagaggtgagtatctgcaaagcaatttaacattttaaaagctgtaggtggtaaaggttaacctccctggtgattcatcaggactgtcttgttaagagtggcagaatttacaagcacaaaataatagctggcaggagaaagtgcccaaatgaaagaggaatagaatccatctacagccagctcaccaagcctctgaaacaggattccttggcatgtggaagtaattcagagatcaatgggagtaatatattgctctttagcccaaaggagaataaggctacattcacacaactaaggaatagtgagtcctgatttctacaagagattagcctataaaaggaagactgtcctatttattaacataagaacctagcattattagaggcttagggcaaaactccaccttgacccatgcgaaaatatttgcccagaaactaacaatcaattgttttacatttagctaaagttttatgcttgatgacaaacatagtccataaatgccacttggtaatttgcattggtaaaaactagccaaaagtcacacttagggcatatgtgcttccaaataccgcataacttgttataacatgtcctcaaatttacaactatgctgtatgtccccattaaaacccaataaataatttctcttcaccagtgattatgaagatttttcttcattagagtagcttccaatcatgcagtgatttcaaaaggtcctatttttaaccccaataaacatagttgtatttctcaccaaatgggccctcgagatcagaaatcactaggatatgaaagagatagctacatactcaatcaggaaaccataaatttaatgaggcaaaatctcacagggtcatacatacccaatggataacatagggaaacaaattcttagcttactgtttctctattagggattgatttttgccctgccaaaattgcatatccatgagcaaaataaattgttatggctactttaagtcacttaattttgcagtactttgttacacggcaatagctaacccagaaatgtccttaaagagatttcagagatgcatgtgaagggctgtcctctttacagagacacacactaagtaggaccaaaatagacaagagaaaggaaaaacctccatctgcgccccaacacactgttccccactaaccccacactccatcagagcctagactcacaagccctttactgtgttctgataaccactgtgacaaaaccaattcaatttcaccccttcagttcagaggggaaaagaaagaagagaaggaagtaatttaatgacaaagacagtgtcttattcagctatagcccctactgtacctacatacaacaggaaactttatataaagaattattttaaacaaatattgaattctagatagcagccttgattttcacaatgttagcaattttgaatccacttttttgtgtattctgatattgatcaaataagtaagtatactgtggatagtgggaacaagttttcttatagtcagagaagggagttataaatgcagaagcgggaacactagaataaacctgtgaaactggactggaattggagatgtcaatatgaaccctagtttctattagatagattggtagacagataatagatgatcaatactgaagtagatgtggacagatatacgtatgtatatgtatatatgcacatgaaatacatacacagtctagctctgtccaatgaacgggcctagaacacacaacacttaagtagtaatgagcacatgtggtatccggatcttggtttctaaataccatgtccgcaatcaaaggaaccagggctctcttgaaaactggctgattctaggttggggttgtagaatgatgaaatgattctagaacatcttgctatactggaaaaagaaataatgaggaatgatggggatatgtcaaatgaaaacaagccaacttgaaggggatcccattgaccaaatctcagataatttgacaaaaaaaaatgtgaataatcaatcataacctactgaataaaataaaaatccatgagttcatactgattaaatataaataaggtagaagagaaaggtcttccttatagaggaatgccaagtaataaatgtagaaataatgatgcatttctagaaaatcaccatttggcaagcaccactgtattaattgcttctggtaggtaccaccaacgaatgctaaaagtaatgtctgagagcttgatgaaaagatgtctacacggtctcaaaaagatacttattaataacttcagtggagaaacttggcagataccctcttaaccaagtgatggcattcacatcaccagtaatgggacaaatcaatgtcacctgcctcttgacatgatgtgcaacgaactgagaaggaccagcatctctcctgggtattcctgcaaaaaaatgtaaaacttgaatctaatcatgataaaatattaaacaaacctaaactgaagaaaagtctgaaatgctggcttttattcttcaaaaatgtaaagtttgtaagggacaaaacaagcccaaggaactgctacatattaaaggagcctaaagagacatgtgaactaaatggaaaatgcatgagcttgaagtggatcctggaccaggaaggtgaaagagccatcattaggacaacgtgagaaattcaaataaggtctgtagattatagcattgtattcatgttaacttctggattttgatcattatattatggatatgtaagaggatattcttgctttctgggaaatacacactgaagtatttgttaataaacatcatgctggccgtgtgcagtggctcatgcctgtaatcccagcactttgggaggccgaggcggggggatcacaaggtcgggagtttgaaaccagcctggccaaaatgatgaaaccccatctctactaaaaatacaaaaaaaaaaattagctgggcatggtggcacacgtgtgtaatcccagctactcaggaggctgaggcaggagaatcgcttgaacccaggagctgagattgcaccactgcactccagcctgggtgacagggcgagactccatctcaaaaaataaatacattaattaattaattaaaataaaataaaataaaataaacatcatgcctgcaacttactctctgtagatgtgtaacacatgtgttatacatacatatacagaaaggggcagatcaggcagggtagggcagggcaaagcaacgtggtgaagtgttcatgtttagggaatctgaatgaaaggtgtaagggaattctttgactcttcttattatagcttttaagtatgaaattcttatgtcttaaaattagattgacataaaaagattttaaaaaggctctcgataatggaacagattaaaacgttacatattatcatctgacagcagttaacataaaaaaaaaccagagccacatggatcaatagggatatcaatagggatcaaaaggcaagttagataatgtcacggacagcatggtaccatttacgtaatttaagacacatacaggaaacatcactacacgttatttatataaacatacaaatgtaataaaagccatacaaacctggcctggatacctatttagtttcatcatactgatgatctctgcggtggagaaaaaggaactgagaatgggagtaaaaagcaaaagccagggaggggagttcaaatccctttggagccagggctatccgacgcaggcacaatctggacagtcacacagggccttgagattggtttaattcactgcctgatgccttgaaattcttaacaattttttaattattaaattaattaatcccacattttcactttgcactgggccccatgaattatgtagccagtcctatttcttttacttctttcataaaaaaataactgaaatgaatttgctatttctgggtagtacacacccaggtgtttactgtattagtctatgtactttttgggatttaaatatctttttcaaatttttaattatggaattgaattgagaagaaccagcttctctcctggggattcctgcaaaaaatataaaacttgaatctgatcatgataaaatattaaacagacttaaactgaagaagagtctgaaatgctggcttttattcttcaaaaatgtaaagtttctgaaagacaaagcaaaccccgggaactgctacttatcaaaggaacctaaagagacaatctgaactagatggatcttttctcaagttcaccttaaggtgttactgtagcctgtggccataaaactgggaaaaaccccataacaaatcaaaattcagcgtttcaaagtggggtggccctacaggagagctcagttaaaagaaaagctctctgcctgggacactcttcccttctgcgagaccttagcattacttcttcagacattttcttaaactccccatctgtaatccctcccgtcctgcctggactatcacctcatccctcaccctgttttggtttttgcacagcatttactactgtctaaaagtctatcacttatttacaaagttacgcattttttattctccctcatcagaatttgagccctgggaggtcaggggatctacatgcctcgcctcctgccatgtccgcaacacctaaaacaggacttggcacacaagacatctaatatacggtgaagaattgaacttaggatgagaggcagagacagagaaagactggcaaagatggagagaggcctaaaagtatccatccttttggagaaagctcagagcaagatcttccaacaggttctccaatggcctgcagtatgcaagcacagtacaaccacagtcaagaaccagcaggccagtggcacactggttcttgaaaatcaccatctccagtcacgtcctgagaacgcatatcatggtaacactccctaggcagaattaggagccacttcttcagatgcagcggcctccctaggtcatcaattctggttgtctcaaacttcacaacaggggaaggctgtgaccgaatctcatcctcatgaggccacaaggcaaagacacctgcaaagatgaggggcctgatgcttaagggcggggattccttggcatctccttggtgagctaggattgccagagatctctcagaatatttgcactttctgtgcatctctgctcttgttcatactgttccaccccaacttccaacaacagactcaaacttccctcatacacttgctatgatgactgagcccactgtacaggcagggtcctggcaaatggggcaagctgggtcctggcagataagggtttaataaagggactatttgcctaccccattgcagggatatggtacgactctgtctgaggttagaaacagaagggtagtgaccaccctttggcctgaagggccagagccctgaggctactaacagggtgtcggggaagaggagaagacctcactcttctgcctccctctggtctcttgatactcctcattggctgaacccacccagaagccagagggcaggagatcctgatgtggttcctacagtggacttccctggcactaagggagatcggggagtggatccaggagccaccgatagaagagactctgcatactcacactaacacttataacagggaatgtggattctacccctttttgtgtgagttctgcccttgcttcctgtgtgctcgccttgtctccctctaagagtttagattctaggctcgtcaaggaaggtgaacaacccctaaagagcttaacatataatcatacatcatatcatagaatgacaataatttagtgatgatgtaatagattactgaacaggctgccagatttttctatattaaaaaggaccccaaagtatgagaatttatgatattctgataatagtgatagcagtgggtatctatctcattaacagtagccagaattctacacaactaatttacatttctacacaggatacagcattacctagtaagaaaagtaaatgatggagaatagtttgctattcaacaaggaaactgcattatctgccctgcgaacagtgcgcaaaaaaattctgttgggtatttattatatggccgttatataaaaatattacagaaataaaaatcctaggaagagaaaaaaaatcttcacaaattcttataggcctgaatggtaatatgctagtgcacaatcaattctgatagaaaataaggtaaaagaaaaaaccttgcttttttcttttagtgtagttttctaagtggaataaataattcactattccttcaaccaagaaactctctcgcttattatttaaaaatatttactggttgcagttacaaaatatggtgcatttttccccctggcttgccctttgtattgatgtatatcttctgattataagaatggtaactcagaagtcataaagaaaagttttttgaaacaccatcttgctttagagacaataaggaaagggtaatcaatccaagtttgaaacattctgggtatatcttgggccatttagaataatttgaaataccttaaactagactaattcacatcaccttctatgttcttaaaaactctcctaaaaaacatgttcattaccctattcctagttctgcagcactccagaaggcagagtaacagatcaagtcaccacttaccaggttcaggtcctgccttccataaggagaatgtctgttctcccgacagtgtttgtaatactaattgctctaacctttaattcattaacaactttgcattcctttattcattcattctgacaacaaatatttatgaggtgagacagacctaacgcaaataggtattcaatgactgttacagtcagtgctaacctaaaggctacctcacaaaagtggtaattaagtgaagtatgaatagtgagtactagtaattacttgaaaccaaaacccagtagaagcagcctctccaaatgcaaacctttcataggttttaatctcattttcaaaggttgttatacaaatgaatagcaccaacaaaattcagtagaaaaacttttgcatgaagaccaaacttgggtatctttgagtctttgtcattcaaaaccatttttgcacaaaaccactatattcccccatctccccacagaaaagttgattttcatcaggggaatgaaatgcctggctatcctcctttaaaaagcaggagttaataccaattctaatcattatttttactgctttatggtacatcttaggttactgtctcatttttatgaatatagacaataatcattaattccccccggtagtagtacagaatcatctccctccactgcaacgttttccctcataaaagacatggatgaaaaacatttggggcacctaattcttcttttatggatgatccatgagcataaaactattaatgtttatctcttaagtgtaattaccatatttcccacatcaatgcccacggttgaacacatcaattaaaactagatatataattttcacatttcagatgaatttaattatgtgaaatctgttttatgccctcttgtctatatatttctggaggtgttagtttgccagttctagaatgggttgtcgaatacgggatggctccttctatgaactaacccaatcctccaggcagctgccattaagagcagagaagccatgactgttcagattattttatgttgaataggtgaattctgttcatttttagaaaactgatattaagttcaacttacctacaatattttttattaaaaagtcttcattatttaaaaagtatttcatactaaataatctcttttgtccccttcctaaccaactggtagttcctttaagacaaaagttaaaagcaatacagttccccaaattaaaccaaaagtatgcacaagaaaaataatacaaataacaggaaataaatgaaacaactgaaaaataaaaaaaaaattaacaaagccagaagtcagttctctaaaaagcctaataaaattgatgaccatttggcaacactgatgaagatttttaaaaagagagaaaaccaaagttaccaatatcaagaataaaacagtgaatatgactacagattatacaaaaatttaaagtatgagggaatgttgtgaacagcattatgccagtatattcaacaacttagatgaaatagagaaattccttgaaaaatacaacttaccaaaaggacacagaaagatatagaaaatctaaataactctatatctgtttaagaaattgaatttgaaattaaagaacttcccaaaagaaaactctaggactaaatgtctccactggtaagtttttccaaaaaatgaataaagaaaataataccaatcccacacagtgtcttagaaaatgaaggagagaacacttcccaactcatcctgtaaagttattataatcctagtaccaaaaccaaagacattataagaaaattaccaaccaaaatccctcatgagcacagatgcaaaaatctttaacaaaacattatcatctagaaacatataaaaaaaaatatgccgcaatcaactagagtttatttcaggaattaaaggtttgaaatcagcgtagtccaatatattaacacattaagtaggaaaactcatgatcatttcagtagactcagggaaagcactgacacatctatttatgtatttaacataacccagttgtgttactacacccatttatcctaaaaactttcagcaaacaaggaatagcattttcttagcctttaatgcacatctagaaaaaatgtatagctaagggcatttgacagtgaaattttaaatgtttttcccttaggttgggaagacaaaaaagtccactctcactatctttattcaacattgtattggaggtccctgcctgtacaatcagataagcaagagaaaaaaaggtgtacagattggaaaggaagaagtgaaactctattattcatcatgtgtatgtaaaaaatctgaaaaaatctacaagaaaactactagatctgacaaatgaatttagcgatgtttcagaatacaaaatctattagcaataaaaattgttaaaaatgctttttacaagagtatgaaaaacatcaaatacatacttggggataaatttaacaaaaaacaagccagctttttatactaaaaactctaaaacattactgagtgaatacataaatggagggatataccatgcatgcatgaattggaagactcaacagtgctcagatgtcaattcttcccaaattgatctaaagattcaataccatccaagtcaaaatctcagcaaagttttctcaaaagaaaacacataaaaatacaacttgaaacagtcacagacctaaacatcaaagctaaaaattgttatcagaaacaatgagaatgccaactctgtaacattcattctttctataactcacaattgcagtctcatcatgaaaagaatttcagataaacacatattgatggttattctacaaaattcttagagtagtcttcaaaagtgtcaaggctataaaagacaagggaagactgaggaactacaacagattggaggaaactgaggagttatcacaaccaaatgcaatgtagtatcccagattggatcctggaatgaaacaggacattatggggaaaattgttgaaatccaaacaaagtctgtagtttacttaatctactgtaatgttcatttcttggttttaataactgtaccatggtcatgtaaaatgttaacatcaagcgtagctgaaggaagtgtacgtaggcactcaatgtactatctttgcaacttcctataattttgaaattatttcaaaataaaaagctttaaaaagagttattagaatgaaagagacacttcttgtaacacagaaaggaataaatgtgaaagaaaaattggacttcatcacaattaaaaatatctgttcatcaaagagtaccatcaaaagaataaacaagtaagccacgaaatgagagaaaatatttgcaatacatatatctgacaaatgacttggatccagaatataaaaaccactctggtactcaataataaaaattagcaacaacactataaaagataggcaaaagatttgaagaaacccttcacaaatgaagatagcacatggccaataagcacatgaaaaagtattcaacatctttcctatgtaggaaatacaaattaaagccacaatgagataccaacactcgctcactagaatgaataaatgaaaaagactaacaacaccaactgttgatgaggatatggagtaacgatatggagtaactggaactctaaaaaaccgctgactaagtatgtaagatggcataatccctttggaaaactctttgggagtttctttaaaagttaaacacaaatctactccataacccagcactttcactcctaggggtttatacaaaagaaatcaaaccatgtatctacagaaattcctatattacaatatccacattcattttattcataataaccccaaactagaaatagcctggatttccatcaagggatcagccaactgcgctttatttatatagaagattactattcagcaatgaaaaaaagaattaatgatgcagacaatgatactgatgaatctccaaaatattagtactgtgctggataaaaagaagccagaaacttaaggcacatactgtatgaccccattcctacaaaattatagttaagtaaaggacaacctatggtgacagtaaccacagcaaagcctgcttctgggggccaggacagtgactggaaagtggcatgggggagcttttaggggtgatggatatgttctgtgtcttgatatgcattcatcacaactgagtgaaaggtaaatttagtaactgaacacttcactgcatgcaaattatacctcaaagaaagtaataccgttttcaagaactaaaagaaccattataagatcttctcaagtaaacatttgagaagtgttttttccttcatgcctagattcttttctacctctggggctaaaataaacctcacggttccaggcctccagccactcctctgccaacagtagtctacatctattttctacccagccttttggagctctcagccagggaaggctgctgtgtgtccctaaaatgcttctcgaacgtagtatactacattcatgcttatgccattcgttcctagtgcagcacccggagtagcaaccttataaatgtttctgattttacaaactttaaaaaagaatagtaatttctgccctataccacctttggaagaactgaaaactaccatgccaaattcattatgttttaagctaactcttcctcaccccacaggaagcacagcagtactgagctccatctccattctagataagatacaccgaggaaatctgaagacaaggcagaattggggttctctttaacctggatctattcagaccatactgctcaaagttcaatggctccttagagagctacaagattttgttcacacagtgttgataaggtctgaatcacatttgtgatgcttaccacagtacagattgttaatttctacatattagcttttgatgttgaaaagcataccaagtagctcgaaagaaaaaggctctggactaaagaatcagcaagtattttatttcgttcacattctacccaagtactctcaagagccacaattgcaagctctataaacttaagagtaaacttatatttatgcaaaaggaccaacgaaagatgatcaggatcctctgacgtctagctggatgtagagtgaggtccaatgaattcactcaaaagaaatatagcacaaagcaacaatggttgttcaaaatggcaaatgaacatattgttcgttcttttccaataaaaattcaatttttctttaagaaaaaaattcccaaaatataaaatttctgcatccttggtttcttacatttaaagaggcaaaaaaagaaaagagaacatgttatggcctaccgcaatatgtgtgctccaaacatattaaatgtttgctgcctctagagagtcacggtgtataattcacttttaattttataattattacaattaaaattaaacaaaggtaaagaaaaaaatcaatacctacctataaaagataggaaaatctcactttaaggaatatctctgctttctgagtatagaatggacaagagagaatctgagcagatgacttaatgcagtctactgggagtgaaccttcctatgaatcggcctgctagatatgaccctcaaagaggcatcagacatttctccaacttaagctattcccatgtttattgtaacattcctcccctgagctcacctgccctgtcctttccaagtctcactgaacaaacttcggtgttccacactggactgggggattcggaaaatttcccaaaagatatgatccctgttgtggggggttaaattattttggaaaacaaataaaaaacatacacacaaagacaacaatgtatatcctctcccttcatccaacacaaatcttaaatatccttcaaggttccacttgtccatcagctcctttgagctgttttcctagagttcccaaagaaatgaaccctgctacccatattacgattagcatctttattatagctcctacttacaattcatgtctgaaatatatgtagtaggctctaagttcctctctagtcctctcagaattctttccatggtgcttagcatagcaccttgtatgcagttagtggtcaccaaataatagttgtattctcaatcttttcatttaagtctggagtagggaagagggctgtcatgaggaggagggttaaggagtggaaatcctgcttctaattaccagcaccattctccagtctgtcacattacttataaactcaaacttcattttacctttgcttactgcaatgaattcaacatcgatctggaaaaaccgacatcatgaggtcaatctatcacgtgctatgctgcagatttaggaattattaaaatgacatatagaacccaaaatgctacttaatcaacttaattttcctgtgtccatacacaccaaaaatgatttattaattttttttttttttttgaggcagggtctcactctgtcacccaggctggagtgacatggcttgatcatggctcactgcagccttgaccttccgggctcaagcagtccttccacctcagccacctgaatagctaggaccacaggtgcgcgacatcatgttcagctaattttttacatttttttgtagagacagggtcttactatgttgcctaggatggtctcgaactcctgggctcaagcaatcctcctgcctcagactcccaaagtgctgggattacaggtgtgagctaccacaccagccccaaaggagaatttttattttagaactacagcatgaagtataaatgactacggttttattttattattattgtacattttttttccttttgctcacactgatttattaaaatttatgtcaggcttgacatggatgatcaatccttattttttcaagcttactaaggatattttcctacaaaataagtatataaatatgtttatatgcaagcccttctaaggaatgattctcatcatcacagatcatgatctaggaatttctgtcaattactcttgagctctttgaggtcaaggactacatattaaagtctttgtactttcagcacatggcacagtgcctggcacatagtcggcactcagtgaaagtttgtgaaatgagtgctctgccatgagtcttaggcagatgaaagaacaactcaaaagtgaagacagacagtatgctgaactctcagccttctgccaccacggaaatatgtctttacatgcttccacagggttcaagtcctggccctcactgaggctgtctgggcagagcatgctgttcagaagtcatgtgcaggtagagtgcagggatgctgcatacaagaacatgattaaagacccagtccctgacatgggctcagcacagaggagacattcagtgaatgttcaatgaaactgcttatgttgttctaaagccaacaagttgaacttccattcccagggagttgctgtactatcagggaatcaaccaaggtctcacaactatggatcaggaaccaataatgttgggatataagctgatgtcccttgcaactgtgtagtctttgcaggcattttgattaatatctgaaaaagctgctcacagttaaatgcaatcatcatttagcaaacatgtattgagccccaattcaactattcaaggaattgaggatacaaaaataaataatttgcagtcatcagtactcatgcaactctcaggcatggggttacagctgtagcataaaccaatgagtacgataccagaatctaaatatatatgcctggaaaggaaagcgagagagctagtgagactgcaagtgcaaagtgcacatacaggggtgcaacagcacaaaagaaatttaagcagtgccattgctcccacctgcccttctccccagtaagcatgcacacccgagtacactggagtggaagcccggggcctgttacctcctacagtcaggcactggttctttacgcttctcatttctctgcactgagctggatgctactgtttaaagatacaaatttttcatataacaaagcctccaaactcaaaccacctacttcaggcattattaatttctacatacacattacacatacatacatataggaccgggtaaattagaatacggattagctgttttttgtgagagatttagggagcctcagggacaatttcaattgtgatttctgcttcatactctgagtatgagtctaatggttctgtggaacaagcaaagtgcttcagaagcataggagctggtgcaaggggcaagcctgccctgcctgggggttacagaggattaagtatggtctgtactgtcacgattcaacaacctcttaaaaaatacaatatatgcttaacaaggcttctgttgacctctttctggaagcctgatttctttcctccacttatgttaacagattaaaaatttaaaaaaaaaacataatttttttaagtaaacacaatcaggattttgcccccaaatgtaaatctccaaaaaatctgaagtgcggcatcacagccaagtgatgccaatcctggtctacttctactgcccctccaactgagaccagcaatctcacacaggctcagggcataagctatgtgtagggtggtcctagaattgttgagagcctggactcctacctccttaaaggaaaggatgtgaaaactgcactatggatatccccactctcatcatgcccctacttgcacaagccaaagcttgcttcaagtcaaaagcttaggagatgagcaattaaacaattttccaaaggtttctaagtgagtcagaaacaatccagccacagggcctctccagggcactctgaaaagtactaagtgtcatgcacacatgtgtccattgcagcactattcataatagcaaagacatggaatcaacctaaatgcccatcaatgatagacttgataaagaaaatgtggcacatatacaccatgggatactatgcagctacaaaaaagaatgagatcgtgccctgtgcaggaacatgaacggagctggaggccattatcctaggcaaatgaactcaggaacagaagaccaactaccacatgttctaacttataagtgggagctaaatgatgagaacacatggacacatagaaggaaacaacacacactggggcctttcagagggtagagggcagaagaagggaggggatcagaaaaaaataactaatgattactaggcttaacaccagggtgattaaatagtctgtacaacagacccttaagatgtaattttacctatgtaacaaacttgcccatgtacccctgaacttaaaataaaagttaaaaaaaatttttttaaatactaagtgtcctaatcagagaaccatgaatgtacatactgagaggccccagagcacgtgggagactgatatggtttgggtggttttgtgtccccacccaaatctcatcttgtagctcccataattcccacatgtggtgggagggacccagtgggagatgactgaatcacagggacaggtgtttcccgtgctgttctcatgatagtgcatgggtctcatgagatctgatggttttaaaaatgggagttcccctacacaagctctctctctgcctgctgccatccacataagatgtgacttgctcctccttgccttccgccatgattgtgaggcctccctagccacgtggaactgtaagtccaattaaacctctttcgtttgtaaactgcccggtctcaggtatgtcttttatcagcagcgtgaaaacagacttatacagaggctgtttcatgcttcagagtctacatagctattgtggggcagatgtactaatatgggaagggaaattaaagtttaagactaaataacttcatgaaaatctcaacgcagcaggtaaatggcattatgtaagtttttaaaatatataaaacattaagccagggattcttccttgaatacaagttcaaggaagcttgaacttgttccttgaatacaagctctttgtcctcacagacaactacaagggaaagctgatatttccaggtcatcttcacagcacatactcacctaattacatttctataactagaacaagttgttgttctcgtaaactttgttttccagtgtcagatggagcttgaaagctgccatggatgaaagactccttcaaaagttcagtaactgtatctgtgtaaactaagttaggttcctctttttatcgtatcacttcagtaaataaggccagttgtgctcatttgtcaacaggaaacacagaaaggaaccagaaaacaagatgcagcctccggaggccggtcttggccatgtgctgggtaaggtaacaccatggctgtgtcttgagaccaccccaacctcagttcacttgaatgaagaattttataatctcaactctaagggacctgtcaaattagtccagggtgagctcagacccactctcttgaagtggcagcagcctttgatgataacaactctgaccgcacaaacactacacagcagtgtgcgactcacacatcacagaaacaccacaggagccacactttcaggtctagaaggaaatactgtagattaaagtcaacttttaaagaagtaaaaaaagaataattgacatcagtttaatacattttggacaattatttaagaaatggcatgcgtaaatgaaagtaaaaactcagcaaggtgaagttgggagtttgagaccagcctgaccaacatggagaaaccccgtctctactaaaaatacaaaattagccaagcatggtggcacatgcctgtaatcccagctactcgggaggctgaggcaggagaatcgcttgaacccaggaggcagaggttgtggtgtgccaagactgcaccattgcactccagcctgggcaacaagagcaaaactccatctcaaaagaataaataaataaaataaaataaaaaggcttagcaagggtgagaaaattcagactcattacgttacttaatcaaaattcataaaattaattttggagcaattcagctccagcaacagaaagaacctaatcatccctttcatcagtaactgcttatcttcttcattttaattttatgttgatgtgcttatttatttttatttattaatgaatctagtttcttgttaccctggacttcccatattaataatctgaataaacaaccttattcaacacatatctttttaccaaaaaatgtcctcttagacaaagcacactctgacatcacgttgccttgccttcacttgatttagactccaagttcacagtgcaataaagtacaaggcaattgagaaattttaaagcaaatgtgttttgggtacagcattttacaaccaaaagagctttaaaatggcatttctgaacaactgaagaggctagaatgccaacaaatatctgaaaatgagcatgacattaaaatacagtttgacatgttcagtgaaagagaactgggggtaaatgcgccattatacattttgaatttttagctttttttttttttaatgagtatctgacttcttcatgtgttacaaactcaggaaagcagacagtcttgggatattaaaatagataaagtgttttcaggatgagatggagactgccacagaactgtacacaagcatctctctaaacttaaagaaaacactgattctgggctaagagagtgtttactgtgtagatgaggtctacaggataaactcaatttatccaaatcctgtgccttccagccaagaaactataaaagaagactttgtagaatgaagcaaaaagtcatacttcctttcctaaggattgcaacctgttcacaagacaggcagagctgaacagctggtccccttccagggctccaagaaatgtgaattccaaggacaaggtagccctgaaatgcctgcctcatgggatcctgccctgtcagtagtaagcatcttcaaagtggctcctgcaggttggtctcctcaatcacagagttcagacagaaccctgacaccagccacgtgtaccatgcggtcagccaaatgtgtaaggaacttgttttgagaggagagaagaaaattctatagtaggcgagacaggcttctctctcctgctcctcctccctttctttttctctctctcctctttcttccctccttctctccctctttctctttctctcacacagttcctacatttctgcactgggggacaaaccaggcttctgatcaaaggcaatctgagacttgggttcaaaagctttgatgaagattggtacctgctatgcagatggggggagggaagaagagactagcctaggggcttttatatttctttaaagcatcagccattaatgggctaagtttaccactgggacccagagagctagtccccaaacacaagctcaaaatgtatgcattttccaattcatggttttcaaggacatgttccatttctatgaggctctaatgagatctgagagatgtacatatttttttaaagtcacacttacaatggctctcacagcacatccgggagcaactcagtaacttgtctaagcacttacatactgaagttccgagaaccaccagcttaaggttcagaattgaaatttacagacccagtctttgcttttttcaactctgtaatcttgtagacggttcataggtttaagacattaaataaccatggattatcatgactctagaatcagttggatttgtgacaaaaattagcaaaatgatgaaataaatgtaaggacccccttcccatctcattactttggttagtttatgccccaggtgggatgggtcaggacttaacagtcatccattcatggaacagttattgagctcaagccactccctggagatgtcaagaaaagtgagctgctttctctgcaggaaagccaaagaattaggctggtgcaaaagtaactgcagcgttgccattaaaagcaatagcaaaaacagcaatttctcttgcacaatatatggatcttttataagggagaaaaaaggtattattgatcgatatggctagaaacaggctggacctttgtgggtataaacccagaagggccctggtgttgaggtgttggaagaacactgatggattctttatttttttcattaactacttaaaacaacagttattgatagggtactgtttagagatcactacaattcctttgcagttatttgacatatataaacatactataggctgggtgcagtggctcacgcctgtaatcccagcaccttgggaggctgaggcgtgtggatcacctgaggttgggagtttgagaccagcctggccaacatgatagaacccagtctctactgaaaatacaaaaattagccaggcatggtggcgggttcctgtaatcccagctactaaagaggctgaggcacaagaatcacttgaactcgggaggcagaggttgcagtgagccgaaatggtgccattgcactccagtctgggtgacagagtaagactctgtctcaacaaaaccccaaaacccaacatactacaagtgaaagtaatctgcattgtaaggtttgttatgtgccctagtctgcccacaggaaccctgaaaaacaaaatgttaaatggcacagactttttaactgcaaatactaggtgcatttaccttccttaatacagcactgtgatcacatatatgatggtatagatcaagcttgtccaacctgcagcccatggacgcatgcaggccaggatggctttgaatacggcccaatacaaatttataaactttcttaaaacattatgagattttttttgcgatttttttttagctcatcagctattgttagtgttagtttattttatgtgtggcccaagacaattcttcttcttccaatgtggcccagggaagccaaaaaactggacactcctggtatagatggtgtggctcattctgctcatccttctttgagaaagcgcatttcagaagctatttctcctcattccagattttatgctgattaaagaaaacaagatttgcacacagagcatcctctagttatttgggtaacagacacagccatgagaatgttccgctccacaggggccatcagtgcaaatggccttccccacactacatcgaccacttccccacagcaagcttggccaggatccagccaaccagtgctgacgtccttcgctcagggaggtgttgggccttgcacactatggccccttacacactccattgcaattttgttcatctctgtccagctaaactgtagaaacccggagtgtagggactgcgtcttgaattcatctgtgtctggcatgtgcaaaatgctccacaacatcagttttacactcttaggataagaaaattcattttcaagagttttaatgactacagagaggtggcaaggtaaacagtttccacgtgaccccatagacttctccattaatcatagtttccaattaacttttttgttgtgctacatagatcttcttgttctattccagatcataatgtacagtttcaataatatgtttttttaattgatgttaaatatgctcctagaagctgcactgcaacaaagtaatttcagagaaaggcaaactggattcagttttcagataataaatatatatgtgcataattaaaagagattgatgtttccagaaaggagcacaatggaatgaagaaggtggtgcagaaaggctgagccctgtgctattagtgatgagtttcaccggaggtctttttttttaaataaaaacttaatttctctgtctttgaattctatgagatctctttcagacaaacacaacattctgaaaatcaaagacttggggattacttgggaaaagttcctttgagaactcatcaagaaagcaaggggcttaaacttgagacatagtatttagcttaagaattggaaagactctttttttttaagttctgggacacacgtgcagaacatgcaggtttgttacataggtatacgtgtgctttggtggtttgctgcacccaccaacccatcttccaggttttaagccctgcatgcattaggtatttctcctaatgctatccctcaccttgccccccaccccccgacaggccctgacagacagggtgtgatgttccccttcctgtgtccatgtgttctcattgttcagctcccacttatgagtgagaacatgcagtgtttggttttctgttcttgtgatagtttgctgagaatgatggtttccagcttcatccatgtccctgcaaaggacatgaactcatccttttttatggctgcatagtattccatggtgtatatgtgccacattttctttatccagtctatcattgatgggcattaggattggttccaagtctttgctattgtgaatagtgctgcaataaacatacatgtacatgtgtgaaaggctctttcaaatacgagacttgacatctggtagaacaaataattaatggtgtccggaggtagttaaaaagggagggatggaagacaagcttcaactccagtgccaaccccaactgagcaccacgaccatccctgggtccccgtagctatcactgcataatatccaccatgcattacaggctttggaggtagcaccagcatctctagggcagccagtcatttctctagaatggtgtagaacaacagcaccaggaactgaaaggaacctgcagtacaacacagcaggtgaggaatagaaagccttgcccgaatctcaccaccagaggtgcccttggactgggactcaggtcacttctttctgccatgtgcctggtgggagtaggatctagacaggggtatccagatgaagtgtcaggtctcctttagtcctgtggtttgacatgtttagttcaatggtttcacactgaacactgacccgacaaatgggcattttcatgtgtggaaggtgaatgaacatgttctgtgagctttcataaagttctgcttaaaaagtttccaagcagatcctccctgtggccccgcatgtatagagctataaagggaattccctaaaacaacagacaaacctccagggcctccacggtgctgcacacatgttcttaagcatctcacaagcagccaatgacatgtaaagcaaatcacctctcaagaaccacagaagcagggtaaggaaagggaatatcccacaaaacctctaactacaggagcagagtaaggaaagggaatatcccacaaaacctctaactacaatgagaaaagcacccagtggggaagaaccctgccccctcagaagccactgggaaggggcacttccacccttgctcagcccctcactcacaaccccctgggcaggaggaccgtcttctattagtgcctctgtcggggagaagaatgggtgcacacggctcagctaggtccttctggatcttcccaaggagaaagtgaatctgtgctgctctcctgccatgcagaaaacttagctagcagggtctgccctcaggagaagctgtggctgctaagcatcacctgagaccaatgtgactgggatgtttaattccagggagaagaaacacagactgaaggtcaccttctctgaacctacatttgactgtcatgtataccttatttctcaaaaagttttgaattcaggagagaaagaaaagatgtgtgtttatgagcctcttaaaatcccagcacattcatgtctgaacatgggaggtcatctaatgtttcgcattagcacagggatggcaaatgtctactgccttctcttgcacatgtggcattctccagagccatgaagacccatcagaatccctgtcaacatggtattcatggcggggcagctacttggtggccaccactgcaacatgaaatatcacctatttgttatggctgacctttgcctatgggacactggccatgtcactttcggaagaaccccttcttactgtgcttagccaaacaatttacctatagtcattattctcattcagccattctacaaatatttcataagcactttataactcttttaagggagaggggagcaggtattttctttaaggatcttctctgaaataaggaagtactaagaacaaagtaccatgaaccttactgagaagacacattctcactacagtagcatgtacaatttaggaagaaggggactgaaacattccaaagtgtgcagagatggtgggccatcccaatgatggactgtgacaatcttacattccatatgatgactgacaacttcctgagaccttggctccaccatcagtgtttctaggaccccataaatagaccatatcaaagagctattatctacctgaatactctagtgccacttttctattttggcagggtctgccctcaagagaagctgtggttgttgagcatcacctgggcatcccctcacaatttgaatacacttcagttttttccattccacttaaaggagctaggagagtaagacatcagagtccccagcgacatggaggaaggaactgagaccgtctacgtgaaacaatacaacttcaaataaaaggtcttcccagtaagtaacccggttactcgtcctcagttaagggagtttcatgatgaatcactgaataaaagcaggaggaggtaggaagtaagaatataaattcaaacataaatctttaaaaaaatctccattatttgtattctaaaatcagaagaggaagatcacccatactaactggctaatctaaccctcaggaactacagcctttggggaaacagatttgggtatttacgagctgggtatgaattagaggatctcagttggctggtacggaaagattagcaatcactagccacacagtctcagctaatcccccatctgaggcacaggagctgttacagcctggtggggctatgtgggcaggaatccccaggaaatctgaaggatcacttcctgacagcttcgtgtgctgagtatcagcacctggcctgctttgatgatgggttttaccctaatcagaccacccagaaatgaaagggacaagggagccagctgagtttcagggagatgtccaagaagcaaccaggaggattagagaggaaaggcgttcttgttatctgtcaaatccccatacgtgctgacaaggacgggaggaaatgccgtttgaggctgtgtacttacacagtttacaggctgtaacttcatcttctaacctgtaggataaattacccaaaactaaagggacaaaatccaacttcaaactcagaagaccccaggaaggaaaaggcaggagggtgcattcattttgtctgcagactcgggctcatggggagaaatgactggacttccgaagtgcaaacacgcttgctaaaaaggcaaacacacttgagagttctaacgaccttcatcaggaaagggttcttccttcagtaagtattgtcatgcatttttcccccctcagctgagacaccagcccaaggtggatttaactgtggcacttttcataagcagtgtcaactcaggacacctcagtaagcacagctctcagcctctcaggtctaatcccaagacagctatggttttttcatgggtccaaaagcccagaatataacattctgaaatgatgatttatgttcaggaaaagagaagcagggtaggacctatttcttgatggacaggaacaggtccatctgaaaatgctgggactggaagcattttggattttggatttttttttgaatatttgcattatagaataccggttgagcatcccaaatccataaatttgaagtccaaaatgttccaatgagaagttcctttgagcgccacgtcagtgctcagaaagttgaattttggagcattctggattttggattttcagatttgggatgctcaacctggataagagccagtgatgtcctggtctgaaaggctgagagagaagggaaaaggtcactcacaaagacatttaggaggatatggaggagctatacatataaaggccatagaatttaaatgaattgaaggatttttttttcttttttaagacggagtctcgctctgttgcccaggctggagtggagtgagcgatgtcagctcactgcaacctacgcctcccaggttcaagcgattctcccgcctcagcctcctgagtagctgggactacaggcgcctgctaccacgcccagctaatttttgtatttttagtagagacggggttttaccatattgaccagggtggtctcgaactcctgaccttgtgatccgcccgcctcggcctcccaaagtgctgggattacaggcataagccaccgcgcccggccctgcatttgatttttaacagagaagatgtaaaaacagtaatagaataacagactttgcttaaggatggtatgtctagtgacaactggtcaaacatgagagtgttaagagagggtggttataattgggaagaatgtcctggaacattcagaatgcacaatccctggatttaaggaaaaggttataaaaaccaagtaaccagtcgttgatgtatttccagagtcacctattctttaatgttgccttgattcttttaatactggtaaattttcataggcatctcacaatcacaaagagatgaatgtggatcctggctccatcattcagagctccatgaccttgctcaggttagtggcttctcagagcctcagctttccatcagttaaaatacctactctttagatacttttcaagattagggtgcttaacccggtcctaacacacagtaactgctcaaaaaacagtaactaccattaactcagtgaacaattactgagcacctaccaatgaagaataacatcagccatgtcttcaaggaaaatttataggcaagacggacatgcgcacaaccaagttagactagctatggaaactgtgggcatgttatttgacccgtctgactgcaaacctatcatccatagaatgcatatagtaagagtgtgtacctgacatggttgtggtaaggatccactgagttaatacatgtcaggtgctcaaaatagtacatgacacacagtcgatgatgatgatgatgatgatgatgatatgatgtaatggttagctttatatgtcaacctagctaggtcacagtacccagacatttggtaaatactagtctagtcatttctgtgaaggcattttttagatgagattgacatcaaaatcagtaggctttgagtaaagcagattactctgtgtaatgtgggtgggcctcatccaattagttggaggctttaagagaaaaagactgaggccctcagggaagagggaattctgccatcagacagcctttggataagactgcaacatcaactcttccctgggtgtctagcctgctggccatccctgcagatttgtgacttgccagtccccacaattatgtgaaccaattctttaatatgagtcttagtgtctttctctggctctccatgtatataatatacacttgtcagagacagagagattctatggcctttatacatgcagcccctctgtatacacctatagaattacctttttcctctctcagcctttccaaccaggtcattactcgctcttatatggcttgagcattccaaatccgaaaatctgaaatgctccaaaatttgaaagtttttgagtaccaacatgacactcaaaggaagcactgttgctctctctctcttggtctgacatatcctattaatctaatacaaatgttattttgttattttattattttatggctaagaaagaaaggaagtgtgagaaatcaatatcacaaacaagatttctgcttgatcaactttttctgcgtggccctggaaggactatcctgtttcatctttgttccataaatccactggcagaatgccaagagaagttacttaatgcatacctggtcatttgctttttattagaaaataaatacaaatgtttaattaagataaacttgggtaacatttaaccttcctgatgacaccatggggcaaaggttttcacacttaactcagttaatcacataaacataactaagttctctgatgcaggagagaaaagggccctggtgagtctccctctttactctcttaaagaacacctaagctcctctcctacagaagagctcatttcagtttagattgacactgtatttaaggaacatttaaatatttgcaacaaattgaaatgaatcacccaagatgaaaaatccaacttccatactgcagctttagaaaggctatgatatactgaaatagaaactactagttgtcttactctgaactccatacaggaatgtatatggcgatttccaaaacgaagcttcctgaagcatctgatattctgactacttctgctggattagtggaacactttaaatgtaaaaaacgcaatctgtatttctctcattatctgtttatagcactaataagaaccactctgctctactgtcagttttccgctgggatagttttaaagttttaagagtacctaaaagctttatatttaagtcttgctctcaatgatgggtgtattgttctggtggggcctatatagctttagatgatagttagatgtgttatgctatagtcatttaaaagttaattttggggaaacaaaatttctcaataaatactaagatcttagacttttcagtaacttccactgccaaatgcgtatgtctaatgtggcaaatgccccatgctataatccgaagtcaggacacctgatgctccagggtttccagacatgtgtgtgtgagtgtgcacagggtctatgtatgctggtacacttaatctgctagatgggctttcttctgggattataaagtacttcacacaaattaagccatgagaataagacttctctgaaatggatagaatattccagttctccattttatcctcacagtgtcagaggcatttgaatcagagcaactccatcttgaataggagctgggtaaaatgaggctgaaacctactgggctgcattcccagattgttaggcattctaagtcacaggaagagacaggaggtcagcacaagatacaggtcacgaagaccttgctgctaaaacaggctgcagtaaagaagcagccaaatctcaccaaaaccaagatggtgacgagagtgacctctggtcgtcctcactgctgcactcccaccagcaccatgacagtttacaaatgccatggcaatgtcaggaagttaccctatatggtctaataaggggaggcatgaataatccacccttgtttagcatatcatcaagaaataaccaaaaaaatgggcaaccagcagccctcagggctgctctgtctatggagtagccattcttttatccctttactttcttaataaacttgctttagccttgcacttgtggactcaccctgaattctttcttgcatgagatccgagaaccctctcctggcatctggattgggacccctttcctgttaacaacagtgtcgaaaaccaaaaccagaactagaaccaggaggcaattccagctcgtgattttttttctgtttgtcatacccccacctgtctttgtttcgtggccacccgctcccggctcccacctgtctggtgcagcactctgggaccactggagaggaaatcagaaaaggctgacggaggctaaagacactgtggtagagcaggagcattcccaggcagcacaggctgtgcttctgaagccctgagcagggaacgtgagctcttgctgagagcacaccaggaaaaactaacccctgccaagaaggtgggtctgaccaagggcccgtctccaggccacagacggtgaccacaggggagtttctctggcaaacagtcagagagaaaaaaagaaaacaacgatctcagcaccactctgacctcataggacagcagggattctttagaggattgggcagctctcactgctactaaaggcttcacctgaaagaaaaattgaacagcctcgtgggcagtttaatgatgtaccacgctactgttatttactgcacttattagagcagcctagcacaccatagtaaatctactaaagttttacattaccttaagtatatatggtagcagagtctgacagctgcatatcacgatgatccattcttccattcttcatgactaacagcccctgaattttgttggataaggcaatgtaaccaacttaaaaactacatttcctaatttccactgtgactacacatgggactaaattctgttcaatgagatcaaagaagctctatctgggggcttcttacaaagcttcctaagtggggacttagctaaaacccctcttctgtccttcctccttcttcctccttcctatcaggaatagagacacgatggctggagccacagtatcttgtgacagtgaagcaattttgagaatagaagtcacacactaaggatgacatgataacgaaaatgaatgaatctggggtgctgatgacatcacggagcctctgctccacccctgcagtgcctacctctatacttcatggtatgtgaaagaaaacacaaatatcattttgttaaaaccattgattttcaggtcattcacagacaactgcaattcctaactgaatgagtgtacactgaacacacagatacaacatatatataagtgtaagcagcctgctgagatcaaccaatcaatcattgaaagattatctcccaggcagccgcagtcatccctttctctagtgaatcgttcagcacttactgagtgcctacttatcagccaagtgttgaagatacgaagatggatgagacacagctcacgccctcaagcaaatgacgatctgctggaggacacactcaggaagtagtggtaactgctgtatgaacagtaagatgcatgcagtgcatccatttaacagatgtctgttacacacctactaagtggtaggcagtctccaagggctacgttcacaagtctatattctagatggcatggggcagagcaagttagagggtggacaagaaaaataataaagaagaaaatgaaggaacaagacaacttcagaaaataaggatgatgtgctagtgagtgactgctgggagctattttagacatggtgaccagaaaaggcctcaatgtaaagggtatatttaaactaagattatgaattaagtggggggaggggcggggggggggtcgcggcacagggaatggcctgtgaagggcttggggaagaacatttttggcagaaggaagagcaagtagaaaggtcctgaggcaggaataggtcagatagaatgttagagggtggtgctcatggctcagagaggagctttgattgtggggaaatggagaagtcaaggaaagtttcccaagttgcccttgactacaaccaagtcttcctcctctctagagccaggggattcccatcagagaaggagcacagctgcctgaaccccaccctctccacccacctggcctcacagctggctcagtgacacctttatctgtgccttaatcccaatatattttccttccctgaagagcaatatggatgccgtctccctccaagtataagacttgggctgaggggaaagcagaaacccctccttttccttctgcgttagagaaaaccatttttcagcagcactaccacttcaaaagcagctgtcctgaataagacccaggctgctttcagatcaatggccatacgaaagctcactaaaacaccattcctgttcgaggtttgcccagtaccacagttcaaaaggatcaaccccattgtcatgggtcatagtccacaccagtgtagaagagcaacagcccccaggatctacagctgcagagagcaccaggcaggataaactgatgcaacctgcccccttactccaaaatcctaagctggtcccatgcgagggtccatgaacaggcatgaccatgctggacagtgtctgcagtcctaggtaccctcaaatagcttcatcacaaataccaaaaagatgatgacatccctaatcttttgatttagttactattatttacccatcaggaaatgcactaggaatgcactagtcacagaatcaactttagaagacttcaggggtgatacatctgattttcaatgaatggtggtgttattacatggacagtgattctttgatcagtaaaagaaaatgtgacactgccttctttccaaaccctacctcttttcctctgaaaactatgactttatcaagtgactgagtttttccctattttaacaaagactttctatcctttcatagattcactgcactgaataaattgtctgtttattacctgttgatctacttctagtgaattctgcttgttaaaaaagtggaatcgtaatttctcactggttttctattaagcctccactcaatgttcttggtctcctctctaacaatggagctgatgagtttagtggagtctcccggtaatttccctcttgtattgcatgtttctctcagatgaatatttcagttaaaactgagactagttgataattttttccactgaagtctgtattccaatttttttttttttgatacagggttttgcccaggctggatcacagtagcaccaccacggctcacagcctcgacctcctgggctcaagtaatcctcctacctcagtctcccaagtagctgggactataggcatgcaccaccatgcctaggtagtgatttcatatttttgtagagaaagggtctccctaaattaccaaggctggtcttgaacccctgggctcaagccatcctcccgcctccgcttcccaaagtgctgggattacaggcatgaagcactgcacccggctctactcctatttttgtctggttgttcatctggatctgaccaagtacggcctatctgcctcacccacttctgtcttccataagctctgtttaatgtcagataacatgtattgactttttgttctatctgccaaaattgggattggagttgagtatattgggttgaagttgattatattctttccatgttgtcacactgtgggtgtttttcactgtaaaattagagctatttaaatacattatctgctcacctacaaaagctctcacttcttcagaaacacagaggttggtcaatgcttcccattccactgaattcacacaccctgctgggaatccagtgatgaatggagaatggggagggtcagcctcaccttccatgcaggtcaatatgtttatttttaaagaagagtcaacctgctctactactttttgtttttttaattccttagtactcacacactatgaaccatgcacgcacatgctacgaaccatgcttggggaaggtacaagaaggataagacaaggcattgggtgacagagctgccacggggctcgcctctagccagagtgatatatagtaaagggtccacaggacctatgtccagaaagagttttctttttccagcaaaacataataaacaaaatctaaaatatatattgtcttacacttgagagaaaatatatgaaccataagaagctaattattggattttttaaaaaacagacttagagaaaatgcagtcataaggacttcacgtgagtctttgagtagaattcaaccatttaagtactccccactcattggacacctatgcacgtaggcactgttagtgctggagtaacaaaggcatgacctgcatcctgctcttggggagacctggcccttagacatgagcacatgtatagaggtaactcatgcaggatgataaggctggtggagagatgcaaaccgagcacacaggaaccggcaatcaatcaaacagcctttagctggttgtgggaagaccacgttagcaaacagatgctgaagtcttctttacacacagaattagcaaaactagtagcaaaacagatctttgaccaggtaaagccagtagcctaacgggactctgaagtaagtttttacactttccttgaagactcatggcaaatatgaacctcctatttctgctgatggggtgaagagctgaggtcaaagagcctccctgggtctcccagttctcatcacactttctcacctatgagggcagactgcccacccaggcatcccaggggctcccaccctgggagtcatcaggtttggccccttttcttcttttcatgaagacaatgaacaggaaggagttagtaacagttcctgctttctacttgctcaatttttacctcctgctatctagcaggggaaaatgagaaactctccatcggcctcaccctcactggagaaattgtatgtgatccaggttatgtaaacaactcttccttcaaacagcttcttgtggactttataacctcgtctaccagtattgttatagatggctcagctctaaactctgagatggataattgatatagaagccatactccctgaaagtaagccatgcttatggaagatgcttggggtttaaaaacaaaggctgtcaacaaaagccctcccagccactcggcacctatcagaaaacctgtgaaggatgtgacagagagatccagcacacccagcagaagtctggatgatgctctaaatatagctgttgaatgattagtatcaatgactacgtatgtgcaaagccagttaactaaattttgacaaatagaaattccttggttaactatttcaatgattttctaaacatttcataggaaatgaaattcaagaaacatgtatctttcatgcagtcctcccctgggttctaccagacacaacccttaccccaaagaggcagattataaagagaccacataggcagtaacagagtggtaaaaagatggggatgggacagggtgtggtggctcatgcctgtaatcccagcactttgggaggctgaggcaggcgggtcatttgaggtcaggagtttgaaaccagcttggccaacatggcgtaaaccccatctctactaaaaatacaaaaacataagctgggcatgggtggacgcctgtaatctcagctacttgggaggctgaggcaggagaattgcttgaacctgggaggtgggggttgcagtgagccgcaatcacaccactgcactccagcctggttgacagagtgagacgccatcttaaaaaaaaaaaaaaaaaaaaaaaaaaaaaaaaaagatggggatggaacacaaggaagctctgacttctgccggagggttcaggataccccactgtctgcagaatttccccatacccccaaactcagacatggagcttccctagcagactgacagttaccaaaatataggaaagaaaattaacttggggtaccctaatttgaaatcaataataaataggaattaggccaaagtttacgttttttactacacatataaaatggtctgttggaggaaacaacagtaccaagagttgttgtgtaggataagtcatacttaacctacttaggagactggagtatctcagacatctctgcatccgcaattatatacaaataactaacaaactaattacaaaccattaaggcagtgactatgtctttcatttgtgtgtcactcaaagggccttgccccccattctagacaaaatgatctttgttaaaatgtgtcacttatgggcttctacttggcaacatgttggtcatctcctgcaagcagatatattatttgattcggtcgttcattaggtaaatatttattcaatatttattatgtccaaagctctgtattaagtgctataactgaatataaaggcgcataacacatctaaacaaatatacgggatataaagtcagaaagtgaacatccagccgggtgcagtggctcatgcctgtaatcctagcactttgggaggctgtggtgggcagatcacttgaggtcaggagttcgagaccagtctggccaatatgataaaaccccgtctctactaaaaatacaaaaaaattagccaagtgtggtcacagacacctgtaatcccagctactccagaggctcaggcaggagaatcacttgaacctgggaggcagaggttgcagcgacccaaggtcgtgccattgcactccagcctgggagacagagtgagaccccctccaaagatagaaagacaggaaagacaggaaagacagatagacagacagaaaaagaaaaagaaagaaagaaaaagagagagagagaaagaaagaaagaaaaagagagaaagaaagagagagaaagagaaagaaagaaaagaaaagaaagaaagaaagaaagaaagatagatagatagatagatagatagatagatagatagatagatagatagatagacagacagacagacagatagatcgatccaaacacaggcacactgagtgaatacattacaggaagtggaggtggcatctgaccagggagatcagacggaggcattcaggactggcttggggaatgcacatgattctggtgtgtggagataagagggttggacaccagctcaagagagatggaaagcatggcacgggggccatgggcaacactgagacatttctttttctcagcgctggaataaatgaagggctggggttgaagggatgaatcagaagaaaacatggactcagcacagagcatcctgcagccgagatcaggcatctagatttggcagtccagagtgagtgcttaaaagcactgaatgcttttaagccaagaaggttgtgacaattgtatttaaaagcaataaaaccaagttgcttctccagtcctccataacttaggggagcctccttcaggctggctgactcctttctcccacgcgggtctgcgctgatgagaggctgctgtacaggtcaccatctagggtgggactcggagctctctggtctgtggctgaggttcactgcatgtcatgactgcctgtgtccaccttttttcccaagatggcctgactgctccccatctgcagtgctcagttcctgcaaaactcacccctttatgaagctccaagttttgaagactcctacccttaacacatcctgcaacaactgctcatagtgcctcgggttccatctccctgccccattacacgttttaatatctgcagcacagtctgagggccctggttggctttatatgcaaatagcatgaataattttctttgatgttttattctattgtgtttcatttggaacagagaaactcaaaggaggaaggatgatgaatgagaaaagagggcagcaagcgcctccatgtaaggtgctctaacttaaatcagctttttgcagattctctgctatccccaaatcatcctccttgcctaattctcaaaaagaacaaaacttctccagacagagcccgcaaggccagagcaggacaagcagtgtgtgcatcccccgctcatcccaaatcagcagtccatgtagaattaaaaccagtctcaaaacacaagaataaaacaaaaaaaaatcagactaaaaacccccaactgtcttctgtatcatgagctcacaacaagatccaatcttcccaattacagcaatatgaatactgggaaagaaatgcgtgaaaacctccaaagtatcctcaatttacctcctccaaagtaaatttcatttgggaaaaataaaggtaaatacataacagagggccttgtttaagttgacaataatatttggcatagtgtttatttcagctaggaggttatgccagggcacaaggggtaaatccatggatttgggggtcagaacacctcgagatttaaatcctagctctgccactttcaagggtgaccttaagcaagtaacttaggctttggattcctcatctgtaaaatggaaaaataatattaccaacccaatggggctgtcaagaattaagtgaaatacctgcatataaaagtacttaacacatccatttaggatattttattgcttctagcattcatatatctaaactgttttaactatttctatctccttaagtaaaatatttgtttctttttagttcacctaatgcagcagtccccaatctttttggcagtatagaccaattttgtggaagacaatttttccataaactggagagcaggggggaggatggtttggggatgattcaagtgcattacatttattatgtaccttatttctattattattacattataatatataatgaaataattatacaactcaccataatgtagaatcagtgggaacccagagcttgttttcctgcaactagatggtcccatctggggttgatgggagacagtggcagatcatcaggcattagattcccataaggagaaatctagatccctcgcatgtgcagttcacaataggattcatgcttctataagaatctaatactgctgctaatgtgagctcaggcagtaatgccagcaatggggagcttcacacagatgaagctttgctcacttgccagctactcaccttctgctgtgcggcccagttactaacaggccactgaccagtagcggtccgtggcccaggggttggggactcttgctctaaaggcagaagaaaagataaactttagggaaatatgtggattccatttggtatatgaatgttctaaatactcataactcttataaatatttcaaatatcaaataatggaataaaatgtcttttcacatcatcacacaataaccatgaaatgatatccaggtactgaaatcactctactcttctattttccctagccacaacaaaggaattctaaaacatccaatctctgacactagctatttgatttacaggaggcaggcaacaacacactactaacaaagtgactttagctaaatcttacgtacatgtgccactgcatcaactcagtttggacaaataattatataattaattgtgcagaagcattaaatgtaacataatagtaagcttaaatggattgtttctatactcttttccttagccaagtatttctggctgtgtggttgggattctggtttttgtttcattttactttaacctgtcaaaaaataagggaaaaataagttaaagaagagtaagtatgtgggtgaatatgtggtagaggttctaggagaggaagaataaaaatacatgggttgaatctgaacattctctggtgaaaggcatataaagtcactgtattctgtataccagagcctgggtcatgtttgtttcctgcatgaatgatcacaataattcattgctactactaataatgaagatcatatgactgaatgaaaatttagagggatttttcttctctttcactaaattgtcatatccatgaaatcattttatcttacaacctcaaaataaggacagatttaaccattccaaattcatagattgaaaatttatgcatccatttagcaaatatttcataaaaacctactatacataattacaatcagactcatatcaatatgtgaattttaaactgtgtattatttatgtttcttgccttactgtgacaaactcttgagaagctgaaaacgtacttcctatgacaaataaaatccaatttgtagacagaaaactgaagttgaaaaaaattaagataatgagactacatatgtctacatccaaacacacgtgcctgtgtgcacacacatacacatatgtccctttatcaaatttggtgtccacaaggggctgcataatatgaatccactgaaaatagaggtcatagttctatactcaatagtgaaataagcctttatctagtctaaagactaagaaaaatttattctatagcttaacatttttaaacattctaattgaaactataccttcacccttaagcaaagaatgaatcaagtcataattatttatcaaaataatttttctgataaaaattatgtggtttcccttgaaaatatctttctgattttgtattcataaagaggatcatttttgcaaaaataacttacggtttctgcaattcttgcaagagcttctctttttttaagattcctcctatgccatcatccactcgattttctctttaattactaacttgcctaaccctgccaaatgctcatttgccagtggctctgcctgcaatgcaagcaggtctccaacatcactttcactgacatcatgaaatcccgtatttttgtaagatttacactcatatttccaaattgtattgtacctgcagttccttgaaagatgtttacaacaatcttattagtgaaggacaagtagaatggatgggtacaagagatgacaggttaggaaagagggatgtttgagaaggaaccagttttacaaatggtcagtttattagtaaatactgtcatattacaatacctttttatttatttattttgagatggagtttcactcttgtcccccaggctggagtgcaatggcgcaatctcggctcactgcaacctccgcctcccaggttcaagccattctcctgcctcagcctcccgagtagctgggattacaggtgtgtgccaccaggcctggctaattttcatatttttagtagagacagggttttgccatgttggccaggctggcctcaaactcctgacctcaggtgatccgcctgccttggcctcccattacaataacttttgattgtctttgcaaccctggaactgactgaaatctctgagaataacagcttggaggacataaaaagaagcgctaagctgccttgcttagagagcaagaggtacaggtttggttactctccctttatttcagaaaggcctttgttttctagtatggtttggatctgtgtctccaaccaagtctcacgtcgaattataattcccaatgttggaggtggggcctgatgggaggtgactggatcatgggggcggatttgccctttgctgctgttcttgtgacagtgagtgggttattgcaagatctagttatctaaaagcatgtagcacctcctccaaaccccttcctcctgctctgaccatgtaagacatgtcagcttcccctttgccttccaccatgatggtaagtttcttgaggcctccccagaagccattatgcttcctgtacagcctgtagaactgtaagccaattaaacctcttttctttacacattacccagtctcaggcatttctttacagcaatgcgaaaatggactaatccacttttcaagctcctaaaccctcttgcagacccctctgtcccgctgcccccatcatgaaagcgccctgccttggctgacctcccatgactcgcttttcttccttccatgactgccagtcctgtgtgttattatttctaggctttattagaaagatgaatacatcaaaatagaaataacttatataaaaattatattaaaaactcatcttaacgatactatttatgatgaaaagggtgagcctgcagaagccctctcacatgtctcatgtgtcatgttttcctttacaagggtccttctgctccttaatcaaaggactgactcactcaggcagggcacctgcaccctcctggtcaggaatgtgagtgtggagggcaggcagcttgggtgcaaatcctgcctctcgaacttactatgtgaccacaggtgagttgttgaatcatcctgtgtttcagtttccttacctgtaaaatggaggtaattacagtgctgtacttactccgctgagtaagaggatttaagtgataagataatacatggaaagtgctccatggtgcctgaggtccagtaagcaccaagtgctagtctttaccgggaacatcaaacaccaactggtgctcagcaaacacgaagccccacactaaggcctgggaatacagagatcgtatacatgcctcaggcctgaaaagggttctaagattttagaattccaaaggtatcctcacattcacaagctgtgcaatttggggatgggggactgggacggacattcagtgccacctgtgtctcctggcacctctacaactctagattgggcatctctaatgtctttagactttcctccactggaaaaaaaatggagacaatacaccttaatccacaagttctttggaatgagtatggcatacaagacacatttgagaaagcgtctaggacagactcaccccaacactcacaaatgtgcatttcccttcctttgtttttaaaagaagaccataaacgtaacttgaaaatacctagaagaagatgtgccatttaaatgaaagtgatctgtgattaattttaaatccttctatgtccaaactacaagtcttagaagattgtggatcggtaatagctataacttctcaaattcctcaaaatttattttttcatcctgtactgaagtggcttaccaatgaactaagaaagttatattgtaatacccattctggggctctgttttatatagaagatgagaaaaataacagtttctaaaaataggtaagaaaattacgtgaaaatgagaggtgaagtgaggaatggcaagaactgtagaaccaaatcagtgggctggacacatgagggacggtgagggatggtgtgggaagaacccaagtgggaagctgggcttccactgccttgacctccacatcgccaggcttctctggcatgttcctttgatcaatggtccaaagagggagagactcagctctcacccatgcacctgagtgagtgactggggagacacagcaaatgctgagtaagcacagagagcctgtatctggtaggtttgattgctggacaaggccatggcctaagttgccttgtatacttattccagggactttttgtctatgtgtgaatggagtgatatggatcctttaccactactggaaacaaataagaaacctcaaagaataagtactaccaacagagggtcagtgatgtgtttttgtatacctttagcattatctaaatgcagggacataaaaatgcatggtacaaaaaaaaaacccacttaattaacaatttgccattctgataattatacatagaaggcattgtttgggtttttctatctttggtcacatcttagggctattctgatttaaaagtatagagtataaaagtcagtgtggcaatttctcagggatctagaactagaaataccatttgacccagccatcccattactgggtatatacccaaaggactacaaatcatgctgctataaagacacatgcacacatatgtttactgcggcactattcacaatagcaaagacttggaaacaacccaaatgtccaacaatgatagactggattaagaaaatgtggcacatatacaccatggaatactatgcagccataaaaaatgatgagttcatgtcctttgtaggggcatggatgaaattggaaatcatcattctcagtaaactatcgcaagaacaaaaaaccaaacaccgcatattctcactcataggtgggaactgaacaatgagaacacatggacacaggaaggggaacatcacactctggggactgttgtggggtggggggaggggggagggatagctttaggagatatacctaaagctaaatgacgagttaatgggtgcagcacaccagcatggcacatgtatacatatataactaacctgcgcattgtgcacatgtaccctaaaacttgaagtataataataataaaataaaataaagaaaaaaaaagaaaatattgctggactttggaaactacaaaaaaaataaataaataaagagtggagaataagaaagctggaaaaaaaagtatagagaggatagatttcatatatttttgcaataaatggcaacttccacataacacaaatcctgaaactttgtggaaatgttaacaaggtaattgtataacatacaaaacactgtagggaagtatagtgtttagaaatgcttcaattatcaccaaggtgatgtagttaaataaggataataaaatataattaaacattcattacagaaactatcaaaaataattgacctgtacaaagcacagcactcctattaaaaggaaactgatggataataaaatatatagagtattctgtcctctagacataattattccaaggcagcaattaaatttatagaaaactgttaagtttcttctgtgacgctttactactgtgaactcaagatgttttgagtgagaattgcctccaaaaaattcttatgattgtttaacatcttaacaagaagtactgccataaatttaaatatgtgtgttatatacaaaaaaaagatgaattttaagatgcttaggactctgctatatttgtcatatttctggtgtccacaggattgacttttgctccagttgaaaatgtctaattcttctatagccaaatctgagcacagtctaatattgaagaaaaatttaatgttaatgcaaaaataacattctgcagaaagagtgacagaatatatttttatgaataattatcaggccaaattttttatacaagtttgtttcttcatcatttaaggaagcgggacactgttccatgaaatcattccagtgtcttatgggaagcataatgtctttaaaagggtacaaaaatctctccttttggcctttttctagcatattcagagagtattgagaattctctacatagaggcagttgtaaacataaacttctttacactgctgctgggggtgagaggagaatagaatatatttttatactgacaaatgttttaaccactggaaaatgaacatgactttagtaggtaaaattatcatgtacaggcatcagaaaggaaaaataaaagcagaaaaactgagaactgtgtgtggagaacagccttcaaaaatccaattgtatttcatcttcctcctcatttagtctttttttttttttggctgcaaagatgctttaaaaatatattgttttagtccaaagatacccctggcacaagcgacaataatattacagggacattaaattaaggaaagaaccaactgatatgtgtctatgagagaagagctacagggtgaggaactgggaacaaaggaggaagacactattagcaagcactggggccctcctttattgacgtgggggaaaagtctgagtcccagaatgaatatttcctgaagcagagctgaaatggaactgtgacggacatgtaatgtaaaccctgatatcaaaagccactgaagttggaggggggggctgtttgttaccgaagcataacttaagcataagctgactgacacaaagcctaacatccagtttttacaagcaagttatggtttaaggacctgattttaaatgactaaaaatgttatccctcacctgcaaagccttgtttttacattaaaataaatttaaatgatttggcaacattccttaaatatgccagattttgacaactcaaaattataccactaaagaaattccagagacatgtgtgttcatcatccatctctattcatgacagaacatttcagcaataactgagcaagaggcaattttttatacctggagtgcagcactaggtaattctggcaaggagtttctgagagaggaacagaaaatggaataaggaagtcattgatactatatggaaattcaccactgttgctgccgtgactgaagaggcaacgtgagttctatgccataagaatcataatgtaaaataggttaagcataaaacaaaataatataagcacctacccacaaaaattaaaatttatggaagattcggcagaaacagctgagagtggtgcttaataaatcccaggccttgtgctaaagccttgggttatgaagataacatacattctgttgcctgtgaaatctgaaaggggtctgtaactgcatgaactgcaaagacaccctcacattcacaggctgtgtgtggacatacgtgtgtgtgtgtgtgtgcatgtacgtgtgtgtgtgcgtgtgtgtgtgtgcgcgcgcgcgcatttttaggtagagaccaattagataccttattcaattcaacatagacccctgaaaatctgggaggtcattcccctgttattgttaaacaatttatcactcttactggaaaggaagtaatgcttaacaccttagggttgcatgcagaaatcaattaaaatctaaagacaataatccagcatgatatttcacttaaatgaacctccacagcctgtcaaattagaaaattcatttatgtatgtgtgtgtgctgtggaagggggagaaaacagaacacagagggagtcattgtatttctttacagaatcaaaatgacacggtgcagtcacaaagacaccggccctttggtgttggcctacagagcactcacgaggcagcacagtctccaaagatggcatgaagttttaaaaggaccaactggcccatccaggttagaaagatctttcactagtgctgtctgtgacagacaataaaccactgtcaggctgcgaaggtctgtagaagacagaagtctgcacattaagtcttttttagaggggagttcactgaatgtgtggaaacaaaggcttggtcttgttctgcctatggaaccctcagcatctgaggcagaggagcagggggtctctggatggcaggccaggacttctaaagcaggcagcaggcctggcccagtcacactcagtcactggggctgaggtcagtgtgacacgctttttagatgcttgaagaattcttggtagacctcactttgccacagtaattaaaacgggatggttttcaaactcctgggcagttttacccctagaatgaggaaactggtcattgtgatgcatcctgccccaataagaacactgttttaagttttagacacacctacaagagggacacgatccaaacaagaccgaacagacagacaggcttcagaaatgttgatgggaaaccatagatgcaaagcctggaaaaattgatggaactgagtagttacctcaaaaactgggggatacaggcagggcaacagtggctcacgcctgtaattccagcactttgggaagctgaagtgggcagatcacttaaggtcgggagttcgagactagcctggccaacatgatgaaaccccatctctactaaaaatacaaaaattagctgggcatggtggcacacacctgtaatttcagctactcgagaggctgaggcaggagaatcacttgaacctaggaggtgaaggagccgagatcgtgtcactgcactccagcctgggtgacagagcaagactctgtctcgaaaaaaaaaaaaaaagggaggacacaatgcgacacaattcaataaatatttactgagcaacttccaggtggacgatcctatgctaagcaccgtgatgggaaatgtagataacgataagaaacagcttctgtccttagggagtctgcaatctaaatgggggacaggggaaggggaggttgaaaataagcaagtcacaaacacaaaacaggcctgaggaaacacacagtattatgacctatgggtggaaaagaccacgtttcactagaggacctttctgagaaacagataggattttgggagccagaggatttttgaggggagggtaaggaataagaacattatcaaggccgggtgcggtggttcatacctgtaatctcagcactttgggaggttgaggcaggaggatcatttgggcccaggagttcgagatcagcctgggcaacataggggggcccatctctataaaaaatacaaaaattagccaggcgtgggtcacagctacttgggaggctaaggtgggaggatcgattgagtccaggagtatgaggctgcagtgagctgtgattgcaccactgcactccagtctcggcgacagagcgagaccctgcctctgataaataaataaaggagaggacagcaagagtagatgctgagcaggcaaagaccaaatgctcttagggaagaaaaaggaggtagcaatttaatcagcttcctttctgtcaaaaggctaagccctaagtagtttgaatcctaataaaatattgcttttgttgttgtttgtattagagacagggtgttgagcaccaccatccatgcccagctaattttcgtattttttgtagcaagagtctgccaaaaaaaaaaaaaaaaaaaaaagaacattatcaagaataggacaaagagtcagaaaacaaaatgtatgcggctggaaaaatatcaaaaatagtctagttttggctggaaaatagggcttgacaagaaaaggaagattagcacatctaacacatatttccaaggcatatttatacttaaaaatttttatcacattaatataatgttctcatcacagttaggaaaatgaagcataaaaaaaatcttcctcacaatccctctgttacacgtaatccttttagtccagcacattgcaagcgctcacagattgccgagttgaatggaaacatgaacttacattttaaaaaatagtgtatagcatatatatatatatatatatatatatgcgattattggcatttttcctccaaaaatcagtcatgtgtttctcccctttctatctgcttgtaaacacagcccgctcttgctaaatccatgttcacaatatgttccccattttaaccccgtgttagcttcctctctacacccagcatagcctatggcttccccctgcatcaaccaatcacatctgcacccaagcaaaggaccacagatattttaacagtaacctaaagagaataaccaaggacagggatttgtatgtgtgttgcttactgttacatttccagtgtctaaaacagtaactggcacagagtgtgttgatcaataaatattttgttgttgaataaggtaaacagatttgtaaacttacacagaataagccaaaatacaattatgtattttatttgcttacctgctacttaagattattcatggtattaatagagtagcacaatcaagattttacaataaacgaaatgtgaaaatgtatcttttaaaaatccttctttgatgggcactagtgttaacatctgagtaattactcccccagaactcatctttaaatgtttaattgtgtttaaataataataatacgggttagcctctactgtgatttttagactcaatctgaactttctggtcataaataacgtcacacattcttaactgttaaaaaaaaaaagtaccgtagtcattctgatacttcatttaatattactatttacaattattttctatgtttactgagaaaatgactagcaccatatggactaactcagaggtatcctgctgagatgctatgctttatcaacaatatgctaaatgctgctctccttatgacaacccccaaacactttctcttctaacaagtgctttgcttcacattacaacctttcgttaagaagtcaagcttgctctctccgtcctctgctctttcttctttgcctccctctcctgtcctatcctttgtgcttgcttacatactagctaggacaggggtcctccaaattcagcctggggcttgctgcatttggggaagagacatttgcaggttccaaaatggcctggatgtcagcagcagtgcacatggaagaggaaggcgttccaggactcctagagcactgtgatatgctaatcaggacccagcctccacacttgccaacccccatgatgtgcggctccttctgagctgccctgatgtagctgccaaacctgtgacctactttcacacagccttgtgctcctggctccccacaggcaatgcccttccacagggtggacttgctatctgttttctcaaaactggaactcacattgagccagccagataccctttcagcctttcagtcctactgcctgtggagcttcagtcatcatgtgtcagcattttaaaagccactcattgtcacagagttcttcccatcgctcttctcccactaacatctccccaccttgcctcccactcccccagcatatggtgaagcagggccaagacaacttgggaaaggtgtcttgttttaagatgctaatctccagctttctgttccgttctaccagctagaggcctctttcatgtgaagatcatatactttgggcatcacaactgctgaaaaactgtggttattaattgctcaagtcaggctggaagatgtattgatctttcctccctcgggggccccggtgtttcttgcccatatcactcacttggcaattaatcacattttgccttgagacatctgcggtttcacttttgccattttccttagctctttgttcccaactggctggtccacttgatgcacacaggttttagagattatctgtctctgagttttccacagtcctacacagtcctacacaaactgggtctcaaaagtattttggactgacttcttgtctggaaaatttcttcctgctcctccctgctaagcacaatgataaaccctgaaaataccacaaggggcagccaaaggttccatgtgaaaggtgaaaagagtaaggtaaactagtcagagacgctgccctgccaatagaagaaggcaacccggacctggcatttcccaacccacagcctatatacagcaacagaaggcagtcccggtaagtgcattccttctgcaaattgaaagagtctcaccaacaaaaccaggaggggtggaatccgcaaggcggatagatcaatcaccccactgaaaaaacttggccagatgaagcactctcctacctctctaggcctcagattctccttcccaactcagaccaccatgcaagggggatcacccagcccaggaagggttctccttccctaccaggcctcagaaacatgaggcagctgggcacaccagaaaagggaatcccaccatgaaaagtacccagcccaggaagcactctttatccatttccttcttataggctacatactccactgctccacataatgcagtagggaacctggcctgacaaaaactccttcctcctcctcaagcagctgcaccagcagcgcaagataaaccaagcagaccaaagtagcactacaaaggctctgaatgttaagtcatccctacaactacagtccacaaaagtagcctgtgtgctaaatgttaaaatggagactcaaaataatagccagaatgtcaggagatgataaaaaatcacccatcataccaagaaccaggaaaatcacaacctgaatgggaaaatacaattagatgatgccaatgctgagatgatcagtgttaaaatgatgacacaagacttttaaagctgtcatcaaaaaaatacttcaacaatgaactataaactatcttgaaacaaataaaaccaaaatctcagctgaaagagaagttagaaaaatgaacaatattgaaactgtataattaaaaaatactataacagaaataaaaactgactagatgggctcaatagtaaagtggagatgacagaggacagaatcagtgaacctgaagacatatcaacagaatttactcaatctaaacagtagagaaaaaatacatctcatttgtcttttccgttttttttaaatattagcaacatccacactgatatttaacttcttttttaatcattagagtaccaaaagggaagaggaaagtatggatgaaagagtattcaaataataataataataataataataataataataataataatggctgaaaatttcttaaatttggtgaaagaaataaactcacagattgacgaaatccaaataggataaacaaacccaagcaaatccacaacaacacacatcataattcaacttctaagacctcaagacgaagaaaaaaccttaaaagcagccaaagagaaaaggtgcattacctctaggggagtaacaattcatatgatagtagatttcttgtccaaaaccatggtggccagaaaaaatgtccctgacatttgtcaaatactgaaagaaaagaactatcaactgaattctatatttggtaacaatattcctaaaaaatgaaagggtaaataaagacattcctaaatgaaagaaaagagcatttgtactagcaaatctacccttaataaatggctaaagaaagttctctaaacagaaaagatacacagaaccaagtttgaaacttcaggaaagtaaaagaacatcagaatggctaaaattgatggttgaagcaaaaattattgcagcatctgatgtggtacacaatgtatatacagggaatacttaagacaattacatttaaagagaggaaaggataaagatacccaaatggcagtcaggtttctacattctacacgaggtttaacactcattcaaagtggtaaaacactgatagtggctgtgatatgttttttatgtgtattatcatacctagagataccactaagaaaagtatacaaatagatgtactaaaaaacaaaaaaaaaccccaaaaacaaaaatcactgaaaacaaatcaacacagaaccattttttaaatgttcaaataacccacagacaattaagaaaatagaaacagaagaatgaggagtcagaaaaacaataaaagacttagcccaaacatatcaataattaccttaaaagtaaatagtcttaacaaccaaataaaagacagagattgtcagagtggataaaataacatgatccaataatatgctgtctattagaaactgatttcacatacaacttcatatgtagattgaaaataaaaggatagaaaaagatataccatacaaacaaataaaaaaaggcagaaatggctatattaatatcagataaagtaaacttaagagcaaagtaaaatactaaagacaaagaagaatgtgacatgatcataaaacaatcaattgactaggaaggtgtaacaatcctaaaagtatatgcaccaaacaacagggcctcaaaaattgatacagctgaaatgagaaacagataaatccataattatagcaggggacttaaataccctactttcagtaatagtcagaactactagacagaaaatcagcaaggatatagaagaaatgtacatcacaatcaaccaagatataattgacatatattttaaaactctactcaacagcagaatacacatttttcaagtgttcatggaacgaatgttcatcatgatagagcatattctgtgctacagaacaaaattctacaaatttgaaagaactaaaatcacacagagcatgttctctagatcataacaaaatcaaactagaaatcaataacacaaagacaacagaacaatctccagatacttgaaaattaaacattcatttctaaatactgaatggttcaaagatgacatctcaaaagttatatttaaaaatccatagaatgtaataaatataaaaatacaacacatcaaaatatgtagcatgcagctaaagtaatgctgagcggggaatttacagtactaaatgcctacattagaatgaggaacttctaaagtattacatgcaaaaattctccataaaatattagcaaattaaatctagcaatgtacaaaaagaattatgcaccatgatttatttaggatttattcctaggacacaagggcaacataagggatctttgtggtcatgaaactcttctgtatcctgactgtgttaatgtcaatatgctcatgattgtgttgtaagatattagcactggaggaaaatgggtgaagggtacacaatctccttgtgttttttcttacaactgcatgtgactctacaatgatctcaacaattaaagcacctgtggatgctgactataattcaactcagccatcaatgtttaagcaatgttatgttatagaagactgacagtgtcgtggttgttgatactcaggggtaagactctccaaaactaggatttgagattgttgtctgagatttcaactttataaaccacgcgaaatgaacagaagatgaaatacacaaattttcaaaaaaaatcactatgatcactatgattgttagacatataagactagattataagctgacagaacccacctattcaaagaaaggacatgtggctcagaaggatggttgaagaaaccatgctaacaaagaaacaaagaaagtgcacagcatccatcccaactacttccaggggaaaagaagccttagtcaaatctattactaataccctgttggtaaggcatctgcaccatggaggaagaaacacaaaattgtattcattggacttcaattattccagtcctgctctctttcctggagtgcacagtagataaatgaaaatatttagaaatccacattaaacttgcatcggaaaactgagaacaatagctgaaatttatggttgtacacaggtctgcctttgcttttttcctctaagcccgccaagatcacaatcctatattctttccaaagccttttagtccttttcctgtttaaatgaataaattgacattctggtttcacatgtttgtcgtattagtttagtttatgtgaatccactctcaagagtttggtggcaaaactagccttctgagcccaaggcccagcctatgggctgtgagaaattcaccactgaaatggcaccaaccacaggtgacccgttagaagtggggcgagctctcaagatgacggacattctttctgttttgtggtccagtgtgatctttcaaacctactagtcatatttctgccaaaactagctaattagacatggtgctttgttctttgactatatatattaacacaaatgcctcatgatgagtagaaatatactatacatgagatttttattttgactagcaaaaaattttgcatttttgtttactttaaagcactacgaaaaatccaagatattaaaattattacaatagacaatgaaattattttcttccaataccagattttgatatagacttttattaataaatttatattgagttttccaaaccacatccatctttctctgtcaggactcccacctagtttcctaatgcccagtgctcaagtagcctgtcaggtaaaaagcaactaaattagatggacttaataggtttgtacttaaagataaagtaaaacttacatggctgtaatggccaaagattacaatttacacagatgaaatactgcctaaagggtcatttgttattcatggacaaaaaataataataataacctagggaaactaaacccagaaaagatggttttaaaagaaaatgaagaggccgggcgcggtggctcacgcctgtaatcccaacactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaagaaaatgaagaatgacagaggatataatcagtaaaattcaatagagatattatttttaagtcattgataaataaaatctttatcataatatttatgaggaaaataattgattctgatttaaataatttcattaagataaatatgaaaatgggaagaaattggaaacagattaatagcactctatggaaaattgattatgggaaggaattaaattggcttaatgatgttccctcaggaacttcatgaaaattaattcatgctgggccagttctgattaaaatgtttatattcataagttggaagtcaaaacatcctatgtcctgatgacatcactgtgtttcttggactctgctgtcttccatactgcaattctgccttctcacaattctcaccccagcccttccattgctctttcccccagtccttcacttctgtgtttttccccatctcttacccttatacacaggtacacaggtattccccaaggttccattttcagcccacctctgtaaatcctgtctccctccccctcttcctctcccaatttctctgcctctcttgaccacccccccgcccccaagcactttaatgctgatgacttccatcttcacatcttgcctgatcctttctcctgagtgccagttctaggcttccaatgcctgcctgactctttcctatggacgttccactgttgcattaaatttgaaccattcaaaactggattggcatctttctctataacctaccagacacaggggtatgctggagctggctcaaaccagcttgtgaactgactgtgtccatctcttcccacctccacattcagtggcactgtcctgggggcagactgaaatgggctttggtgagggcatttacgccatggaaactggcaaacacaacaagtagagccctttgttcaccagagaaaaaagcacacccttgcttatacggtaccaccatatccttaaacagcaaagaaacttgaagccatttcaggcacctcacccaccttaccctccacatttaattaattaccaagttatttgtattctacttctgaaatgactctcacacagccactttctttccagaaccaatgccactgccttagcccaaggtcacctgtgtgtgcctacgctcttgcaacagtttcctagctggtgtccctgactgccgtcttttataacacaatccatccctcacacagccacaggattgtctcactttcaacacagcctgcaacataccattctgctttaatgtctcaccatgttctaaagaacaaagccccaaaacatctcagcaacagtagatcattctgtgttccctgaccacaaaaacatgcacctatacacatccatctttgccctgtcccgagttccctcatcctcctctcaaggcccactcagctgagaagccccttcccagctcccctcagtaagaatgaactagtccctcctctatgcctacatgacctttgtcttggtgccatcctgttcttctggcctcatgctttagtgcctcccacttgctcaacttggtcagcaactgacttcatttccttccatttttaaaacatacttttgcccttaagtggattctattttcctctcaaccatgtattttcttcattttgcttccctaacccaattgcaattatccccaaaccataagcatctacagagttaaggatgcctactctgtctgtcacaatcatgcaagatgaaaggatgtttaaccccaggctgggtgttccaagtggctgcaattaaagcaaatcttttttttctccactttggttgactctatgattaaaaaagaaaatgatttcattaaagataatttagttgacatttctgctttggtacaactaggagttgagatggctttcactgccctgaaataatttagcatgcaggaacatcaagaaacaaggagcaggagtgccatcaacatagacgagaaacgagaaacacaaagggagccacaggggacaaatggcccatggttaagtttggtttgtcataaaaggcatgggcagccacaacagcttccggctagaaggtgcattggcaaccttcctcctgcctttccctttataagtttcacctccctctacctctctttgctccccacttcttaagcaactgaagagacatcttcttcatcatgtgccaaaatttagcaatgtgccactgcaaagaaagagaaccacaggctccagggtcctaagtgagatgagatgaaaaagcagcaagagggagtgtggctgcagaaagagcacagcaggctctggagtcgggcggaacaaactgacttctgccccacactcctgctgtcctcataagatccaagaagaagcaatggagtgtgggagcagttttctggcttctttctctccattgcttgggtataagggagaggagaagatggaggtgcactgccccagcacatattccgcctctcttgttaatgactccccatgggtgtcaggccacagcatcactccatttctaccctcagaggtgacacacaacttcatgttctctttgggtgactagtgacctcagttcactttgaacaaaacgtactcactggtatgaagatccatgtttggacaactcctctcacatatgggatggagtaaactcctttgtctatgaagacagattatttcttattaatggaaagttattaacctgaaaatctgcaccatatctaccagatcatttagacacaaattttattttattttcatttatttatttatttatttattttttgagacagagtttcactcttgttgcccaggctggagtgcaatggcacaatctcagctcactgcaacctccgcctcccaggctcaaaagattctcctgcctcagcctccctagtagcttggattacaggtgcctgccaccccacccaggttttgttgttgttgttgttgttgttgttttagtagagatggggtttcaccatgttggccagactggtctctacctcctgacctcaggtgatccacccgccttggcctcctgaagtgctgggattacaggtgtgagccactatgcctggccaaatctagatacaaattttaaaattaacacctaccaatacaaataatttttagtatttctaagtctgaatatccatttagtatcttttataattagaacttatgaaattttacacagaattatcagaaaagtgtcccacatttgtataatgttctcctcttgcaggcattctctgtctcagtctcatagcagttctctgtgctgctctccgaatgctgcaggagaagaaacaacatatcgcataatagcagacgaatggtgatctgctctgtgagaggtaaagacattttctgataagggataaaggaagaaaatggcaaaaagcacagacgcaaaaagatgtgctctctagtttttctttagggcatttactcgatagctaacaacagactggggttgtccgtgtaccgtcctgaagggagaggtgtccccatcttctccacctgtgacccagagacgttccttctctttccagatcatcatcctgaccctctcccctgaccatcctttctccccttctgctttcaaacaatcacagatcttctacagcttgaaacagccactgattagtgctgctgcttttctagaaaacatctccctccctcacctcccgtttcctttcttcattactaagtttggtttagaatcaatatctctatttcatcatcacccacccacacactttgacttccttcatgagctggctcaaattctttattaaactatttttattgcttgcataaaagtcaacgacaagcttcccttcaccacagaaacgagccttcctcatagcctctccaggcatgggacagtttcccctgccccactccttccggacatgctccccttcctgcacgtccaagcctctaaccctccttctcctccctttcctattggggtctaccgttgcccctagtgacgcaggggctttgacgtggagttcttagcctcctgctctttcttctctatgtctccttcctgaagagcctgaaccactgtgcggatgaagacatgggggaggcgtgtctcacgcacctttgctctacctcccgggcttcctcagcactcactgcttgagatcctcaaccgtcaacctggcttctccatgctcacaaggcttgcactccctaagtttcctaagtgtctacgtctataatacgagcattgaaatatctttcctgcctgatccagagggtggttggaataatggaatggtttttaaatcttcataaacacctacagtattggcatatcaattatcctaccaaccccctgactctaaataactctttttattaagccacaagatctaaatcctctccaatttgttctcccttcacctcggtgggatggtgaatctccaggtcctagggttttcctctgatgtgtctcacaagcccattcttgcccgtccagttcctctttcctcactctttctgcccaggtctccgtccgccaggacttgctgcctgcaatagttgcctaattcacacatttccaattttccctctttgatccattctgctacccccagaataatcttcctaaaccttaatttctaccacatctcatcccattccctaaaatgattatagttcccactatggccaggaaaatatccaaactcttctggctgactctcaaattctctacaatataaccttttctctccagccaaaattatttccaagtcattccaaagccacaacccacaacccactactcctaaatgtaaatgtcataactccctttgcagctccatgtgtgtgcctgtgtctacgttttaaatttattttgcataattcacactgtgcagtccactgttgactgagcatgtagttttgatccactttgtattgaaaactctaagcagggtaatatgatcataaaatataatttgaagggcattttggtttaaataatgactcaccatcgagccctccattggggagtcaggcccagagccaaaccaaaaaaaatgagcgacaagagtcaatgcattagttagaggcttcagctcagtatgactgatctggaaacatatcctgatgcctggttaagaaagctttatggcagaaaaaaaagaaaaatttgaactgatgtcctctgtctaaatcatgaataggaaagcaaaaaagcttgatgtgtctgttttaaaaataaaagaaggctaaatccattaacaggtgaaacaactgacaacggacccacatcaagccagagtccttctcagcatcacagaaatctccttacctagggccagctgaccatctgccagatggctagtggttctaagaaatccaccagggaccaaaagcaggggactataagattaggcatcacacaaatgtattccaaatcctggagctggggtcactgatagtctactacagaaatcaaaagaggtgcctcagaagacacaggctggcttcacagtcatccatgtgtctaccctgagatctcagaggtcacaggaagacccaaagatctatccagcagaaacatttggacagaagcaagtccaagagaattctttatattcacagctgctacagttggtcaactcttgattcaggcaggtttcaagcaagtccttcttccctccctggtctgcacaggggtgattttagggaatcataagggaagaaggggacgtttagaaaaagacaaagagtgacaccacacacagagtttcatggaatgtccatattgcttgccttttcatcacagatagtattttacctcattagttcattcatttgacacacagttattgggcctttatggtatgctaggcatttttaggtgccaaggatatagcaataaacaagacagacacagcccttagtttgttaaggaagcaggcaataagtcagcaaatgaataagataattgcagacagtgctaagtgatatgaagaatctgtaagtctacaaagaatggagagtgactgtagagtggtcgggaactttaagcatggtcaaggaaggaacaggaaggaggcaaagatatgcccccaactcctcgctcaactcccagagatgagaggtgcctcttggctccagctctgcagccacttctgctcaaaaggtacgctgcgttgctttctttattcctttgttaaacctggcaccagcaaaacaggcacctcaacacctataaatggttaggaatagatgggcatgcaagcttttctcctctactgattttactgggcataatagtaggctttttgatatacttgatctgatcagaaataaacccgaaaacaacacatgatacctgtaattgttttccctggtttaccttgtgtcatttctaaggcttagattcccatgacccccagctgttctccactgagtgctcactgtagagaaagttgctcttctttttcttcctgttctctagacgcacttacctctctaactctggtctacgcctccttatcaaggcacagatgcagctaaaaagcattccacctgctccctagcaaaggacttctttgttaagctttgacataaggagggaaaacagagacctcaggacttctactgtgttgacattgttttaagcaaggtgggaaaagagaacagataagcaagtcgttctactggctccactttcccaccacctaagtcaattcagagtatttcccgaacattttttacccatagattcagattacccctaagacagatggttatggtttattccgttttgtgcacacaggggtaaaagtcacttaaaattggactcaaattacttcaaagtttgatacctgccaatcaccatttcatcttgggtatacaaaaccatactgcataagctccaattgcctgattctaattttcaatgttttcccctttttaggtaaataccatcttcagtttttttttccttttttttttaatgagcagtttaatggaaaataattgctccaggtacaggtcttctaggcacattttgtctctgcagctattgttttaattagtgggcctgcttgttcgctgtccctttgttgtggcccgctctggggcaggggtgcccggggagggttcctcttgtggaacgcaggcgttaatgagccatttcagtaataagagtcctgccttgagccagaagtcagagcacccaagacaccccaagcagcagaaatgctcatgaatttctgaaactgcctttctaatttgcatttaaacataacttccaaagaacaatttcacctgtgattttctgagctggaaaggtaagggactttagatgttgaatatgtacaaattatgttaatataacggaggtaaatgaaagtcaaatgcattgtcatgtaaaatgtagacgtcttttctaaatgtctattttctaccaaggcttgttttattttccccctaagtgaaatgtgataattttttttaattaagtgaatctctataataattcctatttgattgaaactgattattcctcattttcctgtaacctagacttcggaaacctcagcaagaggaggcttagttggtgcctggtgacttcctacaatggattgaaaccaatctaatttaacacctgtgtgctcatcaataagtgtactcaagcacaaaagtgagcacagtgttgagcgattctgacactgactgcatgacaaccacagactctgtatccaaacactcgcagacaagaagctaattgcagtgatgaaaggcacaccactaaaagcatgagtaatcgctgcagtgatgcacagataaccctctctcctttactaccagggtgctgcggcatttatctcaaacctgtctctacccaatctgacaaccttttgtctctctgaccaatggaaaatggaaatgatttttcactactgttcccgcagcagtgaagggtctcttctgagtgtggagatttagttcaacagttgagtataaaacaaatgcaaaagctgacatttgtcatccatggcagaaataaaaggctaattaatgagatctgttggagtcccttctcccagtgcacccactggtgcccatggagaatgcacactgccttcccaaattgtgacacgtgtgacaaactctaccagagtgaatgatggtctgggaaaggtatggcagtgcagctccgtggcatggtgaaaggaagaaaacatcatcaggtttcaattcaaggcagtggtagttaataatggacttcctgaaacctgtagctcaatcactaagggaatattaagattttccacttgaaataaccaggattatgtgggccatcctagaagcctgctgaactggaatgcattcataccctggtaatcatattaacttactgttaggccaaggtcaacttgattttgtgtttcaccaaagctcactgggtcttttctcttgacagccattgggcaagtgagggatacacggttgacttgaagctggaatccacccagacccaatgaatcactgacctctcatttttaaccctaatgaattggggtagaattagatattttgaattatcatacaaagcagagtaaacccaacaatctatcaaaattatctaactatctagactgaacaattttacttggaaaggatatacctgcttatgaaatactaatgatgacagcaagaaagtctgatttcaaatctatgggtgccaacattctatgtatggtcatggaaatacatatgtaaacttgatacactgacaagtcatttcctatgacattttgccaatcaaaataaagtaaaatgaagaaaattgtttagaaaatctggatcttgtttccttaaggtgtatgtaggaggaagcagtaggaggcaggaggcattttcatttttattttactgcaccagtgtttggagctcagcagctgagatggggtgagtaacacatgagctttgatgagcaattgtggacacagccctttttgccaacatctcactcattaccttttccctccacttttttttttttttttttttgccaaaccaccctactagattataacagtctgcatcaagaaacatttcatttaattctggaaaggcacagccatggaaatagaagattaaaatgaaaaaaaaaaaaaagaaaaaagaaaaagagaaaacccacacaaaaaaaatgaaactaagagattctgaaagcagcatttcctaattaagaaggcccaagaaggtgacagatgtacccaggtccccacaaccagccagtggcagaaccaccagaagagctcattttcctagtgcctgcccaggttttttctacaatgctcacagcattgcaaggaggagttaacgccaattcttattcaaaattaaattctattagatattaaggatttctggtgggaatacttcagaaatgaaaaagtattttcaatttaaattaaattaaatttccaattaagtcacagagaactgtacttcaacaggaatctcttttactctacccctttacaaaagaaatatttcactttttttctttctggtcatcaattaagagttttatgtaaaatgtgtcactttcatctctgattaaaacgcatcctattttaggttttgagattagaagctgaggcccaaggactcaatgaaattgtatggcatcgttcccgcagatatacatacatatgctcctaggaaaaaggttcgtagcatttatcagattttcaactggatctataactcttccaaaagattaataagttctgttccagatagagctgaggttttggcaaaggtaaggaatccttactaaagaatcttgtttctctcaatagcccctaaatctcttcaactcacataattgcttttaaattcacaaaggaaatccacaaggcctacaaggaaaagcaaattccagcccccactaaaacgggaatggacagcaactgattaattctgcagtaatgaaaatttaatataaaacctttaatttcatttcaggtagcctgaacttcagattggacattttcagtagaaaacccatttctttttgttcctgtttttttttttttttcctaaaaaaggcttatatttacttgatttgaattttgctagcatgctttttcttctgaattcaagtgactagaactgaaattattccacctggggagaagagacagctgaaagccaatttagtattggttttcaaatacatgaagggtactcagagagaggatgattgccaaagaaaatggtctttgaaccatagaaagaatctgagcttgctctaaagttaaatttcctgacttacagagtttatgacattaaactgagagaccaagggatcctttttggagacttcaaaaataggatagatccttaaatgcctgagatggcttggatgtggctttgtctgaagtcaggaggataaatcttaccactgatggtcccttcaggcgtgtgaatctatgggtttgactggcatgtcagaagctagaatgccagcccaggacatctagagagtcatctctccaatgctgggtagcagtctatcaatcgctctcactgcctcaacatctctcagctcgcctccaccaccatagggaacccaaggcctgctcctgtctgaggctgatttccaacgtggcagagaactctgctccctcactgtaccacagcctccaccaatccctcggagagcctaagtttttgagaaaaacaaaaagaagtctcatctgtggtagtagaaattgtgtgaatgccaattttttttaaaaatcagtatttaactttgtagcactcctttttccttcttgaggaaagctaatagcccagctctgcttccaaaacaaacgtctctaagattggaccagtctttgcttttctttttgctggacaaccttgtcccaacttagaaatggaggagatatccatagccttagaccttcagattgggctcaagagcctttgtgtggacccaaaaggggaaccctaggggacacacaaggagctggaagttcaactcccccttcatctcacctgttgtggccttacaggcttagaagtgcagagttcttcagggatcctggaaaacctctggtcaaacctcatctgcaatgcatgccccttagtcaaagctcccagtatttgcccagctcctgctggagctcctccagaaagaactccatactcacaatcagcccatcccaacactgtcctgctctaaggaggagaagagctcagctgaaacctgcctcttcctcttgtccttacatgtccactccacactagtctgtaaaactcctgaagatctaaatgcagagaacgttcacctgggcagtaaagttcaaagagagctgtaccatctgctgcctctgaggttcaggaggagaattcctattaggttaatgccatttccccttttaaaatgaaacaaaatcatctgaaaagcatgtctgaacatgctttataagttaagactgctcacagaactctgactcccaggaactacaaatctaaataggataaacatgtttatatgtgagtgcctgttgtaaagctaaaaacccagcagataccaaaagatgctaataagctcaatatggaaaaattacttagaaaaggtttatgttatggtcttaacattgccaatgcctaaattatttattggtcaataaaaaaacccaatgcatcaataagagtaatattaaagtggaagttattagcaacttctaagacaggcccagcagctgacatgacaaatacaaaagctggacaccatcgggataacgggaacatcattctccccccagacaaacccaaggtgccacgtgtgtgcatggcatggcagggaagagatgaacaaccactataatctcactatctgtgtccccacaaaattctcatgttgaatatcataacccccaaggtgatgatatcaagaagaggggcctttggaaggtgactagatcataagggcagagccagttgagaatggtgcccttataaaagagaccccagagaactgccttaccctcccaccacgtgaggatacagcaataagatgttatctatgcgggcaggccctcaccagataacgaatctgccaccaccttgatcttggacttctctgcctctagaatgagagaaataaatgtttattgtttacacatcacacatactcagtgtatggtatttttgttacagcagcccacataaactaagacagcaactaacaggatcaaaggcaggtggtggaaggactgactacatgggctcttcaactgaagagatcaacgcaatgatctcttcaatagaatagtctgttgaagatctggaagtatataaatagggcatattgtattaatagatatatttgcttgcctccctagtatcctcaaaagatgaggaccgggactaagttgttcttgtatcgtgcaaagaccctgcagtgtgttatatacagtgtgggtttacagcaaagatttatactgaactccactgctttttttcccaagggaaaaatcagtgcctaagaactagctcatcttagtgagaggcagcctgtgagatgggctcttgaagaaaaggggtaagaaggctgatccaaagctcagaacagctatggctctgaggctgagaatatttagattcaaggagaagtctcataaaccatgagaaaggactattcagattccatgaaaaggagaataaacagctccccatctttagaaatttttttaaattctttatctcttttttttttttaagttagaaacaggcaggctggagtgcagtggtataatcacagttcactgcaaccttgaaatcctggtgtcaagtgatcctcctgtttcagccttctgagttgctgggattacagacatgcaccaccacgaccagctaatttttaaattttaacttttgtagagatggggtctctttatgttggccaggctgtctcaaactcctggcctcaagcaattccccctcttgggcctcccaaagcactgggattataggcatgagccactgcacccggcctattctgttctttaccttttatttttaaaaaatcattccctagttctactatctctatattcaaaatcctctttcccactataaatccactatctgaactccaaatatcaccaagaaccagaattccataaagtacaggcaatgtagatacgcaaacatggctctgagaatcttactgcctgtatttctcactctctatggttttcagctacacccctcttgccataattgtgtgcccttaattaaatctaagtttccagccattttttttaatgtgaaaactcataacaatgtccttgggtttatagcaccactattgtcatagcatgttattcaacctcagctagtgcttgacttaacagaaaattctgagtttcatattcattgtagtaacatcagttgtggaaacaaatattgtgctatttgcctttcccctgctgttcctcgatctcttttcagcctcaaaggctgtctggtacacttggttcttgtgccaggatggaagacacaagatgagtcctcagagacgtggtgtcaaggagtccatgttttctttcctctaagtgcagacagaatgactctctggaaggagcatacatgagctggcagttagagacagcacagctcagaaacaactgtgctggagggacatgaagaaaggcaatgatttctctttcccaatatgtggcaattttcagatgtcaaaggaataacagacagatataccctatgaaaggatttgatttgtggcaactgcttttcttttcctgattccattaatgccaggtttcttggccttaagcagagagccaggtattttctttttatttagtgctccctgggcagttattatctgtatcaattttcctttatccaggttaattctcttaaaaatacatgcctttcagtcactgtattgtatttaaccaaaatatctgttggtacaacatgctcttgtagttcatctaaggcacctttaagtcacagagttatttttaaagtatatgagttacttctgattataaaagtaattcaggttcactgtaacaattggaaaagagcaaaaagaaatgaatagctcataatgccaccaatcaagataagctctagtaacagactgcatatttataaaattgggatcatcctctatatattgtttttatatacttgtttttcagttaacatatgaaaattttcttatgacattaactcctcttcagaactatgtggttttttgttttgttttgtttgagacggagtttcactcttgttgcccaggctggagtgcaatggcgtgatctcggctcactgctgcaacctccacctcccaggttcaagcgattctcctgcctcagcctcccaagtagctgggattacaggcatgcaccaccatgcccggctaattttgtatttttagtagagatagggtttctccatgttggggaggctggtcttgaactcccaacctcaggtgatccgcccacctcagcctcccaaagtgctgggattacaggcatgagccaccgtgcccggcccaaaatcatgttttaatatcacattagggcatagagattttttccaattccttgaagtgtttaatgaaactatgatacatattcatgcacccaatcttttaattgtcttcactcatattccaaattgctcttcataaagttaacaactatttaaacttctagaaggatactagaagtttagattagaatcttggttcccaatccttcactttttcaagtgaaggatttcaagttttgccagtttgctagataacacattatgacaatgatatttttatttgcatgtcttcatattcattttcctacatgtttttgaatatctggaatcttcttttgtgaattgtctgctcaggacctttccctattgtttttagagcactggggctttttctaattgatatataagagtacttcatatcttaaggatattaacaaactgtctgcaatgttttcccaatttgtcatctgcctttgaatttgagatcatgtttttaaaaatgcaaacaaataggaacttagtatttctcacatgagcttcaaaatgccacttacaataatcagatgcatgttatgttcttgtccatggactgttaactactagagtcttttttaaaaaagagagccctgaattgtcaactgtgggaagacaaaagaagccagtaccttctgttgcttttttgccattcatagtgccaggacctggcaatgcctcaaagctgctattcctgcacagggctcttcctcagcctggagaagacacacacaagcaagcgaaggtgggtgggaccaaactaccaccttctggaattcagtttggccttccaaggtgactgatatggtttggctgtgtccccacccaaatctcatgttgtagattccataatttccatgtgttgtgggacagaccaggtgggagatgactgaattatgggggcaggtctttcccgtgccgttctcgtgatagtgcatgggtctcacgagatctgatggttttaaaaatgggagattccctgcacaagctctctctttgcctgctgccatccacgtaagatgtgacttgctccttcttgccttgccttccgccatgattgtgaggcctccccagccatgcggacctgtaagtctattaaacctcttcgtttttggaaattgcccagtcttgggtatgtctttatcagtaccatgaaaacaaactaatacagtgaccaaaccaaaagaacataaacataacagaaaaatgcaatccagcttaggagcttaggcaaccacagacactaagttacctgaatttccaagtttcattctggcatgctcactactggaaacattccttatgactctcgaggtctcagtttccaactcccctcatgctatggacccaggatactgaatcgactagacatttgtagaaaactttaaatgtggagtttttaactcataatgaaactaaaaaccaggcaatcaagaaaggaattatgatttaaaaaaatacagaaaatcagaacagaaaaaaattccaaattaaagatgggaaagttcaacagtggaggaaacagaacattatgctttatgacttaggttcgctcacctataatgacccaggtaattgccatatatgggtaacccctgaggaacaggatgtaatcttagtcacaatttgtaagtactcattcatacttcaagtacataatcaggcatacagagtataatccatacatagtttaataaagacaaaagtctcagccccttaaagaactatccaggtgtctgtggctgattggaactcaagcgtaagagattagaaatgtattaaatgaaatctaacttctgcttaatcagaagagcctggtacaagtatgtgattaattcaaagttttccttgaagaggatggtctcgtcaagtcatcagctaccagctatccaatggcagaggtggcagagctgactgaagcctattcttcatctagcccatttgctccatcctgctttgaatggtttacaacattccaatccttcaggtaaaggctgttccccaatagatcttgatcctatctctgtttttttttgttaatccaagatgattcaattctttttctgtgtgcactacttctgaattatttgtcaatgtctttgtgattactattataattattgttattaatatagcctggaataatatcaaatacttgacaacatctctgctaaccaggcagcgacttgaccttcaagggtctgctgttgtttgccatctgaggggagaacctcaagggcaacaggaccagtctccttttatctactgacttcagaaaggctggaaggcaaaaaacataatgatctgggcaatctaggtgagaaaaattcacttttccctgaattctctgtgtaaagaggctttaatggactgagttactcaggtaattgttctgcattggtctgagtttaatcaaaagaagaaagaggataatgctgtcagggaagcagttttcagaaggtttagagttttgcaattgtactacagagctccgaaaagtgccagcagagcagaaaaattaatgtaaataacattagttttaatttcattcattttggaaaaaaaaagcaacttcaaaaaggtttttataaaactctggttttcaagcatgagaaagaaaagctattttacataaaacaaaaaataaaataaaaaagctcttttaaaaaaacaaaaagatcttttacataaaatgaaacaaaatatagaagggttttgcccccagattgtaagaataagctttgtttttgcatttgttttagtcttttattttttaatttcacaacatagtgtaaattaaaatttaaaatgtgaaacttcaagtgttaaggcaattgtggctagagctgaacataatatggacagtgaagaaatacacaatgtatccaagattgatatgtaggtatcaattgcttccagtgaaacagttcattgacttctctacaggaaaggaatctatgagcttctaaatccagtcctgagtagaaaattataacagtgaaagagatcactttcactcagcttccatttccagttttatgcgaagtccttactttagtatgctaggaaacatattgagaggaaataaatatagtccccttctgtggcagcctggaccaagtattaaggttgcttaagaactaacctgaaagatcatctaaatgtgtttttgctttgtttgggtaacctataggatcaaaaacatgctacagctctaagaacgtaaaaataatggaatagaaatggaaagatgcatattaaaaatctacaaatctaaagacaaaatagtgtattaataccatctgttccagttctatatggtccaagtctgcccaccccaccaaccccccaaccccatcacaaggatctagttaattcacaggaactgcttgctgcctgaaattcttgccagaacacttaacagccccctcatttgttgggtggttttataggtctctggtgctgagctgaggtaggacagcttgcagtgtgtgaggaggacagataaaaccaccctgctgtgtagatttagtccatttgcactggctctcagacagaaaacaaattgcaacctctcacaaagcagccccgttctgcactagcaagcctgaaaaatgcaggcaaaaatgagtaaatcaggcaacttcacatcaggaggaaaaaaaatggctaccactctaacagctgctctcgtaattaagaacagatttcatcactaaactcttcctggttatgtctgcagcaaaacaaatacacagatgtgaggcatttgcatactggaaattgtgtactggataaccaaaccaaatttactttttctgctttaaaatattcccttaaaaatatccagtcaataataaagtataaggcaatgtccaaacctaagtacaactatatttctgtcatcatcttgcaactaaatttattttggcattctaccaaattcactttctttttacatattcgaaattgcaatggactgccatgaacatgacctcctttgaataatgaaaatgtgctacccatttcttttactcataaaatttgctaaatttattgctgcctcatttatctatgttttaaaaggctgcatggcacatgcagtaaaaggaatcgcatttgacctttttaaaggtaaattggtgtggagttagatcagagaaataaaactaatgaaatgataaaattacagcaaaaagtgagaggtaaggataaattaatggaaccaccccactaccatgagaaagaacaatttaaaattcacacaacaacatggatgaaccccacaaacaaaatgctaagcaaaaaggccaataatatacagcacaaaaatgagcaaaagtaattgtatcattagaagtcaggatagtggccacccttgggtgggtagggccatcacaaggagggggcacaggagagcttcttcaggtctggtcatactccatttcttcacctgagtgatggttatacaggtgtgtgcagtttgtaaaaattcttcaagttgtatacttaggattacttttctatatagaaattgtactttcataagaagaaaaaaaataaaaaggtgggccaggcgcagtggctcacgcctgtaatcccagcactttgggaggccgaggtgggcggatcacgaggtcaggagaccgagaccatcctggctaacatggtgaaaccccgtctctgctaaaaatacaaaaaaattagtcaggcgtggtggtgggtgcctatagtcccagctattcaggatgctgaagcaggagaatggtgtgaacccaggaggcggagcttgccgtgagctggggtcatgacactgcactccagcctgggcgacagagcgagacttcatctcaaataataataataataataataataataataataataataataataataatgtaggacatgcactgtgttttctgattttcagtgtcaaccatagcgtttactcaccacttttagccacaacctcttcaagcggcaaaatccatcctgcgtttacacacctttatgacactgtaatagcagtgtccttattagccatttttatcaagtcataagtttcactttttaaatgaataaactggccaaatgctgaagcttaagtagcacaatgttctaacagagtcccttatttagtactttaaactgattttcctccccaaaggtgcaaatgctacataattttctattgtgaactgtattattagtactatatttaaagcaaagaagctgttttaaacctgtaattttcagtcaaatgtggttctaagtgcattttaaaaatgacttattatactgttttacctaaagaacaataattcatacagaaatccatagatgtaaataagctgatacaaaagtagaaaaggaagatcatgcctattcaagatgacctagtatgttctaagaccctgaattaaaatgacatttcagtagggttgactgggagtttaaatagtagagcttttcattcagaattgtacttttccaagttgaaattatgctgtggagtaactaggaaggcattagagggcctagagaagtaaacttaggaaacaagtggtggttgttaatgatgagggtggtgataaaacatgcagggtgctctacaggctctttcatcctagttaggtctttggtgaacgaaaaggccgatcgttacaaacgtaatcacacacactttgctctaagtggcttcccagctgcacttctcaattggtgaccatcaatgcatgaaccaggggtcaaaggcataaagagactttctttcccctaaaaggagggtctctctgacctcaccctttgggtttgttcatctatttcaatattgttgcaaaggctgaagtcattagtgtttaaaccattaaacctaaaagacaggggtacggagaactttatccacattctttccattcatcaatctggggtcctcatttataagcgaaagtcatagacgatgtgtacctagcacaatgaagcactccacagatgagtgttcagctctcaactgcaatgactgcagaaatcagaccctatactctgggctggtgcattaagctaacgttagtttagatccatccacagaccctcctgtaatgccagtctgagatctagctgggggccaagggcagtgccacagctcatttaattgtatttattctcaactttagctgaaataagcaatgctacctggacttccccttatgcctggctgggggcatttgttttcaagcactttttctgtagccacaatttgaaaaaactaggtctgcatccttaatgaaattataagatttaagattcccattcattcttacagtgtgtacactctcctacctatcatctgctaccccaaaggaaggttcacctgtgagcctactcttccaatgcccatgttttaaaaatgtattctatgctgtttaagaagttaatgtccaggcagaactctgacagaatgtaagaaataaagtgtattattttctcaatctccagcctcagataatgcttgcttataaaacactatgaacctgttatgaaaaagaactgctctgtgatttttaaagcttttttatttaattcaacattaatttatgaagcacctgcatgttaagcactgtactcagtgccaaggatataaagatgaataagagagcatgccagccctccaggagcacgcagaacaataaaagaggcagctatgtgagccgactgaaaatataatatgatggatggatgaatggatgggaggaaggaaagaaggaacaaagggatgaaggatgatagatagatggtagacaacagagaagccagggagtgaaggcagggggagaagtgctatgaaggaacatagaaagcaactcattccatgaggagtagaaaagccttcttggaggcaatgataaagaagatttagtgccagcttgacttcatcaggcagggtgagtagatgcatatttctggtatggagaaattcacgctaaaagcatggaggcctgcaaagtgcacagcatgttagggggacaacagtcaagctctgagtagctaaagtatagtgtacctggcacagcatcctgaggttaaagctggaggggtgaggtgatgtaaagggtcctgtatgccggacccacaactccagctttttctcttctaggttagtgttttctagcataagtttcccagaatactaattctatgggttgctttgcaaaagcaaaaacaaaaaaccattttgtggccaagtacatttgggaaatgctgcctcctacaatctcctttcagagattagtaacatatatttggtctcgagggggctgataagcgtggcaggaaagaaatcagtttaacttggacaccatttttgcagaactcctgacatccctcggcactgggttctgtagaacacatgggggacactgaacactgccctaggaaagagaggacaaaaggagctattggagcatgaatgtaacatgatctgatttattttttccttttccttactacagaaaaatatttatttggcagtctatgtctggtaatgatatggaggttgaactaagtttggaagagattaatggcaagaagccaggtggtgattaaatgcagaagtgagagagcccactcaagagactttctaggataaaattaaaaggaattcacaacggattagatatggaatgatgggagcaaaccaaagagtaacttcaaaggttctagcttaggagccaggtggaagactctcctttaactaacagaattacagaggagaagcctgctctacagaaaaggtagtatggtcagtgctggtcattttaagtatggaatgttgcaaaaatatccacataggcaaatcaagatagcagttagaaatatggctcctcagcttacaaggaaggtcaggacaagagatacacactgtaatcacagagcccacagaagaagtcatctgaataaagtccttccaggaaaacacacaggacaaaagaatccagaatccaggatacccacatttcaacatataaaatacaaagttaatccatcagctttatggacatacaacatccattaacactgcagtcctagatctgtgtttaccttatccagaacagaatacagggctgagcccgacaatggtttatatttttaatatttgtcatcagtatatagtataaaggaatcaaaatatgtttggaatagaataggatctaattaaatacacctgaaggccagagcaattaagagaattgaccaaagccttatagctagtctcatttgcaactagttcaacaatgatttttttaaaaaaagaaagcgtgaatcatgggctcaggtttgaaaaggaccctgagaggtccatctgtgaattttcatcaaaattgtatttttaattctatgaaaaaaggttgaaaattaattcaaaatatgatattctctttcattttacttgtttctaaggcatttgaggatgcaaataaaatcagataattcacttgaaagtaagatcattatcaggtattagaaaagcattttgctgctttcccacgttatctttttatttttaattgctatgatagaagagtgctaacaatattagctgttttttattgatgtaattgagttgtgtttcatcagaatatcatgggaattagcctgtattcttgtaagggtggtcaagaaaagctgtattctagatcaacaatgatcttatcagctcacgcagccactcaacagacattatcaagggccttacatgagtgaggcacagtccttactcacagaggagacatccaggaaaaggatgaggaagtagcccactcacaactgagttcgaggaggtttccgttggccactacttaattgaatataatgcattcagtgaccagtatgaagtccttaaacacttcagtatacatacttacaatcctgcattaaatgtaacaggatttacaagtctcttttgtgaggaataaaaccaaaaacccaagaattatgaagtttttttgcacaacaatgtgaacagagtgaacacgatctaattgttcactttaaatagttaagatggtaaattttatgctgtgtgtacacatagcataaaatttaacatcttaatcattttcatacaactaaaaattttttatattatgaaattaaaatatctttaaataactgacgtttgtccataaattgtttgttctacatcctgcaaggattgggagcttgtcaatttttttgagctgaggaagaaagaggtgaaactggatctttaggaggattcaccagataatgctactcagggtttatgaaagagaaattgaatcagtggacactcagaagttaggaaagccagcatgaaagtgaaatatttaaataggaaggtagcagtaaaatttggaagaatatgagagaccttcgagaagagcaatcaacaaggtgtggatatggtatggatacggaaaaagaatccaagacgattccaggatgtcggatttcagcaagaacatggtatttattgttactgtcaacctgagttgaaaccaagaaaatgaaaatgcccagggcgcagctggaaaaaggagaccacagtttagatgctgaaccaccatggaccccaaagataccaatctgtggtgtgtaccagaaccacaggctcaaatgaggccccgctgcatccaaccttcacgaacctttatctttacccgtggaaccatcatgttctcccaaagataccatgctgctcacctgcccctacccagtcttcacctgaggtttacccaagcagggagaagggattaacagagaaaggtaaaaataatttcacttcaaatttgatgagactaaagaaatttctggagggccagatctcttctgaaaatttccctggctctagggagacagaagagtcaagcctttcacacacttaacgctcttcaagattctgacaactgttgatcttcttgccatgtttgggtcttagcactgcaggaaactcagaaactctcttgtaatctgcgcagaaggtcatttggtgtatcccgatccatctctgccgtgttcctctcgataaaacagcagattaaattaatccttgctgttcaacattcacaagacttgcaagtgtctcctctctgttgccagacttagagggaaaaaagctgagtcagaatgtcatgatttgaagttggagaatcttattgtgatgtataaggagatgaagaaaaagaaaactgtttttaactaaaaccttcagaaccttatcacaaaatgggccgggcgcaggggctcatgcctgtaatctcagcactttgggaggcaaaggcgggcggataatttgaggtcaggagttcgagagcagcctggccaacatggtgaaaccccgtgtctactaaaaatacaaaaattagccaggcgtggtggcgcatacctgtaaccctcgctactcaggaggctgaggcaggagaattgcttgaacctgggaggtggaggttgcagggagccgagattgcgacactgcactacagcctgggcaacagagcaagattttgtctcaaaaacaaaaacaaaaacaaaaaaacccaaaaaaccttatcataaaaagtcagtcttgacagattaaatggaacttttccacttacaagaagcatagccaatttcaaagattaaaaaaaaaaggaacttggaaaagtgaatttattttcactagaatgtatacatttagagtatcttccctatctctgtcctttaaatttaagcttaaacatttattttttattaaaaagtaggcatcctttaatttctaatctaaggaaagaatggtttaattaaaattttatttattttttttacttctgctagctatttaatctaggaaatacagctcagaaaaaaaatgcagtcataaaacctgttggtataaagataagcagtttatttaatatctaattaaatgtggtcaccagagaaatcacagcttatgaaactttatcagaaaaagattaatccatttcaggcttaacccaaatgtcataagagaactcatgaatttagataggaatccacttattatccaaagacgttttcatatcaagttaggtgagcctatattactagctatatttatacttacttcaatcaaatttatatactttgtagctatcactgatgtggggcacaattatcgaaccagaataagataatagggagcctttctgtctttatcaaaaatttctagaatgttctaaaacacttggagtttatagatcccactctttcagaaattaaaaaaattagactgtcattttaactgaaaagcaattccacaactaactactaaacacctattagatcttgggctcaggtgttaagaaaatgaggatggagaaaatgattccttcctttgaagggctcagaaagtcgtaagtgagataaacccttaaataaccactgatataaaataatgacaactgtaaggcaggggttgcttgtttctctccaatgcctagtctggacacatggtgacccagcttaaagacctcatgtcccagcctaaagctatagccaggtgatctctggccagtacggtgtgagaaaaagtggttcctgctcttccagactgcacctctatgggcaggatatgccctcccctttctgttccttcttcctgatggctggaagggaatatggaccatcttggatcatgtggataagactaacactcctataggtggcagagcaacagaataaagggagtccaatgtcacagagcagaactagcacactgcctcagattgacaatgatagaaaaataagctcttgtcttgtatttaagccactgttatttggaatctatcccatgaaacagccccatgctctaattaatatgtaacggagatgcttctttttctaaggatttttggttctgaaaaatgccgccttaaaagaaagaaccaaaattgaatagtataagcaaagaaaagtttaatttctaactttttcatgaaaaataacacctttaattatgacaatcaatcttataaataacaaaatagagattataattaaaatcttgtaaattctcagaaaagaataatttaagtaatcattggggggcataagtttaaaaataaaattatataaccacatgctggaactaattttaaaaattagaaaactaaaaactaaagataaaactaatatataaaaactaaagataaaaataatatacaaaaacgagagagagttggaaacaaaatggacacttcaaaatacaagaaaggcttaggaaaataacagtgaatgtagctaaaaatacagatcaaagcaattagagagaaactaatagatatgaaagaaagacaaaaatgattaagcataaggacagtttcagtaagggacaaatcaaaaacagtttgtgcaagtaatgtgtacaaacactttatcttttttttttttttttttttttttttttttgagacggagtttcaatcttgttgcccaggctggagtgcaatggtgtgatctcggctcattgcaacctccacctcctgggttcaagcaattctcctgcctcagcctcctgagcagtggggattacaggcgcccaccaccatgcccggctaatttttgtatttttagtagagatggggtttcaccgtgttggccaggctggtcttgaactcctgacctcaggtgatccacccgcctcagcctcccaaagtgccgggattacaggagtgagccactgctcccagccaaacttaatcttttttaaaaaaaaattccctgagctagaacaaactgatacgcagactgaaagaacactccatgtttcaggaaatgcataatactgagacatattttggttaagcttcagaaatcccaataatactttagggactcaaatagaaagaacgaatgatctataagagcaaacagagtgggcatcttaaaagacatcaaagctcaagagaggctccaaattcgatgaaaccaaagaaacagaaagagagaggtaaaaaaagtgagacactgtcatctctgaaatgaagctcaattcatgtttgttagttttttttccagatggtgggatttgagttgatttttaaacttcatttttcttcattatccaaattatctaaatgagcatgtaacctgtcaatataaacaattagaaattagacagaaaaatatcaaaaataagatggaatgcaaatatcccaatgaccaatttccaaagattattatcattttttaataagaggaacgggccttgaaggaataatctggtgggaaaactagaaaaggatattactccaggcatacgcaaagacagaaaggtatgaaagaaaatgatggtttaagggaatggcaagaggtctgataagtggatggagatcaagcctgggtcagattatatgctatgcttgaactcattctagtgttattctttatttttgtcactgatctgcctgacatcatttgaaccagtgaaagtagggttcaccctatatttgaggtacagaaactcaagtccagacatcagggacaaaattattagagctggagtaccagctctaataggaccccatcctagaagatgacagcccaaagacaagtgagaagggaactgtcctcagaaaatttgtgagatcagatgacaccaaataaaaataaataataatgtatggtaatttaacacatgtggacactacaggaattgagaagaaaggaaggggcactttggtggctggagcaggtgggggaagtggtaagacttgcactaggtcttgaaggaaggacagagcattttaacttaagatttccagtttcacaagaaattgtcttcataggtgactcctacctgtggctataattccataaaaagaaagcattttttcttgctgaaattatagaaaaaggatggactaataagtcaattatgctgggatttgactatttaaaaattaaataactaaagcctcatcttacgtcaaaacaaattccagatgataacttttcatctattcctttttttttttgagacggagtcttgctctgtcacccaggctagagtgcagtggtgcgatctcagctcactgcaagctccgcctcccgggttcacgccattctcctgcctcaacttcccgagtagctgggactacaggcgactgccaccatgcctggcaaattttttgtacttttagtagagatggggtttcaccatgttagccaggatggtctcaatctcctgacctcatgacccacccacctcggcctcccaaagtgctgggattacaccacgcctggcccatctatttcttttatagtgtcctatgttagatttaactctaatctttggtaacagtctttgtaaccatactaacaaaggaagagagagagatacaaaatttaatttgtccactaagaacaaaggttaatcaacaaactggaaaaactgtttacaatgtaattaggaaagattgattttcttaatatttaaacaactcttttaactcaatgagaaaaaatatatataaacacttcaacagaaaaatgggtaaaggatatgaacaaaaaatgcacaaaggtttatatatgagaattgtttgctcattttggaattataaattggatgtctaagaatttttcttaggaacaaatcacatatatatacaaaatttacttagtcactcattgcagaataatttgtaatactgaaaaaacctaaaacagcttagataaccaacaaaaggattatacaaataaattataggataaaatcactgaagttgtccaaataaatgagatgctgaaccactaaagaccaagtattgaatgttaccaaaaactgtataacgacatgggaaagtggttacaataagtaaggaaaataaattagataacaatcaaatataatagctttaatcccaatttaatcagaaagatgaagtacagaaaaaagaccagaaggatctgctctttaaccaaaacattaactgtgattatttccagattatagaaccacaggtgatttttttcttctttatgtttttgttgtagttgttgttgttgttttgagatggagtctcactccgttgcccaggctggagtgcagcggcgccatctcggctcatgagtagttgggactacaggcacctgccaccacgcccggctaattttttttttttttttttttttttttgtatttttagtagagacggggttttgccatgttagccaggatggtctcgatctcctgaccttgtgatccgcccgcctcagcctcccaaagtgctgggattacgggcgtgagccaccgcgcccagcccttctttatgttcttaatgttatctaaatttttataacgaagacctgttacttacaaattctttgctgtcctttgcagcaaaacttccagaaagactgtatgtaatgtctctaattcctcttcttgcttctttctcaaacccaagtagacgttggccccaaaaactctcatcaagggaaatgctgacctccatgttactaagcctaacacagcagaggtgacactggtaataactcccttcccttcttgagatcccctttcctcgtggcttcccgaagctatactctacgttttcttcctacctactgatcccttcttctcttttctgctggttccttctcatcagactgacccctttaggtagggatacaccacaggtcagccctcgtcacctgccctcactccctgggttatgacatccaggttcaaggcattagatgtcacgtgtatgctcacaactcccaaatctacacctccagcccagatacagatttcgttctccaaactccagacttgtgggtcacctccacttggatgtctaagagacaactcaaactcaataagcccaagtgagtaagtaaactcttgctcttgcccccaaaacctgcctcacacatagttttcctcatctcagttgatagtaacttcttcctttcatttgctcagaacaaatatctgtcctcagttcctctgtctgccaaccaagctgtcagccaatcttactggctctccttcaaaatatatagagaatccaatcttaccatctttgctgtccccatggtcccagcaactatcaccccccccccagattagcacaataacctgccaagccatgttccacttctcccctgacccattacagctcattctcagtgcaacagccaaacccatcattttcatacctacgtcagatcatgacactcctctgctccaaacccttcaatggctcccaattctcacagtaaagccacagtccttactgaggcttggcaggccttgcaagacgtggcctcccctgccacttctcccatcccatgtacaccactgcagcatgctgtcttgttgctatcccaggcgaggaggcacattcccactcagccttcactccagctttccatcctactccacctggcatgtgccttctccctgccatgtcttcctggctaactctaccacgtcccagcctcactgttctcctgctcacatctcaatgtctcagtgcagtgacccagccaccctcttgatgctgcacccagctcccaccctccacccccatgggcatccccagccctctttcccctgctctgctttttcctctctctgtaccacttactgtcaactgccaaaaggttaaaaatcaaaattctaacaggaatttaggtaggctatggtgacacaggaaggctcctctgactttcaggtctgtctggtaaagggtggcatgaccctgtgtgaggtactgtcctgagggacacagtaaggacctcgtaggtacgaatcagtcatcaaagatggatgaaaatgaaatcgccagcaattaagaaatcccaggggcatgaccaaagctaagaagcgttaagttatagatgggttgatttgttcatcagcataagggtcagagttgcccaaagatgaaaagggcaccccaggagggcaccatccccttctgctggggggtttcaacatgaaagtggggggtttcagcatgtagcagcatgagcctcagcagggatgccacagagagcatagagcatccctcgggggatggaggaggtcttcatcgctgatggagatatccaagaatgggggagaggtgggcagagggcctgtctataccttttgtcagggcttatagagagaaatagctgaatgcatacatttttctattttctgctgttaatccttttgttacacacataaggggtcaaccgtttagtgtgtattaaaaacatgccaaggcctatatggacacagatgctattcctgaaggttatgtctgtcagataacaaatacacagagctcaggagacatacacggcttatgttcacctaaattatgaaacaatgcagcattcccatgaataactgaacgaggaatcgtgacagaaacaggattggtaaagtactaaatggcatgcagagaaaaaggctgagagacattctgggaaacagcaccccatggggccaatgggtgtttctaagaactctgcatattttaggtctttcgtacattaaaacctagttcatgtggcagagacgctggaaatgtgggctccctcctatattgctctgttcccctcatcaccctccttattcccacatcatcttgtggccacagaacacgaccatctgtgggagcacacgcacagcacacccgcacacactacccccggggaaggacttctgctcatgaaaatcaaacaaaggagaacaaggaaaaagaggcagagaacacagcgtcccactcagagcactgcctgttaagtgtttgtttctgaggccagcatctagctctatgatttattttatatgtgctgtgtttacatacatcagtaaatacggtttccatttcgctttgtaacagcagctataaattatatgttggaagtgtttggctcctctcttcccataaaggtctggcagggattacggaggccccaacacgggaaggcccaggattggtggggagcaccttctttcatccatatccttaaattaattaactcacccaataagtatctattgagcacaaactatgtgccaggaaccattagagatgcttcagtaagcagtaccatgaaaatgggacaaaataaacaaaaatccctggttttgtggaacttataatctagtgaaattcatccacctctcttcaatttctacattcagagctgtcaacccatctggggttggacacatgagcaggtaaatgcaaagcaaatagggccactataaataactataggaattattatgagtgtgaattgtttctgagggctatgtgccagccaccgtgctaagcactgtaagtactaactcatctaacagtcataaaaatgctatcaggaggttctaccatgattctgtcacagatgaggcaactgaggcaccaggccatctggccagcaaatggagtgaagaaactcagacattccagctctagaacccacactcctcgctctgctctagaaccgggccaattacagcagagagaggggtcccagtcagtatcacttccagaggcatctcttggtcccacagcccaccctttggtcagaacagcaacaggagtgtccaggcatggtcaacgggtgcttgccacatgagtagctatggaatgggatctgcaaacagcaccagggagactccattttcatctactgtaaatgtattgctaatgctggttaatcatgtggagataagtgattctactgctcagcccaattaaacacactatttaatacactgtggcttcagacagatctgtctcaacaagtcattctaaatgcttactatgtgaacattttaatacttgtcctcagctcaaatcttgttgatttagtatttcatttaattgggaataaagctctcatgtgataggttccactatagataataatagctcagaaaaaacaaatacgcagaaaaagagagaaaaggtgatctcagacttgaaaataaaatctcaggagggggctagcatcaaataaggaagaattacgctcactactcaggatttgtgatattaatccaggataatcttggttttcaagatttcagttatttctaatacaaaggaacttgtagaatttcatctctctctagcacgcgcgcacacacacacacacacacatacacaaacataaaatcactctcaacaatatactcgcttttctattttgtttgcttttgtttcaaaggtgtttaaataacagaaatgtagccaatatttgccaaatgcttagtatattgtcactgtgctaagcatattacatacgtctcattcactccccgctgctgcaataactctgccaagcaggtatcattatcatgttctccacctcacacataaggaaactgaggccctgaggaattaaaccacttgctccccgtcacacggctgacaggtggcaggcccagttcttgctggtctccatagctgcacccattccacagcattctacctcttccctgtatatctgaaagactgcacaagatttctgaccaaagaaaggatgaaagacacaagcttttctcacgaaactggaagagtgacacctcctttctgggtggaataaacacgggatcacacatcactttcaaccaactccaaacacagaagcccgggggttcttgagcagccccaggtgcggagctcaggccctggaggctgcagctgaagggaaagcagccctgtaatctgttcagacgcattccgggggagaaagctttacgagaactgagaaagtatggaaaataaagtgggcttgctaataatctccctccaggtcccaccctccacgctttctggtcagtggtagtttcccacccttgaggctagaaaacttggcttaatgatataagtctgaaggagcccagagaggaaagagaaagcaaaaagtctctagcaccttcacacacacgatacattttaacgcactttcttcaaatttctcatcacaagactatagaaactgaaactgaagttttttcatgttaaatgccttacctttttttctgttttgttttttggtttttggtttttttgagacggagtctcactctgtcgcccagactggactgcagtggcatgatctcgtctcaccgcaatttctgcatcccgagttcaggcaattcttctgcctcagcctcctgagtagctgggattacaggcatgcgccaccacgcccagctaatttttgtatttttagtagacacgaggtttaccgtgttggccaggatggtctccatctcctgacctcgtgatccacccgccttggcctcccaaagtgcagggattacaggcgttaagccactgcgcccagcccaagtgcttcaccttttaagaccccaatggccaaacataaaaggactggaaaatatggaaatatttccacttgccagtcttcattacgaccttcagaacgacccatctaaactacagaaaccaagtgcttccctccagcatctgagatcaaggtttgggtctccactctttcgggtatacgcagtacaggcactccacgttctaagcggacggaagctgcccatcgagcagacaggaggaagcgcagagcgtaaccatccgtgctgttgctatgccacgctgtcctgagggacgtggcctccgactgccatgggtgagcgagggtgatgggaaagatgacaccacgacaggtggggaaactgagtctccaggcttgccacacaccctcatttctcccaggagcaatcagatagcaaacttcaatttgaaaacattatacatctcaaatgtaattaagaaattcgactggcatgaatatgtaatgtacacattgctttacagatgccttttttgcccgacaggctggtgccgactttcatttggaagaaatccattttcatacaaaggtaaccaagagtgacaggaaataggaagcctacatcatttatcttctgtgaactttagaaaaaatcagttaattgcttttctaggaagctattttatggaatcgcagtgcttcatctttctattctttttcatggcataaacggcaattttaaaatgcccttcatgaaaattctatgattaatcaatacatcttagactatttaattacttattttaacaaataaaattctgatcaaccataaatggtttctctgttcttatagatgaattatcaaccactacgaaaacatctaggataccacagtctattgattgatatccaaattcaggtgtctctttccttaccactgactaagctatgggcaccagctcctggcttcctctgctctcctggcttatcaaatgaattctgttcccagccactggagccctctgcaacagcagtttcaaactatcactacttattaaattgcaaacagaaaactataaatgtgtaggttttggaatacactgctgaagctgtaacttgtcaaaccaccaactgcaaaaggcccaggacactcctgtgttgtctcaatggctctgcatgttaggtttttcacaccactgtcctattttgtgccctgcccccatcacctaacatatacatacgtatttttaaattctaccaagtttaggctaatgtaacttttttcaaatccaaaatgatcatcttagtaatgattttatattattccatgagccaaagacagatacactatgaagttaatgatgcttaagcttcagggtctctaaggctctggggagttgggggtcgggggggtgggggtggtactgtgttaacacagttatatgtctttgaaataatggcaaaggtgagatattttctattccttcatttctaaagaagatccccaagactgcaaatttgaggtcccacaaaactgtatctgcctctctaggttaacagtccccaatgtttgaatctggaattacatgctgagcacaaaatattaatttgcgtgtgtgtgtgaacaaaaaataattcacttcagtcagaaataaaattcagtgtgctgtgccctagaacattctagagggcatgctttggctattcgttagtccctggtctctcacccaaccatagacagctttccaaggggcactcccagggaggctcacttaatgaggagtggtgttcagaataaaagactcagctacaacaacaaaaatatgtttttcattaaacacaaaactgagtcggaaaaagccagccaagaagcaggtgtaagagttaaagaattctcttgaggtctttaacttctacatcaaattgcactggatttttctgcactaattacctattattgaagtctcaggaattactgcaaataatttgccatagcagcaggtagggtgcagatgttgtaagggaaagaatgaagagtttatgaagtgtaaaaccaggcaaagggattcaaaatttccaaatttttaaaaataatacagaattgtttttctactacaagggtgatgaaggtgagggaattttcctagggctaaaaggccaattttaaacttaatttggactgtaaatgagagaaactgcaaattaaaagctatgtgctgcagtctaatttattcagttaatgtaaatttcttggaggcagagattacatcttacactaaaaaaaaaaaaaaattctctcattgcattgcacctagttattaatctgattttcttatgaggaatgtacctatacgatgccaaacagctatttttgtatggccctccttgtttttatgtcatttttacctaacccttccagcccccaaattcttcacactgtgataagtcttgctctgtagctaacatcctcaaaaaccatagtcaagtaataaccttgcaggttattttctttggaaatttccctaaaaaacccttctctacctcactggaagttaatgtctgtactattgagaggacattttcataccagcagtatctttatttttaaaaatattggcatgaatatttttgaaattgtcacattaaatcgttttacctctttcaaaaaataaaaatatttattccctcaaaagtaaaatctggttgataaaattcttcagcttctatgttatgattgtgaattttatttttttatttattttttgtagagatgggatctcactatgttgcccaggctggtcttgaactctggcctcaagcaatcctcccacctcagcctcccaaagtactgggattacaggaatgagccactgtgcctggcctgattgcggattttattggaatagcctataaatattgaacaatgcacctgcgaaagagtatgtcttaatcttctcttggaatactgtcaacaaagatctctgagtttgaagggtagaagtaactcactacttggctgctgactgtgaaatttagtcatgtttttattgtgggagtggactgattaaacagacaagtgttataaggttcaaattacaacatttctcctaatatgcagtgcttttaactatgataaacactgcaccccccttcacaaaaaaaaaaagaacccacccaccaatttttaactttcttctacaaacacctcttatctcttctctatcaaagcatgactggcctttttgaaatattcaggacaaaaagttaggaagagggcaggctcgctagttcaatgtcactacatataggggaaatggaacacttcccatagaaagctctgatttctctcagcgtgagtctctgtctgaggcatccccctctctctctgctaaccagacaccatacacagcatgttctttccaatctgagtcctcaaagggcatcctgaaagtgtccaggttattaatgacatacccaaaagcctcataaaaactgcacagttatctgcttaaggctttactggcaatcaaaaattcatctttttttgttttaactagagttttatgaactcactgaattccaaaataaacaaacatgtaaattattacctaataaatctgaagtttctttggtagataaaaaccattttaacaagaagtcaattgagattgaaataatgaaggggttcctggtggttgtaaaagtcagtcaccactgctcaaagatatgccggaatttatttgctgctaccagtcatttgatgatgacgaatcaaacagcctgatgaattcagttttgtaagatggtacctacgtgtgtctcctacaaacttttaaaaacgtaaatgcctatagaaattacattttgcttccattagtttctagtgaacattttctagaatctatcataaacgtgtaatcaaaaaaagttacggtatacctgtcacttgatcttctctacaaaaccagtgtaaacatctcatagattaaaaaagaagtcttttctaaacggtgatatgttgatatccctatcagtccgtggtgatctctgagatgatagttcagaaatgtttaagctcagccttgtcaaaaatgcaacaacaaatgtcaaatcattgctttcatttggttattaaatcaaattaagatacaaagaatattctggccacactgttactcagtctttaaagaatatgttaaaaagagaaaaaactgaacagttcctaagtataatgttctagaactcacatttaattttagttagtatacaatatcacagcaaaaaatatgtatgcatggtcatatttttttcttcatgtactcttcacaaccatcatcaatttggaatatggtctgagacaggacaggatttccaaaacatttgaatagttcaccatattcaaagttgaataatttaaacaattaatttaaaaactattatgaggtttatttggtaaagtttgtgttaaaatatttcaaaacacgaaaatgttaagagttttggaactcttttacataaaaatttaccttaaataggtaaatagatactgaaattatagcctttaagtgcttttcttacttctgaatcacttattcacttatttcttaattttatttataccctcagtgaacactagctattcagaagaaaattctcaaactatagtgaaggggacattccttccctaactaatacatacacacacaactgcatttgctggaactctaaaaattcaaattataataaatttgagattttaagaaatcactatttaagtctgcctcccctttcagtgactgctacaaatcctaccacatgaagttaaccacatcactgaaaaaaaagaaacatggaaactgaattcacgagggtcaaattgtcacttgtaactatgcagttgcatgtgaacggtgctgataaagactcacctccccctgcttggggatgctgaacttggagagcttggccttggctctggcaggctccggcttgctggcagggactcccctgtatgatgtgcagtgcacgctggtttccgaagacgacttcagcttaggagactcatcaggggcctgatcttggccgtccattggcctcacatacgcggtcggtttctgctggaccaggctgggttttgaagctagggatggaggaaagttctgaacacagtgtccgctgctgctgtgcttggccgccatggcaggtggcctctcctgggtctgaaggcccacctccacattgcacacttgtttggcccgaggctgctgtctgccaacaccatctccaagcaaggtcctgagagagccctgttgtgctgagttggaagaagaagaagaggaagataaggatgaggggggtcgacacatagggattttcttttttcattatagttctctgggttttagcagatttgtgcaaatcaagcaacctgtgcctgtgcttacttgctctctgttggccgtcagagggtgggtgcccagccttctgccagcccatagtgcctctcttactctgctgcacggggacagctgctggtgtggaagttgtagtgctacagatagacgagggctggttctgggctcttgaatctgcaacaaaatgttcatcgatcttgttcacaggagtctgaggaaccccaggtttgggaactccaacgagatgactctgattggatctatcagttaaaaagtctttcatttcatcataattgcctaaagtgttctggatccggttggagagttcatcccccttgttagtctggagaaagaaaaacacatccacgctattgttagagacaacagaaacaccggagataatcaacaggtgcccttatcaatcacagagccagggttgtcacatgcagaatgagagctgagagatgaaatcgaaatccttatcgtctctgaagatgtctgtcagcacttggtgatgcaccagaacaggaagcctgtaatggccttggggtgcataaaaagggatctatccggccgggcgcggtggctggctcatgcctggaatcccagcactttgggaggccgaggtgggcggaacacctgaggtcaggtgtttgagatcagcctgaccaacacggcaaaaccctgtctctactaaaaatacaaaaattagtggggtgtggtgtcgggctgctgtagtcccagctactcaggaggctgaggcaggagaatcacttgaacctgggaggcagaggttgcagtgagccaagatcacgccactgcactccagcctgggtgacagaaggagactctgtctcaaaaaataaaaaggagcagggggatctatccttggtactgtgtgtgttgcagctaaaacagattacctggaaatcaggaaaattaactattgcaactttaaaaaatgaactggattaagtctttctatgattggattgtcctgtaattgtagtcccgttagaagctttacttgaaaattcagatttggctcgggattagtctaaatatcattcttgccagaaatccagagtgacaggcaagagatgtcaatgtgaagcttaaaggaacatggggctaaatgtgcaggaagctggaatgacccagagctccatgccgcctaaggtatttgtgaaatctgggatgacatttcattttggaagcaaggttatatttctggcctttggtaaaaatgagaaataatcttagactttctttctcattagccctaacaggtactctaatcctagcgtgatccatgtacgacaaatatgtaacacaacctccttctaatagtgtttgtttcctacgatctgagaaaacataacaaatgggattgaccttataatatgtcaacgcggagatgaagtctgtattattgataaaaatcacagcaagcagatctcaatagtaaacaaaagttgcatgttactgagggagtggccagtaaagccatgtgaaccacacacctcaatttctgggggaagaccccgtacttggtggctgagctgtcttccctgggctgaacagacagaagatgcagtcaagtttggtcggccaattcttttagtcaaggccaccgtcacagggagtgagagaaacaagtgagaggtagagatgaacaactgaaaaccatctaccttgtagggctcactgaagagagagtaactagaattaaacgtgccatcatcctgttgagtttcttgatttcttctttctcgttctttcctccgtaatgcatttctatctggttcatagacactgcatcaggaaaaagaagagagaacaaccacacacacaaattaaactgtaaagcccaatgtaacacttgtgtgagtgcagaagtctggttcgtggacaaatggtgatgacaacaagaacatggatgagacaaaagccagagtcatcaggcagtgtgctggggtgtctaacaattacattctttggggggaaaagaatccttaggaccagttccaaccagtactaggtttctcttcctggtatgtgaaagaggaactgtttaagcaactttgacaggagaagactgaaagtaatcttaaggcagacggtaattacagtgatgtgtaaatagaaattatgagcatattttctctatgacagagcttctgagtgttatatgggaatgctcctgttctttttttttttttcctttttgcatggctgtgtttctgcagtgattctttcattaactagctccctaaagagctgttaaaactgcatgctgcagtggttttcacagttatgagccttcttctgatctctgttaatcagtcaagtcgtcaaacgactactgaatcaattcttccttctgatatatttgacactatcactcctcctaactatgaaaaatgtgccaggaggaaggggtgcaggcaatgaggggagagaacggaaattgaattatgttgtgtcatcaaggaactccgccttttgttgaagaaaattaatatctattctctcaaaatacaattatgaagtggccaggcaccagacaactggaagaaatgaggaagaaataaagtgttccttccccctaataaggagaaaacaaaggggctaattcaactagtgatgaggaagtgacctgtttactgaaggaaggaaatgcacttgtttttctggctccctggataaagaaatctggcctccgtgtagacaacagaaccaacactaccaatcaaaaagagcttacagatcccttaagatgagctctgtcctcctttcccagcagaagcaggtgggttcagtgacctggccatcattctgcttccagctcccacttggtctagtgggcagatgctgagctgggagttggcacactcacctgcgaaatgtggttctccccaaatcagcgacatggggatggaaaagccactcggtctctctacgccttaatgacttcattacaaagcaggggcgtttcatggcactgttataaggcttaaatgtgaaggtaatctataaaatggctttggagtagctttaggtgccacaaaatccaacatattgctaataaaatattgttaataataaaaggatctgtgggttcaaaggaacttataaaaattgtgatttttaaaagctaaataactatctttagtaaaacagaaagtatatgtatcatgtagctgtagggggacacacaaattattgtaaaataaatattgcttatcctagctctgcccgtgtggctggggtacagtttaaatttgctgtctaaggggtgatgcgatactaaacatgcttctggcaaggctgctgcagcacctaaggcatttaatttaaatttaaggttagggaatgtaaagatatccagaacatggagcctattagcattttaattcatccttagtatattacccacagttattagatttgggagtccaaccagtgaccttcatataacggggactgcagcctctagaatcttctaccaactgagaggctcacagcgctaacatcacgatcactgatcactaagaactctctggggtggctgtggtgacagtgaccagcctaaggaaagcaggagatgggaaagacactcttattcacagaaccagacttccagttcccagtagagggtatgatggtcctgccctgcttgtggacatttgtaatatgaaaccccggctttcaggaacattccatggatttaaaatggagactgctctgaggatatatgacccacactgcagatggatatgaagtagcctttaatcaacaggagaattctagtttcattatgcacttctagcttttggaacaatattgacacctgcagttagaaaacaaaaagcagccgggcgctgtggctcatgcctgtaatcccagcactttgggaggccgagatgggtggatcacgaggtcaggagatcgaggccatcctggctaacacggtgaaaccccatttctactaaaaatacaaaaaattagccaggggcggtggtgggcacctgtagtcccagctactcgggaggctgaggcaggagaacggcacgaacccgggaggcggagcttgcagtgagccgagattgcgccactgcactccagcctgggcgacaaagcgagactccctctcaaaagaaaaaaaagcttgcacagcatgcatcataactctccccttttcccatacatagcagggactcccacacacatgcttgctgccctcagtcaggtcaacccaaccagacacacaagactggtgtgatgcacgaagtggcctcatgtaagatggagcaggcaggtggtcattgagaatgatttctgggcttctcagaaggcccccatgcccaaaataatacctcctgcatctgctggctgatgactgaaattccacaactagagagtcattcctctggtttaagatgtcttcacccctgcaagaaatataaacaccacaagaagctgaaacactttaaacctgattagccttgagtatcttagcgtgcatgagtctgtcagcatattttccagaagccgaggggaaagaatccaagatcccggagggtcagaacgggaggcaagctgaacaaaggaagggacaacagtagatgcagccatgaaaacagattcataaactccacttatttttcagtgtggcttaaatgtttaagacaaaggcaataggataaaaaccaaaattaattaggcagatatcagacccaatacatttccagggtctgggagttatgagtcatgtcctactctgaaaatgttggaggtgagagaaaagatgctcctctttaactaaacctgcctcatcccccaacccctttaagctgaaggataccccaaagcactccaagatgctttataaagcatccagattgctagataaaatccactaatgaagttctacccgcataaccagcctacagctcctactaccaagaaggagtgaacaccctcaggaccacttactcataatcttctaatagaaatccactagtcgtcttttcaggggcctgccatcatgctcgtgccatgcttccacaccataagatgaacccagaatgactcaaaatggcaacgtccccacttcttcaaaggagaggaaaggaaactcaaaaagaaaggcaatgccttccctttggtttctctcctccttccttggtgggtagctctgtagcctccactgagctgcttcttaaaactaacctacccattccttctctttaactagaagcacaagccccccaccacatatcatttcatggctagggagctaaaatgtcacttgcttaaagcagatgtcactgtaagagaaaggctgggcttcccaccccctgtatctccctaagtgtctgaactctcacctttctaccaatactaaatgttttgactcataaagacagtagcttctcgacagtgagcccccatcccactaattacaagtgaaaattgtgccggtgctcaccagcctgcagagtgcctttctcttcatctcttgccatgaaagcttagccctcttcgtccccctgccatttgagcaatgtgaagatcatgctttaaaagcaaagaaagctttcgcctgacaagctgaaagtcaggtcagcttcccctgggatggctgacttaggtctaagagaattccaattcccggcatgccaacatatacattaaactcaaaatgtgttgcacgttatgagttatgtttctttgttactagcagatggtaaaaatttctatcatctgcaaagttgctcctatttccataaaaattacaaaaatcacattcctcaaatgtatgtcaccaaatgtatttatttattttgcatgaaagtggaggtagccaactgcttcaatattatttatcatttgttgcagatgcataacattcccagaaaataaacctttttaatcaactccttttaaagggcctatttatttttagaattaaaaaaaatagcaaataaaaaatgtagtgaaaacatttttgatcatttctcacttatttgtttttaatctataaattgcggtatcttgtagagctccagccaaggccaattatggtggttaagtagaaatagacgtctaaacatgaaactgtcatcatttccaaaattcatctattcttgatcatacggtaacagcatgaaactaaataaaagtaacatctatgagcccgatggcttttctcttccattgagctcaaaacatttcacctatatgtcccttaattatcctcacaatgccccttggagaaagacactgatggtgaatattatgactaggttaactcttttaaagatcaagaaacttaggataagagtttgatcatcaaaacaatgtcataaagacacactgtgtaaaaggaacagcaatgtccaaagtaccttactcagctctgcccagagaacaggagctatcctggagccaagaagtggtggcacctcttaaaccctgatgtctgacaagcccagtagtgagaagtagttaacatgagccccagaggcaaaacaggaataaatgaaataaggcaagctatttcccagtcagacagagagaaccataaggagaattctggaataaagtctcagctgttataattttttacagcccccaactgacaaaggatagaaatcagtctctttccacagctcacacacaaagcagacctatgtaacctagaattgtggaatggaagatagagaagtgaataaaaaaataaaaaatgataagattctaaagttgcccagcgagggctactgatgtcactatttttatcaagtgctacccattcattagcctgctccaatctctccctaggctgccctactggtgagaaaggtgctggagccaggacagcctgccctctggctgagtcacaggttgattcagcagacccagccagccagggggggatgacctccttcccactgcactcatccacatgcagcctgatgaaatctgatgaaatgcagtttgcttggagcactcgctccaagcaaactgcatttcccatggaggagacttttaggcaagggtatatgaagccaattgtatcccttgactagaatcatcaaaatgttttattcttatttttaaaaaactatccaaactactgatatgtctccagggttgtggggagtctaagaaataagcaaattcaaggagaagagaatgaaccacctctcacctatcttttggaaaaagttatcatgttttgcatgtttttaaaatacagtccttttcaaataacaaaaacacaattcactttcgtccaaaagcattttctgaataccactgtgtcagatactagggagacagggtcgtgattgagccatcctgctgatgagaagacaacagtctggggcaaggagaatggggaaaaggaagaagggcaccaattcacaatcaaacaatgtgagcagcctgtggtcagggcactggcaggggtagcacaaggaatcagcattgtttcctgcaggagaccagctttgagcttgagaaaacggcaggttaaggagatggaaaagaagaagggcttagaggtacaaaatacatggattactagtaagtggcctttgggagtatattcagaggcggttatgttactctctccatacctccataccaccttgcttcctttttttttttttttttttagacggagtctcactctgttgcccaggctggagtgcagcagggtgatctcagctcactgcaacctccgcctcccaggttcaagtgattcttttgcctcagcctcccgagtagctgggactacaggcatgtgccaccacacccagccagctaatttttttttttttttttttttttgtatatttagtagagacagggtttcaggacgttagccaggatggtctcgatctcctgacctcatgatccgcctgccttggccccccaaagtgctggaattacaggcgtgagccactgtgcctggcccaccttacttctttaacaaggtggaattcctcatttaaagtttcatttatgtggtttacccactgctaacctatcattgctacctcactctaaacaggttcgtctgatcccttcctaagagcagatttggtttggagcaaatgcatgaagagtggatgcagaggacacagagaaacactctccccctttttacagtttatatcaggctgcctctaagcagcctggccacagagaagacaatcttttcagatactttgagacctgacaacatgctaacatgctccctgggcatggacctggagccatgagggtgaggaggaagaagaaaaggcataaggaggagagaagaacgttccccagaaactcccctgctctccagagcagcagcgtaagcactgtgtataattaaggaaatttaatcaaacactccaaatttataacaattgttttaaatttaatgagtcaaactaattaacatctcttgttatttataaagcaaatgataaaaattaaaaattgttttttaaattagagtaaagcaaggttgctgaagtgtacttgcaaattcccttcttaatctatagacatagctggtggactgaaaggcagaaagacagtgagcatgggacagaggcaactcagacagagaaggtgaggctgaaggtagaacgtggtaaaaaggcaagaatctcccaactggagtcttttgaagctctgagttgttgtggttgtgatgctataggtgcgatggtggtgatagtggtggtggtggtgatagtggcagcagaagtactggcagtagtgttggtggtagtgatggtgatgatggttatgatggtggtggtggtggtgatggtgatgatgatggtggttatggtagcaatggtgacagtagtggcagtgaaggtgttgtggtagtggtggtggtggtggtgatggtgatgattgtgataatggtggtgatgacagtgatggtgatggtggtggtagtggtagtgatggtggtggtggtagcaatggtgatggtggtggtgatggtggtggtggtagaggtgctggtggtggtggtagttgtggcgatgctgataatgattgtggttgtgataatggcaatggtagtggcggtgatggtggtgggggtgatggcagtggtagtggtggcggtggcagtggtagtgggggtgatgatggtggtggcagcgatggtgacagtggtagtgaacatgttagtggtagtgatagtgatggtgatggtggtagtgatggtgatggtggtggttgtgataatggtgatggcagcgatggtcatggtggtagtggtggcagtggtggtgatgtggtggtggagatggtgatggtggtggtaatggtgttggtgatgaaagtggtgatggtactggtggtgatagtggtggtggcggtagtggtggtgatggtggtagcgatggtgatagtattggtggtgaacatgttagtgacagtagtgatggtggtggtggtagtggtggtaatggtgatggtggtggtggtgatggtggtggtaatggtgttggtgatgaaagtggtgatggtactggcagtgatggtggtggtggcggtagtggcggtgatggtggtagcgatggtgatagtattggtggtgaacatgttagtgacagtagtagtgatggtggtggtggtagtggtggtaatggtgatggcagtgatgctgatggtggtggtggtgatggtggtaatggtggtggtgatgaaggtggtgatcgtgctggtggtactgatggtgatggtggtggtggtgatgatatggtggtgattgttatgataatggtgatgacggtagtgaagttgatggtggtgatgatggtggtagtggtggtaatggtaatgatggtggtggttgtgataatggtggtgacagtagtgatggtggtggtgatgatgacgatgctggtggtggtggtaatggtgttggtggtggtgaaagtggtagtgaaggtgctagtggttaaaaatctgttgaggagtgagaaacagtcaacagtgcatataacaaattcttaaatcctaaagaacatgactatgccccggctcacttatcctggattttccttatgagccaagtaatttcagttctcatgaatgttcactctactttcccccaacagcactataacattggctcaccagcactcctttcacccacagtgtattatttctaccatggactcctcaaaaatatcggtccccttttacttgtttgtctctgaccacaaacaagtaaaggttatctcaatcttaattcaatcttgaaaatattttctgggagcatttctagatctctactttagctatgctgacctgttctaccagagcaggaatgagattgagggtggtctgtgccataaccacttctgtactctatcttttgagaaactatgacattaaagggagtcacaaagtcacaaagacccatagacaagtttaaaccacagtcaccccaaataattttctgggtctatgtcatcctcccaggcccatctggcccatgttaaatgttgctagtaacaactactctacatggactttacatgaattactgcatttaaaaccccaagaggcattctccctatttacagtggagaaacaagaggctctgaggttaactaacttgtccaagtcccataaccagtaagcgacatcacttagatgtgaagccaggcagtctggcaccagagaccaaattcttagactctgctccactgcctccctggggaactgctcactgacaagctttgacaaatggtaccttcatcctttgttagtaaatgctaggcaaaagggtattaatttacagatcatgcctgtttcagttcattcttccaagatctgctatgcctccttggttgatatgtgtgtgtgtgtgtgtgtgtatatatatatataggctaattttaagaattcttctaaaacctataaaatataactggaatatgcaattcaaatgacacagcactagcagtgaactaatactctagtccctacattttttcaaacagaagatttcagaagctgtaaggtaaacagactcgcccattttaccgattttttagtgtgaattctgcatactgaattccttaagaaatacagaatgccatggtaagttcattttatgacagagctagcacagttgagttgctgcaaactggtattggacactcatcagttttttactgatcatttactgagtcccaactccatttctagttcagtggaacgatgactgtttcaaatctctctcgtaaatatactccagtgggttttcgagagatgacagataaatgacagctttgcatttccaagggttaaatgcttttcctgagggatcctaagtcttggtgccatgagaacaagtgtcaggctctaatggaattgttccatgataaataaactgccaggctgtatgacaagcagctttcagagtctttctatatagtataaacagcagaagttaatttgagtttcttaacaggacctttttcctttacaatataaaagtgccttgggatgaagcaattactctgatttaccatcttctccttggtagaatataaagatgcagcagagcctcacaaaggcagtaacttaaccaaatgagacccacttgcaaagtccctactatgctatttcaaagagctcccttcccggcagcagcacagggccgtcatcaatcacaggtgtctgcgatgagaaggatgctgactctcagggcttttcatgggagagccaataaactatttttcctccaacaaatgctcagttaaatttcattttcactttacagcaccagtttctgaacttcagctcctaggaattttaaaagctatctacacaatgagtcatattttataacatgcttatgttttaaccatgatgcccttccctgcaatccttgctgtggccactcaggctcatgggctggtgcctgaagtcagaagggagaagggtgtctgagtcctctcatccaatccccatacttcaggttggtcagtctcacggacccagaaagcccagagaccctcaacgttagccgtaaaaaaaggctcatgctcttcccgaatccaactcgacttctttttctcccaggactactaaggagataggctgtggttgaaatggggtttctgaaaaggactaagagtcaccttgaactactgctatccattgaactgaatcaacttacctgtgaggtagagaacaagccctaggctagaaagaagataaatggaaccgacttttcaaaaaggaagaattaaaaggagatgtatggccccaaatgcctcatgatagctaatcaccctgacaggccaaccatcacggttctccacggagacaacacaggtggaaaccaacagaataagctcactaatgtacctgagaggaaaggacaccctgtgtgaagagagaatgacctgttttggtacaggcagtttgtcagcttagctggaagtctcagcgggtcaagaggacacagaagagagaagtaagacaataaaaatatcagaatctggaagagaacacagagcagcccctgtggtcaccacaaaagcagaatcgggatgtgaggtcaggggctcggttccgcagtcagcagtggtcagatgcgcctcaatttccctcctccaaccttccctcacctcagtcttcacgccctttcctcctctctggggggagccctttctcctccccaggctaactctcccacctgggctctgaggcctatccccccaaccccaccttcccatagatgccactttctcgtgtttgctcttggtctcaattggcttttttgaatcagcaaataaacctggtcaaggcctctctgtatttagaaaaagagaatgataggccctccctgaccctctttcttgccattacaccttctcttatcagccacagttttctgcaaagctgtctatacttgctgtctctctccaattcctggtttccctaaacatgcaatctggttctcctgttcacggccaggcttcaacttcctcatggggcaatccgtggatgcttttcactcccctatctccccttggctagcactgcccttcagaggtctccttccctggccctctggtaccatgagattgtggtctccctcttgtctctttggctgctcctcagtctgcttgccatttttccctcctgtgacactccaggctctgtgcaaaacctggtctcttctcaagtgacagtctttatgggagatgtcattcattccttgctttcaggtgccatctttatgttgatgttgtacaactctccaagactcactcaaatctctcttctcagctaccaattatccaactccctatgtggccttctcaagtcaggtttctcatagacagcctgcatgtccagacttagctcaccaccacaccgaccccaaccccagcctctacttgttgcctgtgtcagcagaccgcagcactacccacctagttgcctgagtcagaaacctgggcatcatctggactgtgtgatttcccatgccccccatatccaatcaaccctctctagacctgtcaactctactacctgaagactgctcatacttgtccaactctctccttctgcactgccaactccttggcccaggccaccatgggctcccttccagccccctgcagagcctcctaaaatgtatctcccggctgctcttcctaccccagcccattcgctcctaccccagcccaatcgttcctcccccgtcaagccagggtggtgtttctttaaaaaagagcagtttggtcatgccactgccctgccctcaggatagcatctcaatctggtagccctgctcatctgctcaaggtcagctcccaatcttcccagtttctatgttatggctccttcctgtgccttgaacacctctgctgtccacctgccctcttcctcctgatcctgaaggtctcactttagtgatttttccctcttgggaacattcccagactcccctcaccaaatcccggggccctatataagtcgtacgtagaaccctccactctccccgataatggcacttcttatgctaattatctgaatcctttattaaaccataccataagaagaaagtctacatctagtttctatcaaactgtatcctcagcacatagaagagtgcctggcactctaattcctggtttcctgaaacacgcaacctggttctccttttacacactggcacagagtgggcactgaataaaacagtataagatacattaaaaatatgtggtaaatgaacgtttgtttcatgctttttccttccttttcaaaatttaggctgtatgcatatcaccatttgaacacacagaactaaaccccattcagatcctgagtcctacattttatttatggttatagaatttagtaatagtgggaatcataataacagtaatattgagcaactgcctggtgctggaaagcttgtaaagaaagtttatatttgttattttatttacccctcaacaaacctccttatttatacaaaacacaaacttttaataaaaggatataaatctaaaaatgatacaagatctgtgccataaacattattatgctcattttatagataaaggcctttcatcaatgaaaaaagtggggcttagaaaatttaaacagtttgcaaaagtcacacaataagtattagaatcgggattctaagttgcatggaaactgtggatattaaaaacaatttaagttctaaaaagtttatgcttttcaatttaaaaaatattatttaatgctcattatacacaaagtaccagctacacaggacaaaaaatgtctgtgaccacaacttccacacaagtactgcggaggacatttctgtaacttcctttggtgaaaactctgtagtcaatcaagcttgactcagaggaagacattaagaattatgaattatttgaattccacagttctataattcattctgtgctagtgacactaaagacgattaattctaaatatccatataacaatgtcagaaaaccaaggggtcttcctatagctgtggcatcactcacaagttcccaatttcagttagacacctaatctatcatacaaatattttacttgattccctagaacattaggaatgttatatatcatggggctgcctaagcatgataattatcacaaatctttaagaaatgttgcaaagaggacatgaagtctactctaacaatgtgtttgtttcctcttaccttaaaatgtttccctttttttcttttcctcccttccccacttttttttcgggggagacagagtctcactctatccccccggctggagtgcagtggtgtgatctcggctcactgtgacctccgccttccgggttcaagagattctcatgtctcagcctcccaagtagctgggattacaggcatgcgccaccatgcctggccaattttttttatttttagtagagatggggttttgccatgttagccaggctggtcttgaactcctgaccacaagtgatccgcctgccttggcctcccaaagtgctaagattacaggcatgagccactgcgcctggccctgtctctttttatgtttcccatatacacccacatacaacacagcaagtccaatgccacaggcaatacaggcagctagctctgtgatatggagataaatttattaatgtgaagagagcccatgaagacggctcttcttcctcgaaacactgcacagaacaacagacaagctagggtaggtggggttgggcatttagttgtatacacaggaagagatagggggagacacttcacatttctccccatccttgatctctgccaactcaacatcaattagtcctctgccgagttagcaggcctccattctgtgggcctccatctgggtttcccagctgtctgggccctttggggtctccatccactggacttcagagaacacacctctcagcttagctgagaacaagccctggctccccgtaagcactcaattaccatttgtagaatggatggatgaataagtatctggtgttccttctcactgaagccctcccttcactgagccagtaaggataaacaatacgtgagatttgcctggtcttccaggacagttaagcgcatactataatacataaagctgcttcaggtacattctggaagcagcagcctcaaggagtagatcaagctagcttttaccaaattttgtttatgactggcacaaagaaacatggaagtgtcaacattgtccttttggaattaaaattctacatgcattaacagaagatactacataatttctgggaaacatactagaaaattactaaacttgaagatgtcttcaacaagaagcaaatgattccagatcatcttagaattacagaagagggagaaacagcaaggcctcccattaaacaagaagaatacttcctatcactgaacgcatagtttccaaggagccccctctacctccaaagatattaacattgtgccagaaatgagaagattcagctaaggtccaagcagagacaagtcaggactctgtgccttaccccctcatctcaagcagggttaagaaaccaatccatacattgtgatcagtggttggcaatgttaaagtgctctgccaaggtaaaatatcatcaatacctaaatgaaagacgactaacatagccaccattcagaaagaaacactatttctccatctcagacaggtggcctgggtaggctgtcattaaacactgacttcgaaccagcaatagcatatttaggaatatactattcatatttagaatttcactacagaggccgggcacggtggctcatgcctgtaatcccagcactttgggaggccgaggcgggcggatcacgaggtcaggagattgagaccatcctggctaacacggtgaaaccctgactctactaagaacaccaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcaagactccgtctcaaaaaaaaaaaaaaaaaaaaaaaaagaatttcactacagaattatttataattataaaacaggccgggcagggtggctcatgcttgtaatcccagcactttgggaggctaaggcgggtggatcacctgaggtcgggagttcgagatggatcacctgaggtcaggagttcaagatcagcctgaccaacatggagaaaccccgtctctactaacaaaaaaaatacaaaattagccgggcatggtggcgaacgcctgtaatcccagctactcgggagtctgaggcaggagaattgcctgaacccaggaggcggaggttgcggtgagccaagatcatgccactgcactccagcctgggcaacaagagtgaaactccgtctcaaaaataataataattattattattattataaaacaaaaataattgtaaaaccaatgaaatatccattcttaggagactggttagtaaattatagcacttcgtacaatagaagactgtagacattgcactggatggagtggatttaaatgtatagatatggggaatatccaagatacaaatattaagtgaaaagaataatttgtagaaaagcatggattatataatctcttgtacataaaatgtgtgtgcatttatagacacatgaaaattttaaaatagttatcttgaggtgaaggatagagtggtgaggagtggggaagaatttatattcttctgctttagttgggggttttactgcaaatattactttttaaatacaaagcattatgttttaaaaatatcgacagtgtaagttttaatttgttctttccctttaaactatctataaacatgaaaaatgtaaaattaaggtagtaactatcaaatacagcacaggattatgtgctacactataccaggatcctggctttccctaccaggctaggcctattttcttcattcttcttccttcctaaccaaccccttccttcctcactccccaaaaatgaactagaccattcagtagctctcctatacaccaacagccaccaagcagacagtcaaatcaggaactcaacctcttttacaatagctgcaaaaaaaaagtaaaatacttaggaatatacctaaccaaggaggctaaagacctctacaaggaaaactacaaaacactgctgaaagaaatcacagatgacacaaacaaatggaaacacatcccatgctcatggatgggtagcatcaatattgttaaaatgaccatactgccaaaagcaatttacaaattcaacgcaatccccatcaaaataccaccatcattcttcacagaattagaaaaaaaattctaaaattcatatggaaccaaaaaagagcccacatagccaaagcaagactaagtaaaaagaacaaatctggaggcatcacactacctgatttcaaactatactataaggccgtagtcaccaaaacagcatggtactggtataaaaataggcacatagaccaatggaacagaatagagaacccagaaataaacccaaatacttacagccaactgatcttcaacaaagcaaacaaaaacataaaatggggaaaagacccccttttcaacaagtggtgctgggataactggctagccagatgtaggagaatgaaactggatcctcatctctcgccttatacaaaaatcaactcaagatggattaaggacttaaatctaagacctgaaactataaaaattctagaagacaacattggaaaaacccttctagacattggcttaggcaaggatttcatgaacaagaacccaaaagcaaatgcaataaaaacagtgataaacagctgggacttaattaaactaaagagcttttgcacggcaaaaggaacagtcggcacagtaaacagacaacccacagagtgggagaaaatcttcacagtctatacatctgacaaaggattaatatctagaatctacaacaaacaaacaaatcagtgagaaaaaaacaaacaatcccataaaaaagtgggctaaggacatgaatagacaattctcaaaagatgttatacaaatggccaacaaacatatgaaaaaatgctcaacatcactaatgatcagggaaatgcaaatcaaaaccacaatgtgatgctaccttactcctgcaagaatggccataatcaaaaaatcaaaaaacagtagatgttggcatggatgtggtgatcagggaacacttccacactgctggtaggaatgtaaactggtacagccactatagaaaacagtgtggagattccttaaataactaaaagtagagctactatttgatcctgcaatcccactactgggtatctacccagaggaaaagaagtcgttatacgaaaaagatacttgcacatgcatgtttatagcagcacaattcacaactgcaaaatcgtggaaccaacccaaatgtccatcaatcaacaagtggataaagaaactgtgattgatatatataaataaatatatatataaatatatatatatataatggaatactactcagccataaaaaggaatgaattaacgacatttgcagtgacctggataagactggggattattgttctaagtgaagtaactcaggaatggaaaatcaaacaccatatgttctcacagatatgtgggagctaagctgtgaggacaaaaaggcataagaatgatacaatggactttggggacttggggggaagggtgggagggtggcaagggataaaagactacaaatagggtactgtgtatactgctcaggtgatgagtacacaaaatctcacaaatcaccactaaagaactgactcatgtaaccaaacaccacctgtaccccaataacctatggaaaaataaaaacaaataaacagagaaaaaaagtgaactagaccaatgtttccacaaacctatcctataggctttaatcccaaccaaactccaggttgattaaggacattccaagtctcaaagtaattcctctgtactcaggcaggcgaaaaacaaaaacaagctcactgtatctattctgatagcacctaatttgcatctgctccagaataatggtggtctctgataaataagctgcattattccccaggatacctcagaagatagcaggtcttctgacaccaggcctgggggcttctctttataaactcaacttgtctccttccaagagatacaggacctccagactgaacttgcagactgaacttgggtaccaaggcttctagaactttttaatttatagatagataacaatttacggaactgccaaggccttccaggaagtctgaattctactctcctggctacagatttactaaccgtctattcctcttccttattcatccccctaaccacatctctcctacctttaaaatttcatcagtactcttctcagtttttgcataaaactgtatcctttactcctatctagttaaactttgctgtttgataaacaagttattatttcttcccaagtaagtatgtaataaaattagaactttagataaaaatgtgttccctgttcacaaatatttacattttaagcagtttttttctgactagtatttaccagtcttacatagcaaggaaatcatcattaataaatgtaacaccatttcttaatattaatgttaagcatattatattttcttaaacattaaaggttgttaactaatagtatctcattactttactatgaaaacattggtaattctgcaaattcactgtccatttacaatccatgtgaattattttagcaggcacattaaattcacaaaagaatgataaatatctgaaaactgcatatcctcattaatcatcaaggaaatacaaaccaaatcaaggtgaaaccatttttacctgcaaagttgaaacagtttttttcaattagttggaaaggtaatattcaataccagtgacagtggtattaggtgacagtggtgtctcccaggcagcttgaggaagtgtaaatcagaagaaacttcctaaaaacaattttgtattttgtagaacattttcagaatctttaaaaagaacactttacttcgataatgtcctcctaggaatctgaccaaagaaaactgtcagaaatgctcagatttatgtgtatgaatttccatcagagaattgtatgtaagaggggcaaactagaagaaacctaacatgtaataatcagaaaataattaaaacattatgtagctattaatactcatgtacctcaataatatttaatgacacaggaaaggctcataatgtaatgttaaatgggaaaaatcacataataatataaaatgtttacattatataaatggatagtgtgcatatacatatatatatgaatatatccataaaataaaatctaaaagaccactaagatgttaacagtggctattcttgagacacagaagaaataaaattttatttttccattttctgttcttactatttttgaatgttttatattaaacatttattattccttatacctattaggatggctactctcaaaaaacagaaaataacaagcattggtgaggatgtggagatattgcaaagaaacccttgagcactgctgatggaaatacaaagtgggcacaactactgtgcaaaacagcatgggaggttcctcaaaaaattaaaagtagaattataatatgattcaataatcctccttctgggtatatatccaaaagaactgagagcggggtcttggagagatatctacacccccacgtccacagcagcataacgcacagtaaccaagagggggaaacaactcaagcgtttatcagtggatgaacagatttttaaagtgtgcacactcatagaatggaatattattcaaccttaagaagaaagaaaatcctaatatgtggtcaatgtgacaggctgaactatgtcccctcaaaagccatatgttgaagccctaacctccagtatctactgtatttggagacagggtccctaaagaggtgtttaagttaaaattgggtcattagggtgggccctaacccaatctgactggtgtccttataagaggaggaaactgagacagacatagaggggcaacagggatgcttgggcagaggagaaaggtcacatgaaaaggcagcaagaggccatctgcagccagggacagaggcctcagagaaaactggccaccaccttgatcatggaattccagcctccagaatggtgagaagataagtttctgctgtctaagccacccggtcggtggcattttgtgagggcatccctagcaactaacgcatacaacacggatgggccttcaggatatgatgctgagtgaaataagccagtcacaaagagataaatgctgtgtgattccactggcaagaggaacctagggtagtcaaattcattgagacagaaagtagaaggacggccactaggggatgcagggagtgggaaaacagcatttgttgtttaatagatataatttcagttttgcaaaatgaagagagattggttgcacaacaatatgaatgtgcttaacgctactgaactatatacttaaaagtaactggttgggcacagtggctcatgcctgtaatctgagaactttgggagaccaaggcaggtagactgcttgagcctgggagtttcagaccagcctgagcaacatggcgaaacgctgactctactaaaaatacagaataattagccaggcatggtggtatgtgcctgtagtcccagctactcagtaggctgaggtgggaagatcacctgagcctgagtggtcgaggctgcagtgagctgagatcatgccactgcacgccatcctgggcgagagagcaagactgtctcaaaataataataataataataataataataataatgataagatgataaacttcttgttatatatatttaccacaattttttaaaagtagacttgagccttaaaaattgtttcacaatgatacatgttgacacatttcattaatatttcagataaaacaccatgtaattttcctcactagctatcagtagcaaaatgacagtattctagaagtttacctcaattttacaataagatttgtcattagggagttgcaaaataaaacaacgagataccgctacacacctattgtgatggctaaaatccaaaaagctaatgtacagcttttgggaaagatgcagagctggctggaatataagcagctggatatggcggcttaggaagatagtttggcaagttcttagaaactaaacatagtcccaccatgcaatccagcaatcaagctcctagatatctacccaattaatctgaaaatgtacgtccatataaaaatctacatgcaaatgtttatagagatttattcataatcaccaaaatctgaaagcaatcaagatgcacttcaatagatgaaccattggtggtatatccataatggaatattattcagcaatgaaaagaaatgaggtatcaagtcacaaaaatacacagatgaatcctaaatgcatattgttaaatgaaagaggccaccctgtaaagctacatattggatgattccaattatacgacatgctgagaaaagctaaatatagagtagtttccaggttggggacaggaaggtagagaaggttgaatgtagagtacaggagattttttagggcagtgaaactattctgtatgatactgtaatgatgaatacaagaaattaagcattggtcaaaattcatagaactttataaacacaaagagtaaaccttaaatctcattcaggagattagggaaatcccaggaagaaaagcagaatgagattatacatatgcattttaaatgtattttaaaaacctcacttaacagtatgaggaaataaaatcctgacccaaataataactttagaaataagtggagtctgtaaaaaaaagacaaaaggaacttcatataaatatcatactctagttgataaagctgtttcccgatggaagtacaggatgataatgctgaaactgctatacatgcatactggaattaaagatgtaagtaaatagatggtgaataatggaaccaagatttctcaatgttgaagtgggtgggattacacatatgcaacggaaggaagttagaatgatccatgtgataaatggattagagctggagacatcaggatgaactcagtagcatatgtattagcttactatagatatagagggttacatatagaaatgtatacatacacacagagagattagtatacacacatgtatttccttgccctgtagctgagtgaccctacacccagtagcaatgagtacacctagcatcctgatcttcatttctaatagaaccagggccacttggaaaaatggctgattctaggactggggcaaaaaatatacaaaataggtctgaggcaccttgtagtgcagaaagcaagaaaatgctcacaacaacaataacacaataatgggtatgtatcaaagggttacaggaggcaattgaaagagtttccagtggctaaagccagagtaatttgagcaacacaataaagtagtattggcttatcacctgaagtataaaacaaatatccatgagtccacacggtaaataaataaatggggaatagctgaatcacccatgtggaagaattccaaataatttatgtagatattccaagcttaaggaggtgaagcatagcgctgcactctttaagaattacagctatatgcaacaacatcaatctcacaaacataatattgagtgttacatattgaaagtatgtcatattgaaagaagcaacacagagaagaatacctactatataactctgtgtctataatgtaccaaacaagtagacttatagtcttggaattcagcatatagttacctctagagaaaagggaaagggtaatgattagaagtatgcctgagagaggccaggtatggtggctcacgcctgtaatcctagcactttgggtgggacaaggcaggtggattacgaggtcaggagatcaagaccatcccagccaacatggtgaaaccccgtctctactaaaaatacaaaacaaattagccaggtgtggtggcgggcacctgtagtcccagctactcaggaggctgaggcaggaaaatcacttgaacccaggaggcggaggctgcagtgagccgagactgcgccactgcactacagcctgggcaacagagtgagactctgtctcaaaaaaaaaaaaagtatgcccaagagagattctgggattctagctgtgctctgttaaacttgatcactgatctaagttctgtcgaagttctcaaagttataaccaattcaatgaattgtgtacctcacactgtatacaaaccaacttcagttcagaaaaagaaaatatgaacttaattttgatgtaatgaagatatctagtacaatttttttcacatggtgatccaattgacccactaatggttaaacagatcattattttcccactgctccgcggtgccaatttttgtcaaaagttatgtcttcatatatgcttggttctgttcctggactgacttttcaattccatgtgtatatttgcctatccctgcatcaacactgtgtgtcttaattactataaatttatagcttacttatctacctatttactataagtaataagaaaaattatttattataagtaatgagtaattaccataagtagtaagtaataattactatagatttaagtcttgatgtcagtagagtaagtccaacaaccttattctttttcaagattggcttgttatgccttatcctctgtacttttcatacatgttttggaatcagcttgccaatttccacatacaattttgtacacaactgttggaaactagtttgggagcaagtacgtcacatccttgcatatgccatacccatatttccttccttgccaaatctggaagcatggagatggagtttctctttgcctgagtccctgagtgaggccaatgttgcaaagagccttcacccccatcaacacattacaaacatacagggttagcaagaaataaacctcattattaaaaaaaattaaattatatggccctaaaactttaggtaagaggaagcattaaaagagaaagatttgagattaactgtggatttattttaaatatctgagctatgataagcttatatgcacacatacactcataaacacaaatgtgggatacgtgaatcgttacttctatatgaaacatctgagttacttgcaactctctgaaattaactcaaaccatttaccagatggtaaattctggagataaatttaaaatatgcaaaacaatgctatctgacatttctatgaaacacagagtacctaattgtaacttaacattttaattttgggaagaggaaacaatatagaatttttatttctaatattagctttgaatgataatcaattctgatttgcaaaacggtctatgttttgttaacaaatcagcatttcccacttgctgtttttattggacaataaaagccatatgggctaagaattcatcacgattaataaaaaagatgcaaattcttataatacaatgttccacataactttataagaacctctgcaacagcttttgtgtatatcaaattaaaatttactatataataaaattatgtagtaataattttcaacctctaactaaagtcatatgattcttcaacatttatccactgctacaccacagtacataaatcatgcaggctaattctcacaatacatattatatagggcacagaattattttgatttaattctcaataagaaccgaagcagtaacttgttattttagactggcaaatcaatagcaaatgcttgttctaagattggttatcactccagtcatgcaagtagcttaaaaactgacatattagcattgacaaaaggattgctctatttgttttccaaaggctttcccgcatgactctatacttagttttatgccaaagaaaatcaatctctttattcaacttgtcaatcagaaaacacatgtagaaacaattattttattgcaacacataaaagtacactgaatcatataggatgaaatagaaataaaatgccaaagtattaacatgcctgtaaacagaattaagacttaaatgcaaaaataaaattaaatatagaaattaaacctaaaggataaaaatcagttgaatagacttactccaatcctcagttttcaaatacaccaatctcttttcatttcagaattttaaaaactcattagaaggactagcttcttccaacacaatggaagtccataaaaacctaattttccctttttttttttaatctgcaaaaactaagctttctagacagatgataatgctggcacatttatatcagaatatcaatgaagaaaacatttctctttacaacaaggattttgagtgattctaaattacactttacataacaaagaaccaagaaatacagatgcctggcttttgatctagtgcctataaaaagagccccagaaaggtctacatggaataccaaggtagaaagcaacataatacacaagatctaatgatcacctaagttcccccggttccatcaaggtcactcaagttcacatgcatgaagtattcaatgtcattcacattaactgcctcatgtaaattttcctttgttttaatggatgagtattgtagggcctggttgtaaaatatgaagtctgacctaggaaaggagtcaaatctttgtcccagtgtccattcccctggggatcctcatgtccccagacttcagctccctgtatcctcaaggccaccaaggaggcagcacaccacttcacaccaccacatcataaacaatacacctgtccaaccatggctctctctgctatggctacaatcaactgcctccatttaaattttagtctctgggcacctgtggaatcacacagatgcacaaagtggcacatgctttgaagacgctcaggccaagacataacctcactttacaccaactctgtcaaaacaaggctgcttatgaagcatatttcactcaagtattagcatcctacatggagccttttattatgctaaagaaatcgtcactgacttagacaacacttgtccctatccaagaatactgttggtgtgcaaggagcttccaagggtgaatagatcacatttactcaacaggagtaagcagacatcccaatgatgaacaaaaatgattgctgcagactatgatgactaaggaagaccatcaaattcttatagctgaagcaacctactaacttttttgatcagccttagcgaagaagcacatgggagcagacaccacaaagtatggtgtagcagaaagagcattacttggagtccacaatacgggctttatttccagctctgccttttagtttacttaagcatttgaagagcaaaaaccttcttttcatctatatatcctcagtacctagcagtgtttgcaaaactgtgaaccctcgatgagtatttgttcaatgaaagaacaagagaatatataggatgtatgtgatcttaagcacttaacatctttgggtttaagtttccaaatctttaaaaatggggacatagtaaggcaatgcatgccttttacactgggttgctgaaagaaccaagcaaactagcagatatgaaagttatctgttaatcataaagtctgttacaatagtacactgcaagtaaagaagcattctttgaattgggggtggtggaagcaatgaggctacttcaaggaatatggccttgaaaagcccagatttctcctctgtcccttgaatcctttaatctacctcttggcttaaaagggtgttcaactcactgagagagaaaattgatatggttctaatcaaaaccaaaaatgtgtgccaagttctgaaaaatacagtgctaaaaaaaaaaaaaaaaaaaaaaaaaacaactttctcaaagtctttcctggcaacagtcaccctcatgaatttccccactaacacaatggcaccaccctgctcacaatgtgccagccctttcccagccaccccaggtccttctacttaataatcctagcattgcccacacgttaccctagcacccattagtatcctaccaacttttctaaaacctaacttcatataattacaaatccatgaagaaaagtgggcgcttcaatcaacttacttttagatttcagaataacaggtaaaatatttgggaaaaaatacattttattcctaccttgcatttaaaaaaatgaattccaataaattaaagaataattatttttaaatgaagccattaaaaaacaagaaagaaaggcaggggctggcatttcttaatcattaaagcaatgagagagaatgtaaaaaaaatggacatatttgatcatgcaatcatatacacataaccacaaagttacaaaattaaagataaactaggaaaaagatatgtgacatataagagaaggggcagtagtctcatgatatatataaagagctcttacaaatgaaaatggttgaaaatcagagaaatatgagttgggacatgaggtgggggtgaagagggagagaaagtagtcaaacaagtacaaaagcagcagcctactccaaacagaaaaaaaaaaaaagaaaagaaaaaaacaaaaacaaataaggaaataccatttttacctaccaaataggcaaagaactaaaaagtgtaaccctcaataacctacagacagctgtgcagagcggcaggaggtctcatgcgctcctggtgacagccaaacaggtaaaatccttctggagggaaacttggcaatatatcaaaagcgttctgaaagctcacgtcctctaatcagtaattctattgttaaaaactgttactaagaaaattaacagcaatgtgtgcaatgatttctgcacaagaatgttcaccatagcacatgttcatgtaacagccaaaatattagaagaaaaaaatctcaaggtccaagaataaacaagttatggtatatttatgtaatgtagtttacaaatgtgttttcaagaaaaatatggtatttaataatagatgtttacaatactagtgaaaatgtaagattcaaaactatacagggtatgatctgaacatgtgtgaaaggcccaaataggaatacacatattttatacatacatgtatggggggtatatttatttcatatatatttatttatttatatataaatatatatttatattttatatattatttatatataaatatatatttatattttatatattatttatatataaatatatatttatattttatatattatttatatataaatatatatttatattttatatattatttatatataaatatatatttatattttatatattatttatatataaatatatatttatattttatatattatttatatataaatatatatttatattttatatattatttatatataaatatatatttatattttatatattatatatttatatattatatatatttatattaatttgtgtataatatatattattaaatataataaatatatttatttttatatattatataaaaatatataatatataaaatatataaaaattaatctatatctatttacaaataaacatatataatatataaatatatgtgggtgtgtatatatatatatcagcgagaaggtcaaggacagtagtctcaacttcaaccttgagtgtttttgtgtttttaattttgttttggaattattggatttggatctctgcagactctgaaatgacgatgggtaaaagaaaacttttcaaggtcaattattatttcaaattagaaaactctaggctttatttctttgtacctgggaagtcctcatcaagccattaagggaagaggagagggtgaagacactgcagccatcagtcccctgcaatgaagtctaagacagaaggatctgcaggagacgcccaaggacacctcagctgggctggcacatctaagccccgcccgcttccccaccactctaagcgctaaagtcgctgtctggtcttactcccgcagattaaaaccacatgagccacctggaccccaaccccattcactttgggattccagccttccagcaacaatcaagttgtcttatattttcctcaaattaaaaaaaaaaaagggctcatttataaaaaagagaagggctgctctgatcaaaaagtgttttacagaaagacaaagagtaaacaatctcaaccattttgtgagctaataacacaaagagagctttgattttatttctcatatattttataaacacaggagagggtgggtaaaagacatcatgtggcttgcagttgaggggacagaggctgggcacgggtccaaaatctccccatgatgttacctgtgacacatacatgcacaaaaagtctgccacataacgaagcatttaaataatttaatttgtatctaagggtcatgggactatgcagcatatttattttcttcttcttcttcttttttttttttttagacagagcctcgctcttgttgcccaggctggagtgcaatggcgttatctcagctcactgcaacctccgccaccgggttcaagcgattctcctgcctcagcctcccaagtagctgggattacaggtgcccacgaccacgcccggctaattttttgtatttttagtagagacggggtttcaccatgttggccaggctggtcttgaactcctgacatcaggtgatccacctgccttggcctcccaaagtgctgagactacaggtgtgacccaccatgcccagcctattttcttctttatagtttttctacttttgaatttttctgaaattaattgttttacttttataatgagaaaaaggtcagcagtgtctaaaatttttgtagttaagtgaaataccaacttcactatatctctttcatcctcaaaaatctacaatggcttccccaatagctatcttatcgaattcacagtccttcaagtgttttctaccagacctgatgtccagaattttggcataacataaaaggtccccttgggcagcgcacagtggctctggcctatagactcagggctttaggagacctagacaggaggattgcttgagcctaggtggtcgagatcaacctgggcaacacagtgagaccccatctttacaaaaattaaaaaactagccaggtgtggtggcttgtgcctctagtgtctgctacttgcgaggctgaggcaagaagatcacttgagcccaggagtcaaggctgcaatgagctatgatggcaccactgcactctagcctggaaggcaaagggagaactcctctctaaaaaaaaacaaaaaggccctcccccatggccaatgacctagcctgtctcccttattagctctacccgttaatcttctgcgtgggtccatattcttgatgtccgggctggctccctaatgggtcatgttcctttacatccatatgccttcgctcactttctaactttgtttgaacttcctcttctccccaccacatcccacttactggctggctctggtgaaagttcccctcctcttggaaacagtccctgaggtgattgcctgtcgcttcctccttgttccaggcaccttgtgctcacattcagtacagactaattttccattgttctctctaggacaggaactcctctttgctgtccccagcacagagctcaatgactagcctcagtggataaatgtctgtcaaattgtgttttcatcttaatcattctttcttataaatttccaatgcagattcactacctcagccttgcaatcatctgcctcagcattaagaaggactgcaaaacccagtaacagcatgtgccatgcttcctcactggaatttcatcaacctaaatgacccatacctttgcccccttttcacgaccctccacgctcttgtcacaagaagcctcccctcccagtgttattaagtaatatgacgattattgcttacaacctaccctgttagactgcaatctccttcatgaaagaaaatgtgacatattatctggaattccatctctcctgagtccctatacagtgttccacccaaagaaagacctccaacccaatgactgcagcactactttgctccaggaaagagttccaaccagctgagatacaattattttactaatttggccaatatacatcattgagtttcaaacattccaaatgttcctggagaccatcctcttctcagttaagaggcagagggaaaacaagatcatgaatcccttttctaatcatgagcaataagagaaacaaaaatgtcctggttttatcagttacatcagaggaccaccatgaatccctgatgagagcaggatgttgaaggagcgaccagggctgatgtcaggtcgcctgcctatgagagcaaggcagaaccagggctctggcacacctgctttgttcccctgctaccgacaggcttgctatttctttcaaagattttctcatggaccatcacaagtgaaagcagtgttagaaaacagcttcagggcttggggaggcagcgttgttttagactggctggaaagtcatgctgagcagcaagaggacagatctcttttagaggagacagccccacctggctgcaccctccaaggaggccacagggcatatcatccaggtgggtcaggtggcactggggctcacagtcaagccatcatcaggttactgcctctgtttcatcactgtgaaagttaagccatgatccaggtctctgggtcttcctgagcaagtcaatgcagagccaaagcctgtgcacaaatgaataacctcacaaggatgagagctgtgtgtgattgatggctctacacaaaccatctcagcaaaggagttcagtaagagccttgtgagcatatgacactctccagctctactaaagtgatagatgggttcacacggaagctactaaatgggcctcattgcaaaggcatggcttcaaccatagctggacttcagggagcacagtgttttcaacatataccttggaaaattcctcactcataagtaaagattacatatgcaggggcccagtgaatgcttgcctaaaagacagtgtaatgctaagcaaaatagtctgttaataggaaaagaaatatcatgattttaattctggagtgctaagtcgcctaatcttcaatgttctgtgttcagatgacaggcaggaagctgagctagagtttatgcttgtccaattaatcaaataacctccatgccacttatccttggaactggcattagaaaagcccccacgtgcccccaaatcatataaatttcacagtttcctagtcattaaatccaggttggcctaatgctgacgtgtcatattttgacatgtagccacaggggatatacagtcaaaattaagaggagaccctgagctaaaactggcatgccctactcggaggaacaatttatgcccacacatagataaaactgcatgtatcttctccaaatgatgaatattaaactgttagaaacatagggagatataattcattgactcattttgcataaaacatttcttttagctttcaaccaaacatatagaagggatatttgcatcatcacaagtacacaggctattattacatgtaattacatgcagactttcaatactactatcacaatggtatttattgaataaacctgcagcattaataaaatcatattttccctggctttaaaccctacatggcttccccatgcacttactataaacgtttatccaacccctcacatcgcctccaaggctctctgagcccatctctaccacccccacaccatcccaacctctccagcccccggcccggccccaccatcactcattctgccctgccacactggccttcttcctttgttctttgtctcttgaacaagctaagagaaaggcccttgtccccgctgttttctttgtttgaaaggctttctcccgaaacctccgtgcagtagttaactctccgatctcaggtcaaatgtcaccccacagagggccctccgcagccaccccagcgagtgctgcctttcacctgcaatcaccattatgcgccccgcactcacttcattttctctagagcataagtatattccaatctgaaatatattgttttttttctgattatccggaccacaaatatataagctccaataagaaagtagtttgcttccactacagggtctagaactgtgtctgacacacaatagatccaccacaagcatttgttacacagatgaatgctgtgctagaaggtggataaagcaagttacagacatggcagcctacccactgggtgctaatgattgagaaacaagtggacaaatagccaagaaacacagaaaaaaaaatttagcagctgcatacttaattatgattaagtaatcaaagttagttgaacatatcaaacgtgaataaattattaagtcaagacatgtcatatggaaatgctaatgacctaggctgggaaagctctctgaggtttgagaatgaggaactttatgaagtttctaacatggtccctgctatggcacctaactgcctagaacatcagagttgcttaataaatactgctgaattttgcaattcttaaactaagaaaatgttaaaatattattttagctttcttagtgaatatttttaaagaccacttgtctataattcgtactgatgtttttctcggcataaataccagatatatgagtatgaaacttaaatagtagaaaaatcatccatggatgcaggtaagacacaacccagaagaatttttttttttttaaacacagagaatttttttttagcctgacaaatttcaaagaggctttgcaagtgcaaacagacttcagctttttcacattcctatgcccagaaactgggacgtgaaaatgccaggaaccctttcaataactagactatgtgatagatgcaggagaaactctccaaccaccaagattactcctatggagctgccaaagaaccagatgcttccttcaaaagcatatcaatttggcggtgaaaaaccctgtggcctcagctccagtcgggaagggcaggtgggatggcatggtgcaggatgcctgttcccacttgcctcagcaaccatcttcttctgacagcaaaactgtgttactcccaggcttgaaggcatgagcaaaatacatggctttgctatatataaggacgggacttggaaatatttggtctgaggccatgcaaaatgaattccatacatggggagactgtaatatcgaaaaagatgaaaatagtttcactgcacttgaaatttttatcttcaaagaaattgaacatagatgaaggaaaaaatagctgcatttaaaaaaaaagtttcataatgcaggacgttagaaaataaaactttttttaaccaatacatataacaaagagcaattgtttttatgactgccatctaccaaaccatcaactgtgaaatctttctctttaatcacgagtttttaaaggctctattcatgtgcatccattttcacaaactcttgtgaaactagcatgacctggcttgaaataataaacccaaagggtttctgttgtagttgttgttgaggcattagtgtttttatttttttaagaaagccaggacttcatttctgcatatgaagctcctcgtggtgttcatcctcacttaaatttgcagccaaaattattttttcagtctctttaaccctggtgggccccctgagagcatgtgtgttctgggcttttgtaattaggcagcttgcacctgagcgtctccatctctagtaattagagctcaccgcggcagtttccttcccagccgatctggccatggggccaggaatgaacacatggaggagtgatgagggtggtgtgcggctgtcttgacctcttctgcaccttaccctacttcaggatggcagggttctcagttacaccaggggtgcctgaaaggcaggacccgcatcctccattctaccctctcagcaccgagcaggatcccctctcgtggaaaacagctcaccccgtgtattcatgcacagctatgtattttgagggaagtggctctttctgttttcatctgtcactgtccactaagatacaaataaagagaaaacctctgcatctctaaatgaaaacactgaacgtattcagaatagctccgtttcacaacccccttccatctatctacccaagtcatagagtgcaatgaacctcaatgtctttttttcaagctgtttttcattctaaacacctaagttgactttcctgtcccactgcagtagccaacagctaaaaataaaatgaatttccctgggcaatatatagaaaggcatactctctcacttttttccttcgtgggctagacagatgcttgctggttcacttgccaataatgatcgacctggcactcgactgagccttcaaaacactaaacatatcaaaggccccaggttaacctctgagatttactttggagtaattaataggtttatagtccttaaaataatctatggatgtgccaaagaaaactgtacaacagtactgtccgtttagaggccccatcaaacatgggggatgtctgatggggcctcgaaatggacagtactatttctaaacctgggggatactccacagcagcctcgctgtccagcaagtcagaccatcacgtcaagcagacatgaagagagagatgggaacaagctagggggatgtggacaagacggcaatctgctttgggaagaagagcatcagcccacagcatcttttttaatctttccaacagaggctccaaagcacctcctcagcccaaccagcctccctgatgaaactcagggctgtggctggtcaggaagagaaatgaaaggaaggggagggggactggccatggcaacagaggtggggaaggggaggagggtgaggagctggccgttttccttatcaagtggtcagtggtagagaagacggtgaggtcactcagaagacaactgagctagggagcagctgagtgccgcagttactacccgccagcaacagtcgcatgttcaccggcgctcttttcttctcgttctgcctctaagaggcacagaaaacagacaagcaactgcagactaatgtacttcttaataagaacagcagctcccgtgactgcgttctcaccctatgtcagatactctgctaagaactgccttatgtcttcccctttaaggctatcaatgaatatttattattttaagtgagggctttcaaaaatacagttgatccttcaacaacatggattttaaaaactgcatgggtccacttattgtaggttttttttttttttgataaaagttacagcaaatgtgcctgcctctcctgcctccctttcccctccctccacctttcccacctctgccagtcctgagacagcaagcccaacccttcttcttcctcttcagccagtatactccacaggaagatggaaagaatgaagacctttatgatgacccacttccacttaatgaatagtaaacatattttctcttgcttatggttttcttaataacattttcttttctctagcttattgtaagaataatatctatcatatattaacagtacatataatacatgtaacatacaaaatgcatgttaatcaactgtttatgttatcagtaggggttccagtcaacattaagctattcatagttgagcctttgggaagtcaaaagttatatgtgaatttttgactgcatgagggttggcacctctaaccccagagctgttcaagggtcaacagcacacactcctgagttccaagaatagtctaccacttgctgatcacatgatctaaggcaagtaactcaaccttcaaaagaaaacctttcttgatctgtaaaacaggaataacagaattaacaatgcatgtaaggcatgtacttagctggtgcagacaatgattctgataacagctaatgtttacattatcctatacctactctatagtgctcacacacaaacagaatgaggcacaagagaggcccagtaatgtgtccagccccacagctagtcagcggtaacatcaggattccaacctataagtctggtaccagagtccatgttcttaaaccattaatctacgatgcctctcaagtaaatagtcaataagtggtaggtgtgaggctgtaggaaaaagaggagacgaagggacaggaaagcagtcctcattggaaaactaggtttcgactggcactgttggactgggctgcagtttaggtcctcccactgctgagttccctcacttcatctcctggtgcttctggtttcccatttataaaatgcaagggaaggattctatttatgtcacaaggtgcatctaaggagtaaaaagtcacgtcatgtttgaccaatgttagtcagatcaagatttattttagataaattatctgttagttttaattaccatgactcagtttttatgttcactttttggtcaaagctaaataaaatatataaatatataaaatctgggctccaaccagactcccacacactctcagccaggcatcttgagcaggtaccgtccctcttgtccaatggctgtgtaaaagtgagggcaggaatccgccttgacaaagaaagttcaaccgtctaaactcagtggatttgaaactatttcagaataggatttctcagaatgaaaacaaatctatgactcctcttaacagccaaaaaaaaaaaaatcttgaaataatgactttaagagtaagactttaaaaatacagatctacactttccactgtaacagccactaaccacatatggcatttaaatgtaaattaattaaaattaagttaaatgctaagctcagtttcttggtcccgacggccacgtggagccaatggcacccgtgctggatggctcggatctagggcctctccaccgtcgctgaaggcgctcttgagcagtgctgagccacatgctacgtggacaagtcaattttcctttaacatgtgcccaatgtactttatttaaaacactgaacttcttataatatttgtcactcctacattattccattatttatgtagtccttccctttgttccttggctctgtcatagtggtgacagaaggtgaatgcaattactgatttacttttctatctccccaaggagacggtgagttccagaactcggtaaatgctgagtcttacaattctcaaaggcacaacacagaccccgtccttattacattaccatcctacaccacgaggataaactccagacaatctgaatacaacttgaaaacatttttaattactcaaaaaataatccgtagtatatattctcaacaatttttttaaacaagatacagttggagtgattaaaatcttgagttaaaaaaagtcagcgattagctctaagccaatgtttaggcaatgcagtaatgcttaagttctttattcaaccattagtatactgatgaaattctctgtaaggagtaaaacatcatgtcctctgtgacaaattaagctacaaagctgtttcctctgttctctgctttctagcttgtattaactagtgccataaaagaaagcctttaagataatatttatttgcagaaacaaacactgattcaaggcacttagaagcacatatgtgcaatgaggggaacacttgagggaatcctaatattttatcatgtcctggatattactgccgttgtacctgcatatctccatactcatcccactctcgatatttcatgtcaagctctactcccaaccaaagacgttctggtgttatacctgcagattacccacaataatggcaccagtaaatatcacgtctcaccctttgtcagaactgtctaagattacataaacatgacatattttaagaaggaatgcatccctgttgtttacaatgtaacaaagataatgccgtgacaaatatcctaagctataaataaagacatttaccattgtactgcacttactcatctctgggttgaacaaatgttaattatagagaatttgaaaatgggacttgttaatgccatttttaatttagcatgttacagtgtaaatgttttccattgtgttaatttacacctgttatcacaagcttcattattaggtttatagtggagcagctctccgtgactctgaaatttgcttaaaatggcagaaacaattactaattagaagggcatgtttactttaattatatttatttcctagtctagttttacatgtaatgtactatggaagtgtatgatttaattagtgaaacccatttatgaagagcaatttctcaaatgagtactgcttacaaaatacaacagattctttcagtgtttcgtaaattccttgggtgatatttctacagagagatatccacatggaaatctttcactcatgagttcagagcatttcccgtttttgttccaaatactgcaataattaccagtaacaagaattcagctctagaaatttttaatgcaaatcttaatatatggtgtgcaaaatgtagaaatgtatgagtataatctttaaaaatctataaccaaaattaacatgggatttctttattgatgttcacgctcacaaatttcaaatcctattttatcaaatcctactgacagtcacactcacaaatttaaaaatcccaccttaatatataaaaagcaaattcggttttttaaaataaaaaagacatggcttttttcctctctgaagtcatttctctggcttccaaagcacaactgccttttgtttttgtcaaatattgaggcacagtaactaccaatgaaataaccaattcaggcaaagatcattctgcgaaagactacggggaatgggatattcacctggtctcaaaagatcaccccacaggctccttaatcacaaaaggaagaaagaaccttatagcacagagaaatctggtggccacagccttattcatgtgaccatacatcccaccaaagggatagtgtgacaccgtgtacttcctgtggtgccacaggggaaggccactctgtcttgatgggatattctcgcatcttataggaggaaacaattggaactgggggacattccgcaagacctagcctggacttttcaagatgctacatgtcacaaaagactttgaaaaagctggaagactattatagattcaaaatgaggctaatgagatgtgacaactaaacataatgtgtgatctctggctagatttcggactttagaaaataacggccataagaaaaattactaagacaattaaggaaatctgaatataaactgtgcactagatattattatattcaggttaaagtgtcctgagttacactagaaatgtttagggattaactgtagtgacctcaaagagtctttcaaatgttcagaaaacaaagtgagagctatcaagagaatgtggcagaatggctagtgaatgtgggtgatgagtattcgcccatctccatgacaccattttttaaacttttctatatacttgaaattttaaaaaatcacagttgggaaaatataaataatccaatgggcagagtgggaggtcaaactaggagtactcctcatacaacatcttacaccccaaacttcaagaaacattactgccctattctgaatgtaagctttctagcattaatgttaaacccattaaaatggcagttactcggccaggcgtagtggctcacgcctgtaatcccagcactttgagaggctgaggtggacaaaccacgaggtcaggagttcaagaccagcctggccaacatggtgaaaccctgtctctactaaaaatacaaaaattagccaggcatggtggcatgcgcctgtagtcccagctacttaggaggctgagacaagagaattgcttgaaccaggggtgagccgagatcacaccactgcactccagcctgggtgacagagcaagacttcatctcgggggggaaaaaaaggcagttatgcttgcaaatggcttcacggttgtctctcaaaatatttagtcacaacattcccatgaagcacattcttcacattgtcacataaacattcttatgttttattttactttttatttttgggatagggtcttgctctgtcacccaggctagagtgcagtggcacgatcatagctcactgaagtcttgatcatagctcactgccgtcttgcagttcaagactcctggatcgaatattcttgtttttagatcccagaaagaatccatgccacagagcagccaagatgtttcttgtataaagactcatgcatcttgccagcttaggtgagagttcctgtacttgctgtctagaaaagatgtaactgcagagtgtgtttcaattttaagatccttactataaggtccactacacagcactgtgcacaagtgtgcaaaaacacactttcttaaaggaaagtaaacgtcagtgcacgtaggattttgtctgaccgagagaaatccccaagcaccctaaagggcagatcattaccccctcatctcccagcagtccctgcttcacatttccacactgcccctgcagatgcagatgggcttgactgatgcaccaatttccatgcaggagctgatgctgacaacctcttctggggatgctgctattgactaatgtggagtaacagccaacaagggaacagtcccgcggaaagaagacctgccagaagaatgccacattccaggttccctgtctcccatcctctcctacccagacagagaaactgcccaacatgctctccgctaatccttgtgactgacacaaagctttccagcaacctatgtcgtttttagaaatgctggggaagttatttacaagagtcctgatttctccccacggcaaagcccatttcttccacctcaaatagtcattcaggtagtcttctttaaatgtggttatcctgccggttagggcagacatcaagcccctttgtttaaatgcgcacccactcccaccccagccctggatgaaacccctggggtagaccagccctaataagggaggtaaaaagtattttgaaagagagctggagaatacgagctgagcccacgcaacggctcccaggaagatgtcgaggggcttccatgaagaactagttaaggcgggagctgatctgcagataaatcagcagctcagcagctttcaactcagtcttcaaacatactgctcttgcaatgttctgaggctgaaaatagatattctgtctccagaaaaggaagaattaggatgaggccaagcttgttaggagaaacaagagaagctggtattgaacctgattagacaggagcatcttgctagtcccctttcccaagctgtaaaaagttaagatgaaaaaaaccagcatggctcacatttcttatctactgttaatatagagtttaaattaaaactcagggggtctctacatggacagatgacttgtaagtgtccgcctctgtgtgttcacagatgtacaacatacactgtgtgtgtgtgtttcaagaagggacagcccagataaagggaggttactgaagcaggctaagtttcagcaaaatgtaaccttcaccttagaaaccaggaaccagagtaattagattacaatctttccaacactatgggagagatttgatcaattaaagccaagatcagttacattatttggtttacctaagtaatggacccttaaatgcaatcaatacttctctaggctgtgagtcttcaagacctgagatgcattcaaaaaacacaaatggattttcaaagggcctcgggatgttcatcacaggctgaggaggaggactgcagagggtggggggcagaaggaaacagacaacagacctgagcttgctgtatgaagtcttcatttccttccctcactgatgtgctgctttcatgttcattttgtagttcatgtatgaattaaatttgttttaccaaagaaccttaatctagggatgagcagccatgtcactcaattcattttaaaattgcagcattaaaactcatttaataggataaagaatacgattaagatttctatttgtgtttctgaaaatccacaaaacttacattgggaagttacgaagaaaaaggcagaagtagctctagatcttctacctcgtcccccatgccatcccttccacaacatggatttagggaaggacaatgacccagtatgcttgggacccagggccatgacccagtatgcttgggacctacctggagctgaccatatcctgccttctagaactaccctggcttagagtggatccataacagtcccgtgttaacagcaaactttcacaccacctatactccttgtccccactctatgtgcagggtctgtctccagtcctcccttacccagacagaggaactgctccacaggaacccaggaaatgctcctgggtttagagattgtgattcaacttggtgggtccatttgccaaatcatactgttttaaagcctaaaaataatgtatctgtatgtccagatagaacactgcccaggccactctcagtccattcactaatgaggactcctgcaggggcagggcaggacagggcgctgcacctgctcacatttcctccagccgccttccccagtacgagcttgagcatgcgcacctgcaacatgtgaggctcttatcagtgattttgtttaacacacttgtaataattagaaagtgaagcaactaattcctgacttccccaagagcagggcttctgttaaaaggtgtggggaaatgtgacaagaggggaagtggagagggggaaattgatcctgagagtttactctgcatagctttgaagtctctgcagtaatgatgaagacaagctaaggtaatctaaaacaacaggtaatcaaaaagtcatttatgtttaccttttatcatcaattatcttcctcttggcagcagttgaaaaattatgttttactcaaaagtcaggctgttgactttatttatacaacacttgaactgtgttgggtgtcagcgtgttagccactgtggaatttcaaattctgctgtttgacagtacccgagagttgactctgagagtggtcttctaataactgtattcttggttcctaaaatgagatgttttagctcagtgccaagagtgtgaaaacacatgggggcattacattagaaacctgggacctgtcaattaatatcattttcctccaacatgaagaaaatacatccagagctcagtcttctcatttatggaatggggataataatgtgtagcttgcctttcatagttgtcttttagaccaggaaagataatgtataagaagcacctagaatcatctttgacatggggtgggagcacagcctattatgatgagacatatccctgaaaaagagtccctttgagtgtcttcgtctttccggctgaatcatctgctgattcaagaagaggaggccatatgcagacagcacaaagggaactcccccatggagcttcagatggtagccctgcactcacttaattattcacgccagcatgaaatctgcctgacatccctcttcctcatcctcttgacagcaacagcattaaaggattaagtagtatttggggctctgaaggggcctgaagagtgtttgtgtacaaaaggaagagctcacaatccaagtacataagacagcggacatcacttgggtttacattgacctcctctgtatctaggcaatggtctcttcaaaatcaagcaccacacccccaatggctgcagttctccatcctggttaaggcctctccttctgaggaatgacttcttccatttaacagtcagtctaaccctgagggctggagagggccacagaggtcattaacacaacctctacacctgctgaacagtgtggcaggaagaacatagggctgtggagtgagaagacctaataacccaagagctaccttggccactgaccaagtgggggcaccttgggaaagttacatcctctgagactctgttttctcatccacaggatgaggaagttgcattagatggattttctgtgtcatcttgcttgggccatggggtgccacacatttagtcaaacattattctggctgtttctggatagaagtaacatttcaatctgagtaaagcaggttgccctccctaacatgggtaggccccagacaattggctgaaagccagaacagaatcaaaaggcagacccctcctagatataagggggaatctctttctgcttgactgccttgagcctgcgacatcagtttttccctgcctttggactcaaaatgaaacactgggttttcctaggtcttaagtctgccagcctttgaactggaactcacaccactggctctcctgcatctccagcatgctgagtcattctgcagatcttggaacttgttgacctccataatcacataagccaattccttatcctaaggatttacgtgtattgttttccatccatcctattggttctatttccctggaaaatcctaatacaatccccaaagatgaactttcatttctaacccctaccaaatggccatctgatccacttgtacacctcttagagacaagactgcactgctccctgtggcacctcaccctgctctaagggcagtggaggtcagcctcttgggaagcactaccccaggtgactccaaagctgaaccagccacattcccacccacaaagagtgtttctccaacaggtgtgatttgacctgagcagatacagtagaaattttatccctgctttcactgtaattatgtcaatgtaggctgagattgccttggttgttattgttgggttttatctcgttttgggtttcctggttatcacatactgttcgttggctcatattgagtctgcagttaacccttaactcattttcacatccatttcactgggtgtggccaaatcaccacctgacacttctgaaagagacttttagtacatagggaaggcctttatattttttactataccaacatcatcttgttaccttagggccagaatttttgcagttcttaccctgtcatctaaagaaccatgtccacctctccctctgtgtcatccagagattggattgcacagtacatcattaaccctcataggaaacaggagatggcacacacgcccttgctgcactccccactagcaccctccctcctggccagtggtctccagctctgacttcacattacaatcacctagaaatcttaaaaaaaaaaaaaaaagaaaagaaaagaaaagaaagaaaaatgccaggctcaacctctgattctgatttagttggaggggctgaggaggaaagatgcttgggcattagtaagaatgctttaggtgattctaatgtacagcaggctgagaaccagtgttctgtctaggccagagatcagcaaactttgtctgttaaagagccagaaagcaaatattataggctttgcgggccaaatggtctctaaagcaactgctcagctctgctactgtagcacgaaagcagccttaaacaatacataataaacaaatgggcacaactgtgttccaatacaactttatttataaaaacaagcaacaggccattttgccccagaagctatttcattagttgatcaatctgttcatcacccagttttaaaatagttgtgggcccagcacagtggctcacacctgtaatcccagagctttcagagtcggagaaggaaggactgcttgaggccaggagatcaaggttacaatgagctatgatcatgcactccagcctgggcaacagagtaagaccctgtcacttagaacaaaaaaaaaaatcgctgtctctctctcacacacacacacacacacacacacacacacacacacacacactggttatggcagcaaatataaactcatcaaactgtattatcacgctagtcacatctctccatcttgtctgtgacaccagagactctcaaagtggctggctgaaatcaatattcactctctatccggcattcccttcatgtatcagacgaatgatcccatctaaacaagaaaaagacttgttcttagaggatcctttctgtctcccattactcactgctgccttattatatgttcacaaacgtctgcttaatattgcttctagaattcctcagaaactgacttaagctcacccatctgtagtttccaaaccatgctttcccccttgaaagctgggacatgtttgtcaaaatcatttacaatcttctggcatcctattctccttgattcacaaaatattatctaaagtggttccacaatcacatctgcaagttccttccgtgcccaggaggcgtaaaggcatttttttagtcattctcattatctcttctatcttgggttttaatgtctcctaaccatgtttattctaccctttccaacttaaagatcatttttcctgataaagatgataaaatcaaaatagaagttgagcagttctgttttgtccatgtcatttgtttactctataccatctgttctaaataaggctatgtccttttttgtggggagtgctccaaatagtattgttttaaaactcttatatacaggcaaccacactttctggttcacctcaggcactctggtatatactgtctgccctggggtaaatacgaatagaggcctctttactctgaaaagtgtctggttttttgaacagctggttcaataagtaaagctgaagaaatggtaaagcactccacagggttcatgggctctcaggtcttccacacattcaagaaaaagagaaaactatttctgttgaaaactttggccacactgggccaggcatggtcacacctgtaatcccagaactttgggaagccaagacgggtggatcacctgagatcaggagttcgagaccagcgtggccaacacggtgaaactctgtctcaaccaaaaatacaaaaattagccaggcatggtggcgggcgcctgtaatcccagctactcaggaggctgaggcaggagaatcactggaactcgggaggcagaggttgcagtgagctgagatcacgccactgcacaccagcctgggcaacagagcaagactctgtctcaaaaaaaaaaaaaaaaaaaaaaaactctagccacactggattcatatcctaggcctgccacttactagttctatgaccacaggataagttacccaatctctttaactctcagctcaactcactggaatctctgtgcctatttaatactaaatgcatgattaaagcacatagcatttacacatatcacatgataaatgctcaagaccaattatcattgccaatattactatcagtgttattaactccctcaacccctccacagcaacatggtatctgtgactctctattggtgcagtttgtccttccttttcagaatgtcacatcttgttttctcaccaatctcttgctactggtttaaactcaatgctacctccccacaatctcgtaaagtctttctcatcttgacaaagaaatctttgtcttcactagaaatctggaatactccaaggaagtttcttctctggcaaagaagcaaccagcatttataacaaacataatttgtgagctgctctggaaagaaatgcaaacgtgtattccatgaatccctcagcaactgtctttcctggaatcaagataaactattattcttcatggttcccttgggaacacactctgaaaacttaggagactgcaactctcaaatagcttgagtaaatcaccctagctagaaaataaaatgacattaactttctgagaaaaggactgacccaaggcatattcaaataggggaatcataaaagggaccacacaggagaaaaatgagtgatagctacagttttagtatcaactacaaaaacagtaaccatttactgagtaactaagatatgccaagaaatggcataccaggcattttataaacatgatttcatggattcttctcaacaattttgctggaaattgaggctcagaggaagcacttgcccaagggacataactagtaaatggcaggtacagcacttaccacgggtcttctgcactctaagttcaagctctttcagacataccatgctacgtgtatttttttactgaaggtgctccaaactagtttttgagacagttaaaaataaaaggacatcatgaaaaaagcaaaaataatatttacatacattttagaaaaaaaaatatataaacattgttggttaagtggatagcagacctttaattagcaattttgaatgatgaaacagccacataggtgcaatgcttctggccagggcagctcattagggactcagtatccgaagtctttctttttttttggatggctagccatgtatacacactgtatagcctctaccaaaattacataccacttagcacgaatgcaagagatcccttcctcgtactataaacaaaaattaactcaaaatagatcatgaacctaaatgtaagagacaaaactataaaactcttagaaaatataggccttgattagcaaaaccttcttagatatgacacgaaaagtacaagtataaaaaagttttcatcaaaattaaaaccattatcaagaaattgaaaagatacacacagaatgggagaaaatatctgtaaatcatgtatctgataagggacttgtacctgaaatatacactgaattcttacaactcaataataaaaagaaaacctattttaaaatgagcaaacattcttggccaggtgcaatggctcatgcatgtaatcccagcactttgggaggccaagggaggtggatcacttgaggtcaggagttcaagaccagcctggccaacatggtgaaaccccatctctattaaaaatacaaaaattagccaggcttggtggtgggtgcctgtaatctcagctacttgggaggctgaggcaggagaatagcttgaacctgggaggcagagcctacagtgaaccaagatcgtgccactgcactccagcctgggcaacagaagtgagactctgtctccaaaaaaaaaaaaaaaaaaaaaaaaagcaatggatctcaatagacatttctctaaagaagataaatgaatggcaaataagcacaggaaaaggtgttcaacatctttagtctttaaggaaatgcaaatcaaaaccacaatgagacaccaccacacatgtagcattgggatgcctatatcaaaaagacacataattaaaaagtcttagtgaggctgtggagaaactggaaccttcatacaccactagtgggagtttactggtagggtcgtaaagatattctaaaattatggtgatggctgcacaactctgtaaatatactaaagccattgaattgtacactttatatagatgaggtgtatggtatgtgaattatatctgaatatagccagcgtggttgttgttttaaagaaaatggtatgtcctcatttcttccaaatccaaggcaagttagcaaaggcataatgagaaaaagaggtctaattttcattcagaggccacatcagtgctccatctggacaaagagtcagccaagaagccaactgccaggagtggaagatgaccacttccaggatctggcagagagactttgcaagtgcctttgaaagaggacaatgaaaatgtatctggcatgaaacacagcaggatccaaagaacaggctttgatattgccagtcatgatgcgtgtctttaagatcacagataacgttctgtgtaacaacaaacacaaaatgcctatgactaagtgtatccttctgatccactcgtgtgcagttagagaacacccaaggggtcccacacacacacgtgaaggggacactcccaacccatgagggaaacacaccctccatcctcctttggttcaaccccagcctccgagaacaggtaatttcataggagcttgctcagctctgtgttatccacaaacttgtcacctttatagtcacttgaagaagttggaaaaatacagtgaaagtcctggtgctacaacagagatgtagcctatgccagataagctttacatgtgttacctcattagtcactcaacacagggtgatcatcttacaggaagagatactgaggcacaggaatgtcaacttgcctaaggtcacaaagctagaaggaacaaaatagggcttcaaacccagtcattttggctccaaaggctatgccttaaccactgtgctaagcgccgcctgcttaaccgggctaccttttccaccacaatttctcatcccttctgaaagatggtcacaggtgttgctgaaatacaggtaacactatagatatatatcagctctctgagctattagataaatgatttaaatatttatttttatttaaaaatatttaaaaattctacttaaatagaattttaaatagttttacatttaggggtacaaaaactttacaaagatagtgcagagaacccttgtatacccctcaccccctggatacccctcacttggtttattctgttgttaccattgacattactacgtacatctgtcacaatgagggaggcaacactggtatgatactattgactacacgctacactttctttggatttcacaacttttttccccttaatgtccttttctgtcccaagatcccatcccactacgtttagagctcatggctcctttgcctggcctggtcagtgacactttgctcagacttcccttgttttcgatgacgttgatggtcttgaggaacactgccaggcatttggtaaaatatccctcaatgtaggtttgactgatgcttttctcactcatcactagacccagattatgggtttttcaggtcacagagatgaaacatccttctcaccacatcctgtcaaggtgtgacatagtcgatgtgaactgatcactgggatgagaaactgtttgccaggtttctccacctctaagttactttctttccttgccctagtgtgatgtttgaagctaagtcccaaagtgcagcccatgctgtaggaatgaggagttaagctccatctccttaatggggagtaactatataaatataaccttatttttaatgatggttaatccgtatggcattaaaaaaaataaaacaacatgccaagtgacagtgtacggcccttccctattgttgctgactctgcagtggctgtaatggcttcctgatcatctttatgtctcagaatcacaggaggtaagaagcactatctccaaggtgacaaaaaagtaaaacaactggccagcatggaaagagggaagtccattccattctagatgatgtttaacaaacaacaggagtcagagaaaggagaaaaaactatcccatgatggaggcaacacatgctgcatgtttgtatgggcaggtattaaactggaagtttcaagtaagtttccaagcaatgacagatataaatttccaaagtgaggtgccaggctctccaaaggagcttttcaaagttaatgtgtcataactagattcatgattttttataccccgacctactctgagtgagaaacagaagtcaacagagaattttgtttttctttgagggggaaaaaaagagctgtgctgtgatcccctccaccatcaccaaagagatgggtagcacagtggagggggggggggtgccgactctcaagtccactgacagaggcttcaaagcagaaatgcacagcacttgatataatttccgtagaattttggaggcctgctggactggcagctggtacacagctaaaagatagaggctagctaaaattgcactgggaaggacctgaactgcattctccctctgaagtggaggaaaggcaccttaatttgggaagccagatgtagaatttatgatggggatgtcgaccaaggtcatcctgcccaagagatttcttccagggggtcagatggacccagcagggtctggatgaggcagatctcataaaatcagaagctgcgagcaatgtgggagcaagggaaggcaaggctgccagagtaaggtggctgcagttggaggggcccagcagaggagcacacggagtgcccatgtggaaggccctttaaaaccagctcaggcttccagaagtatggcagactaatactcttgttgttttactgtctaccagtaatgaatgaatgaaaaccaattattattgttttgttgggttcagaggaaatgaaaaaaaaatgtctacaggggcaaaaaggaaaaggaacaaacagtaacaaccaaaaatccctgggcagtgagcctcagaaaaggggaacggtcctgtgaggacatgtggtgatctcacgtgatctctgggaggctgggcctcagctctgtggctgggtgggggaactaaactaaaattccggggttacatggcagcatctggaaggcaatggaattgtctcaggaccgcagtacccccgcaggacagcagcaccctatgactactggcaaaagcaaaagcaaatactctgagaaaagcatccttgacttaggccccaagactttttctacaattaggatcaaccaaatatgagctagcaattaaggtttactaaacagacagggaaacgaaacatcaggagtgagagaaagaacagatgcaaagtgccaaggacttcagatgcttcagttaccaaatactgactataaaataactacatatgaaaggctaaagaagtaaaagacataatcacaaaaataaataagtaacaagtgactatcaaaaatgaccaggcagggctgggtgcagtggctcacgaccgtaatcccaccactttgggaggccaaggcgggtggatcacctgagtccaggagttcaggaccagcctggccaacatggtgaaaccccgtctctactaaaaatacaaaaattagccaggcgtggtggcacttgcctgtaatcccaggtactcgggaggctgaggcaggagaatcacttgaacctgggaggcggaggtttcagtaagccaagatcgcgccactgcattccagcctgggcaacaatgagcgaaactccatctcaaaaaaaaaaaaaaaaaaaaatgaccaggcagtttcagctttgcaaactgaaaagagctgtggagattggctgcataacaacgtgaatgtacttaatattaactgaactgcgtacacttaaaaatagcgaagatggtgaattttatgctatgtgtattttaccacaattttttaaatgacaaggaagattttaaaagaactaaaactttttaaaataaaaactatgattattgaaataaaaaaatttgctagcaagattatacagcatttagtcaaagctaaaaatagaattagtgaattggaaggaagaaatgaaaaaattacctaaaaggcaatacagtaagacaaggaaatgaaaaatataaagaaatgttaacctaaatggagaatacaatgagaaggtccaaaatatgtctcatcggagacctagaagaaaagaatagaaaggaaggaggaaagggaatatttaaggagatgataactgagatgtttccaggagtgttaaaagacataaatccacagatatactaatcagggtaaatgaaaagaaattcaggctgggcgcggtggctcacaccttaaaccccagaactttgggaggctgaggcgggtggatcacctgaggtcaggagttcaagaccatcctgaccaacatggagaaaccccatatctactaaaaatacaaacttagccgggcatggtggcatgcacctgtaatcccagctactcgggaggctgaggcagaagaatcacttgaacccgggaggcggaggttgcagtgagccgagatcgtgccactgcactccagcctgggcaacaagaacaaaactccgtctcaaaaaaaaaagaaaagaaaagaaaagaaaagaaaagaaaagaaattcaatctaggtgattgtcataaaactgataaacaacaatgataaagaaaagagatgttaaattgcaacaaggcccagaaaacacaaagccagcatatgaccagacccagtgagaaatcccttctatttcttactatcacctacccctcctctactccttttctccccagcattcactcaatgagaaagagtagctggagcgggtggggagagtatcaatatgacactaaacctacctcctcccacataatctggatggatgcctacagccatgtcttcaatgggcaaggaaagtcttactttcgcataagtgaaatttctgaagttctcattaacatattaatattcttgactgaatatctgaattgctactaaattaagatggtgtgttttcaacttaacacaactgtccaatgtaggaagaaagagagacatgtgagttagccttcctcaacaaaaagcttgtgataaattcctgttacctatgcattgcaagttgcagaagaaaccaagtctatctctcaccatttgctttcccagggtcaaaaaccacaatcatcttgataaacaaggcctatgcaaatacaaaaatacatcgtcatgcagcgataatttcaatgcctgcactcacctccatcccatttctaatatgcaacgtattaactgccaactcattgtgaaaagcatctacgctgttctcttttttataaattctatagattcattatgattagatactctccatatacatcagctagccagaaaaggggaggagataatgaataatacccaagggaaggaaaatccctttttcagctggtttaagtcatgccgataatgtgcacacagcactatgcatttaccataaagcttttcaattagttcatagacaagttaaccttctaactcccagaaaatataattcacgcacattttataccacacagcatcctgctagctattatccatcatttacaagtgttatttgtctataaaaatgacactaaagttttgaaaaacgaggctgctctgccttcttctggctgtgttttaacaaatggtatcaatgcaaaaggcttataaaaagtcatataaaaagcaattagtcaaaagagcaataaatttttttaaaaggatataaatgactgcctgtctagatagccaaatgtctgaaggctgatacacaatgaaataagggttaacataaaagagtacacttcattatttattgttaataaagttaatcaaattcagttcttcttacgcatgcatttaaacagaaacacaagtacgatatgcatatttatagaaaacagccctaaagatcattatctctaaaagaaaatccagcaaaaagagatgcataaaatgtagctgttacccttttacaacataaactgttttgcttaaaacacaaacatttattttaagtaaaactattaaactaaataatattttccacaactgacaaccatgactaaaacatgaattctaggattaacattaaaataattttgggacagagggaaacagaacccttccatttttcttttgctggtatcttatccacctacactagttttgttcttccactcaaaaatctattctcaaaagatatattagaatctttttaaaacaaaattagataagcataagctcatcaatcagcaatttctaaatgcattatcttcaagtagtttggtcttttatgtcacttatctgcttaaaattaagtataaaagagtttccaagaaaagaagatataaaattaacttcatttcataataagttctccaatcatgccagcagacagctgacattattacagctcacacttataaatcagtgattatatacactagttaagcaagaaaagaaatgaagaaggcaattatatagtggtgaaattcccaagaagcacatttgtagtcaatgttgctaaacagtagttcactcgtggttaaaataaaagccccctccccctgccagatatttttggggttgtgagttttgaggggaagaaagtagaaactctatgcaatttgttttacaaataaattaaaaagccagcaagaaatcaatgaactgtaattttaactcattttactgtttactttggagctgaattctaaaacttccatatgacattaagctataaaatagtactgaatcaaacggagagtagaatactttggaggaaggggtggtatctgaatatctatagacatttggtaatgaacgagccagtgacgaatgaagacacagggaactgagctgagcttggtttccacaccctcttctgttccctgccacttgaataagagccaaaatgccacttctaatcttattttccatttcttaaatgtgttttattaactcctcttttattgcaaagctaaatattctaattggcacattatagacatacagctactagatgtcaattacactttaatgtgtttgtaatgctctgcagcagtgaggttctggcagacccagtgaggtcccatttatttcttcacttgtaataatggcatgataatacaacctgagtagtgcatcagaacacagtagttagcatcactgcaagagaaacactctcttccatcttagttatattgctttgaagaaatcagatatcctttctactcattcaaaaggagaaccgaacaatgctgattattcctgaaggaccttttgattttcaaagcatttgctagtaatctgttaattaatccacgcagcccctccgcaaggaaaactagaggagaactgcgcaatactgtactaacattttagagacaacaacaggaggggacagatatttggagaacctgacaaaagtctgagagcttctacaaacacaacctgcagaaaatgtcacttgattcatatcttcaactccagggttatgccctgaaggaaatgcactcatgatgatgtgaactgcaattcgtggacttgtatcttcatctaaaccatcttacccataattcattcccccttacctagcacactttaagatctgttcatgcttccacatagttaaaaaaaaaaaaaaaaaggtggggggagggtgtagttcaaaagacagacagataatcctaaacccctttcgtcccaggacttagaaagcttattttttccagtccaatatacagccaaaggaaggagcaggataatctacaagggaaagtgcctcttatctgtttccttcctgagaacaaatggaccaagcatacagatgtgagtgtacacatgtgtgcacacatgtgcccctctcaaagtgcatctgaagtaaattaaaagaatcctttctgagtgatcagtctgttccctgaaaggtcagaattttctggtaaatattttttataactccaccctgtctaaacagcaacaacgacaacaaaaattttagctaaaagcatgcttgaagaagagtctaaattccattgataagccaatagtggcattaataataatggcaattaataatgcacactagcatgatgttgttttctgtagcacatttttctagatatcttaagactctcggtagcccatatttttatcatccctctccatgaggtagggcaagggtacttattatccctatttcacaagagaactatgtcctagaaaattaaaagacttgtctaagctctaaactggtaacaaggcagagacatgaatttgggtctccaaactctctgctaactaaataatggcccagaagacatacaaaagtcaacacaaacagagtgccagctgttatttacactgcctacaataaatgtttgttccagaaaaaatagttcaaacaagatgagaaatagtttaaacacaaaaggctgaagggttcaatataggagaaaaaatatgtttgcttttaatacagtggaggaactgttcaggaacagtttgttcttctgtaaaggctggccttgttgtactgccgaaggccgcaagatcacaagctacgtggaattgagacgccagctcgcttcggcacaaccaacttctctcttaatgctctaagttcctgtcttcttcatagctttgacctgaaccatgaatgatctttttgacaaacaaaatttaaatgtgtgttataaacagggagcaagtgtcctaattttgatacagggtgctaagaaatacagaaaacaaaggaaattaactgggagatccagggaggctaagaaacaatctgccactgggagaaacagccatagcttctgatgagctaggaagattttgtggttgatatcacagctgtttgttgaggctgtggtgggatttctttttcaagagggtgaagggagatttgaacttggcgcctgacacaattatcctaaagtaggaaagcctcagttggaagaggatgagtttctttaaatagcccaaaggctgtgatgcgtaaaaaaggacttgacttattctggatagctccagagggcaaaactagcaagtggccagcaggaacacacatactcagagtagagcagagcttgctaataattaggactgcctcatccatagcaaggaacactcagaggctcatctcctctgaactacttccagctgggactcccgacgcccaccatcaaggatgctgggagggaaatcccacattagtaaagatgatggacaagataaacgctaggactctttcaactgttaggatttgagggtgattttcaaggtccccatgacagtcacttccagactatgaggtggagagtcacacagaactgagtcccaacctcagttctatcactttgggtatttttttctccttagatggtaaccaaaccttgtattttttaagttttctttgaagttcaggggtacatgtgcaggtctgttatacagtaaacttgtatcatgggggtgtgttgaacagattatcttgtcacccaggtgttaagcctagtactctctagttattttttttttatcctctccctcctcccaacctccaccctccaacaggccactaaaagaacaagatcatgccctttgcaggaacatggatggatttctatcattttttttaactgtgtgatactgagtggctctgccacccaagtgtgacctccaaatcaaggtgtttattagaatcaaatggggaaactacttaactctaaagataatcagatctataccccagaacttcaaaatcttaccctccagaggggggtccaggaatgtccattttttcccatgagttgctagcagtccaattttggaaaccaccaataaacatttttagcctatgaattcatttgtaaaataggaaacatgatagtttttgcctaaatgagtcatggagatatttaaataacacgtaaaatacctagtatgatgcctctacctagaaaacagtcatagtccctttaaaaaacattttctgcaatatatgatcaagcttaagagcattcactgattaaaaatgaggacagaatggcttacatagagttaatgtttagccatctcctattttcttgcctgttttttaatcctgtcttgttcttcaagcaacacaaaatcagaaagaaatttgatacgatataacttgaatcagtttaatcaaatgccttatctatgtgaataatgccttaaaattaatgtatcatcaacacgcatttaaaagttgaatgcagtaatagaaagcctatgattttttgctcttttataataatcagaagctccagatataaactcctcactcaaaaaagtttaaaattcatacatatctccccattctcaggtaaagataaaagatcccatgtctcttctcctctgtatcacgcagttacactcactcctttaaaatcctgcaaggtattgaagtggaagaatcatcctgtcctgacatttatatctctacaaatggcttcagttctttaattgtgaagttgcttctacacattagggtgagtgttaagatactcccagacagaaaggaagagggaaggtaattggagtaatttgtatcaagtgaaaaaagtgtctcctggatttctgtattcctagttgcaagttattagactgtttctgtttgggtggttttataaaaaaaaaaactgtaaaacgtggttgcgtaagcacatctaaaggttaaactccaagcagctaatctgcatgtgagaacaagtaactgtcaaacatttaaccttttgcagattaaaaccgtctgactaacagatgtgaaaccatcgttgctataattgttagaagtagaaatctgagcatttttagaagatacaacactttttggagcagtcatgtttatgctccaggtcaactttcctgttcatgactgagatgcaatcatagcctttcatttattttcacactgtgattctcctgaattattatacgatgttcatagtttattctacagacatgctcttagaaagttataagttgaattctaatcgtcagttatatttgcacaccgtttcatacatgataattttttttccattaaaacacttagttttcttaacagtacatgataattttaggaaggcattagcttcatttccaactgatccaaactggccatggctcctgaagattctctcttcccttccatttctctacgctcatttctgtcacataattacaagtgtcagctcatggtagatgctcaaccaagatctgttgaatgaagtaattatctttaacacctaaaagatctactccctgaagacatttttttcacgaaagcctttttttgtattgcaaattgccatctctagtgaacttgcgtgataatttttaattttaataaatgagatttttcttataataggatatattgtttctggttttcagtattaaaattgctgataggaatgaacattttgtaatatataaaaggacgtgacagaataatactgtagctaaatacttatccagcacagtgtagatactcaaatatttgtttaaaattactctacatttcagaagttgtggcattaaaacatttgacttgaaacacactgcaatttaatgctacatttcttcttgtcaaccagggtctaacagtatatgacctgtttctaagaagaaatagaatgtatgcaaaagcttttaattctggaaatgtcatcatatacaatagagaaaaaaatttaaaataaaaatgtctaatactagaagaaatctgagatatcttttacacgaaagtataaaagtgacaggaggggttcaagtctccgaattctgagctttttatgtgaatagcatataaaacatgaattgtgaaatatacagtagaccatctgtgagtaagatgactccatgatgccatacttgacaaacacggacttagatctgaaaaacacacaaagcaagcatccactttacccacgaaacacgtcgggagagaggaagtgtggttctgtgaggcccctggtctgtagaaagaaaccaccacgctctggctcctgcctgaagctgcacaaatgagctggctcagtattagtgtcttcttttaaaggttagcacctttaaattgctggcatggcgattggtgggagctagaaggggtacccctaaaaattcttcgagcaaaaccgtaaataccaaattacgacataaaggggctgctactttctttacaaaacctcggctgtggcttgtttctcctccgtgaatcaactgtctttttccaacaaagacacccacttcagggtttcaagggatatctattcaaggcacgtactgtacagcatatgtggttatctacaggtagtacagcctgtaaacctagtttgctcaactaaatagcatttatcatgtatttttatgccttctgacatctgctactaaatacaaacaatgaaagcatctccaaaaactagagatttctactctaggagatgtggtggctggtaaaatcacctgcactttaaccatggaacaagacatttcccctccccatgtccagcccatgcccagactgtcctctaaatcaggggtccccaacccccagaccataacagtccatggcctgttaggaactgggccgcacagcaggaggtgagtggagggtgagtgagcctgagctccacctcctgtcagatcaccggcggcattagattctcataggagagtaaaccctattgtgaactgtgcatgcgaggaatctgggttgtgctctctttatgaaaatctaactaatgcctgaggatatgaggtggtacagtttcatcctgaaaccatccccaccctcacctcctcgtccatggaacaactgtcttccacgaaaccggtccctggtgccaaaaaggttggggattactgctttaaatgaacccttggcctttaagggcacatgctgcacacctggagctggacccatggagagctgatcctgagttgggctggggcaggcttgctggccgggctataccatgagctagctgcctgtcctactggtaaagcctgcaaccccagagaaagtgcccatttcagaccaagaagggaggtgctcacaacaaacggaaacatctctgcagtcacaccaagagctgcacccttgttcctcatgtgtattaagtgcaggattaatgccatgaatgctaggaatccaccatatcacaaacactgacctgttgggtcaaccagtttccaaaataacctcattgctgtttcttctcgtttgtattttatctttgccttttcaccttcatttccctctttcctgccatcccttttaccttaactgagttctttgtttcctatttctgtccccatattaaatgacttggctagttcactcgttgattaaaatacgaagaagttattgttggaatgagacattgttcactgcaatgtcttttttcgatggagaacaagataaaggccaacgctgtgagtgtcaatgttgaggacaggttccctaacttcagcctcagaggatcttcccatgctgtagtctaacatgctgttacaggttgaattgtgtccctgcagaccccacaatattcagatgctgacatcctaatctccaatgcttcagaatgtgactttatttgaaaatgaggttgttgcagacctagttaagatgaggtcactctggagtagggtgggcaccacaaccctgtgtgactggtgtcctcatgaaaaggggacacgtggacacaggcatgcacacaggcagaatgcccagaaaacatgaaggtgtcgggtgatacatccacaagccaaagaacgccaaagatcaccagcatccaccagaagctggagaggcatgaagggattctccctcaccaccctcagagggaaccagccttgccaacaccttcctctcagccttccagcccccaggactgccaggtgacacacacctgctgttgaggctgtccaggctgtgggactttatagggcagcttcatcaaattaatacatatgccatgcattttctctgtctaccctgaaattcaacaaaatgtgttatttggtcaaataaaatgaaacacagagcaccaaataactaagacactaacctctttctcaaataaaggcaagttcatatatcatagtcagaagttaaaaattaaaagaacaattgtcgttgtctataatctaaaggttgctgtcaagggcttttcagatgacctcttcataggaatcctgtttattctttgcctgtgaaaattttgtgttgcacctaagtttaaaattgtaaataaggaacctaatgtgcaaaatgcaacactttacttcatccatgactttacggacctgaataagagactaatgaaatgagaaattgttaaattacaaaaaacaagaacacgtgatctgtataatagggtactataaacacagtcatatcagaggaactaatctctcacaagtcagaaggagactgagtagaaaactgcgaacgaccaccacccctggtcccttgttgtaactcagccacggacccaatgctgaatcgctgcaagccttggtttccttgtgtgcatccgtcaggtgtctcaggcaaggctgcccgctccactgtctcccgatctaacggagctcaatgactttgctgcgttttactctgctgacccctcactccttggaatttcccacttcctgagctcctggacttttctgcctcctggccctcctcctgctctgttcctcctccacctgtccaaagtattcctcagtaccctcttgttcttgccactctctgtgttctcccaaagggagctggtccgctatttccctgcctgcatgtccaaccctgacctctcgcctaccaagagcagtctctaggacagcagctatgttaataatcatgataatatgcttgcacttacgtatatttatactgtgctgaacactacgattttacagtggatccatacagtatgaagcaataaggtgacttaaaaaatggtttgttaatagattagtttctttaaaaaggtcaacatatcccagcactgtttacagaattctttggtttaacaagggcttttatctcattttacttggtgaaaagttaaagcccagtttgtctctgaattctaaattagacggtacacaataggcaaagtgctttcaattgcatccaaggtgaggatgtgcaggtccttcctaagactcaacacccagttagagataatggacaaagccccagccgagggcttattgaccttatttatgccaataacacaaactctgactctggagaattaagggatgttggaaacagtcactgccacttggaggtcaattaaagtccacctttgagcactggtggagaggaggcaggaagcctgcagagataaaagtatcctaatttaaatgttaaaaggaccattacaggatcttaattccttctagcaaacagagcatgtacttagatgacaatgagtataaatacaaccactctagaaagaaaagacaggagctctctgctccaaagagtattacagctttcacaagaaggacctgagctaacttctcatgtttgtaggtgggcgatgggataagtttgcagaagacccatttacggggaccatgggcaaacagaagcagaccatgaactaagttaaaattcaaggcccccaggtaaaccagggcaaacatccctgactccccaatccacctcttctaaaactctcttaagaaacaccatgatcagtgtcttcatttagcaaagacgtcttcaagaaccacagctcgtgtttggggcaatcattttgccccctctagtgagggggcatttctttatattaaagccctgagaattaaagaaaaacaatatgcagaaagtgcaacaaattattatccaggctgtgtgcttctctttctcagaacattctattaagattcttcactaaagaatgcccttccacagagcaccaccagacaagagcttggagaataagtacttatatttcctagaaactgtcagaccagaataatcccatttctagaaacggcaacaacagtggccaaaaaaactgtttattagggaaataattatggaaatttcactataattagggaaaatctcaaattctgtattttatgtttccagcttttactttttctgataggttctggccaaattcccagaatgcatttatctgatgatgtctcaagtgatggcaaacacagaatattatatttcagttgtttgcactgcttgtttctccatagttcccaccctcgatgagatgttttgtgcctttggaggcatagtgctgtccaaatgctttggggcccgtaggatggagcttggtgtgacctggctacttaagacacagccacacccaaaggcagctcagattctcctttaagaccctggccagtgtctctctgccattccaggtagtgttaaatctggtttgtggacaggttagcatgcaaagcaaattagaatacaaaaatgggctgcagacatgtaaatgtctcaggaaccaagtgagtttcctctgatgacatgaatgtctacgtcaaatcagggtatggatgcagagcagctggtgttcatggtgaaaaagatgtgactcaagtgccactgactgcttctcccgaactctgccttatcctcaattatgtctaactacaaaccgagatatcttcttatctaatgcagtgacaattaaaatgtcacccttgagatagtaagagtagggcttctgctgcagagaactctaaagacagtcagtatcacattcagactgtgtgcaggaatttcttccccacagaggatgtgacaacttcccagggctttaaaaaagcctcgatacctgaaagtaaatacacgtcaccccaacatggaaggcaatgtggtcactgcaggtgaactctcaaaatgtaaaacctaatacctcaccaagttgcctaagagacaggtctcaaaacacctatggctccagccccgggaacccatttcccttttcctctgcaccactgagtccaagtaaacagcacactctgcttctgaggacactgaggttgactccattcgagctgataaaactgcctccccaacatgtagttctttttccattttctcccctttttccttttaataaattccctgctgtggtacaagggaccggaacagtaaagctgaaagtctctcattaattataaaaatgatttaatctgctggaaatatttatttccagagagggaagtgtggtgtcccagctctgtaatgctatcaacgttatgtatgtgcagtaagtagaagaatggctccccaaagatgcccacctcctaatgcctgcaacctctgaatgtgttcccttctatgacttaagagactgtgcagatgtaagttaaagatcaggcctggccaggcacagtggctcacacctgtaatcctagcactttggaaggtcaaggcaggtggatcacttgaggccaggagctggagaccagcctggcgaacacagtgaaaccctgtctctactaaaaattcaaaacgtagccgggcatggtggcaggcacctgtaatcccagctactcagggggccatggcaggagaattgctagaacccaggagacagaggttgcaatgagccgagatcataccattgcactccagcctgggcgacagtgagactgtctcaaacgaaaataaaacaattaaaattaatcttaaaaataataagatcaggcccaaggtagtcgctaaggcccttctaagcaaaagaaggagcaggaaggttagacaagtgagggccagagtgaggaggttgttggctttgaagatggaggatggggccgtgagtcagaatgtggagctcctctagaagctggaaatagcaaggaaacagattctcccctagatcctccagaaggagcacaggcctgccaacaccttgatgttagcccagtgaaacccactgtggacttctgattttcagcactctaagataataaatgtgtgctgttttaagctgctaaatttgtggtaatttgttatagcagcaatgggaaactacagtatctgttacttcctccttcctgatctaatccaatctaggagtttggggaagtggagggaggaaatctagctaatacccaaattctctttctctactatttccactaccaagtatctgttccattatcagaaactaaccaagtgatggtttatttatctggaaaccactcagcatcatagagtttttaaggctggataaactagaggccatttaagccaagcctctaattttatccaagagggaaagaaaaaaaagaaaaaaggacaaagaagggttcaaggaatgcccttggacaccagttaatgggtgaattttgctggctttctaatccagttctctaaatttctcatctcttgctagtattgtcgacaactcactccttcagaagcattcttcctgccctaagccagttcccttggcaaattttcctttaaaatgaatatttcaattagtaaactacacatattttgcatattccaactagaaagcagcacagactggccagcaaattcatgccaagctagactggctcaaagagcttcagttcatatgacaacatccgttcacaggctcagcccaggtaccacattatcaaagattgaaattttgaaacctggtgaattcagcttctgctgaaatgcagaagatactgtaagcgaatatacaggtttgtcaaggtctatgaatttcatccaaaatactaaggagagtttttactaccctaaactcacagcttttacagggcttgtttttatttatttatttttttgaaccaaaatcatagatttagagttggaagtgacctttgtgatcattatttcaatcctttcagagaattctctctgcaggaatatctatgtaggacttggatttgacccaagcacatacaatgtctcagagggctctctgctcctggccaagagcatcaggtcttgtttttaatataatcagtgttgtaaattatggcacagagaacaggctcattcagctgtggaatgaactgagttaaatggacttgtaaacatccctaaatgaaagaattaaaaagtcaaatgaggaattatatagccgtcccttggtatcctcaagggattggttctaggacccctggggataccaaaatcctaggatgctaaactccctgatataaaacggcatagtatttcaatataatctaagcacatgctcccatatacctgaaagcatcgctatagattacttataatacttaatacaatgtaaatgctatgtaaatagctgttatactatagtttctttatttgtattattttttattggggctcctttgctgaatattttcttttttttttttttttgagacagagtctcactctgttgcctaggctggatggagtgcagtggcgtgatctcggttcactgcaagctctgcctcccaggttcacgccattctcctgcctcagcctcccgagtagctgagactataggtgctcaccaccacgcccggctaattttttgtatttttagtagagacggagtttcaccgtattagccaggatggtcttgatctcctgacctcgtgattcgcctgcctcagcctcccaaagtgctgggattacaggcatgagccacagtgcctggccttttgctgaatattttcaatccaagtttggttgaatccacagatgtggaaaccgcagatatggagggccaactgtatcatgtcaaatgtaattaagttttacttacacagtagtatcctgaatctaaaattaattaattagttaaagccaactagaaactagcaaactagaaaacagatttcaagattctcaactaggttacaaactccttgagggcagatgctgtctaaacatacttctctctcttgcctgctgcaccttatttaaccacaggtgcacaatcagcatgggctgaattcaactggtatacacagttcctgcttagctcccagaaatgaatctagaatacatttcctaggaatctagaaatatgaagcaatatgatgaactgtactttcttgtggccccccaacagaactcacgcttccccagctcataaccacttgcagacataatttaaatttgtcctaatggcccagattcctgtacaaacaccagattcctgtactagtgtttgctccttggtctgaagcttatttttctcagggtacaagaaaggtctgatgccgcagatgttatatctgcgttctgggtcaatagactcaccacacaaaaagaagagtaactcagcctccttgacgtctgatgttcctcaagtgcctggccatgaagacagaacttcctgatcttattttccttgctcttaactcactatgtatttcactgtgactcttgtcactatcacttcagcagagttcatcacacagcagcactccagtggcctagctcagacactgcaaaccaaccaagaataagaaccagaatttacagttttttaagagaactgtactatcctttagaatagccagagccagagtgaacacctgctttgctgcaaatcagaatggcatggtagaatgacatcaggtcggatgtcaaattcaggctgaaacctaactatgccttggtttccttgtatgtttgatagaggcactgtgtctgctgcattaggttattatgaggactagagagaatataggtaaagatgctattattagtagttagatgtttattgtaattttgtttagctctgtcaaagaatattacttttaattaaaacgttaatatagttcatcttgaagattttctttttccttacatttttatctggggccttagctgaaactaaaaacaaacaaacaaacaaacaaacaaaaactctatgcagatttgtcacctctcttataaatcattttcattttcctgaaacctggagacaagaggcaaaatgaaacctaccatctcttctaaagggagggagggaggaaaggacagtctattagcaaaaaaaatatatacatatatattaaggcaagactccagaaaaagaaaaaacacaggcatgaaccaagcactaaccagtgtgcctcaatgttttacttgagggaaatgatctgtatgttgcccccacccccggccaggatgcagccaaaggacctggatagtgaactctgcacttctctaaaaaagatggctctcaagaaggtggaaacctaggatgacagccaggaaaaggttggaaccagaggtggggtctttattgggctgggagcagactaagttgtacccagtagctggcaatcaggatcaaggaagaggctacaaagtcagatcacagtagagatctgggatacacacagaggtcaaggaaaagcaaggttcagaaaccagcaatgcagcctgaaccacaggcagaaagccacagcaacactaagatctgatgcttctaagttttctgctgggggctggagccatccacaaggtaagccaagcccacagtccacaagtggaatcaggtcactgtcctcaggaagtagggcgacaagggttaggaattactcactgggtacaatgtctgtcactcaggtgacggaaaccctaaaatccctgacttcaccactatgcaatataagcaagttacaaaattacacttgtactccatacatttatacaaatattttaaaaaagaaaaagtcttgatacagaggcccattttctctaaccaggaaggagtttccaaactacaagtcaattctttctaaaagcacctctctctccttcactcagatctggagacagaagaggatgcctctgggcagccaacccaagcagagctgggcaagcgagaaaatcgccaccatgtcagtgaccacctgctcacccaggcacttcctccaacagaagaccttctgttgagcctccaccctgcatccggcattcctgaacgtcccctgacctgcaccccctcatcatctggcttaggaaccatttggcctctgacccacccatgttctatattcacagacaaaagaatagggagactgtggattaggatcacagggcctctataattaactctgattcacccttcacactttctgacacacagaatcattgggggaaaactcttctgatttattgagggttgagtgtaaggtactgtcataggttagctgtgaaaattcatttaattctcacacaaccccatgagttagacaggatagtgtccccatcctcactttatagacatgaaaataaaaaaatcagattccagtgagtggcatggtcagaagtaaactcacatttggcctctggttgatcaacagttctcagtaggcagcctctgtagaggaattatgtctcttagggataaaactgagatgtaatctcacagaaagctcttgtgcgttttttaaattcctttaaagaaaaatttgtattgatagttcttcccttgatttagggatttttttaatacctggtttcttgaaaagctttttaagaggatctgccaaattacataagcatttctagtttttcttaattttaattctcattatgagattttctcatcaaaaataattcagatagttctaaaaatgtcccgtaagtaaacaatgtcaggaaaaagtgagatatgttgaaatacgaacaaacgaatgaatgaatggacaaacttcagaacaaactatctaactgcagcaagaactgggactggaaacacctaaccaatgacagccccatagtggtttctggatgctaaatatagacaaggtccaaattcccaaagtctaactctggctttatcacacatacttggcaaaagaatgttatcctgataaagccctcctgtctggccatgcttaagtaaatgtcccaacatggactgtcttccacctagctgccaggggaaaatggatcacttctgtactcttggtgtgtagccagactatattaaaaagtccttcatcctgcctcagcaacaaaaagtgcactgccatcagttacgttaaagctgttgtgtgataaatttgaatattgcataatggaggggaaaaaatcaaggacttacactacagctataaaagggatatgtgaagctatttagtcatgattttgtcatggagtagtgacctagacaactcaaattccaattaatacttgaaaagcccttgggacatagtgtgatatgcattcctataaaatggctcttggctgggcttggtggctcatgcctgtaatcctagaactttgggaggccaaggcaggcagatcacctgtggttgagagttcaagaccagcctgaccaacatggaaaaaccccatctctactaaaaatacaaaattagctgggcatggtgatgcatccctgtaatcccagctactcaggaggctaaggcaggagaatcacttgaacccgggaggcggaggttgtggtgagccaagattgtgccagatagtgccactgtactccagcctgggcaacaagagcaaaactccgtctcaaaaaaaggataaaataaaataaaatgaaataaaatggctcttaaaataatgcatttgaattcctaagtatttatatacaacattgcccccttaattttattttaagcaaagaacaacggtatttttcatttagcagttgtgacttgctacgaggaagtctaggtcaatcagccggtttgcagttcaggcaaatctaagctacctgactccactgtgccatgaggaaatgacagacaagagaacgccctacaggccctgaggttttcctggagtaccttccaaaccatggcctgcattgtgcttatgacctggacaggtcaccgcaagcccctgctggtccaggcagtcaagaagggactccacagtgtcttcacaatcaccgcacttctgcctggcacaacggctttgccaagctaccctcttcgtgcccaccgtttcctttgctgctagaaacactcacaaagcaatagagttcttacagttctctgagctccacctcagcgcctgctcataatggaaaacggctgctgccagagccacttccaccctcacggaagcggggtcacggctgcctttgggagtctgatgaaagctgtaggctgtcttctcaggaaagacaaaaatgaaagaaaggaacagaaatgcagagacgatgagagggattccctgacctccaggttaaggatcctcagctttacaaggctaagggaggaagaatggagggggtggtggaaggagaggcagagagggagagaagggagtacggagtgagccagctccagggaccagccactgaacaaagtgctgcccttgtctcagcctggaatcagacggtatgggttctggctcaggctcgagattcccagtgaaagccacaaagttctatgacttcatcaaaaatgttcccttgcccacagtgccattagctattccacgtgaccacaccaatctttttgaccaaatattctctctcactgattaaactattctactacaaattgttgatgcctttgggcatatacaggatggaaatagcttagaaaaaaaagtattctatttaacaaaactttacagtaatcggtacagtccctcatttagtcaataaacactcggcgaccacatgctatgtgtcaggtcatatgccagctacaattaataacaacttaaaaagtaatcatagctaaacacattgtgcacttaactgtactaaacactttacgcatattagctcatttaatcctcacattaatcctttgaggtacgtattattctttcttttccactattcacaatagacaaaatagagctatccacagctagctggtggcagagcaggggatcagaactcagactatctggttcacagtctgtgttcttaatcattacagttcctgccttcaaccaacccacacaacaaggagaaatgtaacagtaccaaaaagcactgcttgtgtttgacagttcgacagtgaaatgaacacaaccagacttgatcattacacgtcgtatgcatgtaacaaaatattatattatacgtaccctataaaaatgtgcacgtattatgcatcgtttaaaaataagttaaatcatagagttaaatttcttagaaaaagaaaatgaacacaaccataaaatatgcataggtataaaatagttttttcataaaaggggaattctgtttgatgtcttattatacacattggagaaataaaatttattatgaaggatttatatagattgtccaatttcgtgtatctttataatatcaaaagttccataaagagaattcactttgagaataaaattattttcaaaaagaatagcttatagatgttaagtgttttcattggttgtccatagtacacctctttatccaaatatattagcatattgcatataaattactttattaccaagaaattcggaaactgagtatacaaaattatcagtttctgtctcaactattttgagatggcagtgaacagactaactatgatttgatgataaactaaagaaaaatatcacgctttgtcgaatataatcaatttggaattgaagaattaattgtgatgcaattacatactttcttaaaactaaaaaaaaaaaagtcaaattgactatcaaaatgtctttagcagaaatatactcacagctctttttcaaagcaaatgtacaaaatctcctacagccccttgctgtccaagagagtcacgtgacgtaaaacatcttcctcatcacctcggccacaccagttcccaattccatatgctcacctaactgcacccctgtccccaaaggctccagtctccctcaatcttacctgccctttatgcaacatcatttcctccctgaggctctttcttggtctttcactgagctcccaaaatcctagattccaaaaccactctcagcctgttaccattcccaaatccaataagcaaactataggacttatgaactccaaaataaatacctgggtccctaccccaggcactctggatccccagctgattctgggaagcagctaaatttgataagccctggactacaccatagaaataagcatttagttataggcatcactttctctgctgtacattgagggaggtgggctggaaagatgatctctaaggttccttccagacagatctaacagtccaagagtccagactctatagctatttcatggatactggtttctctccacacagactccatgcttcttcagagcaggggccacattactttttcactgtccccaagccagcatggtgtgttatgcatagaaggagctcaataaacttgtgactcgtgggtttctatgactgtgcccgctgactgagggtaactagtaagctgagccaggcactgctgtggcagggctacttggcagatcttgtgcagacactgagttacatcttgctccaaaggaacctcccacaaaggcatcaagatgtcaacactggatttactgtggtcagaaaactgtagaaatcaaactctttcaaattctagtataccaaaatacaacaagttctgactttctgtttatatgttaaggaaaccacagaaagccctcagagataatgtatctggtttgtaagaattatgatgcatactgccatagtgtcataagaattcccatatctggctgggcgccatggctcatgcctgtaatcccagcactttgggaggccgaggtgggcagatcacaaggtcaggagactgagaccatcctggccaacaaggtgaaacccagtctctactaaatatacaaaaattagctgggtgtggtggcacaagcctgtaatcccagctacttgggaggctgaggcaggagaatcacttgaacctgggaggcagaggttgcagtgagccaagatcacaccactaaactccagcctggtgacagagtgagactccatctcaaaaaagagagagagaaaagaaaaaagaattcccatatctaagagaacctaatggtgagaagaacgtatcatggatctttttgctggaatgacagtggggtgatccaggtaacaattcaagtccaggaagtatattaaatgggcttgaatctattaccaaggttattctactattgaaaaaagatgtttctagctggccttctggagttgtccaatgcctggctactaaaccttcttaacaagaaaatcacctttgttgagataatagaaaagctaagatttatacagagaaacaacattccacacatttataaaggacttaatagcttgaatcatttctatctgttatgccatttaaacctcttacaacagcccttagagttaggcaagacacacattatctgcattttacaaatgagaaaatgaagctttggagaaggtaaaaacctaccccacagtggagctgaagctcaaccctagggccttacacttcatcagtgaccccctgaatgagggattctatagaggcagatgtatgatgtctggccaagaaagtacaggtgtgggtgtgtgttgtttactgtattttgcttgttttgcttttcatctgaatgtattgaagcaaggtagtagagcttcaaatggaccacaagccccatcacatccaactgtgatactgtttcagacatttatttggtctacttggccctgaaggtatttgaattttttacccctgtgctaaataattatacttacatacttatataaataattatatcttcccatcatgtaacatcttatgagcatattcactgcatattttatttcttccttataatcctgtttactcattagaggactaagctaaaaaaaattgaatgacttgcacaagatcaggacctaaaatctaaatgtgtcatataagaaattacattatgtgagaatttcttaagcaggtgtcaagttaaaattcttcagaaaatcattacataaaagtttctgaacttgagtactcaagtactcaaatctcttttgagatttgattattcttacttacaggactatcattcagagaatatgcagaaacaatgctttcgtgtttccatgggcatgtcctgagaaagtcatattcctttatttttatctcaagtgttcatgaactttcattatcaaagaagaaaataggcaactgtttctgaaaaaggaagtcattcaacaaaatactagcaaaacaaatccagtgatatataaaaggattacataccataaccaagtgacatagtccaggaatgcaaggttggttcaacatataaaaatcagtcaatgtattaaagtatataaaagtatattaatagattaaagtatattaaagtatattaaagtattaatagattaaaacccatatgaccatctcaatacatgtagaaaagcctttgacaaaaatcacacatccttttgtgcttaaaaacactcaacaaactaggaacagcaggaaacttccttaacctgataaagggcatctatgaaaaaccaacagataatatcacactcaacagtgaatgacaaagctttcctttcaagatgagaaacaaaccaaagatgtctactcactccactactatttaacattctcctggaggtcctagccaggccaatcgggcaagaaaaaaaaattaaaagcaaccagattggaaaggaaaaagcaaaactatctctattcacagatgacataatcatgtgtatatatataaaatcctaaaaaatacacacacaactattagaactcatgaatacactcagcgaggtcacaggatacaaaatcaatatataaaaaagaaagtaaaaatatcagtgatccatgttaccatcactaaataatcactggcacctaaaaagcttcctcttttagttttattactctcaacctgggatatagaaatctaaaatccagagtttactttagcttttaaaactatctatgatatcaggttaaaagaaacatttcctggcagatgcacagctctggaaaattttgttttccaaacgtctggaaaacaaaaggaaagcttcctttgtttacatagccaagaaggttgagtgatgagaatcagaaaagattttgaagcaatacaagatcttctcctagggccattagagatcagctaatctgttcaagttttaattctcttctaatgggtttcctcaaagtactttacagcagttgcaatcagttccaaatattgcatcgtgatactcacataaactggaaagtaacggctacatttccatttatttcatttatatttttactttggccagtctcgtaaagattttaaaaaccattaagtacttcacaatattggtggggactgtttccttcttcattttcattagaataaacacagaagtggtatctatcctaataatacagaacatgcttcttaggtaatataaaccaaacacaaatagaaagaagcattgttatacattttaaaaaagtgttacacttatttttctgcaggcctgaatacagaccctgcctgctctaaaagtcacgaggtataaagtgtgaacctatgctctgggggctcctgataagttccaggaaactcctttcacagcctctatctcagggccacatcaaatacacgttcactcactggcctcaacagtcgattatcactccctatttatttgtaggttcacatatttttgccatttaaattttttcaaaaattaaaacctggctcaagttacaagtaaagcttgggttaaggaaagcattcatgaaacactttgttttctgtaaatcagatagtttattgcctggttcccttccaatatatatgtgggctttactctccattcagaatttgattctaatttttaagtggcaagcaaagtcgaattattaattaaagaatcaagacatataagtataccttactctctacatggtgaaggcaaacactttcaaagacaatttccctaatattttaaacctatcacatgaaaactttagccctttggatggaaacatttcactgactttcttcatcagtcccccttttttgccataaaaattcacgagataataaattccagtaaaaagaaaaccacacagtaaggcacagatctttgatagtataaaagaacattatctaatttaatccccataacaaatcagtgacagtattatctcatttatatataaggaacctgaagctcagagatgctgagttactaaagatggcacagctagtaaatggcatgtcagaatctgaacccattgctggatggctctgaaccctttgcccttcccaacattaattcgtgcctttctggaattttgccagccaagtggattttttttaacctaacttaaaatattcaaaaataactaacgttatttaacgtcttattctctaagattttttaaaaaaacatttaaagttatttttgtcatctgttttaatatgtcccaatcccttaagctaagaatctatcatttttactttacccaactatctcgtgatataaattaagcctgtttactctttccaggtcactgaagcaatgcttctttctagaattagagtcatacaactagaagagatggtctgactttgtacagaccatttgtacaccatgtgtagttccatttctaagaagaaacagcaaaatgatctacatgaaaaaaaaaatcaccttacaatttcagatgactttcatgaagtggttttataaattgtattgctgtaccatcattattgttattaatgaagttacatttaggtgttatggtagatttgaccagatgtggcaaacagttgttaccattgtcttcatccataaaatttgtcaaattagaggttttatggagtatacaactaattgcaagaaattatataggcagtgtatttttaacattttaaatactaacaaaaacagcaggacttaatgacagtgaactacagacaatccatgcacagtgaagcctgtttaattagaattccactagtctaaaatctgtaatagcttgaacacaatatactattcattctgagtttgaaagttcaaaataaatctcaagatgtttttccatatatacctcactgtacctgctggagaccatttacatacatacatacatatatatatatatgtttgtttttgagaaggagtctcgctgtgacacccaggctggagtgcaatggtgcgatctaggctcactgcaacctctgcttcccaggttcaagtgattctcctgcctcaggatcccgatgagctgggattacaggcgtccaccaccacgcctagctaatttttgtatttttaaattttgtatttttagtaggcagggtttcaccacattggccaggctggtctggaactcctgacctcaggtgatctacccacctcggcctcccaaagtgctgggattacaggcgtgagccaccacgcccagcctatatcacatatattttaaggtcgcatgggacctcagtactcatgccctctgattctgtcattaagagatacatattacaggatagtggtgatgtgtaggggctctggagccaggctacctgcattaaattcccagctctgccttactaactatgggaccttgggcaagttaccttgtgcctttgtttccttctctataaaatggggaatagtagaatccaccctacaggtaatgaagattaaaagagataatacatacctgtgaaaggctcaggacacttcttatgtgtaagaaacacaacaccctgaggccagctggcctagatgtctttccaaggaaaatctgccatcaaacgttaggacaacatcgtgggactcctgtcttttctatttgaaaatagtttttaaaaatccatttaaaacagcccacaattagacaagctcactaatttttcctggctatgtaccttcaccaaattacttctcaatcaaaattactttaaattacagatagtatgacatagatgtatgccaaaggggcttatgcggacttttaagtcatatattcaaaaataactaggaagaacctactagtttccctttacaatctgatgtttcatattaccctcttctttgtagttccattctgtgaaacttccatttctcataggtattttgttaaatatcacccctacccacaaggtttatcccaaagtatctacacagattccaccctcgcgttcttcctctgattctgggcctggcctgcccacatctcctctgaggccttcctccatcagtttgcccatctttcccctcaagagtgggaacacgcatagccgccctcccacctcccatccattctttcaccctcactgccaactccaaaaagcagctggtcacagaccccactggctcatggcctcgccctggctgatctttccttttcaaccctcttcaccggctgctttccctcccactacaccgtggtgcctgcagcctacttctcattctctcctcctccgccctagacaatcttgtccaatctcaaggctttcaccagcacctgtatgctgataacgcccacttatttccatcctgaccttttccctaaatgtcaggatctttagtaaacttcctagagacaattttatcttcatggtccaagggcatttacacgcaatacatttaaatccaaagggttcctctttccccactcagcttgctcttcctcctactttccctatctcatcacacaagctagatagcctcaaagcaccctcatccccttctacccagaaaatgagtgaatactgtctgtgtcatgcccccaacagctctctactccctctcctcctctccatcctcaccggcccaggctagtcagccctcactcctcactgacctcctgaccttcagacatggcctctcacaaccaccagactcatccatctatagtgccttctagaaataataaaaaaatgcaaacgtgaccattttgctcccctgcttaaagccctcatgcaggccatcacctactggaaaatgtttgagctccttagaaagccatgcaaggccctctgagagctgctcccagctccactgcccaacctcccatcctgccattcccaacctgaatgccagggacctgaaactgacctgcactggtcactgctattgttcacaacttgctaattttcacctctttgcctttccttacattatcgtacctgccatatccctaccccgctcccagcctggctaactcttatccttcctttaagactgcaatcagatgtcactttctctaggaaatcatccctaaaataccatgctgagtagggtacccccgtacatactccacaggatttggggcaggtaaaaagtctacttagactaatgaaataatctgttcttattaccaggctaaaatataaacatatcaagggctagaaatgtggtctcttcacttctgtgtctggctcaataaaaggatgctcatctcaacccagacacctagaaatccagaggaagaaagttacaaagagcagcttcaagccctctatactgtagacggattgcgttacattattatatattttagggctctaaaacattaccttttttttctttctgagacaaggtctctctctgccatccagactggagtgcagtggtgcaatcatggctcattgcagccttgaccttccaggctcaagcaatcctcccacatcagcctcccaagtagctggaaccacaggcatgcaccacgatggccagctaatatttctgtagagatggggtctccctatgttgcccaggctggtctcaaactcctaggctcaagtcatcctccttcctcggcctcccaaaatgctgggattacaggtgtgatcagcctgtaccaccatgccttgtctaaaatattacttttgtcctgctgaggaataaaagtaaggaaaagaaatcaatttatgtaactaattatttacctaactattagaaaccaacataccctacttcctctcagactccaaagaattttctcaggtgttccattcatattcaaagattaaactctacttattgaaaaaaattaaaggaagtcacttacaaggattggttctcaaaagcagctatgccatgttctggggaaggaactaccttcaatgaaaggaacacaaataagagagtcctggtgttacccgctgagctgtcctctcctgcacgtagacatgcttctgcaaaaaactcagcaggctccaagtcaaactctgtcctgggctctacaatatgccgccgcacgtgatgatcactggtgctcaggcagaacggactttatccacatcactgtaacctgagcccagacttcatcctagacagtcacacagctagggccacaggtggcacaccatggtaaaaacgtgagaccatctgattatccatcaaaacagagggcctactgcacatagacatagatgtgagttggagtagtgtggtcttcccatttctgatgttgccatctatttcctcgagatgacagacagctcatatattttgctcaaagggttgctagagctgtatcctcctttaaggtgaatcctcatttctactcccacaacagaagtggtcctcaacctctttggcaccagggaccagttttgtagacgactttttttccatggaccaggggtggagagatggtttcaggatggttcaagtgcattacatttattgtagacttcatttctattattacattgtaatctataataaaataattatacaactcaccataatgtagaatcagtgggagccctgagtttgttttcctgcaactagagagtcccatctgggggtgatgggagacagttacagatcatcaggcattagattctcataaggagaaacctagatcccacacatgctcggttcactatagggttcatgcttctgtgagaatataatgccagtgctaatctgacgggaggcggagatcaggcagtaatgttagcaatggggagcagctgtaaatacagatgaagcttctcttgctcgccatccactcacctcccactctgcagcccaggtcctaacaggccccggaccaatattgatccacagcccgggggctggggacccctgcactccttaacagaagaggggcctggcaggatgtttcagaaagtggaaggaagtaaacatttgaatcttcggcacactgagaaggcctggcaaggaaagtctacctgcttcttcccaggatgctctgagcttctattttagtaaactacagagtctatggccagtgaagatacctacttcacagcctgagataaagtcctcggcctccaactgtagtttctacctcagcagttctgagaaaggacactagaagcctccctgccatggaatatgattggtgggacaagaagcaagtgggccatgtgggcaacctatcttctcaaccaaggcagggtcccagggcaaaagcccagacaatgcatctaaaggtcagaacctacctgaccatcatcagtagctttttctattcttaaggaactcctgaatgtcgcttcttgggacccaacagagtaaacctctgagtctgacagtcttttttttttggtgtgtggtggggggcgggttgtctgaatcacctgttatttgtactatttattgatagtaaactgtattttcttaaatgtaaaagaaactgtattaatttgatgacactagtactgaagcaataatcaaatacttgcttatcttactacgggcctgacctaccttcaggcttgagggcaactgttttcctctctcctcccccacaatctgaaggaagagttagaacagtggaaagtaatgttgcatattacaagaaatggttaaacacaattagtcagatcatataatggactatgacgtattaaggcagtatcacggctaccaggagtacagataccaactatggccccaaataatgctaaacactattgcaagaacttcatccacgagttcacgtgtctcaagactgcaagatttaaatttgccctactattcgtgaaaattcacctttcttttccaaatctggaataccccccattgtttaaatccagtctgggtttctcttgtcagtagcagtcttcaatgtctacttcagagaatgaaaatgtgtgtatgtgcactcatgtgcttatgtgcacgcacacaccctccttagaaagataaagtcaataaacttcctgtcagtatcacagaacatgcaaagtcaattgtgcaacatttccttgcattatccatcctatatgcaaacattctaatgaaatagaactggaaattacacatggaaactgcagctaagtttggccacctaatggactcagggtactccggtaacggcgcagagagaagaaggttggccgagcggggatgcaaggtccccaactgaagtatctgaaacctactatgggttccacgtagagtcttcagttgtgatttctcgtaggacactaggaaagttgcaatttgcagctatggccacggggtagtgcaataattctgcaaatagctgaccccacccccaacactcccatccccccaaccccagccctcccaaagacagaatggctaggagagaatggggacatttggtctgaatcctgggcatccacaggggttactgagagattctccacaaatccaaaagtgtctgtaagactatacagttactctcagcattcgagcccgatacaacagaaggtcccgggctttgaaggaatgatgagaactgagaggctataaaaagtgattagcctatttattacaaattgtgtttacttaggtttttatgtttacttcccaccatatctccaccagaatacaattaaccaccccctcactcatcagaattgtattagaaagactcacaaaaataaaataaatactgcatctaaacgcaaccgtcaagctttatggaactgtactgttattacacaaaggtgtccccaaaacagggagaaggaaatgcaaattttgaaaggtcttcttttcaaaggaaatttttgtccatttagtccttacaagtcaaagtttggtctgtggaccaaaactaatacttgggagccagttagaaatgtggactcctggttctattagattagaatgtgtattttaacaaggcctctagattatttggatgcacatggaagtttgagaagcattccccgagtgagagctaagcatactgacctatgctctcaaaactattttctacaccctgggtcttttcttcttctacaagcattctacgtgaaaacaaatatattttgaaattttaaaacaaaaacagattatttcccagaactggtggtgatccactacagtaaagcctcttcctatctaaattgccaggtaactaattaacatgtcaatgaacactggctgaaattctgttctgtcacttcataacgcaggtaaacagtacagatatgagaagaaaaatttaagaccaacagactcacatcatggtcctctaggggattttcgaaactaatttcctgcccatataaaaggaaaaataaaattatttccagtatcaagttaagcacataactctctaaatggagttgctatgttaaagtggtctccaaattacagtcatttttgtttacctccgctaacaatgagcctcctgggaagaaattatgtgaagaagtttaagtaccctctatgcctttctccacaggtgagtggggaaattgcagaggaaaaatacacaagtgaatacaattaatgacttctgcactctttgattcctgctaccctgtgaggggaatgatcatagaattttgaagctggaaggaatctcggagatagcctattgctgccgctctgcctacccaggaatgtctttctacaaagtcaggtaattgttaccctttgagacagcccacatcacatcactgttaaatgctctcacacccactgatcttactcgtgcccttgagcaacccagaacaactctattcccacttcccagctaaatgccttcaaacacttaaggcccctatcatatcccgggtggtagtttccttagattgaacccatttagttccttggattgggtggtgtcctcttactctgatataaacactgtgtattttgtttccagtgaaactaaattatgattagcctgacataatttaatgagacccacagtgccaaatgaagtcattcgatgtaatggttggtaatgcaatacattctcagtgaaacataaaagattatgtaatggttaatagatctacatatgtgagtagtaccaccgtaagtaagagcatatttgtctgctggactatgatgcacgactaagaaaagctaccaacctctactcaaaaccgtcccagggtcctgttgccagggacagaacgctgcaccgcatggactgctgaatctgaccttatgcggcctttctgtattcttccttgtttatgaaaaagagacatttttaagaaagcaaagggtatagaagagctacatttggcattcagagcaattgacacttttattacttaacatcacaaccttatgaggtaggccagtctaagtgctgtcattttataagtgattaaaccaagactgagaataggaaatgagaaaaatcatgagctgcccagggccaaacagaaagcaaggttggggccagctgaattcagaaacctcaattaaattccaagacaaaagggaacagccaacattgaaaataagttttatggatttcactttgaaataaaacaacaacaaaaaaattatgttaccattaaatgatattaaaatcgtcttttatggggcctcgattttgccaccaaggctttattcccaaaaattaaaataaaaaaaaaatcaaacaggcaaatctattccaggttaaaaattccacttacacacaaaatcttgcattccatattgagaggtttttttttcttaatttgcctattaatctgtattaagccaaaggtcttcgttcaagttgctcaagtgtcattgattagacccattgtagttaacaaggacattctcccaaaatagattcttagcattttaaaaccctcctacattttcacaaaagagaatctggaacacaggaaggaatcatttccccacacacaatactcatcttcatcgtcatccagatacatttggttaaaaacctatccacacattaaggtgcacactccctgggttcctcctccctggtatcctctggggccccagcccagctggagtccccaagttctcggcgccctgaactaaccagtctctccacccagctttctccaaaacacaccccacacgagggctgagctcctccacagcggatgcaacactccactgcttcccatcgaggccccctgcctcctccaggctgatgagcagccccttccccactgctgcccacagccctagccctggaagcctctcttctgagaaggctttgcctcctcgtacctgccgaggcccctccaggcccatgctgagggccaatgagagccacgcagtcaactacacggtgaccttcggccagtgtgagtacacgcagctctgcagagctgctgtctaccaatcagctccaggacacctggggctcagacaggtgcactctccttctgccctttctttgtactctgttttgacccataaggactgaccaaaaggataggaataggccttaaaatgtttgctttactgcagctggaggaaagggttagaggcacctgaaggtcaagatcagggatctgtagcattttctggcactatgaagtaaagtctaaaaaggcctggaggaagccgcccactggcctgcgcatgccccctggcagttgatttgaagacaagcaaaagcatcagcgggcactactaggcagcatccttagggagactaaactgctagtgcctctgcatccctccctgcctgtgttagcctaccttcaccaaacaagatccacactttattccctccatgtttctattcacagtcttcccaccacgtggttttcctcctttccatttcctcctgaaattctactccaggacccatttcaaatgccaccccaccatgaatatcttactttcaacaggatgtgcccatgccccctcaagcaggcagtgtcagccttggattacaggtatttatgggtatggcttattctcctattaagttcccaaaaaacacactgtcctttgcatcctgtacagcagggtttcctaaactgcaggtttcagcctatgaatgggaaattctaaaaaaaagaaaaaagagaaagaaagaggataggaaatatccaagtgtatcacacatagtaataagcgttatttcatgatgctcttgtttcacttacgtgtatgcatgttcaaggggtggtgggtggcagtgttaaacgtgtatttgttactgggggtcatggtctgaagcatttgaaagtcactgccctgatggtacctctcctctgtctaatattctgtgaatgcttattgaattgaacaggttgatgagtatgaaatgatccatgtattataacttcaaaggctccaacttaaaggaatataaagaataatgcctatctgaacaaaagtgtgtggattctggcttatatgaagctgtggaggaatggggtgagtggtagggaagatcagaatatttattatactgttgtatgttgatagactttctctccaatgattaaaatgtgttaacatttaaggaagatgaaatacaagttcattttggaaaacttttctcattcactgaaactacctcatgactacaaagttctgcatctttaaaagagacagtataggtaattccaccatgatgcataaaatgatcttttagagacaccatgaaagcccttgttcaagttttctttgcccaagatgtctccatgtactctcaatacccccacccacaccatctgtcttccaagacttagttcaaaggccacctatttcatggaagcctttgttttttaactcaatttttcctctttccatcctccacccaagtcccaaatatggtctcttttctgaatcaccagtgttgaaaacttcctttttcatgtgtgttcttgtcttaatttcctcacttgacaataacactaatatgtacaacctacgccttactcatccttgcatctcccacagaaaccagcacaaggtcttctacttaagagatgatcaacaaatatttgttaaacgaattaaatgaaagcaacagttagcctgttaaaagggatggtcattattttaaaggccctgaggaatggcttatatgtctagcacctaatcaaaagctggtggaccacagaaggaagaccagggagtggagggggcagccttgtgcctctgcatatctgctgcccctgtaaactcacggaatgcccaactcttcaagactctacagaacaaagctacagtgttgggtgctgaatgaacaccttaacctttttccaagttctccagtcttgcttcaaaccagaaattggaagtggaattagaggtggaaattagggccatccttttcaactttaaggtatggctgaaaaagttgaaacagccatctggataattcaggctcaaaaaacccatcctgaagagtaagtatggatgtttctgagtggcaggaagagtgtgcaagaaggcaaaggaggtagttgtgaattatcaattgattgtgtatattgattatattcaacagaactgagcttttccctttttattttctataaggacactctctgtgactgcaagaataaactagctcagattcaaagccacagtcaccactaataaattccaatttgttcaattggaaaatgatgtccatcaattagaaaaagttcttagggattaagattctcttttgccattaatctgtacctcctccttcctccttcaaaaaagtttttctatgatcaatcaaaggaagaagttttcaatggtctttaaaatgtatattgctctaatacaataattcataattaacaggtatactttcctaactatggtagtttattttcaaatttttaattttaataccatttagggctctctctctttgttattttagtaggaccttaacttccagtccatcgaggttttgttttgtaattaatttcagagctgtccttataagctgagagatatttgaagtactctagaaaatggcaattgtctgaccggatttgaagtcagatcactgggctttgaagctaatttctggttgaaatatggctgccccatttttagatgtgtgactctgggcaggttaccctatcttcccatcttcaattttcctatctttaaaatggaactaataacagtacttgctttataattaaatgagctaaaacatgtaatgtacccagaacagtgtctgataaataatacgtgttcagcaaatgttagttttaaaaagtctgctgtcatctgttttatgacctcagtaaagtcatttaacagttcaaagcttctatttcctcatctataaaatggaactactaccacttacttaccctttccaggattaagagattcaaataagaaaacaatggatatgaaaatattggacacacagaaagttctcaaatattagttattttgaaccatctataagcttaaaagtaaccataaacttaaaaatttacgtaaaccataaaactgagaacatagcatccaaaaattcatctgtgagaaaatgtctaaacatattagaaatgcatactcaagcttggtttttctttaacttatcagaaacatataagcttttgtaaaatgtaattctacatctgcaaaactagaaaccctcccggtcaagccaaactgtcctagtatattgtgatcaagaaagtctacatgccttcataagccaaaactcgatgcactgattaaaatgtgattgcacgtacatcaactttttaaaaaacgtgtaagtttttgttttttttaaagtaataaatgtactgctaatgtaaatttcaagtcaattcaacagatatttattctgtgacactgctccagggtaattcagctgggaactaaggatgcaaaaggaaacagagctcaggttctgtgcaggaagaccccacaaattacgctgataatctcaaaatattacttatgaaagtcataagggggttcgctttgagtcagcaagcagacaagcagcataaaaatataccgaaacagtaagttcttccctttgactgaaaaactgccttttaaaagcaaacagcattttaaaagtacagttgctatctggaaagctattgaatttgcgccagaaaccaacatttctaaatgtaaacctataaaataataggtatctgtaaatgaaaggctgaaataaccccaggagcagcaacacagtaattagcaacttttacacagtcataacatgtttcatattctttctgccctggctctttgaagtttccagtgcaatacgtaaaagttttattacattagggcccgtccttgtgtgttttacaggcaccaacattatgcagagcaagctgtacttactcatcataggatcttttataagaaaccgtttgataatgtgctagctttgtgtccagtttattttgttacacctgtctttaggaaaataaaagtcactggaaacctaaatcacagaaaatacacacagatccacatatcatctatatgttataaatcataaagcagtttagctttaaaattgtacattgcatattcatgtgcacaccacttgcagttttagacacatgtgaactctttactgaattaaagcaaaaggaaaaaaaaaaaagctcagctctacaataagcgattaccagaggcagaacagagtgcagttaatatgcttgttccagcagatgttcatccccgtaaatattaaacataacacaagttcctccaggaatatgcaggcagtaattttaccacctgaatagtgctggttggaaacatttaagagatagtggggggttggggggagcagagaaagaagggggaataagacagatactaaagcagccaatgggatttttaagacacccgcaactggaattaaactgcttccagcggcgatttacctacagcagctccccagtgtgagatcccccgagaaacggaacctggagtgccccccgggctgcgagctgtgagcgtggcataaagggatacccggggcgcccgggtggggtggggaggaggagtgcaactgtgacgaggtgtgaagaaagggcccagaggaactgtgaaccccgaggaaaggagtctccctgggctaaggcctctggaataccggcacggagaaacactcgtttcctgccctggatgttcacttttccatctcggtggaagtgggtgggagagacagaaaggatgcagccgagaccgggcgcaggcggggaggctggagcatcctctaagggcacttcgcagcagcaccaactccagggggtcggtggtgccagccggaggagggagggggcgcagtcggagggaaaggaagtgagaggagcagggggccgacgggtggatccccaggcattagtgacacagtcttcaaatcgcttcttttcctccccacggctgcgctctgcccctggctacctagatcaccagtccctgggctggggcgggccgccgcgagggaggggaacaggagagggggaaacagacgggcaggcggccacgcatcccacccggggaggcagaaaagggctggcgaggcaggcgcccccgacccaccccacccccacggcggccggccgcccggagcccccggcccaggtgaggacgcgcgggccgccgcggccgcccctcgccgctcccgcccgcccgaagcggccggcacggggacttaccacagtgactcgaggtcccattcctggagcagggctaagtcgaagctgtccatggtgggaggtgtcagcgtcgccgccgccgctaccgccgccgccgaggctcgggccgcccgcgcgctgcaacgaaaggcgccgctcaaggtgcatcccagccgcgccagagcggccgccgcccgcccaccgcccacccccaggtcggggctcccgacgccccccgcccccgactccgggccggccgggctggctgcagcggccggcgcactcacccgctccccggcttgcgcgcaggcacactcaagagagagcagcgagctcgccgcgccgccgccgccccccgcccccggccctgcgcccgcccctcctcccctccctcgcggcggcccggcccgctgctgcagccgccgccgccgccgccgccgccgcggtgctctgcgcccgcccgcccgcctctttctcctccgggaggcgcgtgtgcgcgggcgaggccgaggcgcgcgcgcaccgtgagccccgcgccgcgcccgccccgcgcgcccctgtactccccgcgccgctcctcggggtcccgcggcgctcgcaggccgcgccgccctgccgcccctctctcgtggcttttacggcccgcccgcccctcagcagccctggggtgcccggggcggccctgcaagcgggagagagcggcgaggcggcggcgccgagtgcggggggatgcggagccgtgcccggccctgtcgcatccctcggccgcccgcccgcgcccggccccgcccggccttgcccgggctgcacgcacttctcccgcggcccagaatccacttgaccctgctgggcgctcccgcgggcggcggacccgggtgggtgcgggggaattccccggccgcccaggcgcggggagagtgagctgtgccgcccgcagcagcgccccaaacaaaccgtttaaggtctctggagcccgcaagttcagcgaaataaagcggcggcgcggaggaaacctcttccacccggacctgctctccgttgcggtttggcctccagtggtggtcccacccaccctctagctggccagccctggaaaccaacctcctttctttttatttctcaccgggaagggggacaaactggcctctgggtgtcgacttcaaacttgccgcccgtctccggtctggaaaggcaggtgatcag

SEQ ID NO: 2143 - DNA, 62896 bp, Homo sapiens
gcttgcgcactgagaactcacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacaggtagataggggttgggtccgtacggcggcggccgccgtggctcagtggagtgtgcgggtctcgccgggcgcggcgtcggaccggggtctgggctcgcgatgagcttcgcggggtaccaggcctgggcccagagtgtgcggagcgggcccaagcccccgggccgggtgggcacgtagggcctcgacggcgggcgggtcctcccagtcgagcctcgctcccccggcaccccttccccggcctgaggagcggggtagtcatttgagggttcctggtcgcgcggggagggtcaggcggcttcgccagcgtggcccaggccagtgtgagtttttttccgcgctactcttggcgagggtggggaagttctttttatgcctcttatacctgtgagtactttgggagggaagggagcttgaatgtgatgtacggccgggtttctctactcgcggtttcaggtacgttagagttatggggaggtgtttagcagttcgctgtctctcaacttaatctgatttggatacagttttcgtttatttaagggctgattgtccagccctcatgcttttcgctttccttcttccggcctgtttttttttgtcgtttctttgctctctagccttcccctaagaaaggaagggaagaagaagaaaccaaccaaccgaggtcgctcctttctaaccacctgcaatgctttggggagggaggataagggtatatgcgagttacttacctagagatttttgagacatttctgtgtgtcacattcgattgagttctgttactcatgatggaaagagttgacttcctgggagtgaacaacatctgttacattacacgttcgtacactacccaccaaacttaaatacgaggcggagagtaaggtaaattaaaaaaactagtgctagttcatcagtctgactcaaaacagatatgttgtcttgaagttaaaataagtttactaattataaattggaagcctggatcgttttctcacctagcgtttgactagcttatgagtagaattaaaagacaacaaagatagtcttgtatttcagttttaggtctattggaggaagttaattggtttggagaattgaattattgttaaaccagatgaatgagaaaataaggattatgggtgatgtaggggaacacaaatttctgtacttttgacaggaatttttgatgtatagggtacttttttccttgctaatgttcagctgtctctagaaaatagagaactgagtataatgagcctttatgtattaattacctgccttcaaccattgttagcacatgacctgcttggtttcatcccacctactagaagtgtgtgtatatatatatatatacaaatatatatacacacatatatataaatatatatatatacaaatatatacacaaatatatatatacattttttttttttttttgagacggagtttccctcttgttgcccagacaacaagaaacttagggcaatggcgcgatctcggctcactgcaacctccacctccctggttcaagcgattctcctgcctcagcctccgagtagctaggattacaggcatgcaccaccacatccggctagttgtgtatttttagtagagacggggttactccatgttggtcaggctggtctcgaactcccgacctcaggtgatccgcccgcctcggcctcccaaagtgctgggattacaggcgtgatccatcgcccctggcccccacctactagatattttaaagcaaatctcattagcttttcatctgtaaatccaccaagtatatctgtaagaaatattaatagtgattcttaaacattagcaaatattcagtcagtttgctgatttccctgattgtcttattacagtttttttttcaattcgttcgtttggtttaggattacacaaatgtgttctttagattaaaattacatatatatgtgtttttgttttgttttgttttttggagatggaggggcagtctcactatgttgcccagtcaggtcttgaactcctggccagtgatcctcccacctcagcctccctagtagctaggactacaggcgcgatccggcttatatgtttccctacttacactttttactttccaggctctttcacaatagaaaaaagccattgggagacaagatgtttattcttgtctgtgtctttttagggaaaagtgagtgtctcattgatttataaagattttcagggatgctgtaaagtttaaattgcacactagaccctgttgttaaatgattggtttggttgtgtagaagaaatgctgttttttccccctctcaacctaatctgtgttttgttgttgttgttgttgttgttttggtttgtttgtttttggctcatgttgaagggaaagtggtggcaatataattttaaaacatttattttctcatataccaatatatgaaattgatacattttgtgagtgtgtgtgtgtataaatgcctcatggactcctttttatgaatggctttcagattgtgtttaagaaatcctgagctttagcagagttccctttgactggaactgcttgggtttttattttggtcttccacatgagatattgggagatggggaatgggaagttccactgctttgtgagtcagctttttacctttattttaatatttctttcctttcttcagggatattttgaatatttgtaaatgggacaaaaacacagactggaaagaaaatctagagggagaaagtccaattttaggattagtattcttgtttgtgtaaaatgagatagagatccggttttattctcctgggtgaaggtccacactttaaagattttactgtcattccacctcccctccttggctatgtcaggcatgtttctggcaaggtgtgaactgtgtgagaaatgacaactgcttatttagttatcaagagaaggcatggagccacttttcagttcttggacagaacatacaatactcactgtccttaattcttatatttaattaatccttattttaacttcttagccactcagtattcatttaaaattagattttaacttacctaattttatttgtacagcatgtgtcagtgatcaagatatttattcttgtctgtgtatttttagaattctagaattttgcttaaagaccaagttctagaattctgttccagtttgtgaaaaatcttcttttttttttttgagatggagtcttgctctgtcaccccgggtggagtacagtggcgcgatctccactcactgcaacctccgcctcctgggctcaagcgattctcctgcctcagcctctcaagtagctgggatgacaggcgcccaacacctggctaatttttgtgtttttagtagggacagggtttcaccatgttggctgcctggtttcaaactcctgaactcaagtgatcctcccaccctggcctcccaaaggcctggaattacaggtgtgattcaccacgctcagccccagtttgtgtaattctaagaatgagattttgatgtggtgtttgttcagcaagttttcctgacctttttcagttgactcgggaaacttgttgagacaaaggctaggattcaatatccacatatcaaacaaatataatacacatagcctaggtttaataaaggaattcatttcttacttgcatatatttgaatgaaactcttgtctgcataaattacatcaaaaaaagatgcataatcagaattcttttggtctagcctgttcctatcctgacgctttaggaagtggtaggggaagaagtcctagtttgctataaattaataagaaaacagattatagatttttgttgatagtaacctctctagccttccatgctgtccctgtggggaactcattcagctacttttaatgttacttgctcatttgttgtgctttatttatgcttctaagtttattccagtattgcagttgatctataaggtgggcagagtgttgttttaccaaggaactgagtgtcagtggttaggttagaatagcaattctcaaattctggtcctagactcctttacactcttaaattcctaaggaacacaaaaggcttctgtgtatgtaggttatatctaccagttacaggtattacaaactaaaactgaaaagttcttcaaatatttaatttaaaaataaaaataaacttacactatgatacataacattattaaataaccatattttcaaaaatagaagagctaagcgtttttgcaaacatcttcactattatatgacttaatagaagatagatcctcacatttgcttatgcatttgatctgcagcatcatcacacatcatttagcttctgaaaaactcccctgtacagttgtgagaaaatgagaatgaaaaaggctagtatcctcttagtattattttgaaaatagttttgaccccctaaaatagtttagattccctaaagagaccttgggaatgaatttgaggactgctggcctagggatttctaaactagatttaggcatttgtgagacatttctcaagctgtttgaccatcgttcatgtatgtcttacaggtgctgagaatgcttgagaatcacttaaaggcaactgaagacatctgtgggcatgttaatgttcttgatattttaacaatttgagatttttcctttttttttttaaatgtaatacttgccaaggtaaatatcagttgagattgatttcaattgggagtccattaagtttatagattatttgtgacacttgacatctttatggtgttgaatcattccattcaagaaatatattgagatttaagcacttgagtgccagatatttttctggatgctagaaatatatttgtgaacaaataagtaatatgatttgcctctccatttagttggttaatttaattctataacagtaaaatattattttcttcattttaatctttaggatttggctttttcccatgtatcacagaatttttgttgctgttaatgtaatcattcctccccctcctttttttttggtaaattgtaaaattttgtcttttttgtctccttttctccttcctttctgttgagagatggaatctcactctgtcacccaggctagagtgcaatggtgtgatcatcgctccctgtaaccttgaactcatggactcaagcagtcctccctcctcagcctccccagtagctaggactgcaggcatacaccactgtactcagctaatttttaaaaattttttgtagagatggggtctcgctttgttacctaggctggtcttcagctcctggcctcaagtgatcctcccatctcagcctctcaaagtgttgggattacaggtgtgagccactgtgcctggcctgggttgtctttttctttctttctttctttctttcttttttttttgagaccgggtcttactctgttggccaggctggagtgcagtggcgtgatattggctcactgcaacctctgcctcctggattcaagcgattctcatgcctcagcctcccaagtggctgggactacagtgccaccatgcccagctaatttttgtatttttagtagagatgcggtttcaccatgttggccaggctggtctcgaaatcctcacctcaggtgatccatccgtcttggcttcccaaagtgctgggatcataggtgtgagccaccgcacccagcctgggttgtatttttattgttgggttgtaagaggtcttgatatagtctggatactagatccttatcagatatatgatttgcagatactttctctgatttctgtagtttgttttttccactgtcttttaaagtttctttttcacaaaagttttaaattttgttgaagtccagtttatttttgttgttgttgcttgcattttggtgttgtatctgagataatctgttgccaaatccagggtcgtgaagatttacctgtatgttttcttaagagttttattgctggccgggcacagtggctcatgcctgtaatcccagcactttgggaggccgaggtgggtggatcacctgaggtcaggagttcgagaccagcctggccaacatggcaaaacctactactaaaaatacaaaaattagtcgggtgtggtagcacgcgcctgtagtcccagctactcgggaggctgaggcaggagaattgcttgaacctggaaggcggaggttgcagtgagccaagattgcaccactgcacgtcagcctgggtgacagagtgagactccatctctaaaaataaaaaaaaaacaaaacttttattgccttatctcttgcattttggtctttgttccagtttgaattaattgttgtatgtggtatgatgtaggggttcatctgcattctttttttttttgagacggagtctcgctctgtcgcctaggctggagtgcagtggcgcaatctcagctcactgcaagctccgcctcccgggttcatgccattctcctgcctcagcctcccgagtagctgggaccacaggcacctgctaccacgcctggctagtttttttgtatttttagtagagacggggtttcaccatgttagccaggatgggtctcgatctcctgacctcgttatccgcccgcctcggcctcctgaagtgctgggattataggcgtgagccaccgcacccggcctgcattcttttatatgtggatatctagttgtcctaataccatttgttgaagagaagatttctttccctattgaaaggttctggcacccttgtcagatcattagatgctagatatatggatttatttccggactttaagttttatttctttggtctgtatgtctgtgtcagtgttgccaccacagtttgttgttgttgttgttgttgttgttgttgtttctgggttttttttttttgagacgaagtctcactctgtcacccaggctggagtacagtggtgtgatctctgctcactgcaacctccgtctcctgggttcaagggattcttctgcctcagcctccggagtagctgggattttaggtgtgcgccaccaggcccggctaatatttgtgtttctagtagagacagggtctcaccatgttggccaggctggtctcaaactcttgacttcaaatgatccacctgcttcagcttcccaaagtactgggattatagatgtgagccactgcatccagccggcaccacagttttgattactgtggtgtgaatttccttagatgaaaaatttcaaacacatacaaaagtagaatagtctaatgaacaaacatgtgtccatcacccaggttcaaattcattcataaatctcatttcatatgtattctgccccctcctttcttttctccattatcttgatacaacctcagacatttgtaaatatttcaagaaattatataatgtattataagaaacatttatatcttaaatataaatttttagaagtggtacatttcattcatttggaaaattcacatacaatggaatcgttgtctgtgttgtcagataaatgaaatgtcattgtactttttcagaggcatttaaactagcgtttcaatttattgcttcagaaaattccatttggaagttttatgatcaaaagtacagtaattattatagtgttagacgtgttttttattaaactgctgtgttgaaactggttagccttgcctgttgtatgagagtcgtgattgccactccagaataggactttttccttatttattagtgcctatttgaaatgtctaacatgcgaccgggcatggtggtggctcgtgcctgtaattgcagaactttgggaggccatggcgggtggatcagttgagcgtaggagttggagaccagcctggccaacatagcaaaaccccgtctctactaaaaatacaaaaaattagccaggtgtggtggtgcatgcctataatcccagctacttgggaggctgaggcataagaattgcttgaacccgggaggtggaggttgcagtgagccaggattgcaccactgcgctccagcctgggcaatggagtgagactgtctcaaaaaaaaaaaaaaaaaaaaggaatgtctaacatgcctttctggttgccacttgtagaacataggtaggtgggcggggtgcggtggctcatgtctgtaatcccagcactttgggaggctgaagcagaaggattgcttgaggccaggagtttaagaccagcccgtgcaacgtggggagaccccatctctaccccctaaaaaaaatagctgagtgtggtggtgtgtgcgtgtggtctcagctactcaggaggctgaggtgggaggattgctggagccttgggaggtcaaggctgcagtgagccatgtttgtgccactgcacttcagcctgggtgacagagctagaccctgtctcaaaaaaaaaaaaaaaatgtggtgaattgggaatacaaaagggagtttgctgttctcaaagggagttacgttttaacatagcaaataggcatatgcacagataatacagagtgaagtgctgaagggagaaaatggagtatgagagtaccaccctcgagatttcacatttgcctcttaaagttattgtttatgcatctttaaaatccttttctaattaagtttgccatcaagagagcgtgcagattggaaggaatgggagtatgctgtgtgtttctgtgtctctagagtaccaagggtgaccatgaggaatatttgagatcttcagttgctcctgtattgccaataattttgtacacaggtgcagccagaccattctaatgatggtgttcaccaaattggttattcagaaatctggtcttgagagtggttgtctacataaaactttttgttaaaatttattagtaattattagtttgttaatattaatgatttattaatattagagtgccaggcactatacaagttaggtggggaaaatcctttaacagtgattaaggatcagagttaacttctatggagtacagagactgagtttgctttgagcacttaccatgtgattagttattttagaacataagttgtatctctttttttttttttttttttttttttttgagaaggtgtctcaagcaatctcagctcactgcaagctccacctcccgggttgatgccattctcctgcctcagcctctcgagtagctggcactacaggcacccgccaccacgcccagataattttttgtatttttagtagagacggggtttcatcgcgttagccaggatggtctcaatctcctgaccttgtgatccacccgcctcggcctcccaaagtgctgggattacaggtgtgagccactgcgcctggcccatataagttgtatcttaaggtgtttattgagaatgtggatctgaatttttatcaatattatatatatctgcagacataatcctaaatataaacttgtatctctgtaattatgaaacccaaaatattctttttttattattattttattttattgagacagaatcccaccctgtcgcccaggctggagtgcagtggtctgatcatagctcagtgcagccttgatctcctgggcttaagtgaccctcccacctcagcctcctgagtatctgggactacagacgcatgccaccacacccagctaatttttttgatttttagtagagatgaggtcttggtttattgcccaggctggttttgaactcctgaactcaagtgatgttcctgccttggcctcccaaagtgttgggattacaggcatgagccactgtgccaggcccccaaatagtcttatatcaaatagtaacaaatataaaattttgtaaagttccaatctgcagtattgatttgaaagatgatgccacgttgttgaatctaaatcagggcttctcaaactttgttcacctggggatcttgttagaatggagattttgattcagtagatctggggtgagggtctgagattctgcatttttcagttttttttttttttaacaggcctgagattttgcattttcaataaggtgatgatactgatgctgcttgtcctataactatactttgagtagtaggatctaaatgaccattttcattgtgaatgtattgcctcttacaatggatttcttttgagttcagcatgcctgaactagcaagagctcaattcttctgatacttttttttttatttgaactagtgattttgagctttacatgacagattcttctcttgacaaaaaggtttaatttacctagtaagtgtgcatctgatctttttcatcaaccggaaacaattttggggggtaggggttgtaaacaaaaccttgggttgctgttctatgacagtatactgtgataaagtggctgtctgtattcatcttaaatctttattatcaaattaaaatttaaaacaggtaaaacagaagttgctagagaattttgaagcttctgaaatccctgcaactctgtgttcctccccacttaatccagtttgtaaaagctgtactgatctgatagttagacatactggaatctataatacatatgaacttagggtatgtgtatcgggggcgtctacaagatttgtattcttatcaaattaatgtatcagatatttagaaaataaagggttaggctgaattttgtagaaggtgataagatacacataccctttgcattgcattgtataatatagtagcagtatggtttcatatcccttttaaaggagtcacgacttcataaggacatcgtaagctgggagggttttcttttgagacatagctagttctcagcttattgattgtagtacttgagccataacttcattaagagagttgagagtgaaaactgttaagatttgtggttataagtggtgggggccactgaggagcaatgactgctgggctttcccttcttttgtcttgtttttcctctttttgtatgtaactgttgatgatcaaagatgttctgggtaagaagatgaagactggggaaatgagatgtcagaaggtaacctgtagagaaggtgggactgaatttcccggtttctcttattgcagctgttactgctgagatagagttaagaataaagagaaggattccctcttatgctcttcttgtttactattattaagagttttggcggagaggggcagaagccaaagtaagtgaaaaagggcagcaacagtgttatatgtgacttatccttcctttaatactttgaggttttggacaatttgtccatcaacttggggatggggacggaggaaggagtggtgtagtttggattttacacttctaccaacatgctgtccattactataggtcctggtattgattaggaataggaagaaatatgggggtgcttcggttattattgtaccataacaagtcatcccaaacagtggcttaaaacaagaaaacttgtgattatctttcatggttctggaggttgactgggcttaatcagctggagttgtcagctggagcatctctatttgatctctcctcctgacctggacatccccattagcttggcagtgagcattccaagagacaggaagctgccaggttaaggcctaggcctagaaactataacaaaagttgcatccttctatttagcaagcagtcatacaactcccacattaaaggagatagacctccacctctcaaagagtgtcagagatattttgtgccaggttttaaaacctctgcagtgggtaaagaggcattggagaagagaggttggtaaaaaggagtcttagacatcttggagattttgaagtgtggaataatttggaaaggagttgaatttcctgtgtttcttgtctaactttacattcattacacaagttttcagtggaaaatacctgtcattatcaaatgaaatttgctaagtttggaattgagaggagatttgtacatgaggttaattttccttttactttgcagtgaacaattttttgtaatatgtgtctttaaaaggctttctactacattggtctcaagatgaagtatttgtcttactttttatttttatgtatgatttttatttaattccaaaagccaaactccaaagttgagtacatgcctgcacacacaataaagaaatactgtttttatacaactggaaaaatacaagttgtattttgttcttgacacataataattgtacatatttatagggtacaatgtgatattttggtatctgtatacattgtgtaatgatcagatcaggatgattagcatatctatcacgtcaaacacttgtcatttctttgtgataagaacattccaaatgctcttttctagctgtttgaagtataatacattattgttaactatagtcatcctactgtgaagtagaacaccagaacttattctcctaactgtaacttgaccaacctctcctcattccctctccttcctactcttcccagcatctggtaaccactattctactctttacttttatgaaatcaactttttttgattccacatatgaatgagatcatgcagtatttgtctttccatatatggcatctttcacttaacataattacatccaagttcatatgtgttgtcacaaaatgacaggatttcattcttttttatggatgaatagtattcacactgtgtagacgtacattttctttatccattcatctgttgatggacatttaggttgactgcacatcttggctattgtaaacagtgctgcagtaaatgtgggagtgtaaatattcttcaacatagcaatttcatttcctttggctatatagacccaatggtggaattgttagattatatgatagttctgtttttttgaggaacttctatactgttgtctctaatggctgtactaatttacatttccccccacagtatataatagttctcctttctccatattctcaccatattattttttgtctttttgtaaaagctagtctaaggtgtgatatctcattgtggttttgatttgcatttccctgatgtttttttcatatacctggtgcccatttttatgtcttcctttgagaaatgtgtattctgatcttttgcccattgtttagttggattatttgcttttttgctattgttgttttgagttccatatgtattctggatattaaccccttgttagatatatagtttgtgaatattttctcccgttctataggctgtctcttcactctgttggttgtttcctttattgtatttgtcggtttatgcttttgttgcttgagcttttgaggtcttaaacaacgttatgaagtgtctctcctgttttcttctaatagtttcatagttttggattttacatttaagtagttcattttgagttgatttttgttaagtggtgagatgagaatgaagaaataaagaataaaatgtttttaaaagactccttcattaagtatcattttaactccacattactgtgtttaatagaaattaagatactagaaaaagattatagatttgttcttatttttgtaacttataaaaatggataaaagggccaggcatggtggctcaccactgtaatcccagcactttgggaggccaaggcaggtggatcacttgagcccagtagtcactgtagttttcatgttttatttttggtcactgtagttttgccttttctagaaattcatataagtagaatgatagactacatagtcctttttggctgactgggtttcacttagtacagtatacttttgagattcatctatgttagtgcttgtagcattagtacttcccttttgttacccagtagtattattccattgcctggatatatgacaatctgtttatatattatctggtagatggatatttgggttgtttccagcttttcctgatttcgagtaaagctgcaatgaacatttgagtataagtctttgtgtggacatgtattttcatttctcttaggtaaatacctaggagtgggattaggagtgggattgctgggtcgtatggtaagtgtatatttaacaagaagctgtcaaactctcttccaaagtgactgtgccatttttgcattccctctagggatgtatgtgctccagttactccatatccagtctcaacacttggtattattaccaatcttcaattttaggatttctagtggctgtgtagtgacatatcattgtgttttttttttgtttgtttgtttgtttttgagacgaagtctcactctgttacccaggctggagtgcagtggcgtgatcttggctcactgcaacctttgtttcccaggttcaagcaattctcttgcctcagcctcctgagtacctaggattacaggcacgagccaccatgcccagctactttttttgtatttttagtagggacgggatttcaccttgttggccaggctggtcttgaactcctgacctcatgtgatctgcccacctcggcctcccaaagtgttggaattacaggtgtgagccaccacaccctgcctttattgtagttttaatttatgcttccttattagtgataacatcttgtcatgtgtttgtcattctttcatctcattggttatgtgtctgttcaatcattttcccatttaaaaaattgtgttgtttctttgtaggcaaatcctttatgagatatatgtattgcatatattttctctcactctttgtcatggcttttcttttcttcattttttttgagacagagtttcgctcttgttgctcaggctggagtgcaatggtatgatctcagcttactgcaacctccgcctcctgggttcaagcaattctcctgcctcagcctcctcagtagctgggattacaggcatgcgccaccatgcctggctaattttgtatttttagtagagatggagttttgccatgttggtcaggctggtatccaactcccaacctcaggtgatccacccgctttggcttcccaaagtgctgggattacaggtgtgagccaccgtgcccagcctgtcttgccttttcattttgctaattgtgtcttttttttttttttttgacagagttttgctctgttgctcaggctggagcacagtgatgcttgtgccttagcttcctgagtagctgggattacaggcatgtgccaccgtgcctggctaattttttttctattttttagtagaaacaggatttcaccatattggccaggatggtctcaaactcctggcctcaagtgatccacccacctcccaaagcgctaagattacaggcgtgagctactgtgcctggcctattttgttaacagtgtcttttttaaagttaaacttttatttcaagattattatagattcatatagttgagacagggtctcactctgtcgttcaagttggagtgcagtggcacaatcatggctcatcatagcctccctctcctgggctgtcaatcctctcaccctagccattggagtagctgaaagtacaggcacatgccactatgcctggctaattttttcttcttcttctttttttttttttttttttttttttttgagacggagtctcactctgttgcccaggctggagtgcagtggcatgatctcagctcactgcatcctccacctcctgggttcaagcaattcttctgcctcagcctcctgagtagctgggactacaggcacacaccactacacctggctaatttttgtatttttagtaaagacggggtttcaccatattggccaggctggtctcaaactcctgaccttgtgatccgccagcctcggcctcccaaagtgctgggattacaggcgtgagcccccgcgtctggcctgcctggctaatttctttgtagtttttgtagagtcagggtttcgccatgttgcccagtatgatctagaactcctgggctcaagcaatccacccacctcggcttcccaaagtgctgggattacaggcgtgagccactgtgcccagccattacacagataatgacattgatacaatccactgattatattcaggtttgccgagtttcatttgtactctttgtgtttgtgtgtgtgtttatatatttagttctgtacaatattattacatgtgtaggtctgtatatccattacacagtcaagatgcagaatatcagtgcaaaaatctctcatgttgtacatttgtaaccatctccttcctgtactccctacccacctccccaacccctcacctgtctctaacctcaggtgtcttgtatgtttctaaacttttgtctttcaaaaatgttgtattaatggaattaagtatatatatgaccttttgaggttggcttctttctactcagcctaattctcttgggatctatcgaagttgttgcatgtatcaatggttcattccattttattgatgaataatatttcatggaatggaaatgaaccactgtctattcaaccattcacctattaaaggacatgtgggttgtttccagtttttggctattgaaaataaaattgctatgaacttctgtctacagatttctccatgaacataaatttttgttatttaggtataaatgtgcaagaatgcagttgctgggttatgtggtaagtacatttttagttttgcaagaaactgatagactgttttccagagtggcattgccattttatatttctaccagcagtgtatgaattttccagttcctttctatccttaccagtattggttattatcactattatgggggaggagggcattctcattggtatgtagtgattcgtatgtagtgatatcccattgtggttttaatttgcatttcccaaatagctaatgatgtgaacatttatttgccatgtgtatatcttcagtggaatgtctttttatgccttttgcccattttttaattggattgtttggatttattttactgttgagttttgagagttttgggtatattctagttgttaatccttgtgatttggaaatattttttcccattttgtagcttgttcttcattcccttcacatagtctttcacagcaaaagtttttgatgagttccacttcttttggattgtgcttttagtttcaagtcttaactcttaactctttgcttagtgctagatctgaaagatattttactcttttcctaaaagtttatgcttttatttatttttttaagtacatcatatatcttgggttcactcttggataaggactgagggtgaggttcatttttgtgtgataggtgtccatttgctgtagcactgtttgttaaagaggctaccctctgcttttgcacctttgtcaaaaattaattggttgtacttttttttttttttttttttttttgagacagtgtttccgtctgtcacccaggccgtagtgcagtggtgctatctcagctcactgcaacttctgcctcctgggttcaagagattctcctgcttcagcctcctgagtagctgggattacaggcacctgccgccacacccagctactttttgtattttttagtagagacggagttttaccatgttggccaggccagtcttgaactctgacctcaagtgatccacctgcctcggcctcccaaagtgttgggattacaggcgtgagtcactgcgcctgggcctaaatggttatacttctgtgggactgtttttgggttctctctcttctcgtcttgatctgtgtctattcctttgccagtaccaagagctttgcttaagtcttgaaatctggtagtatgattcctcacattttagtcttttttcaaaattggtttagctattctagtttctttgccttttcatataaatattagaataaccttgtctctattggttatgtcctaaaaatcttgctgagatttttattggaattgcattaaacctgtatatcattttagggctgattgtcatctttactgtgttgagtcttatagcccatgaacatggcatgtctcttcacgtagtcaagtcttggatttctttcataagcattttgtaattttccacatataagtactttacatattttgttagatttaagtatgttactttctttggaataactataagtaatatgattgttttttccccctcagtttttctgtttgtttgtttttttgttttttgggttttttttttttttttttttgagacagagtctcattctgtcgcccaggctggagtgcagtggtgtgacctcagctctctgcaacctccgtctcccaggttcaagcaattctcctgccccagtctcccgagtagctgggattacaggcatgtgccaccacgtccagctaatttttgtatttttagtagagacagggtttcaccatgttggccaggctggtctcgaacttctgacctcagatgatccacttgcctgggcgttccaaagtgctgggattacaggcgtgaggcactgcacccggcctccctgctcagtttttaaaaaataaactttaatttgtagaagttttagattgtgaagataatacagagtctccatgtgccccacacctagtttcttctgttattactatattagcatggtacacttgtttcagtcaacgaatcaatattattaagcgaagtgcatactttgtgtagatttctttagtttttctctactgtcctgtatctgttccagggtcctatacaggataccacattacatttagtcagcatttatccttagatttgtcttatctgtgatagtttctcagatttcattatatcactgatgtcgatgttgatcacttggctgaggctgtgtttgtcagatttctacattataatgttactcttttcttcctctttctatattgtactctttggaatgaaatcactgtacacagctcatagtttaggagtggaaaattatgttccacctccttgaggatgggattctgcatatttagctttcttctgcacacgtttgtctcttccccatttatttacttaatcatttctctctaatagtatgactagtggaattatttcatactttagcttataatttaatattgttacttaatttgttcttctaattaattaacatattaatttgttgctcccattgcccattgggagctctttcagttggctcatgtgtccctttgtcatagactcaacattgtgtgtgtgtgttttcgtgtgttttggcattttcttgtttgtgtgtttgttttttgtttttaaatcatttccttacttcctaccattacacagtgctccaggcttgttttgtctgtgtccagcccctgccccagaatcagccattttgctttcttaccaggaattggtattgtcagtttcttggattttagcaactctgataggtatataccactatctctttgttttaatttgcatttccccagtgacaaatgatgatgaacatttttcatctactccccctgcccctaatttgacaaggtgactgcccacattttaattgggttgttattgttgagttttaagagttctctgtgtatttgggatacaggtctttcagctagtagtgctttgcaaatatctctttcagtctgtggttagtgttttcattttaatactagtatcctcagagctctatttctgggctgcctggtctgttgccttgatctgtgtgtctcttctttcaccagtactacactgtcttgatagtaattttataataaatcttaaaattgagtaatgaggcttgcagctttgttcttcagtattatgttgacttatgctaagtcttttgcctttctgtgtaaactgtaggaatttcatagctatgtttgaatttttcaagcaagtaaaaaactagatcatttcccattttctaggaaggcagtagaacctggtgttaaaatttgggcttgaattcctggtatgctactttgtagctggtggcctttaaaaaattaccatctttaagaataattttatgtaattgttatgaatattaagtgacagtgtatatattatgtctaggcattggtcagcacaatgcctgaatataagcatattaaaaaactgttcatcttatattgttagtcacaaaaagcctttcagacttaataatgtacaaatgtagtcctatactttgttatcctagagatgtttattgatgaattctccagaaatatagctaatcacaagaagattcttgaagctattttgatgaggtgaatatagtttgggtgagggccgataaatttttggaaatgagatgccaaacttcagccttctcttctcatgcagttgtcagaagctgctgtagtgtgaaatgttgccagagatgcctttggggatactcctgggagatgctagggcagacttaggttcttgttacctgaagagacctgagaattgtccttgattcttccttactcctttctatattcatcctgttgaccacttaagtgttgttgattctattcccttaatatttatctaactcatttacatcttgcctgccactggtgcaagtcaggtgctcattgtttctcattacagttactacaaaagcttcctaactggtctccttgcttcctgactagtcaggattcagccctgccactcattgtaccagatgtagcattctaaaatgcttttatatatatatatacagggttttactcagtggcacaattctagcttactgcagcctcaacctcctgggctcaggtgattcaggtaatcttcccaccatagccttccaagtagctgggacaagaggcatgcgccaccatgcctggctaatttttttatattttttagagacggggtttcatagtgttggccaggcaggtctcgaactcctgggctcaagtgatctgcctgcctcagcctcccaaagcgctgggattacaggtgtgagacactgcatccaggcctaaaatacaaattggattatgtcagcagaagtaagacatctggctatggaatcagacttcctggattcaaatcccatatctccgactcgtgtgatcctgggcagattctctgtgcctcagttagtagttacttcatctgtaaaggaagaagaatgacagtgttcagatctggtacacaatcacctggaaatattgttgctaaaaatatactgcctggcttccccctcagtttctggttccctctatcttgggtggggtcaataaatacataatgctcaaacatttcttgggtggttcagatgccttttgtgagccctcttgaggcataacacaccttgttgcctttaggcttttgtacttactgtgtctggtatgtgtaccccttttactaagaataaggtgcctctgactttcccattctggatttggtactgtaggaagtcaccaccactgcagcagatcagtgtcaaattatctaaaatgtaggaagaaaaggagcacatttcaattctggccaactatttataaaagcattaagttcttttacttcaaggcatttaacattttgcaatttggggtttactggtttgctgtcttccctattaagcgccttaaggctaaattctatatcctcaatgtcttgtcatataatcttttaattatatttataatatggttgaaagttacttctctttagaaattttctttactgagaccgggagcagtggctcacgcctgtaatcccagcactttgggaggccgagggtggctgatcacaaggtcaggagtttgagaccagcctggccaatatggtgaaaccccgtctctacttaaaatacaaaaaaaaaaaaatgaaccgggcatggtggcgggctcctgtagtcccagctactcgggaggctgaggcaggagaatcgcttgaacccaggaggtggaggttgcagtgagccgagatcacgccactgcactccagcctaggcgacagagtgagagtccgtctcaaaaaaaggaaaaaaaaaaagaaattttctttactgaactaaagcatctcttacaaggtgtccattataaaggccacattacatgagttgttttcttactgtgccattcatttggattcatctgcctttgctacttggacattttagactggactgccttcattttctgtaggttttagctggaacttaatttggtttactccaagtaagttggtaggtgacgacattgttggatggatccagaaatgaaaccaggagcaagcaggtttagttctggatttttggttaagtattttatttagtgaatcattcctaattcatttagatttgaatgtgtggttatgtttttctcaggacattcaatccttgtgcattttagttttcccattggtaaaatgagataataggctaggtgactgatctctaaacttccttccaactctgaaatttctgctattccaagtaaaaatgcacagggatccaaatatttaggtgttgttattgatcgtcgagaaataagacttgttttatgttttaagatctcccattttataaataacttcattcagacgcacaaaaaacctttggtatctgtaaaagttaatttccttttcttgattaccctgatttttttctggagcttttcattatctgttccttatttgagtgtaatccagaaacttcactgaagcagatgtagggaggctgataagtagatgtaacttgtgttgtaatgaaagaacttgccaaatgatttttctcattgtgctgctaatgcatgaaaaaggttaaaatgataaaatctatataaatgaatgattattttgcttttaagtagcatttaggatgtttttgttttcatttaagcaccaaggatgacattgatcttgatgccttggctgcagaaatagaaggagctggtgctgccaaagaacaggagcctcaaaagtcaaaagggaaaaagaaaaaagagaaaaaaaagcaggactttgagtaagtatattttaaatatatttgatttttatttgttttggtactggattcacttaataaaaactataccagtgcttcacaatgtattttaatccttttctagtgaagatgatatcctgaaagaactggaagaattgtctttggaagctcaaggcatcaaagctgacagagaaactgttgcagtgaaggtgaaagacagacctttgttacctattcgtatttcgtattctattctttcttcttaatgttggtttggggagctacatttggaaacttttgagcagtgtacaatatgttatttaaaagcttctatgaaatctgatgtcaaagggaaaaataggaatgtaaaggtattttgtggtatgttgattgttcataaaattggtacatttggagttgtgatgtaatcactcgttccatcttcagttttctctgttgtttctttttcatccttcgaatttggataagcctcagagtaatgggaaaatcatagatattttttcttctttcaacttgtcccttaggctttgtaaagttagtaaatgggtggtgactagtgcctgtttcaagagcccctggattctgcaatttacaatgatgcgagatgtgtctgaggccaaggccaacctctcttgcttgtttgaattttatattcctgtgaaaaagactttgaaaaagattttgaaatcattttgagatttttaaaaaatgtttacttaatgaagcacatgactctggtctcaattataattctgttaattttttctaacaatggaaattttttagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaaggttggttaatactttagaggaaagagcaaaaggcttttgattcacagtataagttgtaatcattgtgccccaaggtcgttttgttatttgtccatgggtataaagacacttgattgtaaggagccatctaaaaaattacgtctaagtatttgacttgatttgcattgttaattctttacatatatagtataaatatctttcagattatttatgtacagactggaatttttatagaattgcattatgaaaactattttttttgctgttgataaaggctatagaagttacttaatgaaaaatttattcttcctttctgataactcagtgtcagataatatttgaattctttcctgtctttaaaaacctagttcaatttatgaaattcacaaagaaatgttttcatgaagttgctaatattttctgcttcacttaaaactcaacatgctaaaattagtgtcttttaagcaataatgagccatttttttaacaaccaattataaaataaaagttctagctaatttcttcctcttatttagaatgaaaatagctaaagatcagatggtttgcatggccatactatattcttaaaacagtagtttttgggctgggcgcggtggttcacgcctataatcccagcactttgggaggctgaggcagatcacgaggtcaggagatatagaccatcctggctaacatggtgaaaccccatctctactaaaaatacaataattagccgggcatggtggcgggcgcctgtagtcccagctactcgggaggctgaggcaggagaatggcgtgaacccaggaggcggagcttgcagtgagcggagatcgcaccactgcactccagcctgggcaacagactgagactctgtctcaaaaaaccaacaaaagcagtagtttttcttttgactggaaaacttttaatgggaaaattgacacaacttttttttttgagacggaatttcactcttgttgcctaggctggagtgcaatgacacgatctcagctcactgcaacctcctctttacaggttcgagtgattctcctgtctcagcctcccaagtagctgggattacaggagcccgccaccatgcccggctaatttttgtatttttagtagagatggggtttcgtcatgttcgccaggctggtctcgaactcctgacctcaggtgatccatgcacctcagcctcccaaagtgttgggattacaggtgtgagccaccgtgcccagcaacttttttaaatgctagcatatttattatctggatatattcgaggaggaacaccatgaaagtaccttcatagcttttaattctttagagttcttggagtataactacctatatttttgtattttatcctactaataccccctaaagtggacatcattctcattaactccatcttgtagaagtgaaattagctacagaacttacgtgggtgttagttcattctgattgttagaacttcatataagcatctgttggacaccagccactcaggtaccatggatttagagatacattaggtacaggattgcccttttgctgctgacagtatccttctgtcttactgtattcctcaggacatctgagaccaacatcagtattgcagacttctcaggaggccatctgtgagttattctgagctattctagttaccaaagtgctcaggatgccttgatgcctgtagaacttagcctgctgctggcatcggccttggcccattatggtccttgaattgtggttgggttttgctcgtcatcaccacagggaattgttttttcatttcaatgctttgcctttattctttttggtagatgacaatgaaggagacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggtatgttttcatgaagttggtaacattgatattgtgtttaacttaaaatctattctctgtaaaatatctttactcttctaattctgaaaatttcatagttgcatggtaattcagttatattattgttccgatacaaataataagatgaagaggtacagcacatcttatctttattttctcaagaacagattgctcgatacataagttgcttatgtatcattgccaataatctgatgtgatattaattaataatcatgtataacatttaaaatactttgatttggaatctcctaacataatactttgcatgtgtctcaagagatttatttgaagtttggattgtttacatttgaattttatagttcattaaatgaatacaggttttgtctgacatgtactcttttataggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgagtggtactcttcattaactgaatggtcagagagctctgcacatgcagttatatcccttaatgttcagaaggagaatggaatttgcatcaggacagttcctatgaaaaatctgtgaaaaagttcagtaaaacgtaaggaataggtgatgtcatttcattgtttaggaagatgacatctacatgaggataaaaatttatatgtaaatgatagtatgtctaaataagttatcctcccacaaacaagaatagtgataataatagaatgagtccctgtgtacctatcagccagcttcaacaattaggaccatttgacattcttgttttgtacctctccatctactttttatcctagcatgttttaaagtgaatcccaaaaaataaaaaagaaatacagtgattcccagacagcatattagtttgcccacatgaccacggtgaaaaagtattcatgaccatttttttttaaccctttccttactttctgatgcaacaagatatcccaggttcatcttgcatgggctgagacctggaatcggttgtttatccaaagagcttttgttccttttagagggtaatagtgtttagagatcacaactgggcatataatttattacttttttgaaaggtaaggtgatttaaaatagtgtctttgctccaatgagaagaatatattgggacctctcttaaatttcctgctcctatattccctagatttttatattacagtcattttggtgtttatgctataattacagtaatagctaccatttattgtgtgcttagtgtgtaactgatgctacaatgtctttgacattgtctatttttccctcataaaaaaatcttatagctatttttacttccatcatatagatgaagaaatggtggttcagagtgtaaacagcttacccaaggccacagagctgaaatttaagctggtctgtgcaactttttcttacgcatatgttcagctaggaacattagatgtgaagaaacccagtacttagattttagaaagttttattcttaatggagaatatagcttttgtaaaattttaaatgaaattaggtacaaacttgaatatagttagcattcatacatcagatttcattggtgactattggagaggctaaaagcacccatgaagaaattcagatgggaccaagcagggagtaatttgccagtctcaaaaatgctgttttaaggagcagttagacttgtagttatggaaattacagtgtagaatggtggacttttagcatcagtctttagcattaggcttgtaagagatgctctctcaagtggcatccctgacgctggtctcttactcttcatagtgttgtccagtgtttaccatcttattagttccctattgtctactaataagaatccaaattccttagcttgacattcaaggttcccccccacccacagcccactcatgtgagtcatctcattaaaagatcctacagtgttgtttcatcgtatgtttgaaagacagctgcttaccacatttattacctagaatattgtaaaacttattcattgagctaaaaatgtactctcagagagtgtaggcatctgcaggtgtcttcatataattgctctgaaatgtgcagcaggttaacttttcagtcatcctttagcctgtgactactaagcatatacacacacacacatatatgagtactttatcaataatttgtaataaactcatttcaggcaaagagcttcttcaagaacttgattgttatgtctcagtttgcaaagtgaatggaatgtctaaacacatacaagtcttggtgttgattccaagtacagcagcttatttgagagtctgagactagagcagtagtcagttgattaagtctagggtgttattgggaccacccttcaggtaatccagcctacagtttcccctcaggcccatgcttttcatcttagtaggtgtaggctgctaggcaaggaaaacttaaagtgatgatctctgcattctcagctggctttatcctctttctttggtttgtttaatgtattcgtcttaccagtcatagctatggttttaccattctagccattcttcagtacatgcacaacacacatccatatacattcctacgttagagataacatttttagtcattttcctttattagtgacttcattcaaaatcccatggtatacaatttctgttgtctttattctaaggcttctgcccatagtgagagactgagtcagtaatccagtaatctgtagattcagttcaatcccagtcaaaatcacagcatggtattttgtagctatctgtcaactagttctaaaatggatatgaagagaccagagagttagaatggccaaaatatgtttgaaaaaggagaacaaacttagaatacctgatttcaagacttagtataaagctataggaattaatacagtgtgatattgccagaaagatagacaaacagataaatagtctatacatggttagtatataggtgaaaggtaattcagtggataaaatacagtatttgtagcaagtggtactagaacaattggacatctgtatgcagaaaaacccaaaaccagttttaattcccactgtataaaaattgacccaaatgggtatcatatgtaaatgtaaaatatacaataatactttcagaggaaaacataggaggatatcttgtgttaggcagagtgcttagataggactctaaaccataaaaggaaaaaagatacattttgagaaagaccagttcagaacttttctctgcaaaagacactgtcaagagaattccaagacagtacctccaagtcagatatctgagaaagaattaacatccaaaatatataaagacctctcaaaattcaactataagaaaaccaataagttcatttaaaaatgggcaaaaggtatcaacagacactttcaccagaaagctatacgcatctgaaaagaatgttctaaaaaaagagaaacctttaccacattcagagcagttgaaactctttttttttttttctctctttttttgagacagagtttcgctattgtccagactggattgcagtggcgcaatctcagcccactgcaacctctgcctcccaggttcaagtgattctcctgcctcagcctcctgagtagctgggattataggcacccaccaccacaatatatatatattttatataatacaattttttgtatttttagtagagatggggtttcaccatgttggccaggatggtcctggactcctgacctcaggtgatccacccacctcggcttcccaaagtgctgggattacaggcgtgagccattgcgcctggccaaaactcttctgcattagtggtgggaatgcaagatagtatagccactttggaaaacaactggcagtgtctttataaaaattaaggtcatatttaccttatgtttcatcattcacactacaaaatatttgcccaagagaaatgttcacacagaaacctgtctgaaaatgttcatacctgctttattcataattgcaaaaaaccagaaacaactcaaatgtccttcagctgttgaatggataagcaaactgatatatccatacaatggaatgctgcccaacaatgaaagtaaacgaagtattgacatgtgcagcagagtgagtgactctcaaatccattatgatgatagaggccagaccgtaagattccatttatgtgacattttagaaaaagcaaatcttttggttggagaacagatcagtggttaccagaggctaagaaggtaaggagggtttgattacatggagcagcacaggatgatggagtgatggagcttttctgcatcttcattgtgatggtgatacacgtatcaaaactctcactgtatgtgaaacgaggatttttactgtatgtaaattttaaaataccttatatgtaaaagatacaagtttttccatgaatatcctttcatattttagggtatgtgtctctgtggtgaatgaaatgctatcctttaaatagtacttctcaggtgacatgcaagtagtataagcctgaagtttttcatttttatccctcaggtgttgaagtgccatcaaaagactctttgccaaagaagaggccaatttatgaagataaaaagaggaaaaaaataccacagcagctagaaagtaaagaaggtttgtatacaaaatagcctctaatttaggaaatatgttgtttgcctttcccccacaatcttcaaaacagtgtctgtaaagaagaaaggaaaaaatccgaaatgcatattgaaacttattttctaaacttatttcttattaatgccattattctcacttgattcaaatgacaagctaatggaaaaagtattttactttgaaaaatctgggttctaccctatgaatattgtaactgttgttaactctgagaagtaaaactaccattcttatcttttcttggtttccttcttagccttctgtgatttttgtattttatttattgagcagaaagagtagtttcctgtaaaacatatgactatatttaaacattttctaaacttgaagaaataggtttgcacaggctgggtacagtggctcacgcctgtaatcccagcacgctgggaggctgaggcgggcggatcacctgaggtcaggagtccaagaccagcctggccaacatgatgaaaccctgcctctactgaaaataagaaaattagcctgtcatagtggcaggtgcctgtaatcccagctacttggcaggctgaggcagggagaattgcttgaacccgggaggtggaggttgcagtgagctgagattgtaccactgcactccagcctgggtgacagagcgagactccatttcaaaaaaataaaaaataaataggtttacactactgttttttattcagtacttaatggagtatcttaacagaaattatacaccaaaaaaaatattatcttggtttctgcccctttttcagtgtctgaatcaatggaattatgtgctgctgtagaagttatggaacaaggagtaccagaaaaggaagagacaccacctcctgttgaaccaggcgggtagtgttatctgattatttaattagtgaattcttattaaatagtgttggtgtgtcataagttgtcttagttattataaataattggggagaaccaaataagtatctggctggatggccctctttcttcatagttctttcttttctatttcttttcatttctactttgaataagtatccaagtgagacttgaatcagttgtgttcttttcagcagtgttagaaaatgttttgtagaaaggatacactttgggagggtgaggcagatggatcacgagatcagaagatcaagaccatcctggctaacacggtgaaactccatctctactaaaaatacaaaaaattagccgggggtggtggcgggtgcctgtaatcccagctacttgggaggctgaggcaggagaattgcttgaacctgggaggcagaggttgcagggagatttcagtgagcctaggttgcaccattgcactccagcctgggcaacagagcaacagtccatctcaaaaaaaaaggaagaaaggatagtaggttttggattttctctgatgcttttatttatgagtcagaaatctcaaaaaaagatctgaaggtcttcatttaatgcttcagaagcaaattggaaggatttttaactagaactttttaagaaccataaaaattggcatttttagaccttcctaaaggtcggcttctatttacaataatcagagaattcaacttactcattgtggggtatctgtgtatatgttgaggagttggggaaaaatctctggttttaaaaaaaaaacattgttctaactcttacgactagatattgatgggagagctggggctgcctaaatgtatgtttggtattcaagagaatccccagcgattaaagataggatcaggaatgggaaaagcctttacagaatactaagcctgatttacattggtgaattatattattgatagttcctttccttctttttctcttttctcttctgagcgaataggatcatctcacctgggtagacctcagcctagcactgatatgacgagattagagaaatttagattgatatgcttaatagcagtccactattttagatcgtatttttagcaccagaaagaattgctaatttagatggatgttttgggtacctgagtctcatttcctcctcaagataacttatgcaggcttgttagtaaataatgattatttcagggaagcaggtaccacatgtcctacccgtcatcttactttcatttaagaatagttgtgcctggttagatttcagtaaagaaaagcattcttgttaagaagagtattaggtctttaatgtctaaataatattcagaattttagctttctggctgttttggggttatgagcacagcattgacccagagtgatggtggtagttttgtaccttcaacttcagaatttaagtatatttaaatacctgtaaaggttaaaagcaaaataataaattccttgcataaagtatgagttggatgatcaaaaagaagatatatatgaaatttcatttgttttcaagaactgagtatattcatgtagctttttcaagatctaaagaaacatttaaattaattaaattaatgaaacaattagcttgaatgtaaaattggttaagtttaatatgttggcagtagtaggaaatggaagcatttaagtaatagtaaattataacatgctagctatattaaaaagatagttctggctgggcgcggtggctcaagcctgtaatcccagcactttgggaggccgaggcgggcggatcacaaggtcagcagatcgagacaatcctggctaacacggtgaaaccccgtctctactaaaaatacaaaaaattagctggccacggtggcgggcatctgtagtcccagctacttgggaggctgaggcaggagaatggcgtgaacccggaaggcggagcttgcagtgagccgagatcacgccaccgcactccagcctgggcgacagagcaaagactccgtctcaaaaaaaaaaaaaaaaagatagttctaaagataatagctgcatacatattttttacataattaaaacattctttttttatgtcagagcataattttttacttttttctaaaagaccttcatatttctaaataatttttgtgtcttaaatgcaaatttttacttacagaagaagaagaagatactgaggatgctggattggatgattgggaagctatggccagtgatgaggagacagaaaaaggtgaatacctcataagcacacactgatacatccagtggttattagaaatgaatgatatatatttaaatgaatagtcttttgattatgaaagccatatgaacatttctggggatagggataagtctcttgttctctcctttgccatggtttctaagtcctcaagtggatcttcattttgtgaatgagtggttcctcagaatgttatttgtaagatagctgcctaaggtttagaatgcattttttcagagtgatgatgttacaaaatagggttgttactaaagctgacctacaaaaagcactgttaacttaaaaggtaatgagataaatactatagttcctgataagtatgaatagaaagtaaacgtttttgtcattgtttccccttctttattactgaaatctctacttcgagatttaatttcctgttaattttactaacttactgataatgatatctggctctttgatttttttcagcctccccccatctttgtttttaaagctatacctttttctttaagcatggctttagtcaaattctgtaagtctgatatgttgatattttctcattttcattttgatgtattaagttttacaagatttatttagtgtatttcttttttttgagatggagtttcacacttgttgcccaggctggagtgcagtggcgcaatctcggctcacaacaacctccacctcccgggttcaagccattctcttgcctcagcctccagagtagctgggattacaggcatgcgccaccacgcccagctaattttgtatttttagtagagatggggtttctccatgttggtcaggctggtctcgaactcccgacctcaggtgatccgcccgccttggcctcccaaagtcctgggattataggtgtgagccaccacagcccgcctagtgtatttcttaatttacaaaaatgggcattttctaattgtcttttgttacttcattgtgatcagagaagatacatgattctatcctttgaaatatgttgattattgctatacaacctagcatggtcagttattgtaagtgtttcatgtttggaaagaatttatattctgcagtagttggatgccttgctttctatatttaggtcaagtttgctaatcattttgttcaagtctttcatagcgttctgagggtttttttgtttttgcttttgttttttttctgatctgttttttctctctgttactgggaccaatgccttaaaatctcccatcatgattgtagattgtctatttctcctgagttctgttaatttttgctttatgtatttttatgctgtgtcattaggtaaacacaatcttgtatctttctaatgaattgactcttttatcattgatatatatatttctaacaatgccttttgatataaaagtctacctaaaactcatataggtacacgagctttgatttacatgatctttttctatctttatgactctttttgtatccgtaaatagcattatcttagtccatttgttctgctgtaacaaaataccacagactcagtagtactaaagaacagaaatgtgtttctcacagttctggaggctgggaagtccaagatcaaggcaccagcattggtgcctggtaaaggctgctgtctgcttccaagatggcaccttggtgctgcatcctccagagggaaggatggctgtgtcttcacatgatggaagggagggaagggcaagaggagcaaactctctttgaaggcacttttctgcgggcgtgaatccatttatgagagtgacttaatcactccccaaaaccttccccaccaccctcctacctcctaccagcaaaatggggattatgttttaaacatgaattttagaggggacaccatttacaaatcacagctaggatctagttgagattttttcaatccagtttgtcaatctttatattttacctagagtacttagcctgttcattaaatgtaacatttggtgtaattaatgaagtatattgattttaaacatttcatcttactaagtcgttttttgttctgcctggttctttttctctcctttctaatcatcttttggttactaggtttttaaatttttatttttttttcctttcatgagcttagcagttgtatacctttcaaacaactttttagtgattaagaaaatttttagcaagtacctttgaactaacaatgtctgatgttatcctctaacaatgcagggactttagagtacttgaatgacatttacccaatactctatttagatatcattgctctcggccaggcatggcggctcacacctgcaatcccagcactctgggaggccgaggtgggcggatcacttgagatcaggagattgagattagcctggccaatgtggcaaaaccccacctctactaaaactagaaaatttagctgggcgtggtggcgtgcgcctgtaatcctagctactcaggtgactgaggcatgagaatcgcttcaccctgggaagcagaggttgcagtgagctgagattgcgccactgcattccagcctgggcgacagagcgagactcttacctaaaaaaaaaaaaaaaaaaaaaagatataatttttctcatttcttttcattatctatttaaaacctcaaattagcttatattttatatagtcaatacttactatttataagtttacccacattcttaacattttgttgcgcttcgtttcctgcatcttgtaccttccatttgagatcatttcttcctatctgaagaacactttagagttttttttagtatggatcagttagtaagacattctgttttgctttctaaaaacatctttattgcatcttcattctttagttttatatgtttactgagtgaggaattattggttgaagtttaacactttgaagttattattcccttgccctggctttcattgttcctgttgagaagtcaggtatcagcctaaatttttcatatggtcttgcttttcagcagttttatcatgacgtacccagaataggctttttaaaaatatattctacttgtagagctttattaatatatggttttatgtttttatcagttttatgttaggagtcattttctccctcagaattccaatgatgtctctgataggccctcttattgtatcattgtttcctattttcttttctgtattttccacctagtgagtctctgtggttcattctggattgcttctcttgactgtcttctaggtcactgattttctccttggctctttctattctgaggttagatccatcttttgagttctcaatttcatttgttatatttttcagttttagtatttccatttaactttttttatagttttaattcaccttctaaaattttaactttgtcttttgcttctgactgaatgttagaagcacagccattttaaaattttgattttatgactttattaaagtccttttggtgttttatatgttggttcttctcacgtaaattgttttctcatgtgccttgctatttttatagctggatattttgcttggagaagtaatttgaggtcaaggatgatgttttcttttctccagagctaatttatgtgttacttccacaaggtacctgagtgaactagcaatatggaataatcttattctagatttagaatccagaggatctgaaggtgatctgccaataatggggagatcctgtttatttcttattcatccttattcctagggtacagctcttcatgattgtaccccacagtaagggtgtaacccaatgtctgctcactgcaccccactgaattcttagtattttggtaggtctggactcccaatgcagcttagcctttcatctgcctcttcccgaatcaacaaatgaccataaggggaaagtggtactaaagactgttccacctccttgagttttgttctcccatggattctgtcttactaatactgacttcagtctggattactgccttaaggttttactgttaagtgacagatttcgttttagcatatagacaaacaccttgcgtttatgatgtatgaaaacaccatgttactgccttaaatacaagttgagcctctgaaattcaaaaatctgaaatctgaaatgctccaaaatcaagtttgagcaccactacgtgacgctcaaaggatatgctcattggagcatttcgtatttcaggtttttccgatttcagatgcaaatattccaaattaaaaaaaatatgaagtaagtatagaatgcaaatattccaaattttaaaaaatctgaaacagttctggtccaggcattatctcctccccttactttaaagcaggcttgtccagtctgcagcctgtgggccacatgcagcccaggatggctttcaatgtggcctagcacaaatttgtaaactttcttaaaacgtgagacttttttttgtgatttttatttttaagctgatcagctattgttagtgttagtgtgttagtgtattttatgtgtggcccaagacaattcttcttgtaatgtggctcagggaagccaaaagattggacacccctgctttaaagtctcttatcttgatataaatctatcatattaatgtttatttatttaaaaatatatttgctttcgtagtagaaggaaacaaagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgaggtatttattttaccgtttctctctacttttcttcccactcctctgtgatgattaaaacagtactctacaactaaaggctttgaacagcactttatgtattctcaagaatagaacaccgttcagtttttgtaatgttgaaatattactggcctttgatactggtcttacccaaggaccccccgtccccgctcttacctaagatagaatggtgtgactacttcatttttttcttgttttctccaaattttaatgtactctttgagtgatagtttataagtatgcagaggtattctgagcatatgccctctgcttataaacatcagttatgtgtttgcctcacatatttaggttagtcaccatgaggcatctgatcactatagttatataaatctggtgggttgatgaggcttctatttagtaaagtccgatacctgatagactttctgtatttttcctacttaatgcagtagatttcagtatgcttcaagagaaagttttctttagttctgtcagcttaatgtaaataatacattaaaatctagtttgcttgaggatattaaactattttaaagctaaaaactattttagctttcctttttgtgtattattaattttttaattttttgttttactacctatatatcaacatttgctttttctcctgtaaagtctaggtatggataaattgtctaaatttctaaaggactaagaggatttgttattctaaattagggtttctcagccttggcactattaaaatttgggggccagataattctttgttgttggggacagggactgttctcttccttgtatgataccaaacaacatcttggcctttgcctactagatgcctgtagcattcttccccacctggcacctcagttatgactgtcttttcccgtagcacctactcccaccagctcccttgccatatacccatgttcgagagagtgatggaatatctgtactgtgcttgctgattaacaaacaaaataagtataaagcagaagagtttctcaattatcctgctccctagattagttaatggtagtgtgtatgagcttcatgtttttaaaaataaaggccctagcccccaatatagtcatatgaggggttagggcttcaaggtaggaattttggggaaatgttcagtccataacaaacttcatggatccataaaccttgctacatattatgattttctgaaattcactccattcctgggtcagaatctccattgtggaatggggtttgtattcttgtcctgtcattgcttcagtatacttagaatttctgagtcagtttgtaacttattgccctccaaaaatttttaacacttcactaagtgtgggagagagaggcagttttcagccatatcaaataaagtcatgatgtttgaatttgagttgtatgtactgtgaggttgtcgggtactactctttgctagtgattaagtcctactttgtgctcatccctggcatctcacttttggtattttaaaaagtttttcagtttcagtttctaccaaaaaatctaatgtctagtactagaaatgcaagtaaagggttcttacagaaatggtttttagatgaaaaatagttttgtaaatgacattacttcatagtttttgcttcaagtttatctaatttgaatgccaactttactgtatttgagaggtcatttcaaagaaaacctattgctggcatgtgtttttggtcctcagaaagctgaagcatttaggtaaatgcaacggagaagcacgttgtggttcaaggaaaagctttctcgctcttactggtgttcataaagtggtagagccttggaaagtcaggacatgttttacttatttaagctgaaccttaaataaacagtctcctccttgaaaggttttatagcatttgtatattggataaaagtgtgaaataaattgcctttaaaaatctttaaaattcttaggttccagtgaattttttaaaatgtacaagttcacctgtttttatataaatcctcacacaaattcagggttgcactatatagtcagtatgatgggaagattgattccttttctagtcattatattccattaaagtaactgtgtacaaaagtattcaaaaattttgaaatgacactttacaatattcctattcgtattcagcagtgctgctgtgaaatctaaacaggtttttccttatccagaggtgctgtgatgggaattcgattgtaaagttcacattataaattccaattatgtgtagtcaaatcaacaaagaacttggatgcaggttgtagcattcttttgccaaggcaaaacagaaaataaggatagtgaggatttgaaataatatttaatttttgatttttttttttttttatttctagaaacggcgacttgaacatagtaaaaatgtaaacaccgaaaagctaagagcccctattatctgcgtacttgggcatgtggacacagggaagacaaaaattctagataaggtaagaaagtattaaatgtattgatagaactttgaaaataagtgaatggtaccttataaaaaaaaactttagagaccaataggacatataagcaattctgcttacaataaataagttgctaatttcttattatttttgctgctatcttttccatgttcaaataccaatctgtatttgctgtcttctcatagctccgtcacacacatgtacaagatggtgaagcaggtggtatcacacaacaaattggggccaccaatgttcctcttgaagctattaatgaacagactaagatgattaaaaatgtaagtacattgtatttcatgtattttaatctctgacaaaaattaagatatgaactatttcaaacatagaaaaaggacagagactaggataacagctccatatactcaccattcagaattaacatgtactattttgcctattttgctttagatcattctttttaaagaataaaacactacatattataggagctctcacattccatttccttccctccctctcccagaggcagccactattccacagttagtcatttgcctccatgctttaacactgataccatttatccccataatttaaaattttgtttccttctctactcttttccccttctaatctaatcaatttcttttctttttctcccatatttttctacttgtttggaggtattcagtttatgtatgttaaatgtaacacagtaagataaatgtaaagcttaaagaatcagtataatacacaccaccctttaagtgtcacctttgttgagcaatataaccttgcaagctgcttcagaagccctccaggtgtagctttccaatcaaagatctcttctccagccacaactttttaagataatctctaccttttaatgtgttaggagttgcaaaatgttgatactcgaactccatcagccattattggattacttctatagagaaacgttacctaatctactatttgattattcagtgatggcttatttaggaaaggcagaattaatgcctgatcctttaccttcttttaaccagcttttaaaataaaaagtggccaatatgattttttttttcttttgtttgcccttcatagagacagggtctccctatgttgcccaggctggtcttgaactcctgtgctcaagtgatcctcccacctcagcctcccaaagtgctgggattacagatgtgagccactgtgcccagcctgattctgttttgtattattatgaactcatggatttaaacatatttactgtgcattagtccatttcagttattattgtgctgagatagtcccatctttgcccagtggttggctcttgaatctttctcatacaattctggttgtcctagttttggttgcattcatgctgtctgatatagcaggatgttcccggctcatgtaatatagaaactacccagactgagaactgggccttgttaataattcctcagtttcattatcacagagcaggtgaaagtggtagctttggaactgagaagcagtaagttgaaaaacaaacagagcatatgttattatatgctaatgtccccttttattccttattgagtcttagttctgcatgtaaaaagagtctatgagtttgtctctccagtttttgttttgtttctttgtgactgggttttatgaagcgtgtcttctagtcaatttctaaggaaggaattagaagaattaacattccttgaatttttgaatattgaagagttattttgtggcctttatactggaaagtcattggccacatataaaatccttggttgacattttcattccttaagtatcttgtgtcccatttattctcgcataaagtattgctgttaagtttgatcatcagctgaatttcgtctttttataaggcctatgatcgttttacatcttgatgtcgcttctgagttttccagttatgtggtgttctattataatatgtagtagtgaatttttattttagaacagttttcttgaattatagcttttcaaatttataatttattttcatcctattttaaacagtatttctatgttttagtcactagaggagagggttcataacaccttattccaccagttgccagaacttgaactctcgttgttattttagaacgtaaggaacaagattattattaggcctgtattaaagttcttgggataacctttatatgacaattgtaattacttactgttagtatataagacactaaagtggaaataattatggtgctcagtgaaccagaatgcggatctgaaatgttttacgttgcattattttgatgtagatcaggataccaaattttggaagatcatttgaagattagcaaaaagaaaatgtagataagcataatacaaaaagggggtgtgtgtgtgtgtgtgtgtgtgtgtgtgtgtgtgaaattagttggtcagtgttactttttagactaaaagggaatgtccagattagatctgttgtaatgttacttccattcatttatgtccttttgtccagaaagtcaagcatttatgacgttatttgaatacaacagggtatgcatttactctttaacacttttgatcaatgtggtaaatttactttaaaatgtacttttgggatatatttgaagtcagaattgctttaaaattggaccacataaattttcccaatgctgagaaccacctcttgcatgtcagatttctatagaatatttcagatgactgccctgcgattcgtatcaccacttacttaataatctgctcaaacttggactacagtcatagttgtaagaccttaagaaaggagatattttctcatttagtatttttttgttaaaatgcctttggattttaatgaaaatactgacaactgtactttgctggttaactcactgtttctaaagccatttatatggaaaagggagtagtgatactttcagagttttatggcaaaaggattgttctgtaaagaagctttcatgtctgactttcttaaactttgaacttttccccattgtttctagtttgatagagagaatgtacggattccaggaatgctaattattgatactcctgggcatgaatctttcaggtaagagcaatttgagtcttttctcatcaagcaatctacttgaaaccattaagtctaaaagttcagcagagtcattaacctttgagtagtaatttgatctctataactaccactccacctttgtacctcattgatttagtaatgttttctttgaatacttgttttttatagagggaagtctttactgctttaaaagagcacccccttaatgtggaatgcagaaaacatgctaatacatgccaggcctatctcctgtaaaacccgttacaagtggaatattatgctgttgtctcttgtccatattctttaacacagaaaacttggtcagtaaaattattagaaatattagttggttctaaaactagctcattccacttgaggtcaattcaagtgattggtagatgagcctttggcaagttaagggctaatagtacttgaacaatttaatacatatactctattttgtttgggttttacagagaagtttaaaagtttaagaaaagtattaatttcaagattttctacttatagatcttttccttcttttcaacagtaatctgagaaatagaggaagctctctttgtgacattgccattttagttgttgatattatgcatggtttggagccccagacaattgagtctatcaaccttctcaaatctaaaaaatgtcccttcattgttgcactcaataaggtatgtgcgccttctgaaaaattaacctaggaaaacatgtttcttaattttttgtgattaaaaaaagtagtataattaacttacaagcatagctcattttattgtgcttcactatattgtgcttcacagatattgtgtgtgtgtgtgtatttgtgtatagttttttttttttaaatacaaattgtaagtttgtagcagccttgcatcaagcaagagtattaagtctgttggtgccatttttccaacagcttgtgttcacttcttgtcacattttgttaatttgcaatatttcaaactttttcattattacatttgttaggttatctgggataaatgatctttgttattttaattgatttggggtgccacaaaccacacccctataagatggcacacttagtcaatacatgttgtgagtgctctgactgctccagcaaccagctgttcccttgtctctttctctctccttgggcctgtttcctgagacagtattgaagttaggccaattaataagattacaatgacctgtaagtgttcaagtgaaaggaggagtcacacatagaatatcagtccagccacaacactcccttaagccaaagcctaatctaaagcaaggccctctcttcaattctgtgaaagttgaggaaggtgaggaagctgtcgaagaaaagtttgaaaccagtagaggttggttcatgaggtttaaggaaagaagctgtttctgtaacctaaagttacaagttgaagcagcaagtactgatacagaagctgcaacaagttatccagaaactctagctgagatgattgatgaagatggctacactaaacaacagattttcagtgtagacaaaaaagccttctattggcaaaagatgccatcttggactttcatagctagagagaaatcactgcctggcttcaaagcttcaaaggtcaggctgactctctagttagggtctaatgtggttggtgactttaagttgaagccagtgctcattgaccattctgaaaatcctagggcccttaagaattatgccaaatcctttgggaggccgaggcgggcggatcacgaggtcaggagatcgagaccaaggtgaaaccccgtctctactaaaaatacaaaaagttagccgggcgtagtggcgggcacctgtagtcccagctactcgggaggctgaggcaggagaatggcgtgaacccgggaggcggagcttgcagtgagccgagatcgcgccactgcactccagcctgggtgacagagcgagactccgtctcaaaaaaaaaaagaattatgccaaatccattgtgtgctttataaatggaaatataaaacctggatgatagcacgtctattcatagcatggtttgctgaatattttaagcccattgttgagaccaactgctcagagaaaaagattgctttcaatatattactgcttgctaacagtgtacctgattacccaagctctgatggagacacacaaggagattaatgttgttttcgtgcctgctaatacagcatccattctgcagctcatggatcaaggagtgttttcaactttcaagtattgttacttaagaaatacattttatacggctatagctgccatagatcgagattcctctgatggatttgggcaaaagttgaaaaccttttggaaaggattcacccttctggatgttatgaagaacgttcatgatccataagaggacaaaatataaacattgataggagtttggaagaagctgatttcaactctcatgtatgactttgaggaattcaagatttcagtagaggaagtcactgcggatgtggtagaaaaatagcaagagaactggaatttgaagtggaaccagaagatgtagctgaattgctgcaatcttaagtaaaacttgaacagatgagaagctgcttcttatgggtgggcaaagaaagtggtttcttgaggtggagtctccttctggtgagggtattgtgaacattgttgaaatgacaaaaaagaatttaggatagcaatcaacttaattgataaagcagtggcagggtttgagaggattgactccaattttgaaagaagctctattctgggtagaatgctctaagcagcattacatgctacagataaatttctttttttttttgagacagagtttcgctcttgttgcccaggctggagtgcagtgctgcaatctcagctcaccgcaacctctgccttccgggttcaagcgattctcctgcctcagcctcccgagtagctgggattacaggcatgcgccaccactcccagctaattttttatttttggtagagatggggtttctccatgttggtcaggctgtcttgaacttccgagctcaggtgatctgcctgcctcggcctgccaaagtgctgggattacaggcgtgagccactgcgcccagccaatgaatctttcataaaaggaagaatcagttaattgatgggacagacttctttgctgtctcttttaagaaattgctacagccaccccagcctttatgagctaccatcctaatcagtcagtagccatcaacatcgaggcaagaccctctaccagcaaaaagattatgacttgttgaagaatcaggtgctcgttagcatttttagcaatattttaaaattaaggtgtatacattgctttttttaagaagatataatgctgtcacacacttaatagactacaatatagtataagcatctcttttagaagcactactaggaaaccccaaaaattgtgtggcttgctttattgtagtattagctttactgcagttgtctgaaaccaaacctgcagtatctctgagttacgcatgtataagaaaatgcaccccatgctaagtgtttaatttgttttgacaaatttacaaccactgtcattcagaacatagaccatctccatatttccagaaaagttctctcatgttactttgcagtcattctgctgccctccctaaactcaagctagtattgatctttctgtgtcatatggactagttttgcctgttttatgatttcatataaatggaatcatatagtatgtaattttttaagtttggcattttttgttactcatgttattatgctttgttcatgttgtcattacatgtataaagggtttttcctttttatttttgaatagtagtccattatctgaataatactgcactttatccatttatctgttgagaattctagttcctgcatatctttgcgaatactcgccctacctccagcattctagtaggtgtgtagttgagtgcaaaattattgtggtctagtttgtttccacagtgactaatggctttatgcatcttttcatgtacttatgcttagagagatgaccatatctgtttctttgaaaaatatgttcaaaatcctttgttctttattagattgttttattgttgagttttaagagttctttatacttctggttctatgtatataattcctttttcacttgtatgtactgctgatgtattcttatggtctgggacttggtttttcattttctttgttttgttttgcgtgtgtgtgtgtgtgtgtgtgtgtgtgtgtgtgtgttggagactgtctcttgctgtgtgtgtgtgtgtttttttttttggagaccatctcttgctgttgcccaggctggagtgcagtgtggcgcactcttggttaactacaacgtccgcctcccaggctcaagcgattcttgtgcctaagccacaggtagctgggattacaggcatgcaccaccacacccggttagggttgtttttttctggggggcgggggggcggtgtgtgtgtgtgttttagtaaagatggccaggctggtctcaaactcctggcctcaagtgatccaccgctttggccacccaaagtgctgggattacaggcgtgagccaccacgcccagcctccttttcttaatagtgtgttttgaagagaagaaatttctgattttggtgaaatccaactaatttttatattttatttatttttgggacagggccttgctctgtcacccaggctggagtacagtggcattatctcagctcactgcagctctacctcctgggtttaagtgattcttgttcctcagcctcccaagtagctggaattacaggtacatgccaccacacctggctgatttgtatttttagtagagacggggtttcaccatgttggtcaggctggtcttgagctcctgacatcaagtgatccgccagccttggcctcccaaagccctgggatttcaggcatgagccaccgtgcctggccccaattaatttttttacgatttgtgttctatgtaagtaatcttttcctatcccaagttcattaaatttttctctggtgtttccagatgtttaatagttggagctttttttacattgagatcagtgatcttttttttatatagtgtgaggtcagggtttactttttttccatagaaatattttgttatttaaagactctttgctgaaaaaattatttttttccccatggaattagtttggaatctttgtcaataattaattgaccatatatgtctgttcctagaatttatcttttgttccattgctctatatacattcctatgccactactaccctgtctcattatagcttcatagtaaagttttgaaagctggtagtggtaaatccttcaacttagttttctttatattgttttggctattttaggtccttggatttcaatataaagttttcagtcagcttgttcgtttccacaaaaagccttttaggattttgattgggattgcgtttcaatctgtagataaattttgagagaattggctcttttagcaatattgcatcttttgatcagtgagcatggtatctctgtacatttacttagtcctctttaccatttttaaaaattatttttcattttatttatttttttaaatagagacgaggtctgtgttacccaggctggtctcgaacacctgggctgaagcaatctgcccacgtcagcctcccaaagtgctaagatttaagacctgagccaccatgcctggccaggccttctttactttctcttggcaatattttgtagttttattgtccacatgttggacatatttttctgaatttatccctaagtatttcatggtttaatgctattgtaaatagcatgaaaacttcttaaatttccagctgtttatcacatttacactcagtttgtatcttgtgaccttgttaaattcactgattaggcctagtatcttcttttgtaaataatgtgagtttttctaagtatgttgttatgttatctgcttataaatgcagttatgtttttttccccttacctatatgctttctacatctttttcttctttattgtactaactagaccttctaaataatgttgaatagaaggaatgacagtagacatcatcctttccttattcctgatattaagggaaagtgctcagtctttcacccttaagtatgatgtcagctgcagggtttttgtttttttggtttttttgtcaatgccctttattaagtttgaggaagtttccttctattctaggtggtttaaagtgctttatgtttttatttctttaatcatgaatggttgttgattgtgtcaaattcttttcctgcgtatgtagagatgttcatgtggattttctccttcattctgttaacaacataattactgttgaatttttagaatgttaaaccaactttacattattaaaataaaccctagttggttgtcatttgttatccttttgatatattgctagatttgatttgtaatgtttcattgttgttttgtgtctatgttcatgagtgatatgagtatgtagttttcttgtaatgtcttttatctggttttcatatcagagtaatgttggcctcctaagacgagttgagaagtgtttcctcctctgttttctgaaagaatgtgcaggaattggattatttcaaagaattagcttttggttttattgatattcttttctaatataagcatttaaaagtgttaatttctaattactagttagacatgtttttattatttagctttacaagcttcaggcttttcctttaaaggtgttgagcatgtttataaatattctaaggacctcatatgctaattttaacatcttcgtcatttcctactgatttgtctccttagtagcattcagattcgtctgattctttattttgtcaccctagactctgtccccagacagattatgcttttgattgtttgtttggctagcaagtatttttcatttcttctatgctcatttatctctcatgttgaaaagtgagggaaaatagattctgtcattaacaaaacagatttaatcctaatttgagcaataaaataattaaaataggctgttcccttagaaaatatatattttttaattttttggtatataattttatagtgatggtacttgctgggattgattgatttgttacaaaaactgtttcggaattccaacaatatacattaatagtcttaggataattctaggatgttatcttttgcaaacaaatggcagccacttaggaactcatggaggctgacaggggcagcatggcaccacagcagtttctaatttaagagcaggtgccgataagcagtctgaaaggagcttttggtacaataaagtgtatgagtaagtcacactgttctgtatatatgagacacacatgaggaattttctggagctattaatacagttcttgaatgttctgaattttttagagatctttctcatgaaaaaactttttcagattgataggttatatgattggaaaaagagtcctgactctgatgtggctgctactttaaagaagcagaaaaagaatacaaaagatgaatttgaggagcgagcaaaggctattattgtagaatttgcacagcaggtaagaaggccttccttctttctgaagagcctatctcagaatatgtattatattatctttataatgaagtcagcattttcattaatactggttcttttcctctgttgacagcaattactttttttaaattcttcttcccttttctcctttttctttgcagtctgaatactttaatttagaaaactgagttgacttagaactactttgctataatacagttaatgcttataggatatacatgatcatttttagtgtttatgaggagtttcaaaatgatgagccatttgctcatccggcttctagtgaggcacacctattccagatacgttttctttacagcctggcattttggatgatttttgctcctagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggtaatgatcaacttttcagtttattgttttttttttttttaaaaatagcaagttccttgagtggaggatatttactacttttagatttaatgaacatggtgcattgtatgtatgtctttctctttgcattaatgccttttaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaaggtatgctgaggtgggaagcattgacacgtggggacttgtacagtgtttagaagttctgctgagatggtttcctcactttgaaagctgtttgacttaatacagaacacatacatccctcgctctcccttttattttagttgtcatcatacaggaaggcctgtctgtcagagtagagatgtgtgaaagtacctgcttaccagactgggcctttgccagattctaaactacactgttatggttctacactgctaaatacggttgactcttgaacaacatgagggctaggggcactgactccctggccagttgaaaatccacatatattttttgactccccaaaaacttaactcctaatagcctaccattgaccagaagccttaccaatcacatacacagtcgactaacatgttttgtatgttttatatattacatactgcattcttacagtaaaacaagctagagaaaagaaaacgtgattaagaaaatcataaggaaaatagatttactatttgttaagtggaagtggatcatcataatggtcctcattctcatcttcatgttgagtaagctgagagggaagaaggagaggggtaggccttgctgtgtttggtggcagaggcagaagaaaatctgagtataagtggacatatgcagttcaagcccattttgttcaagggtcagctgtagttttttaacatttttaattgtgaaataaaacattgctcctgaaaagtacacacaacatagaagaaaagtttaacacatttttgggaagcaaccagatggagaatcagaacgctgctggcacccagaagcttcctgtgtgcttcttcctgatcaactcccctgccttcccctcctaccccctgacctttcatagagttaaccatggttgcattttatgacagtaacaaatatccttgctttgctttgtttttgtgtctaagagtacttcccttagaagtgtctgtagactttatgtagaaatggagttattctcagtgtgtacttttatagctggctctttttttttttttttttttggtgataggctctcactgtcacccaggctggagtgcagtggtgcagtcacagttcactgcagcctcaacctccccggggttcaggtgatcctcccacctcagcctcctgaatagttgggactataggtacgcaccaccacacctggctaatttgtttacagatgggactttgtcatgttgcccaggctggtcttgacctcctgggctcaagcaatccacccaccttgatctccccaaagtgctgggattataggcatgagccaccatgcctggcctatatctggcttcctttagtgaaaaaaaaaaagtatataattttaagatttctattccattgtgtgactatatcacaacatatctatctgttctgttgatgggaaatgtaggtgatctccagttttttatgtttattttattttattttattttgagatggagtctcagtctgtcatccaggctgggattacaggtgcacgccaccacacccggctaatttttgtatttttagtagaggtggggttttgccgtgttggccaggctagtctcgaactcctgacctcagcctccctaagtgagccaccgcacccggcccagtttttgatttttgttgttactaataatgctgctgctgtgaacatctcttgatgtgtttgtgccagtttcccagggtatgtatacctaggagtgaaggccacacttgtctacagtgggtgtaacaaattatattctcaactgcagtattttagtttcattgttttacagcttcatcagttcttggatgttaggttttaaattttttttgccattctgctaagtgtgtagctcattgccgtttcagtgtgcatttgcctaattgttaacctggttggtcatttaaaaatgtttattggccatttatttcctccttcgtgagatgtacatttttcttctgcattatctttcttacagatttatatgcgcttatatattcaggataccggtttgttagttggtgtgttttgcaatatcttctactcttgtgactttttttttcctgtggtattttgagaaatggaaatatttaattttaatgttaaatttatcagtcttgtgattattgctttttgtgcctcgtttaagaaacctctctctaatatcatgatgagattctcttatatcatcttctactgctaaccacttttaaagtacatttggtaacaaatgtttttatctctgtagaaccagtatgaaaagcataaagaagtagaagcagctcagggggtaaagattcttggaaaagacctggagaaaacattggctggtttacccctccttgtggcttataaagaagatgaaatccctgttcttaaagtaagttcatttaaaaatttttttccttaaaagctatttgagttctggcatgtgtcagcattgcacatgctagggatggtgaccaaaactggctttgtctttgtgaagcctgccatttcttggcctcttagcaaacttgatgcttttgaattacttcagtttgtacaatcatagaaattggtataatttttatatgtactagaattataaaaataatgcattttattcaaataaaaaaatgagtcaaaagctagaagtcggctgggcatggtgaatgcacacctgtagtcccagctacttgggaggctgaggcaggagaatcacttgaacctgggaggcagaggctgcagtgagccaagatcgtgccactgcactccaacctgggtgacagcaggaccctgtctaaaaaaaaaaaagctagaaattgtatattctttttggcccatgtccattgtagtttcataaaagtggactttgagccatagtttgttcatttgccaaagagaaaatacaactgttcccagcacatggctcttgtgtcctggggccgtgtttattatttaggcagcatcaagtcatgctgttgggaataagctatcttagggccagtgagagaatagggcaggcctgtctcttcacccagtcctgagtatggagtggacttacgtcccttcagtggcattgataaacttgttttacttatttctggttaaaaatctcttcttccatttcccgacaagcagtgatggaggaaggagctgctgagatcatgagattatggtatttcctagttaacacagacaagctgaacttttgggctatcataacacattacgtttatgtggtacttttttaactttaaaaaaatttttcttctctactgtttaattctgcccacccatctactgtatttgccaagtggagcggagattaaacatatttcaaagttagtaaacctaagacaaaggtgaagcgaaatacagttagggtatggccccgaaatctcctccttcattccagcacaggttctgtgatgccttgctctatctaagccttagtttcatatttgcagatgagtacttaaccaaagagagaaacacaatttaattctagactgctgaggatagaggtgtgttgacaaccttatcaaatctgatttcttttcaaggatgaattgatccatgagttaaagcagacactaaatgctatcaaattagaagaaaaaggagtctatgtccaggcatctacactgggttctttggaagctctactggaatttctgaaaacatcagaagtgcccgtaagtaactacaactcgctccacaagtgaatggtggttggtcgtggtttttggtgccatcgccattacctgatacatacagataaacatggaaactcccattttttcagtatgcaggaattaacattggcccagtgcataaaaaagatgttatgaaggcttcagtgatgttggaacatgaccctcagtaagtaatttctcttgctatgaaggctttcatgttacgtagctatcttaaaactgtcctatcttaaaaaactgtcctctgtgacatactctgtttttcactgaatggtctttgatgtgttttaaccttttaggtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagtaagttactgtttttatttactttgagtctttgttaatgaacatgattgagaattactgaattccagaaagggctgtaaacagcaaaatcatggcatttactcatctaccagaggctgcatcctgaaatggtgtgttacaaaccagaaacccaacatactggggacattccagcagtatgcaaacaagtcttgtctgtgacttcagtttaataatcttggcagacttgggtcttgttaatgggttcgtagttattaaatgtagggactttatgttgctcatctgggattatatagattggaagtaacaaaacttgagtgaggaaaaccgggaaataagagattctgtgggagagaagtccattcctctaccaaactttcactcaagcactcacagtacctacattgctgcagtggtagaggaggcatcagcagagaaccaggccagcctccctcctcctttccctttgagacagggtctcgttctgtcacccatgctgcagtacagtggcatgatcatgggtcaccccaacctctgcctactgggctcaagtgatcctcccaccttggcctcccgagtagttgagactacaggctcacaccactatgcctggctaattttttgtatttttggtagagatagggtttcgccatgttggccaggctggtcttgaactcctgagctcaagtgatccacctgcctctgcctcccaaagtgctgggattataggtgtaagccactgtgcctggtctgggacatgctcttattgcaggacaattgacacatgttgagaagtgctgaaaaaccaaataaagcagggaagggcctagataaggagaggagggactgtgattaatgatgtggtttgggaaggcatctcacctcttcagacagagtaagccacacaggcacatggggagtgtccagagagaacagcagtgcgaggcagagtgaccagaagggacagtgataaatgaggtcagagagggtggcaggacctgtatcgtcaaggatcttacaggccatgggagggattgagcttctctgagttttgcaagaagccattgccaaggctgtgtgttcacaatcagactggttaattgggttgttatgtggaccttgggttgttaggaagtcagtggcaagagcctgtcaggaggctcccacagtccaagcaagaggtctaggtgattcagaccacagtgatgataggagtgatggcgtagtttgggatacatttttaagtggagcttactagtaaatattaggatttagactggtatatgctcactttagatcatgaaacctgaagtgagaagaattctacttaacaagactgctggaaacttttaaagcattttaagcgtgtgctcaataagcagggtagttatgtagtggccttttggatcaatggtttgggaacgtggtggagaaaaggagggtgataatacggtctgatgcctatgtgatcccccagtagcctacatatgtgcctaacgaagacctgcctgtcaccaggtactgcctaggttctaagccccagactgtggctgacatcttcagcagccaagctcagtgttttagactaggaacagaatgctcctgtgatgcagcttcttttggaggtagggctttaaaagagaagaaagcaaagacttgggaagcaacagaatggggaggaggaggttaagaacaaggaagaagcgctctgggcatggggtggccctgggctgcagcaccctgcctgcccctctcctgtggccgctggggaaagctgctttcctctaatgggagaagcctgatgttcagctgcagtttttctttttatgtttaagtgattctgtaagcttaaaattcttttcttttttcctttcaggcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaatgtaagttctagttgtacattctgtgggtcatttcttaaagcactaaatgagtgtccaagagtcgtaccaacacagctttgtgcctgtagttcacagtactgtgctgtgtatttagtgtggtctccaccttcttaacaaatgtttcagtgtttttacctcagtaggaagaaaatgtggtaactttaaaacaagcagagcctgtcaccttctgttgtgcttcagtattggtaaatatcagtgctccatagtcagtgttgactcagtgctgatctcagtgcttcagttaattggggctccaaggcactttacattattgccttttattttattttgaaaggtttcaagcctgtggaaaagtttaaaaactagtataatgaacactcatgtttaccttccctttctgtcagcatacctaagaaaaattaataatatttcaacaatatcctataatttgcagccctcaacattatttcaccagttattccaaagatgttttggtaactctccccaccaatctggcccagtgccctgcaagctgcattgcactggggcttgttttgtggctgagcctcagtcaagaacagtcctccattctttttgaagtgtccctgttgttttgcaaatccctcctccatttggatttatctgtttctctccctcccaactagacacaggttagaattattggaaagacactcatgcagtttccctgtgtgcctgcctcttgcatgacccagcctgtctgactgctgctgatgctctgatttcctggggaaagtgctagacgccaaccatctccattagaaacttgcccctttataattactctgtaatctgtctggtacctggagttcctaatggatatcctgtttctcaacagcctttatcccagtgcctttagtacccactggcaagcgttgcctaagtcaactattacgtagatggttgcaaaattgtggatatacctgtccccccatttcttacaaagaacctcttcccactgacctttttattgagtcatagactcagtgggtttttttttttttaatataatccattacctttattcttttgatactcagattttctattgtggtcagtaggagctcaactggctcctgtatccttgacacacagcagtctgagcatcatcttcctttctggttgagatgttccagcctcatctagtactttccctggcccaaacctggttcttgtaatgggcaatggcacttagaagttgtcattgcttttctaccatttcagtggactaagcctggacatttatttgtgttactttctatgtggctttggcctcctaaaccaaccagagctctccctgttttcactcttactctcctgaatctttttctccacaaaggagtcagggttttttgccccaaactctgagatcacatcactcatctgctcacaggccatcattcttaaaatttcaggattggtcctcactctgacttcattcccatcagccacttcaagctcattcctgactcagaccctttgtgcctgctgatccctcctattacggcacctgtcacgtgaaatggtagagcaaaaataggaaatgacattgggtcaacagggcacttggaatgttttgcaaagcacattatctcctgtcattcttacaaccatcatgaagggaatagggtgttggtggtgccagcctagtttaccaaaatgttacaccgtgagtgatgaaaggatcgcactgccatgacttttaaaacaggcttttgctctagttcttacttcagctatccagccatggcgcctgtgattggcatgaattcttctgcatgcattttaatttgttcttattttatagtttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaaggtaagtatttcagcaaaagtggcacactttaagcaacagggaatcactcttcttgggtcacctgtacctgtagctccttgggcttcagtttgattgtagaatctgatgggactggatcccccattagggcttgacctctagctgggccttgtctgttgaggaagttgctctatcaggaaagcagcaccaacagagaaagctaggacttttaggtcccctcgtgcctgacatgcaaaccagatgtgattttggaattctactcccttaggcaggcaagccctgttttttatttctgcttaagctttttagtacagtgagagcgggcatctggggccacagctttctttggcacgtttgttatgttctgtttaccctgtttgtgcctcgggcattgcagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaaccaagcttctgcagattttgtgattcttgggacttttttgacgtaagaaatacttctttatttatgcatattcttcccacagtgatttttccagcattcttctgccatatgcctttagggcttttataaaatagaaaattaggcattctgatatttctttagctgctttgtgtgaaaccatggtgtaaaagcacagctggctgctttttactgcttgtgtagtcacgagtccattgtaatcatcacaattctaaaccaaactaccaataaagaaaacagacatccaccagtaagcaagctctgttaggcttccatgttagtgtagcttctctcccacaagttgtcctcctaggacaagaattatcttacaaactaaactatcatcacactaccttgtatgccagcacctggtaacagtagagatttttatacattaatcttgatctgttttaatcttgatctgttttagtagagatttttatacattaa

SEQ ID NO: 2144 - DNA, 12861 bp, Homo sapiens
tttctttcatgattttaatcatttctttgccagtgttgtatacaacacattcacgtaaaactctcaaaggcggccatctgagcactctgccaacctggcccacccacagagctttgcctagaagctttgtcttttatagaacttagctcgagcaatgatatcattgacgaagtcattgtctatgtccgatggggtggcaatcgcttcaattcctgacttaaaagctgagagaccacctgaaatgaaacacagagaattaggctcaaatattaactttcaacagaaataagcaatgagcattgccaagatgttagctttccaggcaaatcttccaaagcaggcagtcccaaatcctcctccctctccctccctttctgaaaggacgtgctatcccaagaatcactgggaaaattccagattgctttctttctctttttccaaagtctttggtttttcttgttgcaaaaatcagatttgcttttttatgtaatccaggcctggcagaactagactcccagtacatcctctgctgaaaatgcttgtaacattctctcatttattcaataattcactcatctattcactcactcatttattcattcaggaaatgttttcaagcacctactatgtgccaggagaggtgccacactgactgcaaggtacccaagacacacttatttctttgggtatgtgtacatatgcatgtgtgtgctattttaccctagaattttatctctagtagttatgtatgtgtttaacataattgtgctctgctctgatatccagagaggaagatgcctggtcctgatccctgccttcaaggaccttgaagtagagactagaaactgttctgattaaggccgttagagtgtggaggacataacattggccaataggaggcaaacctaataggaattgatgtggttgggtgtgaagagagaaggaaccagagagcctaagaaagcaatctggttttcaggctgggatgactggctatattatggtgcctccaagacatgtaaaatgcagaagaaagagcaaatttatagtgggaagttagtgagttaattccatctgggagatgctgaacttgagggggcctgtggtcagccaagcagagatttccacttggatatatagcacctgaagtcccgaaaatactcacagagtaacattgttcagacaatttggaaagttgttgacagtttcttataacaggaaaaaacctatgagaggtaggcaaacagatagatagatagatagatagatagatagatagatagatagatagataaatttttttttgagagatggggtctcactctgtctcccaggctggagtgcagtgatgtaatcaatgctcactgcagccttaacctcccaggcacaagcaatcctcctggcttagcctcctgagtagctgggactgtgtgtcaccatgcccagctttttttttttttttttttttttttgtagagacagggtctcactatgtttcaaggtatcactcaatagctcagtaagcaatgaataagaaccccaacattctgcagaagaggaaatggaggttgaggatggaggacctctcaaagtaactcagtggttcagggaatgcaaatgcagcctctagacagctcctcccagggccactgctgaccccgtggaaatgctcccagggagtctcgggtcacactggccttcagtggtctcattcattgctcatttaaacaaagtactcagaatacagcctacctttgaggtgctgagcaacactccacgtggggaattttttctggattgccttaattctctctgttagaatcccagtagcctgtgaaaggtgctctttgctatcccaggcaccgacagggtggtacgtttgtttatcaagctagaaaattcagataataaagtcagcatctggatgaggtaacacattttttctgccattcctaatttcctctcctggtattcaagtcatagataccggcctttatccccaaagagtcaattctattgttctttctttcatatagatgagagtcagagaaacaaagtaaggtttgggagaaatggacatggtatagttttagctaaacattctaatatacaaaaaaaaaatttaagttgttttgaaacaaataacacccaaagtctacacatttatagtaataaataattatccagctaattcagataaaaatttgtttctaactgggaaggccagaagtctgtatttctacagacaatttaaaatcgagcctggaagcaaatatccagataatttggatccccttcctccagtttacccaaaggaacaagttgtttcaagtagggcacagttataccatgttttgatccacatggatgaaatttactacttcatgaaccccaagaggacacctgtaacaataatgctatttataagattttctcagttttagtgtattacatattatttattgcagaatggtagttatgaaactcctaaaatactttttaaaatatatctaataatgaataagccttgaataaaataaaaagatgtgttacagaaatcccagatcaaattatgctggagtggccgggcacagtggctcaagcttgtaatcccagcactttgggagactgaggtgggtggatcacctgaggtcaggagttcaagaccagcctggccaacaaggtgaaatcccgtctctactaaaaatacaaaaaattagctgggcatggtggcgtgtgcctgtaatcccagctactcaggaggctgagggaggagaatcacttgaacccgggagtggaggttgcagtgagccgagatcacgccattgcactccagcctgggtaacaagaatgaaactccatctcaaaaaaaaaaaaaaaattatgctggagtacctgtagccagatgccagggtattttggggcttggaagcactgcaaatggatttctagttcaggttgagcttctgtgaggagggatgcagtggggctgatagaaagtttctagctaaatacctgcatcaagccaaatttaagtcccctgtggtcccagccgtcttgcaggacagatccgccatggctttccctggagatgatggctgcgatgacagcagggtccacgcaatgtctctgcccgacttctttgatcagagtctggtaaggttttatggccctcaaatccatctcagcaaacatttcagaaccacggatccctacgtcaatagaaaagaaactgtttttccgggcatggtagtgtgtgcctgaagtcagttcctgctacacaggaggctgaaacaggaggattgcttgaacccaggaggagttcgaaaccagcctgggcatcatagtgagagcccatctctaattaaaaaaaaaaaaaaaaagaatttaaagttaaaaaaagaaaagaaactgtttcttctacttcagaagaaaaccatttttaaaaatttgctaagttagccacagcctctgatcactgctaatgacttgggacaaccattctaagacatccttttgatctctgactgcagaaacaaacagatccacaacccccaacaggtgtcgcttctgctctgtttctccttcaaattgctcatgcctgtaatcccagcactttgggaggccgaggtggacagatcacttgaggtcaggagctcaagactagcctggccaacatggtgaaaccccatctctactaaaaatacaaaaattagctggacttggtggcaggcacctgtaaccccagctactcaggagactgaggcaggagaatcgcttgaacctgggaggtggagattgtagtgagccgagatcatgccatcgcactccagcctgggtgacaaagcaagactctgtcatacacacaaaaaaaattctgccacactagtgcactgggaagcctgttgtactaggagttagccaatgcatgttttagcctggctccgccactagttggttctgttctattgggaagtattcccctccttgctgagtctttgggctctgatttgtaaatttgaggggttggggtctgatgtgaccttgtggttgctgccagctccgacactctaaaaccaggataacgtgatgaagacgactttggaacagtattgcttcaaatggtcatgtgtaacatgaagcaaacacagcagcaccacccaaaaaacaaagccagagtctaatatttattcaagcagtagtttcaatacatggaaataaacacagctggacaaagtttggaaagaatgggggtggaaaatgaaaagaagctggttgttagattggtcaggattgtggtttttgctcatttttaattttgatactattgtcataatgatgattataccttttcaaaattaagtgacttcctaagaaagaatctgaaaacgatgaaagggggaagccagtcatttgctctgcttttcacttaccgcagttcatcacactgtttgcatcacaagtggccccagaggtcttcatggtcatgatgtccccatagcagccgtggtacaggcgtggatgtaggtgaggcttcattgagtgactgaaggggtatgagcccctggaagtgcctaggaggcagaagtgtaactcacatgaatcctctgagaagatattacttgggttgctgcaataaacatcactaaaccaaaggcagaaggccacagacagaactccccaactctcttgttgccattatttgttcctcagacagaagttccccatgcccactctgctccgatcttttgttttgttttgtattaacacaggacgtaatctgaaaactctatgcaaaatattatgaaattcatctcttatagatcctaaatacatgtgcagtctttttttttcctttttttaagagacaaggtcttgctctgttgtccaggctggagtgcagtggcatgatcatagctcgctgcaggcaccaacacctgggctcaaactatcctcccaccccagcctcctgagtagctggaaccacaggtgcatatcaccaggactggcttattttctctttttgtagagatggggttttgctatgttgcccaagctagtctcaaactcctgtgctcaagcgatcctctctccttggcctcccaaagtgctgggattacaggcactgtagtcataccatgctctatgtcagaattaaaactgacaggtttttaagcaggaaacttgagagttttttttttttttttaagattcagggggtacatgtgcaggtttgttacgtgggcatattgtgtgatgctgaggattggccttctattgatccttcacccaaatagtgaacacagtacctgatgtgtagttttcaacccttgcctccctaccttcctccctccctccttccttttacagtccccagtgtctattgttttgagaggaattttaaaacatttctgacacaaatgcctctggagatgtgaacatctagattaacaatttgcctttcttaagccaaaattgacaaatggggtctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaagtacatgaacagacacttctcaaaagaagacatttatgcagccaaaaaacacatgaaaaaatgctcaccatcactggctatcagaaaaatgcaaatcaaaaccacaatgagataccatctcacaccagttagaatggcaatcattaaaaagtcaggcaacaacaggtgctggagaggatgtggagaaataggaacacttttacactgttggtgggactgtaaactagttcaaccattgtggaagtcagtgtggcgattcctcagggatctagaactagaaataccatttgaccctgccatcccattactgggtatatacccaaaggactataaatcatgctgctataaagacacatgcacacgtatgtttattgcggcactattcacaatagcaaaaacttggaaccaacccaaatgtccaacaatgatagactggattaagaaaatgtggcacatatacaccatggaatactatgcagccataaaaaatgatgacttcatgtcctttgtagggacatggatgaaattggaaatcatcattctcagtaaactatcaccaaggacaaaaaaccaaacaccacatgttctcactcataggtgggaattgaacaatgagaacacatggacacaggaaggggaacatcacactctggggactgttgtggggtggagggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaaataaaaataaataaataaaattcaaaaaaaaccaatttgcctttgtttagaaagataagaaagaagggcaccataacaatttaaatatattcttattatatatcatttactgtgaagttgagttcctatgtatatttaataaaattagaagtaaaaattgaatttgccaaaataatttaagtcaaatctattcttgtctttttgttctgtcattaaaaagtgaatttctgtccaagtctacctgttacaggagaggcagagcttttgctaaaggagatacaaagttattttctgtaatgttgaaaagtttgttctaacggtttcaaggactgttaacttgtaccttaagagtccaaatatttgttataagacagtacttagggctggatgttgtggcttatgcctagaatcccagcactttgagaggctgaggcaggacgattgcttgagcgtaggagtttgagaccagcctatgcaacatggcaaaactcatttctacaaaaaatacaaaaattagcctggtgtagtggcacatgcctgtagtcccagttgcatgggagactgagacaggaagattgattgaacccgggaggtcgaggctgcagtgagctttgatggtgccactgcactccagcctgggcaacagaacaagaccctgtctcaaatctcaaaaaaaaaaaaaaggattttgttaaaatgtttgatgtaaaaaaaatagaatctggttgggcgtggtggctcacacctgtaatcccagcactttgggaggccaaggcaggcggatcacctgaggtcgggagttcaagaccagtctgaccaacacggagaaacccatctctactaaaaatacaaaattagccaggcatggtggtgcatgcctgtaatcccagctactcgggaggctgaggcagaagaatcgcttgaacccaggaggaggaggatgcagtgagccgagatcgcgccattgcactccagcctgggcaaaaagagcgaaactctgtctcaaaaaaaaaaaaaaaaaaaaaaaagaatctaaccacttctcccacctctgcttctgccatagtcccagccagcatcattgctcatctggactctcctaacagccttctaactgacctccctgattcactcttgcagcccatcctctacttagtagacggagtggccctgtgggaatatgcatgggctgctatcagtcttctctcttaaccttccagtggctttctcctcctttaggggaatagccaagtccatcctgcagcctccaagacctactagatgtggccctctgctcctgttcctacttctctttccctttgttcactctcctccagccacattcttctttgtgcttatccttcaacatgccaggcaggtttctgcctcaaagcctgtatgtttgtggtcccttttgcctagaatgctattcctcctggtatctacatgatcatgccttcaggtctctgtccaaatatcaccttatcagcagaatatatagcgagtttatagacaaaaaaagaaaatagtccttaaacatataaaagacgttaaaccacactcaaaagaagagaaaggccacattaaaacatcattataacagcattttccaactctttttttttttttttttttgagacagagtcttgctctgtcgcccaggctgcagtacagtggtgcgatcatggctcactgcaagctccgcctcctgggttcatgccattctcctgcctcagcctccccagcagctgggactacaggcgcctgccatcacacccggctaattttttgtatttttagtagaggcggggtttcagcatgttagccaggatggtctcgatctgctgaccttgtgatccgcccaccttggcctcccaaagtgctgggattacaggcgtgagccaccacgcctggctgcattttccaactctttagttggcaagagcccaaaggtttggcaataccctctgtgggagaggttgtgaggaaataggctgtcacacacattgctgtggaacacagttttgtgataggctgttcattccagcactgttgataagagcaaaggactgcaaacaacacaaatgtcattaatttagggactggttgagtaagtgatgctacgtccacagtggagcactatgcagctgcaaaaggaaagaataagacctgtatatactcctgtaaaattctctccagggacaaaatagtatttatagaattgtactctttgtgtaagaaaggtaagaaaatacaatcgtatattttgtgtgatttgctcatattttcaaaagaaacaatacaaggatgaatgaaaaactgataaaaattgttagttatggagagagtaagaggaaggtaaagggaacagggataggggatagactaactatcttttttaaagtttttattttggaaccatgtaaatgttatcataaattttaaaattaaatcaaatggggaaaaatggaatcataaaaaagaagaacaaatgaacataactctataacaaattgaaagattaataaacacatagaggagaattatcttaagtgactttaaaatatatccatataagtctataccactacataggaatccatcctgtgaacataaataatcacaagaaaatcttaaattatatttactgtctcattgttggttggtaatactgtcatacttattttgacactattgtatgtaaataagtaataatgctaatgtcattagaactaggatttttagtgtaagatagcagaggtacaaatataaaactgatgtaaaatgcttgcattcttaaatataaatgtgaaatatctgaatgcatagttgttttccttttaaaaatatatattttctagttcctgccactgaaaacacctgaaataaacgacagctccatagcaatggagcacttttacttcccacactgtggtctctaaataccatttcctgctaagtggaaccagcgctcctcagaataatggctgattgcctgcctggggcaggaaatgttcaagatgaaccaggaacatctttttgtgccagagctggtccttatatgttagagacacattaaaaaaaaaaatttttttttccagatggagtctcactctgtcgcccaggctggagtgcagtggccattctcctgcctcagcctcccaagtagctgggactacaggtgcctgccaccacacctggctaattttttgtatttttagtagagatggtgtatcactgtgttagccaggatggtctcaatctcctgacctcttgatccgcctgcctcggcctcccaaagtgcagggattacaggtgtgagccaccgtgcccagcccaaaaatttttacaggtgaaatgtttttatctcactgcaagctccgcctcccaagttcatgccattctcctgcctcagcctcccaagtagctgggactacaggtgcctgccaccacacctggctaattttttgtatttttagtagagatggtgtatcactgtgttagccaggatggtctcaatctcctgacctcttgatccgcctgcctcggcctcccaaagtgcagggattacaggtgtgagccaccgtgcccagcccaaaaatttttacaggtgaaatgtttttatctccctcccttcctctcactctttccctctctcttccctttttcctctcactctcttactgttcgttcctctcactagaagataaatttcattaggtcagatactagatgtttttctctgctatatcctcctcagcacctggaacaatgcttggcacaaagtagacatttaataaacatttgctgaatggaagaatggatagttggatggatgaaggaatgagacagaaagggattgtttaaattatctggatcaagtgtccttatattgacaggttcagtatcctttcactgggaggcagtctttgccaggctcactgtgtggcccacagaccacaggcatcaaagttacccaggaagcttattaaaaatgcttatcactgggccgggcgtggtggctcacacctataatcccagcactttgggaggccaaggcggacggatcacgaggtcaggagatcaagaccatcctgggtaacacagtgaaaccctgtctctactaaaaatacaaaaaaattagctgggcatgatggtgggcgcctgtagtcccagctacttgggaggctgaggcagaagaatggtatgaacccaggaggcagagcttgcagtgagctgagatcgcaccactgcactctccagcctgggcgacagagcaagactctgtctcaaaaaaaaaaaaaaaaaaaaaggcttatcactgggcttttcacaccagatctactgcaccaaaatcttgcagtataaggcgaaagaagctgccttttacccagcattcccagttgactcttacacatgtttatgaaccactgctttaagggaactggaatatgaccatggaccctacgctgcctgtgtaggccttataaacacacaagccctttttaaattaagagtcacctttcagctatacacagctaatatggtagctcataattaatctactggctatttaactctgctctcacctggcaatctaaaaagagtaaaaatttaaaactatgttgccctgttttgaccataagtaactggaaattactttcgggtagccttgtttttccaaatttagaattaaacattttagaaacactttcctttcagtcaccattctataattaaagacaacttgaacattgctcataatggcttttcattttgcttaggtcagagttttcacattctcttattcaagatcccttaccaacttaccaacctatctttccagccttccccccagaaaccccctcgtctgtccagaccacactgacccaaagacttttcattcatttctgcctctgcttttttactgaaatctttcttcccatccagcaggctcttcctttttcttattaaatcaccaagcatccttcaattgacatgtcccccccaaaagcctttcacatctgagcattctagttggatgtgagctcttcctcccaaacctttcccagactagtgcttttttcccacctatacacattgaactctcatccactgcttggcattgataattgtctcttcatgtgttttgcttccaaggcactgttccatatacctctcggtaaggtatccagcctgataggtgcattgtcagacaggaagtaagcagatcaataaatattagattatttgaaattcccatagatcctgtttttcacctgcttagcaagcagaacacactgttaattatagaaataatagttgattaatggccaagctggtcagaatgagagcccactcttccattacaggtaatcattgctctttctgattcatgattgtgctggaggtttttgtggacaccctgtgaacaatgctaaatctcagccagtgacttaccaatgagggcaattagtccccaaaacaccacggaggataacatggcggggaatcttatcttccaggacctgctctgatttgaaatagaaactggttaattttaaaacctgaaaatttcctaaagaaaaatttgctttgatattttaaaaagtttagagttatttccaattcactactcatttccctgtttcaagatagtattctcacaggctcagtacatagtttgttggcacactctctttcttaagcataaactcctaatctcacttcaatccaatttcatattgacatgagtcatgcgtatcttacatatgtaactaaatatacactcccatcccacctctaagcttggtaacaccacaattttgttccctttctttttaaaaaaaaaaatactgatcttttcattctagttattcaccctacccctggcttcaaggatcagttttggtctttcattcatttatttagaaatgggatcttgctctgtcacccaggctggagtgcagtggcataatcatagctcactatggcctcaaactcctgggctcaagcgatcctcccacctcagcctcctgagtagctggggcgacatatgcgtgccaccatgcctgggtgtttccattcttataccagggtctccgtagggaaaacaaaataaaacaaaataccaacaggagcatgagaacgtgacttagaagaggtttcctctgctccatttcttcctcaatcaactctattcttggtttcattcaaatggtagcttataagttttacaagacataagaaggccagcactaaccttgtttgcaaccttacagagaaaatctcccctctctgtttgcaaaggtcttctgtactcagcagcaaactgcacttcaagcttttac

SEQ ID NO: 2145 - DNA, 17375 bp, Homo sapiens
cttccagttacaggtattttattgagcagagacagtgaagttccttatgctgttatttcaaaagtgtttcctggtttctttttaatgaatgtcttaaaatacaagcaatcaggaccctttaaataaggcagtatgttcacaaatcaaaatagctttctgctggcatcagttgattcaacatcaacatgcagtgtccagaatgaataagcagttctttaatggttatttaaatatattccagaagagcgtttataattcatttacaagtgcagtattgcgctagtaaatgttacttgacctcttgtataaataatgccgattaagaattagtcctggaatagttttcgaatttctaactctgtagatctaaaacacaattgtaaatggtataaagatgtaagaatcatattgtgataaagtcaatctcaaaaatagagaatccagacccttcccagataatttaagaactgagttttcctcaacttaaacatgatggccacacagaaaacagtaaagacacttttcgatgtgatacaactgtataaaactcgagaatatgagtatttaggtgaccaatgtatagacattaatagaattttaaaaacacatttaaatctgaagcagaaaaaaaaagacaatttacaaagaattattgagctctaatcatcatcagagtctgaatcatatttctttcctcggatagttttcttttccagctttgtgaagtttgttccaaatttcttttggttctgaaatggtggctccattaaatttccacttaaaaaaaaaaaaaagcattttattctttatgatttagtactagtatactaaactgcacaaaaatctatctttgttttcttcctgtaacatagaataaaatttctttaaaatgctggtgtcagggaagaggtataatgcttatattgatattgatggttaatagccttaaaccttattgtgtcctactgaatgttttagatcaattttattttcctttctttttgagacagggtctcactctgtggcccaggctgatgtgcagtggtgtgatcacagctcactgcaacctccagttcctgggctcaagcgatcctcccacctcagcctcccgagtagcttggactacaggcgtgtgccaccatgctcagttaatttttacattttttgtagtgatgacatctcactacattgcccaggcttgtcttgaactcttaggctcaagcaatcctcctgctttggcatcccaaagtgctgggattataggtatgagccactgcaccagacctattttcctttttatcattaattatggattaacatttggttaacacagtgctcagttgtcaccggaaatgagagaaaccatcacacacctcccgatatgatgcatcacttccataatatgcccgtcaaaaatcgataatctgaatctaatcttgaggaaatttaagacaaacccaaactgggagatgttctccaaaataaacagtttgtactcttcaaaaacatcagtcttaagaaccaaagaataacaatggtaactaaagacgtaataactaaatgtgctgcatttttggtatgaaggacaattattgggacaatgagaaaacttgaaataagagcggtaaattacacaataattcctgtttcaataattgtactgtcgctacgtaagaaaatgttcttgttcttagaaaatatatatggaagtctttaggagtaaagggacactgtattcacaatttccactcaaatggttcccaaaatacttcatagtatctataaagacaatgataaaacaaatataaaatgtttaaaattgggtaatatgggcaaagggtcaatgaggattcgttgtactagtctgcagggggttgtttctactagttttttgtagagacgaggtctcatctcactatatgttgcccaaattggtctcaaactcctggcctcaactgattctcccacctcagcctctcaaagtctgtaatcttctgagattacacaagtgccccacccggctgcaatttgtttaaggcttaaaattacttcaaaatatataactttatttaataaatattaatattttatgttaatattaaggaaatgaaaccaatttctacaacataggaatgatttcggcatgtctaggagagtcagagaaaagacgggagggaaatgggggagaaagaaaaacgtgagagaaccttctacttcctgaaaggcaccatgactctggaatggtaagtgcacaattttacctgttacttttgcaaatcaagaaaaggcaaaaaagacaagatgatatgctctgatttgtggaattagataaattatttgtctgaagaagtggacaaagaaatggaagttggattttagattgttttcaaactaaaactgttcttcatagcaagcaatgtaagctaggcatagaaacctttttctattcatcagcctctataagtaaaacagaaatatccatgttaaaaatctagtattttaaaatataactttctttgcaagagtctgcttttaatttttattttatcaaagagaatcacttaagtcagaattcatttgagcaatctggcttaaattggggaatagtcaacactggattgccattttaagtttccagattaatacaaaattagtgtcaatagtatacgttaagctgaaaacttttatagtcaggagtacggtgagactcagttttacctattaaatcagtttaatctgtaaatctgattttgccgtaaaatcacgctaatattacacacttcaaaaaaacatgcttttcctttgagaaactttccacatctcagccaaaatgccttaatttcataaaataaatgttacaatacaaaaatcttttgtaaaaatatcaactatatatgaattaaaatcaatctcttcttttgttaaaagttacctgtaattaagaatgtcagaagaaccgagcctccattctaaagtttctgtggtgaagtcatctgtatttcctaggtcagtaaacccaacaacataatcttgtgttttcccatcttttagcagtgctagtgtgggaatgactttgatatgcagtctctcacaaaggaaaggtgctttttccacattcagcttcaaaaatttggtctcgaggtgtttcttggacaatattgccagatgtctgtctagtattttacacctgtaagtgaccacacatagaaaattataagctaaaaccacagatcgcttttttcaaaataaatatcatcaagggaaatctaattatgtagtttttctgttgactctcataacatggcagccaacttaaacttgtgtcagatgacctcacttccagatcagaggttagctgcctgattacgagatgggaaaacagcctataagattctagaaagtcagatttgcattaatgatattctcttttaaaatattaaatatatgctttaagtcataaaggaagttgtcctatctcctacacaggaaacttgaagaggaacaaactgaaacttgacaaaactcggaagagacttacaagaatcagaagtgcacacatggtgccatatttggaagtcatgaagaaaaactgaacagcattaccgaggaaaaacttcttactcctaaatatgcaacgctgtcagtaagaagcacattaaggctaagggttactaataatatttaaataaatgtggccattatgcttctaggaaattaaaaaataccagtagtaacttttttattttttatttttttggaggtggcgtattgccctgtcccccaggctggagtgcagtggcacaagctcggctcactgcaagctccgcctccctggttcatgccattctcctgcctcagcctcccaagtagctgggactacaggcgcctgccaccatgcccggctaattttttgtatttttagtagagacggggtttcactgtgttagccaggatggtcttgatctcctgaccttgtgatccgcctgcctcggcctcccgaagtgctaggattacaagcgtgagccactgcacccagcctaccagtagtaacttttattaagccatcttccaatgaagacggaaacagaagtgagattttcttggccaggtgcggtggctcacatctgtaatcttggcactttgggaggctgaggcaggcggatcacttgaagtcagtagtttgagaccagcttagccaacacggtgaaaccctgtctctactaaaaatacaaaaattagctgggtgtggtggtgcatgcctgtagtcccagctacttgggaggctgaggcaggagaatcacttgaacctgggaggtggaggctgcagtgagccgaaactgtgccgttgtactccaacctgggcaacatagtgagactccatctcaacaaacaaaaaaagtgacatcttctttacattaaaatttattttctggcctgatgcagtggctcacgcctgtaatcccaacactttgggaggctgaggcgggcagatcacttgaggccaagagttcaagaccagcctggtcaatatggtgaaaccccatctctactaaaaatacaaaaattagctgggcgtcatgatgggcacctgaaatcccagctacacaggaggctgaggcacgagaatcacttgaacctgggaggtgggggttacagtgagctaagattacaccactgcactccaggctaggcgacagagtaagactctgtctcaaaaaattcattttcaactggccaattcacgagtgtttctaaaacagactattgtaacaatcttttagaccggtggttcttaaccccaggtgttcattatgatcaacttttatttattcatcttttttgagttggactctcactctgtcacccaggctgcagtgcagtggcgcgatctcggctcactgtaatctctgcctcctgggttcaatcgattctccttcctcagcctcccgagtagctgggattacaggcacctgccaccacgcccggctaatttttgtatttttagtagcgatggggtttcaccatgttgactaggctggtcttgaactgctgacctcaagcaatccacctgcctcagcctcccaaagtgctgggattagaggtgtgagctaccacacccagcctgccgtcaacttttaaaatatccagatgaatcaaaattctctggcagtggagttgggaaacatacagctgttcttatgctcaaataaagcttgagaactacctctagatgactcacacacaaaatacttcatggttatttttaccagtaagctttttgtgcacttgatgtagtttttcctgaactaagtttggctctaacataagttatgtgtaaccttggtgcctcatcactttttccccggatatgttttttcatatgttactcatgtagttcagtaacgagatttcagtgaaaaatggtaagagagaacaaattaataaatggtttttaaataaagctcaaaacaaatgataaatcaacctttatatgagaaatatgttcctgaaaatttgtaaataaatcaactccatactttaactgcagtaaggaacgtattttttttttgagatggagtctcgctctgtcgcccaggctagagtgcagtggcacgacctctgctcactgcaacctccacctcctgggttcaagcaattctcctggctcagcctcctaagaagctaggattacaggcacccgcaccattgcctggctaattttaatttgtatttaaagagcaagacagagtgtcttgctctgttgccaggctggagtgcagtggcacgatctcagctcaatgcaacctccgcctcccaggttcaagcaattcccctgcctcagcctcctgcacaactgggactacaggcacgagccaccatgcccagctaactttttgtattttagtagagatgggttttcaccatgttggccaggatggccttgatctcctgacctcatgatccacctgcctcagcctcccaaagtactgggattacaggcatgagccatggcgcccaacccgtcaatcaatttttaaaaatccaaaacaacagtcatggtataaatagctataggcctttacgtatgtttaaaaataactaaaagagcataattagattgtttataacacaaaggataaaagcttgaggtgatggatattccatttaccctgatgtgattattaaacactgcatgcctgtgttaaaatatctcatgtaccccatatttacctactactacccacaaaagttaaaaattaaaaaaatagcaataggcttaaaacatgggttccaatctctctcttttttttatcatttagtatctgagtgatactaggtgagtcaatttctccaaatcttggtttccatacatgaaatacaggaataataataagtgcctctgaagattattgtgaatgttctagggataatatacatgaaagcatcctgcctactatgtgctaggaactttgctaatatataaagttcactggatgattttgatttttcagttctgtttgaaggtgagtactcctggtgatgcactgtttatacaccatcaaatgtatttattgaccacctactatgcgtcaggcagttgctttagggctatgatcccagagaacagtaggtcacaatacaggcaaatgcgctgcctctacaaaacgaacaatctagttgggaaagacataaaaaaaacaagtgaggccgggtgccgtggctcatacttgtaatcccaacactttgggaggccaaggtgggtggttcacctgaggtcaagagtttgagaccagcctggccaatctggagaaaccctgtctctactaaaaagacaaaagttagccgggtgtagtggtgggtgactgtagccctggctactcgggaggctgaggcaggagaatcacttgaacccgggaggtggaggttggagtgagccaagatcctgccattgcactctagcctgggtgacagtgtaagactctgtctcaaaaacaaaaaaaaacaacaaaaaaaaaacaagtggacaaataatattttacatactagtatatttatatatcacctcatcatatttgtcagaggttggcaacttgaggaatgtgtgccaatgcgagatggttgtgtaccataagggcagaggtttctctgatacctttctacctgcctaatcccttctctcactgttcctcacaagggatttcaccatctcaatattttgtttcatttttattctcttagtcaatgaataccaggcaatcaattcttgaaaggtgttaactaacaatgaagctgttgggttgtgagatcaagacaaaggggcaagaaggccacagaaatgagaaagagagcagggctgaaaccacagtgagtgccagagactctagagcacagtgcttgtctgtcctgggtaggcaggtgccagtcagcagatgactgccatcatagttccagctatgctattagcaagttttctgattttttaaagaaaaattctaagtgtggatattttcaaaaggagttatctctcgatttttaagtgttggcaactaatcaaatctgtgcacaaaaaaccacaaaggcttgggtcctttggtttacgatgtgacctcttctgaggaggtattaacattttataagagatctgcttccttagagaaatttggagacctagggtggtctaagaaaaatcacttctccttctagccaagactggcagtcccaactctgctctggtgaaaggtttggccaagccaccatctccccaccacagttgctagttccttcaaggaggaactgaaggaacactgactctcaacagctgttgcccgttcccaatatcatggctacatcacaatactagagggaaataattactgtcatggtgataagaattttaagtgtacatttctaagatgtttttagttagctagtgaaaatacaattcaaaaatataagccatttatatgggaatattgactttcagtaatattcatttatacttttgcatgtaactgttctttaagttactctttaaaataacaattaactttttttttctttcttttttgagatggagtctcactctatcgctcgagctgaagtgcagtgtcgcgatctccgctcactgcaacctctgtctcctgggttcaagcaattctcccacctcagcctccccagtagctgagactacaggtacctgccaccacacccggctaattttgtagttttagtagaggcagggtttcgccatgttggccaggctggtcttgaactcctgacctcaagtgatccaccccccacttggcctcccaaagtgctgagattgcaggcttgagtcactgggcccctgcctgcttaacttaatactaaataacatatgagagagtacaatgaaacaacttaggaagttttttcttttagttttcttcatttctctagtaagccagtatatctccagccaaacaattcactgtgtttttttagaaaaagtcacagatggaaacaaagttacctgaatgtggagtctctgtagaaatggcaaaccacattttcactctccttgacttcttgaaaaaagtctctttcactagggatttctctgtattccccatgtcctttagaaagccattcctaatttggagagaggcaaaacattacacatgtgagatatctctttcagaaccacttgacattttaagtgtccaaatcaccatcgtattttgtaatgaagtcaattaaaaaaaaaagttttttttttgtttgtttttgttttttttttttgagacggagtcttgctctgtcaccaggctggagggcagtggcgcgatcttggctcactgcaacctccgcctcctgggttcaagcaattctcctgcttcagcctcccgagtagctgggactacaggcgggcaccagtatgtccagctactttttgtatttttagcagagatgggttttcaccatgttggccaggatggtctcgatctcttgaccttgtgatccgcctgcctcggcttcccaaagtgctgggattataggtgtgagccaccgcgcccggcccaaaagtgttatttatttattttttttttgagaatgggtcttgctaaagttgcccaggatggagtgtggtggcatgatcatagctcactgcagcctcaaacctcctgggctcaagagatcctcctacgtcagtctcccaaggaattgggaccactggcgcatgccacaccacgcctggcattttttttttttttttttggtagagacggggtttttactatatcgcccaggctggtgtcaaactcctcggttcaagcaatcctcccaccttgtcctccaaaagtgctggggttataggcatgagccactgtgcctggctgaagtcaaagaaaaatgaatgttttttagcaatttactttcctgtttctactgtcaatgcaaaactagtctacggacagtgaacgtctccacagcatggcctgggttcaagacaattacctgtctttgtagcttaaaacatctattttctcagaactttcaaaataaaaatttagacttgagagactcagaatgtaaatatccacttaactctatccatgtactcttaaactactaaaaccagaagcatttgatccaagttactacaagtcttttaaaaataatgctcatgaggctgggtgcagtggctgatgcctgtaatcccagcaccttgggaggctgaggcggctggatcacctgaggtcaggagttccagactagcctcgccaacatggtgaaaccccgtctctacttaaaaaaaaaaaaaaaatacaagaaattacctagctgtggtggtaggcgcctgtaatcccagctacttgggaggctgaggcaggagaattgcttgaacccaggaggcagaggttgcagtgagctgagatcacgccactgcctgggcaacagagtgagactctgtctcaaaaataaataaaaataaaaataatgcttatgagataaacccaattcgtcttggggagaaaaggaggatactgcagctctgaagctcaagagccctgtctgcttttgataaccactttataaatgcttaaaaagtctctatacctgcactaattgttagaaaggtcatctcacactgaactgcaatatatccataattctggtctgtggattccagcttggataaagattaaagttttaatctctttcccacgtgggcccttcaaacatcacatattgcctaagttttcccttctccacactgaacacttccagttccttttaactgttctcatatgaaaagatttctagagttcctactcttccaggatatcaactaaacacactctaattcaccaatgtcttcttaaaatgtgacagaggtctgaatccagcctccagaaggggtccaaccaaagagccaggagggccatctcccttcctcctctggacgtcagtgaacgtggcccagactatattgatgactgcggtgtcaaaatcacatccatttacatcgagctgacacttgcaggataccctgatattttcttatgtgaaatttctacacacagtttaactctcaaatacaattccctaatgacatatgacatttcatgactgctttcacaacttaccaatgatatgtgcccttaaaaagtatttgttaggctggacgcagtggctcacacctgtaatctcagcactttgggaggctgaggcaggtggatcacttgaggacaggagtttgagaacagcctgggcaacacggcgaaaccctgtctctacaaaaaatatgaaaattagccaggtgtgttggcacacacctgtaatcccagctcctcgggggctgaggcacaataattgcttgaactccgaaggcggaggttgcagtgagccaagatcacaccactgcactccagcctgggtgacagagcaagaccctgtctcaaaaaaaaaagtatttgtcttttaaaaagctgctatttctaggccgggcgcagtggctcacgcctgtaatactagcactttgggaggctgaggtgggcggatcacctgaggtcaggagttcaagaccagcctggccaacatggcgaaaccccacctctactaaaaatacaaaaattagccgggcatggtggcaggcgtctgtaatcccagctacttgggaggctgaggcagaagaattgcttgatcctgggaggtggaggttgcagtgagccgagattgtgccactgcactccagccggggcaacagagcaagactcttatctcaaaaaaaaaaaaaaaaaaaaaaaaaaaaagctgctatttcttttcattatttattctcaggtatttaaccaagaggctgaagacccgaacctgtcctgggctcctttgagggaggatgtgcccattccaaacctctaccaatgctcagggcctctcctgacacattcactacacccctgtgctcttagcatagccccttttggacagcatgtgctcctaaggtatctgcagaacagaatcaagcaggatgggcctacctgaggcatggcagctgggcagcacctggctgtcagtggctgtcacccaagcctctgcttaactcctatttcttaccttatccctctattctgctccctacctaagtgtgccagctctagttaacagtaggagggtgcttggctgacagaagaatatagattcacctaggtctattaagtgccgactgtaagtcaatgcatacaatgatctccccaataccctcgtggatcagaaaatcaaaattactgcataatctaattactgtataatctcttataaaaagaatatctatacaaatcactaggtttcttgactatttccagaaaatattttaataaaagacctactaaaatgcagtgaaagttctaaaataagaccctctgaattactcgatgacaaattcattttaaattgatttatacattaataataaaaaaggcttatagccagtctgccttagttggttttaattatattcagaccactgttttgaactgccaaaaagttcctttaagacattatttaacgtatgttcatcactgcaaatcaggtgaattcagtctctctacaaaaatatcctagttacaaataattatttttagttgcacattagcaattagtacttaaatgtgactatgaaatatgagtttgtggcagaacctaaacatatattaccttaaattccaataatccgtcctttgcatactaattatcagccctatactatgaaaagaagccaattgggcctggtgtggggtggctcacacctgtaatcccagcactttgggaggctgaggcaggcggatcatttgaggtcggaatttgagaccagcctgaccaacatgatgaaaccccatctctactaaagtacaaaaatcagctgggcatggtggcaggcacctgtaatcccagctacttgagaggtcaaggcaggatgggcaacagagtgagactccctctcaaaaaaaaaaaaaaaaagaaagaaaagaaaaagaaaagcagcctattttttaaaatacggtagggtacaggtaaaagccatataacgtactctattttagaaactcaaaatataaaaatttggactcacttataaaagattatttccttttgtagtaactcttctaaacatgagggtgtaaacatatcaaagtgatgctacagcaatacaaacaaaactccttctctttttttgtgggggaactgggtcttgctctatcatccaggctggagtgcagtagcacaatctcgactcacggcaacctccacctcccgggttcaagagattctcctgcctcagcctcctgagtagctgggactacaggtgtgcgccaccacacctggctaatttttgtattttttgtagagacagggtttcaccatgttggccaggctggtattgaactcccgacctcaggttgtccgctcaccttggactcccaaagtgttgggattacagatgtgaaccaccatgcccggtcaaaactccctatttcttcagaaaagttaagcctcatgtttaagtcacagtcaactgaaaaggaaccagagttggtgataaagtatttccatgtaacccagtggaaaaaatgttttaatcaaaattcaatttggccaggtgcggtagctcacgcttgtaatcccatcactttggcaggctaaggtgggcggatcacttgaggtcagaagttcaagggcagcctagccaacatggcgaaaccccatctctactaaaaatacaaaacttagccaggcatggtggtgtgcgcctgtagtcccagctactcgggtggctgaggcagaataattgcttgaagccgggaagcggaggttgcagtgagttgagatgacaccactgtactccagccagggtgtcacagcgagactccatctcaaaaagcagaaaaaaaaatttcaatttacagaatttaatccactggtttcagtcagagtttacaactctgcgtttattctacacaaacattctaagaggcaacaacgatagagctgtggccacctttgttacaaagcatgcattcttttgaatatgccacataattatttcattggaaatgcctgaaatacatttttcaacataaattgacttaattgctcttatctcatctgtcttatctcgtttgctttgaaaatagctaaatcggctttaatattacctgaaatggaaaccaatgactccctagccctccattcaaccaaacaaatccaagctcagaaaaacgatcttgggcagatctttcttttactcgactgtggattaatatagagattgggctaattttgaatgtctttaaaacatatttttttctgggcaaatttttaacagtaataggtattctgaattttaaaaaccctaaacacaaagaacgaaatgtaactactacagcacatgtatatataagttgttaggcgcatactgttatagcaatttcagaaagcagggcagagaggttacttgtttctgctgttgagctttccttagtgcctggagtctcttttctttaaggcgttccaattcatcctcatccatctgatccagtttttgaatttcagaatccaaatgttcttccaccagtttggtagtctgaagcagctgatgctccaggactttggaaaacatgtcaacagatgcatcagcttccattcttccaaatggtacagagttcagcctgggtgctggggagaagatttacaaaatacattttaaaaaatgcaaacaataagcaaggttttctctaccattttcaaaaattctggcaagtgtataatgtgtactctatggagtattctaacgacatccaagcacttgatgctgggcttaacaatttttatgtgtttttaaatttaattctcagtaggttctagtcacaccactcaaaaactacttacagcaaatttagggtgcttctgatttagcatatgttttactatactaaagccaagacaagtctttaagaccatcaccaaaccacagagaaatgagttgtgaagttatacctagtgatatatactgacaatcagtgttctttaccaatgggaaagagaaatcagaaacaactgcgaacaataggaaggtatacctactgaggttttacacataaatatatatattaaactttacttaaacacagagtacagttgagcaaaacacagatttttttcatggctgctgcccaaatgagtttcatttaactcctaagacgtctcattaccatttatgtaaagaagagtgcctggtgttccctgagcattaatgtccattcctgttctcccattacctaacaaaaaagtctatgaggtcacaaaaattaatactggtttccatttactgacagtgttaactttgatgtaaaacactccaaatacttttctaaattttgggtttttttccaacatcactcctctgtgtaaaatcagagtttcaaaatagaactaattcagattagaaaggaagacctatctcaattagtcatgcatcacttaacaatgggaatatattctaggctgggtgctatggctcacgcctgtaatcccagcactttgggaggccaaggtgggcagatcacttgagttcagatgtttgagaccagcctgggaaacatgatggaaccctgtctctactaaaaatagaaaaattggccaggcccggtggtgtgtgcctgtagtccccgctactagggaggctgaagtgggaggaggataccttgagcccaggaggcagaggttgcagtgggctgagaacgcaccacttgcaccccaccctgggcaacagagccagaccctgtctcaaaaaccaaaaaccaaaaacccacaaaacaatgagaatacattctgagaaatgcatcattaggtgattttgatattgtttcaaacattatagactatttacacaaacccagatggtacagcctgctacacacctaggctatgccatacagcctattactcctaggctacaaatctgtacagcatgttactgtactgaatactgcagacaactgtaacataatggcatttgtgtatctaaacatagaaaaggtacgataaatacagtattacaatctcataaaactgaaatgtccttatgtggcacatgactatatattttaaaagaaatggagtattttgtactagcaattagtacaaaattttacttttttttttgagacggagtctcgctctgtcgcccaggctggagtgcagtggcgcatctccgctcactgctagctccgcctcctgggttcacgccattctcctgcctcagcctcccgagtagccgggactacaggcgcccgccaccacgcccggctaatttctttttgtatttttagtacagacggggtttcaccgtgttagccaggatggctacgatctcctgacctcgtgatccgcccgcctcggcctcccaaagtgctgagattacaggcgtgagccagccgcgcccggccaaaattttacttcttttaaaagaaatggagtattttgtacgagaaattttataccaacaattagagggcaagtttatgtgtatctcagggttattactgcagaaatgatttataatttgcctatcaaagcaggaggctgttgcatatcaatgaactatgatacatttgcaaataatactgaagcaccccaaacttcacaacaaactgtgaattcattcactcagcttctgacacagattctgacccacacaggccctctataaacgttgagctgaagagaaatattcttgcaaacttcaattctgattcctttttctttacaggaaaaggatttgaaaagcatacttgatttcatctttgtatctccatagaacacagcaggtactcaataaacatgtatttaacgttgaatgaacacgtgcctgacttctgttcaaattactacactgttaagtttcaaaagtatttgagtctaaaaaaccaaattgtaagctcctcgtgagtgctataaaattggaaaggtgctgtatttcaaacacagcaaagatttccacgctccctatcgcccaagaaaaatgtcagtaggactgtgaccctcagtgagggggctggaaggagaagataataagatactgaattgaacgttggaagctgtgctccagggataagcacagagaatgcctaccctggaactttatagaatgagcccagaatttaattatgggataactggaaaaagacgagattaagaagagctattctgggtgtaggtgttggtggtcagagcattgagaatggggtaaagagacgatgcaacccctcgttagcttttcatttttcaaaccacagcctctgattcttcctttttacagctccgctggaagggtgggacgggacacagcgcgtcctcaaattccctagtcatttcctggacacccttacaggtatccgccaaaacaatcaaggggcctggtccttaactgaaccccaggtacctccccaatggcaagccggccactccctgcgcccggggaaacagaggaaagcacagtcccggtggccccaacttcgacgcctcctggtgcgcttgcgcaagagcctctgccaggacaccgacaccggtgctggggccgcgcccctcctccgctccggatgtggagcagcagaatgttcaccagcacccggacgtggtggtcggattcttctcactaccctctgcctcacctgagctctcggtgacgcctgagaagtgaaagagcagcagtttcaaaagacacgtccactccggcttttgccttgcagtagctgccggcggctgcaaacgggccgtcacatccgcctccttattggctgcgaacctcgcgcgatatcaccttggacgcc

SEQ ID NO: 2146 - DNA, 16940 bp, Homo sapiens
atgcaggtcaaaattcttcctttaatgtgattcatgttattttaatgacttttaggtcaaactcagattcccagttacaggtgcccttggctagttttatctgtgtaacatttgaggctgcatatgtgatcatggtcttgggtttcatctgagatgttagaagccatgtctcttgaggtacttggctcgtgcaaggacatcattgcagaagtcacagctcaggtcctggctgcttcggacatagccagcacccccactgtaggcacagagtccacctgaaatgcatgagataggttaatgctgacctagggtactcagcagttaactctgattctctttactaactacctaacaggaggcagctggagtttcggggaatctggtgcaatgtattatatttgtccctattaattctgtgcttgagacaactgactgatagcgttacacgtacctctcaggtactggtcaggggtccaggttggaaacctcctctggatttctttgattctagtagtcagaacttcagttgtctgggaaacctgagactcactaatccaggatgtgggagcttgagagccagggtcctgcagggaaggaggcagagaagaagccacgtaagctgggtgggagggtgatccggcttactgggctcaatggcgcttgttcatttcctgtctcttgttctcctttcacctttgatggaaccaatgccaccgtcagtctcctgtgaggtaggttagatagggtggtcatagcctcccttatggggaacaaatttgccagacaggtggagagaacaaaccactgacagtgcacaaactacatggtcagaatatcctacagtgccagacacggtggcttatgcctgtgatcccagcactttgggaggccaaggtaggtggatcacttaagctcaggagttcgagacgagcctcagcaacatgggaaaacttcatctcaacaaaaaatacaaaaattagctgggcgtggtggtgtgtgcctgtaatcccagctacttgggaggctgaggtgggaggatcacctgagcctaagaggatcaattgagcctgggaggcagaggttgcagtgagccatgattgcaccactgcattccatcctgggtgacagagtgagaccctgtcttaaaaaaaaaaaaaaaatatttgcagtaaggagacaaagaacagaagggaaaattcccaaatccatgcaagcacagaaacccatgattagtgtccttgggctgacctatgctcattgtaagagtgaaaaaaaagcacactcctgggtggagaattaaaatgctgagacacgcgatgtatgtgctagcatgcacaacaatagcgcatgtgcatcccggagaccctgaaacatgcttaacagcaataaccatcccctctgtcttatgaataatcatataagctttccatgaagggattttcccaatgtcacatgaggctgtctcattctccacccagctaccagagtgtagttttgctttgcaataaacttcttcgcctacttttaatttggactcgtgcccaaattcttctgtgcggcaaagtcaagaacttgaactggccctccaacaacacctggagatcagacagtaaagccatttatacctgttagaatagctactgtcaaaaatgcaaaagacaggtgctataatttgaatgcttgtcccttgtgaaattcatgttgaaacttaatccccgatgtggcagtattgagaggtggggcttttaagaggtgattagattaatctatgaatagattaatagattagtgggttaatggttatcacaggagtgaggctggtggctttataagaagaggaagagagactaagccagcacactcagcctctcaccatgtgaggccctgagccaccctgggactctgcaaagagtccccaccagcaagaaggctctaccagatgtgtccccttgaccttggggtccccagcctccagaactgtaagtaataaattttatttttcataaattacccatatttaggtattctgtaataagtaacagaaaacagactaagacaactagggttggtgaggatgtagagaaactgaaatcattgtacattgttgatggcaatgcaaaatggtgcagctaccatggaaaactgtactgtggtttctcaaaaaattaaaattagaactaccatatggtctgggtgcagtggctcacacctgtaatcccagcactatgggaggccaaggcaggtgggctcaccaggcaggagtttgagacctgcctggccaaaatggtgaaaccccatctctactaaaaatacaaaaattagccaggtgtggtggtgggcgcctgtaatcccagctactcgggaggctgggacaggagaattgcttgaacccaggaggtggaggttgcagtgagctgagataatgccattatacttcagcctgggcaacaagagtgagactgtctcaaaaaataaaacaaattaaagtaaaaattaataccatatgatttagtaatcccctttctgggtattcatccaaaagaattggaatcaggatctcaaagagatatctgagctcccacattcattgcaaagctattcccaatagccaagaggtagaaacaacctaaatgtacctgacagatgaatgaataaagaaaatgtggtatacacatatcatggaagattattcaaccttaaaaagaaggaaatcctgcattatatgacaacatagatgaatcttgaggacattatgtaagtgaaataagccagtcacaggacaaatactgcatgatttcacttatatgaggtatctaaaatagttaagttcatagaagcaaagaatagaatgatggttgccaggggctgatggggagagggaaactgggagttgctaattaatgggtataaaattttagtcatgcaagacaagtaagttctagagatctgatgtatgacattgtgcctataattaacaacactgtattgtatgtttacacatctgtagccagcattatccttagcaaactaacacagaaacagaaaaccaaataccacatgttctcacttgtaagtgggagctagatgatgagaacacatggacacatacaggggaacaacacgcactggggcctattggagggtggagtgtgggaggagggagaggatcaggaaaaataactaaagggtacaggcttaatacctgggtgatgaaataatctgtacaacaaacccccatgacacacgtttacctgtggaacaaacctgcacataaacccctgaacttaaaggttggaaaaaaggctttctttttttttaatattaggtttgtgactgtaaatctcccttaaagcatttttaccatatctcatagtttctaatatctagtgtttctctatcatcctgttttagttatttttaagtttcactatgatttgtttctttaacctaagagttacttagtgttgtgtatgtgtgtgtgtgtgcatgtattttaaatttccatatgatcagagatatttttaatttttaaaattatcttctagcataattgtattattgtgatatctgaaatttttgaggatttctttaatagatgatatatgatcaacttttgtaaaatgttcctcatgtgcaggaaacaattgtgtatatcctaatggatacgtaaataattacatccccctcatttttctctcctgctctccctccctccccaattaacaatcaagcctcttaattgtgttcttattacatgtgttaattgttttacttatttttcttctatatctttgctggtttgtttattgtataacctgtaaataatcaagagagatgtgttgaaatttcccattatgatagcaggtttattattatagtaataataatttatgctgcatatattttgaggctattttactggcatctacttgttttaaattgctgtatgtcctggataaattcaatcttttttgttatgtcataattctctccataccaaatattttttcttctaaagtgtattttatttaatatatcatagttatcaacattattttgattattgtattcctgataggtcttctttttaccatacttttacttcaaacttttgcatattcaaatgctttaagtgtttctcacataaaccatgtaaatctggatttgggcttttaatctcgttcatacatctgtgtctttaaaccagtaggtttcctatatttatatttattgccattattaatatcgtgtagttgctactatcatcttaatttgttatttcaatgtgtctctctttttctacattcctttttactcttgtcttaactattattattattaatattgttagaggtagggtcccactctctcgcccagactggagtgcagtggcgtgatttcagctcactgcaacctccgcctcccaggctccagcgattctcctgcctcagcctcctgcgtagctgggattacaggcacctgccactactgcctgactgatttttgtatttttagtaaagacaggatttcaccttgttggccaggctggtttcaaactcctgacctcaaatgatccatccgcctcagcctcccaaagtgctgggattttaaagacgtgagccactgtgcccagcctattttgtaaccgaaactatgtctcaccctaaataaggcaaggactctctgatcctttgtctccccaccactgcttccagcacccatcatattgaccaaacctataccctgggttttacttaaaatgtggtccgggaaccagcaacatcagcaacaactgagaacttatttattagaattgcagaactttgggccccatttcagacctactgaatcagaattctcatgtaaacaagagctccaggtgttcatatgcacaataagcttcgagagtcagtaaactagacttaaaaaacaaaaatctgtggccgggtaaagtggctcacacctgtaatcccagcactttgggaggctgaggcaggcagaccacttgagtccaggagttcgagaccagcctgggcaacatgatgaaaccccatctctacaaaaaatacaaacattagccaggcatggtggtgcatgcttgtagtcccagctacttgggaggctgaggaggatcgtgtgagcccaggaggcagaggttgcagtgagctaagatcataccactatactccagcctgggtgacagagccagaccctgtcttaaaaaaaaaaaaaatctgttaagatgatagatctcatgttaatgttaagtggtgttcttgccaaagaaaaaagatagtcaagttacaaggtttgggctaaggaagggatgagcagacctttcactgctgcttcagcttaagggtgtaactcagttaatgactgagttagtgtaggtagcagtgtgatgccctccttcaatgctgccagtgcaaaccctccaaacagtccagaaagggatttttctgtctgaacttgtaattctttttccagatagtctgaacgtctaaagggacttctaacccttcttatacgcctttgattatcacttccatgtaggtttcatcatatttgggagaaatgtccaaatctagagaattctcttgtttgttgttgttgttgttgttgttgttgttgttttttgagatggagtctcgctctctcgcccaggctggagtgtagtggcatgatctcagctcactgcaacctctaccccccaggttcaagcaatcctctcacctcagcctcccaagtagctggaattacaggcatgcaccaccatggccagctaatttttgaattttagtagagatggggtttcaccatgttggctgggctggtctcgcactcctgacctcatgtaatccaccctcctcgtcctcccaaagtgctgggattataggcatgagccactgcgcctgacccaaatctagggaattcttatttcatcttcaaaggaaatggactcatcctttcctcaaaagccagattttacaaaggagacagaacagcgcagcagaaatgatgccagccctaacatcacaagatattcagtcccagttctgcctcttgcagctgccatgtgactttgtagcagcaactccttccttgtgattctatttcctcacttgtcaaggatggattacgtgtccctcacctcatcttatcagattattggatgggtctccaaatcgaagtaaaataaagtatttgaaagtactttaaaagtatcatacaaaaaagtcaagggaagcaaatttggagagatcattgagaaataaatttttctaaaatcttaaaaaaaagactgcaatactcacaggttcctcaacaacaaccacaaaagcagtgtgagatcaatggaaaaaatcaagcctcattctcacccttgccatcactgattccctggcgcagagttaattcaacagtggattagtgaccattccccagaagtctctatctggcaagtgacaccagacggaattcatgcaaaaataaaactcaatcttcagaactaagaattgtatagaaaaaggtaaaggaaaataaatttaacattttttgagaatccaacagatatcaggtacttttttgcattgtttcatggaatcttcataataatgctgtaagaatggcattttataggtagagaaactaaggcccagtgagattaaatgacttattcaaggccatgtggctacaaagtaactgaggaaagatttaatctgtgatctttctcttggaccacttaggtccagaaatccagaatagggtggcccggatgatattctggaaacacggcattatttactgtgaaaagaaattgtggctcaacatgaaacagaaatgttgctgctcatatctctcaggcagaactgtcactgtcacagctctagagaccttcattcatgctgtgttctgtgaagctttgccatcatccaaaaaacaaagcagtggtgccacatagcagaatggccacatgtgtcaacggatgaagagttacctgcaccatgctagtcctatcgcccatgttgaccagaattttgtcaccgggagacttcctggacaagacaccagcgatcacggcaggatccatgcagtacttttggccaatggtttgcatcatgggttgatatttcaggaggtatggcatgtctatttcagccagcctttcagaagcacgaactcctaaaccaaacgcaaaaggaatgatgcagcttgttgtgacttatgctgcaacaggagctcaaggggagagagaaagaacaatccaaggatctgagtaatggtcgaggactgacaatcccagattttggtcttaaatctttagtagtggccactccctgacctgaggttagggctctcctcctgtgagcttgagtcagcatcccctgagccagggtcccctgtggctgtcagtgcccttcgactgggctctcaggggctgctctggcccacccaggacaattccatggccataggaaccattggtcccattctaagcaccccaataaaatgaaatgtgcctgcctatcagctgcaacctgacatgaaggagaaattctgcaaacccttcaataagtctttagatagtgttcctcaacaagtttgttcacaattgcacagttttccactcctaaacgataccaacaaatcatgcaagtttaaacctttctgaaataataagaatgctgggcaaaaggaaagccaatattaatctacttagctagccttaccttctaggtgcttttatggtttaaaaagcaccctcggccgggcgcagtggctcacacctgtaatcccagcactttgggaggccaaagagggaggatcacctgaggtcaggagttcgagaccagcctgaccaacatggtgaaatcccatctctactaaaaatacaaaattagccaggcatggtggcacatgcctgtaacccagctactctggaggctgaggcaggagaatcgcttaaaccggggaggtggaggttgcagtgacctgagattgcaccattgcactccaacctgggcaacaagacagaaacttatctcaaaaaaaataaataaaaataaaaaataaaaagcacccttgtccacattgtgtcaatcagagctcacaacaacactgtaaataccgtactgctagccgccttgccacggatgcaggggcagctaagtgacttgttcaagaagcagagctttgggaccccatacccggaactctttccaacactcagtagcgtgaggcatgggaaacagtgaaagccgggggataggttgagagggcgaaagctcatagctaccacagtagttcaggccgtgacgtcttccaatcccacaagatgctccaggggtgtccaggctttggatgtttccatagcatccccagttgctgctttcagacaagtctacaagttgagaaaagttcagcctaaggcatggaactagttctcatcattcttctgtccatgaataaaattacattaataaaagtaacaataataaaatccattacatcaccttcactctgcaattgaaactcttgaaatttaaatgagaaatatcccataaatgatcacaaaaacttcctcaataccaaattctcacctgctcccctgcagacatgagtaactactggagctattgaagcagttacactctttgtaaagctctggtgccctttgatgttgtcaggtggtatcttggaacacaaaggagaggatttgttccctgtaaagtagtcctcatcttacttttttttttttttttttttttttgagatggagtctggctctgtcgcctagtctggagtgcagtggcacgatctcgactctctgcaacctctgccttctgggttcaagtgattctcctgcttcagcctcccaagtagctgggattacaggtgcatgccaccacgcccagctaatttttgtatttttagtagagacgaggtttcaccatgttggccaggctggtctcgaactcttgacctcaagtgatccgcccgcctcggcctcccaaagtgctgggatcacaggcgtgagccaccgcgcccagcctcttctttcatcttatatgaactctgagcacttctccgtcaaatactcctaacttgttgctctgatgaaatatttatgtttgctctggagaaacaagtataaaacctggatctctctgggatatcaacccagatccaaagtaaggcactgctcgtaaatgaggatttgaggctggctacactttctctcaggtacacttctagataagagcctaaggctgcagaagggagtgaaggagagaggcatgggaccagtctccacatgggatcacccactttccacttcttccctttatctctttctcctttccatctctctctacctctgtcattctagtcatcactgaaggggaggagtggtttcagacactcgggatttcacaaaggccattgaagaggagaatgttctttctcttcacaccaggaggagagtgcatgagtatttagatctacaattcacacaaggtgggtacacaagtatttataatatatctacaattcacaccagaatggggacacatgagtcagtactaagatacctacagtaggcaggaaattgctccttttgagaatcatctcaccattataaggctgtaagaatgtctcattagattactctttaattaattaattaattaattaatttatctatagacagggtctcactgtcacccaggctggagtgtagtggcatgatcatggctcaccacagcctcaacctcccaggttcaagctatcctgccacctcagcctctcaagtagctgggaccacaggcacaagccaacacacctgtgtaattttttgaagagatggggttttgccttgttgcccaggctggtctcaaactcctgagctcaagcaatttgcccgcctcgacctcccaaagttctgggattacaggcatgagccaccgcatacacctggtttactctgtttaatctatttgatcctttgactaaagtagattagattatcaaaccttaatgatttgcagatctttggagatatatctattgcctataatcatatgtgtcctgtgtgtttacataaatgcattttcaggttctactttcttagaactttatggggttgataaatactcgtcttttggagtaaatacttctactttacaaacttgtgataagtaacctaagaaaaatgtggaaatgaaaagactagatcttttatgaatatactaaaaattaaaccagctgacaggttcttttttattttttaatcagtgcacttttatctttatgactggtgacaaatacccttagtactgcagttggttttatcactccttggttcctgccttgtggacctctccctagccacactctatgatcctcaaaattctttgtattcccaatgcttagcaccttgtaggcatttttaaatatttgttgaatgaatgggtcaataactaaatgaatgactatgagacctcatctaagaaatctattaaatttagagtcaggaaaatttagcttctcctgaggaactttgcttcctccttttatttattaaaaaacaagtaggctgggcgcagtggatcaccctgtaatcccagcactttgggaggccagatcacgaggtcaagagtttgagaccaatctggccaacatggtgaaaccctgtctctactaaaaatacaaaaattagccgggtgtagtgacaggcgcctgtaatcccagctacttgggaggctgaggcaggagaatcgcttgaaaccggaaggcagatattccagtgagctgagattgcaccactgcactccagcctgggtgaaagagcaaaattccatctcaaaaaaaacaaaaacaaaagcaaaccaacaaaaacaagtactttccctttttcctccagctgcaaagctgaagttcaatcacagcaactaaatcagcctcagtgattagcttagtcatgtgtactcggttgccttgattctggttttctatttgaattagtcttattcattagtcttattctggcaaccacctcaattcttctatggaaataaatgctttaggaataaattcaatttggcattttttatagtggacaatgagcagctattgatggtgtatatttaaagtctggcttcaagcagtgctgttttaagcccaccttgcattccagagaaccccaatcttttgtgggacatttggggagaggctgattgttggtggctgttcctaactccaggatttgttggacagtttagggaaaaaataatcttttttgttgcattttcaagtattagaagtgccattgtgttcctgtgcttatccttcccatctccaaagtcatttgtaaaaatcagccacactcacccatcagggcaaggaggcccagcagcagccacaatgcagacatgatgacgatctggctctacggctcctgaaacacttttaaaacaaaaattagcttgagaatacaaaaatatcagtcatcatcataaccacatgtaatatttccacagaagcaggggtgaaaagaacaaatttccccatatctgacctaagaaaatgaattatttgaatcatagtgaaaaaaaagcaaaagtaggacaagtaagtgctccattcatcctttcaattaatctaaaaatgagaagactcttactcagcccacaggaactcaacatacagtcaagttactaactactttatttcaagaaggcaagacactttgaatctcaaccaccaagaaacatactgacctggctccagaccctgaaaagcaaatttctgatgcccatacctcatcccaagagcctttttattatctccattatcaaaaggagaattttgtattggtgacttcttggaatttaggtcccttcttcttcaggtttgaggaaagaccacgctttcctcagtgccctggaatgtacactggttggaagacgtttcccactgctctaaccccagcctggaatcacagaccccctttatcaccttgagccatgttccccattccccctctgtaaaaccccaatgcggcaacaaacctggaccagagcccagggagaatggagctacctccaccagcaaatccccaagaagctggctcatgggcaggggtcccaggattgaactcatgaggtgctcacaagactggagaatgaacacgtggccaacatggagcacccgctcatgtgctctctctctctcttatcccaaccattcccctaatcaccttccatgagtacaaacagccctggttctcctactggctaccaaaccaatacacaaataccaccaaggatagtttgctgttaacctcagggaatggtagagtttctggacctttgcctccaaagcgcctcccaccaagccctgccactccagggtgtatgtcatcattgccccagtcagcagagcctggcagcctagcattttgaattattactgtcattacatgtaggaatgtgcatataaacaaggcacttggtactttcataatgcttctctcatctcttttgttttgaggttaaccttatgggttgtttctttcaaacacccaggaagagatcacatctcaagatggagaggctttaaggaagtcatttgaagccaggtgtggtggcatacacctgtagtcctagctacttgggaggctgaggcaggaggactgcttgagcccagagggtcaagggtgcagtgagctatgatcacaccactgcactccatcctgggaaacagagcaagagcctgtctcaaaaaagaaaaaggaagttattcgatttctgtcttcttaaactgagggggcatatgcccttcagttgcagtcatgctttttgttattctctctacaacattgagatggtctgtccgattttgcttagttgagcacaaaatgtcatggtcagtcccaacaccaaaaagattcagggacctggaatcttagctgggtctgcaggaacgctcagatttaatcacccaacaggagtcatttattcagcatcctgagcctccagcagtaaacaagagaggacaaccaatcccaggagaaaagaatggacaaagagctgcttgggtataggaaaagctcatggtctcatgaaagtgcatcactggctttatggaaggacccttcaggaaaaagcactgctcacattcaaatgctccacccagggtatttcactctttttgctgcttttccaggaaagaaaaaatacttcctcttggaaacccaagtggaaggactcagcttttattgtaacaggagagctaccgtattttccatgcttggaactaaatatctgtgttgagaagtcactttaatgaaagagtctatgtaaatacatgtgccacttaatgggaacacagaattactttctagttgctcctgggaccaggtcatcaaggtaaagtttttcaatttcatcagggaagagcaagaagtgacaatggaatttttcttttttttcttagagccagagttttactctgtcacccaggctggagtgcaatggcacgatcacggctcactgcagccttgacctcctgggctcaagtgatactcccaccttagcctcccaagtagctggggctagaggtgtatgccaccatgcccagataattttttagtttttatgtagaaatgggtctcactatgttgcccaggctggtcttgaactccaggcttcaagtgatccttccacctcagcttcctgagtaggtagggttacaggctcaagccaccacacctagcttggaattcttaaatggatgaacaatgtcattttgtccataaatacagcatattgaagcaacccaaactctatggcccaactttacaagtgacgaaaagtactctgtgtttagaagagattgttgagacatcactcgggtgtgctcaaagagtgtctgtcagttccctatgactcatttgttaattcccctgtggctccctgcttaaaaccattatgaagatgtcagaccaaggcagcacagtggtcatgatgtcaagcacaatgtttatggtagcatccctcttctcccttcccagagagcaaaatagtaacaaacagcaagggggtgtcaacaagctggggcaacaggcctgccaggcacactggaaactgacaaccagagcatccctcaggagctacctcatgttcctggtggctttgatggggacatcttcctctactcaccctctctccactgagtactttggaattcccaaagcactgtgtaagtttgtaaggcataatggaccatgtcttcttcagttcatcaatttttctagaaaaggtagaaacaggtatctttggtcttatggttttctcaccttagaaacttttccatgaatgctctcaatctttaccttgaacagtatcattgcaggtcattggggccctccatccagcccagaaatgtgacgtattaacacctcaacgtgcccaatgaaggtgcccctgccccattgtggtgtccccatctaatcctgagagaactgagaactcctgtatgcatccacattaggcatggtctcctgctctaagctgtgttgtcacccttgtttattgctaacatgtctctgtgtctacctactcattgtgtgccaacaggcctttctttttttaattttttaattttaattttaattactttttgttttgttgggttttgctttgttttgtttgagacaaagtctcactctgtcgcccaggctggagtgcagtggtgcgatctcagctcaatgcaacctccgcctcttgaattcaagtgattatcttgcctcagcctcctgagtagctgagactacaggcactccacgcccagctaatttttgtatttttagtagagatggggtttcaccatgttggccaggctggttgagaactcctgacctcaggtgatccacccacctcagcctcccaaaatgctgggatcataggcatgagccaccgcgcccagcccctgggtttttttctttttcttttctttttgttttttctttttctttttctttttttcttttttttttttttttaatcgagacaaggtctcactctgtctcccaggtgggagtgcagtggcccaaaattgtggaatcatctcaccattataagcctgtaagaatgtctcattagattactctttaatttttaaaattgttttaattttttttttttcaaaacatagtctgactgtcacctaggctggagtgaagtgctgtgatctcggctcactgcaccctcgacctgcctgagctcaggtgattctcctgcctcagcctcctgagtagctgggattacagccctgtgccaccacgcccagctaatttttgtatttttagtaaagacggggtttcgccatgttggccaggctggtctcaaactccagggctcaagcaatctgcctgcctcagcctcccaaagtgctgggaaccaccaacacctggcctgttttaaaattatttttaattttttattattttaactttttaatttttttaatttttgtttttttaaaatttttaaatatttattttattccatttttaaaatgtttaagtttttaaatttcttaaaggccttaccagtagcatcatgtcgtactcatcctcttcttgctattctaatcttctccctccctacatatatacacacacacgtacacacacacacgtacacacacacacatgcacgtacagcaacactccagcccattgcctcacagattgctatgcaccaacaggcctaaaattaaaatagtaatagcaatgtagtcacaaatataaaataatataaaattattctgccactaagatctttttttttttgagaaaaatacaactttttagagcaaaaatatagggcagcaacaggaaggctcattttaagctgttacgctgcgtagagctgcaccttcacatggcctgtgaaaatacctattcactgaatttggattgtaatcaataattaccagcctagaagacctctgaaagtttgatcattttcttccctctgggcaggcaaatcttccctgcatagagacactgtgagctggaagggagttccttctctcagtgcgtcctctgtgcctgcttttcccatttgcgtttttgagagttcagaactccaggaaggatcatcctatgctggagatttccccgtgaacgtttccttctgcacagagcaaatcagggagacttggcccctctgttccgtctatggactctagaggcgtatctgtctttttagtctgttagccgaggctgttagacatgttggccttagttcttacacagcttgcagagaaaataagattgttatagaaccaatactcatggtctatgggttaatgtagcattggcaagactgcccatgagggcaggcaagggatttaccgtctggcaaaatacaaacaccttagtcttttggctttcagttaacaaatatgacgtcgcatttggccctattacagctacagttaagtgcacacacatttcttttctcccattattcgatttgcacatgctcacaaatccaaaagtaatgacatacttgcattaaaagatatctaaattttgatgagtgttgtaatgaacaggaaaaattattctatcatctacaaatcttttcaaacttgggttttctttgcaaggtccttaagtttcgcctgagtccaatatttcttatgcagcagagacacaatcattgccaactgatcaccatacactggattttcatcctcaataagcccgagtgtaagatccatgcctctgcttcacactcacctgtcttcagtcagtgctcctccttagaggtggtgagcccacagcgatttatatagagtcctgttctcttgttaaaagtgttcatctcatcctattttggagagatttatgacatctcataaattat

SEQ ID NO: 2147 - DNA, 89544 bp, Homo sapiens
atagaattttaaactatttttattttaaagttatggcataacatataacataaaaatattttatatacgtttgaaaaatctataccgttcttttttatcatcaaagtttctcaatggccagtagaagcaaaaagacaacaccacctctgatctacgggacataatgttcccaggaaaaaaatcttcaagtgggtgtgagggtgtttctaattcaaaatatgtagatttctccgcatggaagaagtagtaaagattttcttaacatgctcctgtgttcatgcttggagacaagaataagatggtttagaagctttaccctttcttggaacaagtagaatcccggtctgagacctctcaggaatttcagagcttagcagtctggcctggaggtttttcagccttttagtataataaacagtagttgcttcctagagttgagtttttaaggattcacaaaaaggagcctgtacaaaatatacatacagttctttattaaacaactgtaaacacttcactgtaaaaatccataaaactttataaacaaacattttgtaaatagaatctatgctacagtaaaataattaacacaattatttacatgcaatactgacaaatttggcactttttgaaaagaaatgtacaaaacacttgctttaaaagaaatttaaaattataaaaactccgagcattactatcatgcactttgcaaatacctcacaagcacttatggcacagctatcagagagcatcaggctctctggtaatatttatgtaacttttaatgtgcttccataagtttgttgtaaaaccacctggacattgtcaagaataaagtcaaatgccatattccaaaccgattccaccgattgctgcatcagcctaaaggtggggagagaagaaatgtcattaggaattaggaaaggtccttaagactaattattcctttttatatataaaaattgactttggcaaaaaaaaaaaaaagtcctggccaggtgcggtgtggctcatgcctgtaatcccagcactttgggaggccgaggagggcggatcacctgaggtcaggagtttgagaccagcctggccaacatggtaaaaccccgtctctacaaaaaatagaaaaattaggtgggcatggtggcacatgcctataatcccagctacccgggaggctgaggcaggagagtcactggaacccaggaggcagaggctgcagtaagccaagatcctgccactgcactccagcctgggcgacagagtgagactccatctcaaaaaaaataaaatcctagaacactcaaatttttttttattttgttttgagacaagctgtcgatcaggctggagccatgcagtggtgcaatcatggttcaccgcagcctccacctcccaagtaactgggaccacaggtgggcaccaccacccccccagattatttattttttgtatttttcagtagagatggggttatgccattttggccaggctggtctcaaacgatccacccaccccagcctcccgaagtgaagtacaggcgtgagccactgtgcccagcccacttcctatggttttttaatcacatgtaagaccttgagggcaacatatttggaaccttatttgctacttagtcaacatggcaaaataaaggatatcactttctcattaaccctaatgagtacagtttcccagaaagtttaaaacaactcagtacaccctcagccattgtgacatgccattttttcccatttgataaaagtgatgaattactaccttttcatgtattttataactagatccagtttttccaaatctttttcttctattagatcagtacagtatttcacaacttggagaatgtcttcttccattggatctaggaagggggaaaaacttcaaatgaggaccagtctttttgaaggagaaagtcagagatctgcatggataaaggaaaactgcatttctacaactatgtcactaacagctatcaaaggaatgggctttgttacttttcaaagcaagtcccagaatttaaaagatttgggggtagctgctttaagcttatcagagttagagaaatgggttaaatctgcatagtttagtctgtttatgttctcaaatcatgagacgactacatctcagccttgggccatctaacacaggccaagccaacctgaaattgtagttatccattctctgagcaaggtcttcacatcattgaattcaacagctccagctagattgggtgctggaggtctcacacagccagctgggtcagactgcaaactagaaaggcctggcacacctgaagtagaagcagagagttcttcctgttaagaaaacaaaggataaaattgctatattcacacattatccaggtatattaagatctcataaaggtcaaagttaaggaattaccaggggtttctctgcaggaggtccttcatgttttagaaacccatcaattaacttctggggactgccacaggcccctggcagagtttttgcaggactgttaagcagcttgttattcaaaggactctgaatcctttttggtgaaccaatggtttttttcttcttgtttcttttcttttctttcactgctgcctttagatgaagtaaaggattctttggcactaagagcagatggatataagatcctcaacaaaatgatagtatggatagtctggatgacagtattgggttctcttttctcctcccaaatacaacaggctccctagcctacacctcccctcctgccccaagtgagaggcagtgaatggcaatggcccaaagtacaggctctccaattctctctttgctttgccacttactaatttgacctttggcatgttgctcatctatgatgggtagtactaaatgtgggtttgatgtttgtgatgcattttgaaccaacatcctttaatgtattcatctcaaaggacaactagctgaacaagtatttaagacatttgtggtaatgtcctattccaactttttaaaaagtaaaaagtggtgtgtttaaatcctgaaagtacagacacaaatccaactagaaatatgatgatatttactcatactgtatacttcagatattatcccaatatgaagagctcttaatgcaacagcttagactttgcccattatatactgcaataattagacaacagtgactccattactctttgtcttcatttttgttacatgccacttccaaggctcaccagatgcgctggctgactgctggtgagtgctgttctcgccctgcctttgtctttgatcatacgctgctttcagctccctctgaagttcagcaggaagggcagcaaatacctcagggtccacctagtggaaaagacgaggtcaaagtcaaacctgagctaattgtagatggtagctggtttctctttttcacaaaacagactttgttttcaaatctcacttttctgatctgtacgaattcttaacagttccccaatatcaaagctgattaaatcttcaaaatggttagagcaagaataaggaattaagagcaagaataaggaattaagagtactaacttaaagaaacccactacaacagcagaacctgggcaaaatgcactagtagaaaatgggaagcaaaacattgaaacagggactcaggttgttactgtcccccatgcaggattatacatctccgctctgttgtattcaagtgtggccattgatgtgtttgccccagatcagtgtgtttctgtcttagcatgccctcccccgtctcttccctgctgcttcagcgggaggctgctctgtgtctacatcctgcagatgcaggagatggagacaagcccactctcccctcccctcccctcccctccccagtggatgtggtgtcagatacagaggagaaagggaagtgagacaggtcctaagttggagcaggggggtgagaatattgaaactacagcagagggttcccatatttaacttacctgtgaaaatgctggaagggctattaaatttattcctgcgtcactgttcgattcttgaggttctggtatttgcaacaagactgtcccaactggttgtggcaaaattcctgtattacagccatttactggttctttctttttgtcgccatgtgactctgcttgctggacagcacagacttgctctacttgttcccggagatcaggtggaagtgcttctaaaacagactgatccagctataaaatgccaaacatatgagtaggaagttaaagcatgctcagagatgaggtgtttgggagttaacacgccactttaaatttcaatttgaatactgtggataatcaatgtaaggtacagaccatcaagctaggaaagccacctccaaatcagcacatttttggaacgtcttggccttttgtcattgaagcctgaagtactatgtgtagtctggaaagaagtgtatatatactaccagccactatcacatgaccaggtaagtccaaatatactcacagaatgtcctgcaattggggccaacagatatgaatagccttggtgaagctcaaattagatcccaccccagggaggggtgaaggcctgaggcacatgttaaaattctggacaggtaacagtcctgggtcaaaagttcacctttcagatgagagactgcccaaaaatacaaataattctactctgagagcagcacactggaagaaagggtttctagaagctgaattttctctaacttacaggacagaatccactgttcctttgccagggcctacctgtgcatccacatctggccctttggaaacatgcaatcccatcaactgggtggaccaatcttatcttgccaggagtaactaattgtgggtatctgtcgccatacaagcatatcagcattgccctttcccctagttttgcagccagtatttaacatctccttccgcctccttccatgcagggggagcagaggcacaaataaacttgcccaatatagcttaaggtgctaccttactttcaaggaccagcagtatatcacatgtacagcccacacacgctgaattaaaccatccaaatctccagagacctgtttgcaaatactgcaaaaacccttcgacataaggcctctacttcaccactaatcaccaaagctgccttgctgaatacagtaagtctgcatgatgaccactgtcacagacaatggcagtccacaggaggactgcctttcagctatgctttacaacttgcaagagtggcaaatctttgcaaaagcactttcactcaacccaaatattgcttatttagaatccaacatcatgatctacccaaacaagtggcccgttctccctttcttggttaaacggatgaagaaataaaaatgccattttcatttgtaaacttgtatttttgtatttatatttaggagtataaaatgtacttatatttaggactacaaaaatgtacctgggaaggtgacgggacctctatactcaggttaagtctcgactgcacactgacaggagtatgtagaccattccatttccctgaagactcagccttgttagtatcaggactggtcggcagatgtgcaggaaaaggtggcaagaaagtgcaagttctagaagcagatgatatttccagatccacagcagcccgaaatactacaaaaagaaaatatataaaatagcctcttcagatcatcgggcagggcctttaatcctctgtccattacaaataaaaaaactttattactgattcatcataatgaagaatataaatttttaaaatcacataaagctgtgtcaattttaaaaccaactgccgtctttccaaggacataagcagcacctaaaaaagaaccacattgatgaccaccaaccttctttgtgctcctcttcggtggatttcttagctttctgaacttggaagacatcacggacagagtatgacccactaggaaagtggcttgactgaactgatgggcgactgggacatgtggaagggttcagattagttggaaccaactgattcacgtgaatcccaacctagaacccagaataaagagtatgcttctaggaaaactaaagtgaaaatatgaattcagctaagcaaaatcctcagcaaatccttttcactatctcctggatcctgtttctagaataaaggtaaatgaaagtattcaaacagcattctatatgacttattacaaaaacaatttctaaagtagctagtgagtggtcattcatctcaaacttcagagtatccaattctcccaaaatataccaaaagatctttaaaatcagaaaatccaaacaagtggaatactgtattccactgatgttctcgtcaactaaggttttaaattaggataaaaaaaaattaagagaggacagtctacttggaaacttcactatttttatcttttttaaatgaaatacttctcaaaaaatattggcgggagtgatgaacagcaggtacactgcagacccctccataaagtgccattataacagtatttcagggagaaatcacaattacggctggcttagtgactaatctttcaacaaagcccacatcaagccagaacaaccctttacttacatatgcacacataaaactaaacctacaaaggttctttttttttttttttttttttttttttgagacagagcctcactgtgtcactcaggctggagtgcggtggcacgatcttggctcatgcaagctctgcctcttgggttcaagtgattctcctgcctcagcctcccgagtagctgggactatgaggcatgcaccaccacacccggctaatttttgtatttttagtagagatgggggcaagtgcctgtaatcccagcactttgagaggctgaggtgggtggatcacctgaggtcaggagtttgaaaccagcctggccaacatggtgaaacctcatctctaccaaaaatacaaaaaattagctgggcgtggtagcgggtgcctgtacccccagctactcgggaggctgaagaaggagaattgcttgaacccaggaggcggaagttgcagtgagccgatacaacgccattgcactccagcctgggcaacagggcaaaaactgtctcaaaaaaaaaaaaccccacacaaaaatctatggttttgacattttgatgcctcttgcctgtttcaaaggcatcttgatgtgcctgtggtttcactcccttctaggtcatcatacagcagatgcagagtatgtttctgattaaaaaggaacttaaaggtacaaaatttatgtattcatattcctcacagtcatatctacttctaggaaacaagaacagggaagacatgtatattagcccctggttaatcaggggtaccttggaaaagtacagtaagaatctaagaaaattattctaaaatgaaggaggtcaaaatggaggaagtcaagaatttttgtttctcttttccttgtattacaaagcagctaaagacctacatataaagtccctatacaccagcaataacccttttgagagcaagcctcaaaaatgagagatacattacacaaagtcagaatttacaatgttactatatacttacccctctcatatctgatatatttagtttcattgtatgaaacatgtttagcatcgcctttccaattatttttgcattatctgttgcctggtcaagagttacagtcctgtaagtgatagaattaaaaaacaaaagcttcattccatatgtattcactagtactaaagtagtatggaactgtttaaaagagttatagaaaagttgtaaacagttacaaagaagattataaaagtgaatgccatagtctcccttcaaggaagccagaaataccaaattagttacactggcaaccaagggggaaagaaaaattatggaacactagaactttaaggtaaaaaccgtaatggacacttaggtcaactaaaaataagttgagaaatttagaaaaaggtagattttagctaacatatgcacaaataaatacatattttccagctaaagcacaagtgaatggtaaacacaatgttcttgattccaagagaagttttaggttccaagattatgtatgctgaggtatagcaaatattcagaagagaaagataaattctctgtatgttgtttcttgactctcctttcattgtgtttacagtacagccaataaacaattcttagatctttaagaactcttgaaggaggaccaaatggtccatcagcattattaggtctcaaagatgtgctgacctcacccaccatttccttcagagccttttgagcttctctggcatgagcgggctgtcccattgcaaacagaattactaactcagtaacagattaacaaattactaccagttctctttccaaaggaaagttatttcgtgttttggatgatcctttccatgtataatgaacaaatgaagttccaggccattaaacaagaaatattcccagaaaaaattattataaattgaattggattttcccatagaaatgtttaagaagataatcacattacttcatctgcttatagaaataaccactaaaagctgagcacagtggctcacacctgtaatcccaaaacgctgggaggtcaaggcaaaaggattgttcaaggccagcctgggcaacagagcgagatcctgtctctacataaataagtttttaaagtaaataaataaatgaccactatttactatttgagatacatgtgtatcataacaggtaggtaaatataattcaagataaccaactgataaaaaatgtattttataaattatgttctctaattgtaatttataattcctgctttcatggtaacttgggagtttctctgtttaagagcagtcgtctcacgacttagcaatatcatcatatacatgaatgcaccatgtatggttggcatgagctaatctttaatgaaactatacttcatattgtaagtagctttcagtgtcaaaagtctcaaaattttggtttcacagatgaaatacagtgcaatataaaatgacatgtaaaaccacacatcttcatattggtcacgaatcttacatgaagtttaatattaagtagttggccctgacataaaagacgagtgtttcagaccgggcacattggctcatgcctgtaatcccaacactatgggaggctgcggtgggcggatcatttgaagtcaggagttcaagatcagccttgccaacatagtgaaaccctatctctactgaaaatacaaaaattcgctgggcatggtggcatgccccataatcccagctacccaacaggctgagacaggaggattgcttgaacccaggaggtagaagttgcaatgagccgagatcgcaccactgccctcaggcctgggtgacagagccagactctgtctcaaaacaaacaaccccccccccccccaaaaaaaacagcgtttttaaatgcttttaccagttttcagacattacagtgattcattcatctttttaccaattaaatgtatacacctatgtaaatgaagttgctctccttcaccatcatttttctagctactatagtctgcctttgtgtatcatttttttgagacagaatgttgctctgttgcccaggcaggagtgcactggcgcgatctcagctcactgcaacctctgcctcctgggttcaagcaatcctcctgccccagcctcctgagtagctgggactacaggcgaatgccaccatgtccggctaatttttgtacttttagtggaaatggagtttcaccatgttggccaggctggtctcaaattcctggcctcaagtgatccagctgcctcagcctcccaaagtgctgggattacaggtatgagccaccacacctggcctgtatcattgtttttaagaactacattgaaattttcctcaggaaaaaagtttcaccaagtcccgaaactatagcagtccctttggtctgcagccttgccctttctttctgtccatgcagtaaagttaacagcccaaagatgccaagcaaaggctgccaaggtcagcaatgccgtcaaaccaacctcctgtgtgtgggcctcgctgaaaccaagtgcattaacctaagctgaatgccttgggctgatgcctgcttctacagaataccagattaacgggtttacaggtctttattcaaactcctccttggttttcttcattttctattacttacaacaacctgtactgaaatataattaccaatatcatttctgaggtgagcttacctggcaatgttatcacaaattccatggcctccaaattttgcagtttctacaggagccccaggctttcgtaccatgattttgagagttagacgtttacccttcatgccagtggcttctagtcttctttgaatttcttctgaaagactcagaagaaaagcttctgcctcttttggctatggaaagacaaacgtggagaaactaccattccactttcctatatacctaataattgttctcaagtattttaactttgaatattaaacatgttggttactcactatcacgctcagcatctattaaaaagaaacgtggccaggcgcggtggctcacacctgtaatcccagcactttgagaggccgaggctggtggattcgtctgaggtcaggagttcgagaccagcctggccaacgtggtgaaacctcatctctactaaaaatgcaaaaattagcctggcgtggtggcgggtgcctgtaatcgcagctactcaggaggctgaggtaggagaatcgcttgaacccaggagacggaggttgcagtgagctgagatcatgccactgcattccagcctgggcgacagagggagactccgtctcaaaaaagtaaaactacaacaacaaaaactgtttggtataccctcaactattaaatacaaatacccaccttcccaacaaagtgaaagtaatgagtacttttaaaagatatttttcctttctttccttttttttttttttgagacagtctcattcttgtcccccaggctgaagtgcaatagcatgatctcggctcactgcaacctccgcctcccaggttcaagtgattctccttcctcagcctcccgagtagctaggattgcaggcgcctgccacaatgtctggctaatttttttgtatttttagtagagacggggtttcaccatgttggccaggctggtctccaactcctgacctcaggtgatcggcctgcctcagcctcccaaagtgctgggattacaggtgtgagccaccgcatagggcccctttctttcttttctatgccatcactgacttgtcgaaaattcttttgtaactatgttaataagttctgctaataaaatgtgtgttccaacactgtgcttacagcccaaacatcatctatctccatgcctaaggaaacaaaactcctgaggtccacagtgtaggcacagagggtaattaactcatcacatttcaaatccttatgatatggtgttgtttgtacatacaaattcaagacatatccagccgggcgcagtggctcacatctgtaatcccagcactttaggaggctgaggcgggcagatcacaaggtcaggagtttgagaccagcctggccaacacggtgaaaccacgtctctactaaaagtacaaaaaattagccgggcgtggtggcgggtgcctgtaatcccagctacttgggaggctgaggcaggagaatctcttgaatctgggaaacggaggttgcagtgagccgagactgcgccactgcactccaccctgggcaacaaagtgagactccaccctgggcaacaaagtgagactccatctcaaaaaaaaaaaaaaaaaaaaaaaaacatatccaaatccataatctgaaggaaaatggaaactactcagccatctgtgctgcagctttccaaaagcttgcataaggaggggtttgctgaaacttaattttaactacagcttaaaaaatatttcaacattaaaaatatttttctcatcttttttattttttcactgttaattagaataattataatctcaagttctctaataactggcctccaaagcataatcttttagtatatttccccaagagctaagtttcctcagtctcagtcttatctggggctacaccttaccacacagtgccttaaaaggccttcttaaggctctggggatacaacagttttaagacttaatttcaagcattgagggtctaatggtttagttgtagaggtaggactatgtaaaaatataaagagcaacagatggcaaaatctgttcaatgatcagtacctgagtaaaccttattccatagttgatctcagctgaaacagattttctttccttttcagttcgaactggtctatcatccaagccacggcagaacctataaagcatctgacctgttttgggaccaaattctttttggagttttgccatggtcatatactgcaagtctccacaagttttaattcccaaagatgccaacttagattccattgaatgtccaactcctaggaaagggaatatagttaagtatgcagaataagctactaataacaagtttattaacacaaaatacccaccatttatgcacaaaacaactagtttaaaataatctttaaagtctttaggcaacataactgaagcatccacaggctgaagaattttttggtgcaaaatcatgctagtagatgtatttctagactctacttctcaatttggactccacatatagatgaaccagaaacttttaaaatatgtataactcaagttatcaaaaatgtcactttctttattagtgaataataccaagatatgtatcttagtcacaaaatcaactaaggaatcaactgtcatttaaacaagtctatagtgtgacttacagacatactaaccaactcacgaaatgtaagggatctattatgatttcggtcatcaccaaatctcacagtggtatcagccacattttttcagtgaaaaacagaacaagaattcacaaaatgggccaaagtccagaaatgttacatgctatcacacataccactgacctgaagatgaaggaccctaaccaaaccaactggtggttggggtagaagacagactttttttttaatcaaaaggatgatctctctgaagagatatgaactctcctacagctgggccagcaggcagcagtccctatgtcctattctgcaagatgtaacgtttgagccccacctaaaggatactgattaattctgttgctctaagttggagtcttggttttcttcaatttgccctaaatgctttaaaaaggtccacaaatttgggaaagaggtttggagtaactgagggaaactataatgcttattaaaatggttccacaccatcaagtaaaaattttccatcaatgaggaaaagacagcgttgtgtttctggtcttctgtaggaacttatcaaaagagaactcaggctgggtgtggtggctcacacctgtaatcccaatactttgggaggccaacagtctgagtttgaggacaacatgggcaactgaggtagaccgtctctataaaatagaaaaaagaattagctgggtgtggtggtgcgctcctgtagtcccagctacttgggaggctgagttggaaagatcccttgagcccgagagtttgaggctgtagtaagctatgaacctgccattccattccagcctaggtgacagaacaagaccctgtgtttaaaaaagagagctcagagtgaagtctgctaacttctgttcatagctcccatcctcctgagtggtcttcagtagcagaaaaactatctagtccaagttctgccaggaaaacctctggaaccagtatataacacaaggttaggaagtcatcaatgtgggtcagacaagtttaaacccagacactttattccttaatggaagtgagatgaaggcgttaagcgtgctcgttcacaattgtgccattttaaagtccaagccagaacaaagggcaagtaaataccaaagaccccgagttaacaatttaaaaaaaaaaaaaaattcctccagagaagtaccattcaccaaaaggtaaaattttaagtgaaacctaagtgcttttcaaaatggggaggagaaacacaagggaatagacaaattacatacttgggtttgtcaaaggtagacactttgcacagctatttgcttttaagaaagacttttttcttcaatttgctctttttgttatttcttttttgtcataagacttcttaacatcagggaagactttgtgtctctcttttgtccctcccactattgcctcacttcccactcccataatctgaccatgatctttccgttacagttctggggaacaaatctgttctcagggacttccaagattagcaagagacaatcatcatcctgggttgtgttagtgtgtccatgtgttggggtggaaaccccatagtttaaaattttagagtatcttgagtataccacaacaaattatgcactacaggtgcaaaggaaaggctatattaaacatcaccaagttaaccgtaatcaatctaatctaagtggacatccctctatgaaagaagcacagttcttctccatgcaggctcatctgatggaatgaaatggcctgaaccggaggtgggggagggaggcagggcatgtggtgtacctccaactcctattgagtgggggtgggaaaattaaacttggagccaggaccaaaaccttgaagagggctgctagttttaactaaatacgtcaattaagtaggtgtttataagggaaagatggcaactctatggacaaagtaaggggggctccgggcccaaagagtgcagccacctattaaggaaaaggtgaaggaaaatatgctcttttagaatcaaatctcaacgaagagagagtcaaggaggctcctggtcaagcaactgggacaaagacttggcatctgtccttgaaggggaactattaccctaggttaaaagtggccaataatgtcccctccttggcatccagaacttggctatccaatacagacatagaggagtaaacttcaaagaataaagttttcaccatctacaggagtgctgttcaactgaactttctgcagtgatggaaatgttctcgtctgctatccaatacaggagaaccttgctccatgtgaccactgagcacttgccatgtggccagggcagtgaggaactgaactggtagttttatttaactttaatttaactcatattgtactagcttcacttggctacgtagctactgtattagtgcagactttatgaatgcctacatgatcatggtggttctctgaaaatgggatagagagggaatccatatgctagatgcacaaacctagcaaaggctgaatgaggtgcagagggcccttcattgaagagtgcatgcgcaggtaaaaagccctgcaaagatccagagaaaaagtagaaatggttcttcaaactgtaatagtcgttggggtcaatcctttctttcattaggtaaccggatcatattaagaaacgtatttattagtgtaatacacaattattattctgtggagtctcctaaagcaaaaacttactattgtgtttttccttcttatgtagttattctaattgtttattactgtgcgcagcacgtatgtggtcactaaacatttatgggtacaagggactaaagaggttggagatggggcaagttaccactgaatttctcctggttatggttagagagccaagttcctccaaagcgtgttccacaagatataaataggtactgtatatttatcaccaaatatctttgagaaattactagtctttaacaaagataaataggtttcttttctaaaataattcccaggactttcactgtacaaacccctccaccacagaaggttccctctcctatatgaaacccctttttaaaggaacagcttataatctgtggaacacacttcaggacaggagtaacaatggagaagggagatattttatagacctgaaatgttctataacagtcaggttaaggatttggggattttatgaaaaccacatgaaccactgtgagcaatacagaacctggctctgaagaagagaaggccaactctgctgccctatctttcaaatctcccttaggaaattcaaggctgtgcctcagcttggccaggacatgtaacttcacacttgcccttcaagaaataaagtctcactgggcacggtggctcatgcctataatcccagcactttgggaggccgaggcgggcggatcatgaggtcaggagaccgagacagaggtgaaactccatctctactaaaaatacaaaaaattagccggctgtgtggtgggtgcctgtagtcccagctactcgggaggctgaggcaggagaatggcgtgaacccagaaggcagagcttgcagtgagccgagatcgcaccattgcactctagcctgggcaacagagcaagactccatctcaaaaaaaaaaaaaaaaaaaaagaaataaagtctttccagccaggaagcaaatgaaggtgaatggtaggattactaggtcaagtagctaaaacgtccctatttctattaaaacaaagaaaactacaaaaagggttcgatttaaagatggtgttttggactaaactgtgtcttccccaaatttatatgctgaagtcctgaccccagtacttcaccatgtgactgtatttgtttttgttttgtttttttcaacacagtctcactctgtcacccatgctggagtgcagtggtgcgatcttggctcgctgcaacctctgcctctcgggctcaagcgattcttgtgcctcagcctcctgagtagctgggactacaggcatgtgccacctacccccagctaattttttttgtagttctagtagagacagggtttcaccatgttggccaggctggtcttgaactcctggcctcaaatgatccatctgcctcggcctcccacagtgctgggattacaggtgtgagtcaccatgcccggccacagtgtgactgtatttggacacagaatctttaaagggtaattaagataaaacaaggtcatattgatgagcctaatccaacatgactggtatcctcacaagaagagatcaggacggagacatgcatatggggaaggccatgtgaagacacagggagaggagggtcacctacaagccaagcagaggcttcagaaagagccaaccctgctgacaccttgatcttgaacttccagcctccagaactgtgagacaacgcatttctgttgtttatgcaccccagtctgtggtactttgttatggcacccctagaaaactaatacagatggctagtgtaataaacttaaaactcaaattttacatgcaactttaaatataccagttccttcttatataaaacttcagtaagatttcttattaaaaatgtttaaactgtgttgtctactacagtaatttgctagtttgattttataaagtattctcaaattaaatgtgaaactaaccatcaaaaatgtcatattacacatttctgacactaatacatcgttttaagttatatactacgggggtcaggaagctttaaaactaacctaccataaaatgccatttctgtcgtttaatatttatggcctgttaacagaaacttctaagttagttcggacatacttttattaggcttaaaaataggcatctaaaaatgccactaaatctacttttaacaaatgaattttaaaactttcactataaatgaagatggaagactttacaaagctgacagaggcactttataataaataggtaactacacaaaaatatgaaataactgaacatcctgccccttaggtgagaaaggttaagatggaaggtttttttccatgagtggagttaattgaaaacacaatccttctttacgtttcctttttcctaatacagctcacacacattctatttatacttttaaaagtacttgtttaataaactcagaaaactgtcgctagtcctgcagcatgacataggagaatcgaagctcaaaacttttatctttagcccaggagtaaactatttcaataatcatttatttaaaggactgaaagtcaatttcatcatcctcccttttaacattgtttcttagaatcttgctacttgagaaatacctaaagtaaaactgaatagaagcaaaacaaaaatgtaacattaaggtcctgacaaatcattttaggggatatttaatgcagaattccaaattttgtttttcatggcactcaataagacttaaaaatttttatattcatgtctgggcaaaaagaggtctcacagttctatattatagatatgaaaagtacttgtaatgcctgtaataaaagtattgttaaaatatttctatttacctggtagattggtcactagctggcctctgataaaatcatctacttcttctggttttaggtggtactgcccatctggttttgcttttctagttgccattctagccaggagaatattagaacctattaaaaaaaaaagtcatccaagaaatagtcacaattattttttaaatttctcaacaaagatctcttcatacaggttatccatcaagtttctaaaaacaatgaaaataaattttgattatttcaaataaggtgtagaattttgctaagtatttagattataaccaacagagtacctggacagaggtttctctttgctctaacgcaagtgccacttcagcatctaaccagaagcaggaatagagaaagcagtcctgattttttttttttttttttttttgggggatggaggctcactctgttgcccaagctggagtgtagtggttgtgatctcagctcactgcaagttccgcctcctgggctccagccattctcctgcctcagcctcccgagtagctgggactacaggcgcccaccaccatgcccggctaatttttctgtatttttacagacggggtttcaccatgttagccaggatggtctcgatctcctgacctcatgatccacccgcctcagcctcccaaagtgctgggactacaggaatgagccaccgtgcccaatcagcagtcctgatcttcagagtgggtgtctgtaggaattgaaggccatgatcaaagagtagttcatgttcccaaccacaggagacagaggaggtagggaaatgacaataaaaagtgcgcgactggactggggaaaccagaaagcccaaagcagcagtgggaactgagggtagaagagtcctcaaaacacagagacaggcagtgaggttcacggtgtaggtgtgggcaggggccacagaagcagtggaggaaaagggcaccaagccctgagaaggggcagggatctgcagagctcagctgctaggtgggcttctccgtgaataataaaatctccaaagggaagacttatattgaggacatatcttggttttatagaagacttatataaacagagattcacgaacagggaaagttctgggaagtcacaccaaaatgataaaagtagtgagttcaggggaggggaaaggcactgaggagtggaaatataaagtgggactttggcattacatatgcttgaacttaaaagaatggattcacatgatcacttataaatgaaaattaaggacaattaaaaacaaaaaaataaaattgtgcctgacaatggaatatagaattcctaagtgaaatgttaccaatgtctgtgggccaacatcagggggtaaaaggtaggctagccagtagctgtaggaatgctgggaatgtattaatcatactttttattttctgtatctcgcagtgttttgaaatcttaaaaatcctgctggctggggagagactgccctcccagggctggctaattcctaaagacagtaaacctcttacctggaagcacacttgtcatatgcaacctaaccacctcctgccctaaattgtcccagggccagctaccaggcaactagggaccacccctatagcccagagcccaccagaattactcaaactagccactcctaaagtgtttcctcagccctgccttgcctttctgaaaaaaaccctaacaaaggctctggagcctaggcgctccgtctgccactccttcagcttctgtctcctaaccaccctggtgcttccccagtagtcctgtgtagcacggtgtgcccctcctctcgggaaatggaagtaacaaattcttctttcaatggcattagcctctctgcatcatcactcagtcattagtaaatttcatgggtacaaaggagacagggaactttggaagaagaagggtttttggatgaagatggaggaataatggttgaaagtgacaatggcaagctaagacagttaactttaccttccaagcctgtggtatactgagtatggcagggacaaactggctctagtaacagaatggcaagaaaaggggtatcttgccagaaggtaatgagtgggttaagaaaggaagaggtgactcagggaagcttaagtatgaaagagttccagaggacacggctggaagaatcaacaaaaaagcagggtaagtgctgggagcagctgtggaaacaaagtacaaggtttaaagacagcatggatggagatggaggagagactggacagttactgagagcacttggagtcagggtgacttctagaactgagtgaagacaggaatagctccatgtgccgggaggctgaagtgcagagagtaacaagactcagacttaacacgcaactctaaacccataccaccacctagctttaaatacggtttccgttcacttttgggaaaaaaaaaactgtttacaaatgttgaatgaaaccttcccaattttttaagaataagtaagaaatattctaacttatttattgcgaagattatcaaccatttacttatatttccagcacttatctcgtgtgtcacacaattgtaagcaatgctaaaaacggttttacaagtgagaggaagctaataaaaagaaaaactccataaaattaactgatattcaagaatctcaaagcaactcttttgagtacaagataagctagatactaaccaattccaacagaggcagcacatttcgtctggtctttgatttccatacgaacagcatttgcaaattcatcaggagtaagtttggtctctgcaaggatttcggtaatgtctaccagcgcttcatcacaactgacagcttcaatgttatgagtgtagctatcaacacagagcaaaggcaacgaatcacagccacagccaccatctggtagacccaatgttgcaaaatagtcttcttatcctctcttttttctatttcctcacaaagcattttaaatgaattggctgaagtaccattttagtcacccaacttttaactgcaaagttaattagtgtgttctctttctccttattaactaccaaaatacagcatattggataggaaaatgtttgaggagtaaaataaccaacaaaaaaaatttaaacacaaaaaaacaaaaacacagcataaattattatttcagtttctctatactgacaatacttctataaacctttgaagagttgaaaaccggtgggtgaatttgaactgtcaaaacatttaatctaatggtttatgagaatcctttaaggaacagaaaaattagacaaatcagtaattgctactctcctaaaaccaaaatatcacagttaaattccactcactgtagcaggcctagaatacagaaggaaaaagtggccagtcatcccaactgcttgtctgagaatagttatctacactctctgcatgtggacatactttttaaaaaatcatctcataggatctatccacaaaaaggatttgttttaattagagaaaagaaaaaggaagacaagagttgctatgtggcccccatgctaatacgaggactaagaaatcacaaaatagaactggaccagaaatgggaggaaactttcccaagaggcctcaggatcaaaactatgtctttcataatccacttggtaatgtagactaggagggcggtcctcatctctcacctacaccttactgtaggtaggttacaatcagattaagatctctattaaagaaataatctattaaagaaataagtatgttttgtttaggcttaaagtatgacatttttaagaacagaagggtatatctggtatgaggtattttgcttcagagtgaaagctgccctgagacagggagaatatgaagctgagataggatttcccaagggtggtagaagaacactactgtggatatttttcccctaagaatagaaacatgccactgaaactgtctccagccttctactgggaccgtgtgcatgtgactgtgtaggagtataggtcacagctctctctcacatcctcataacctcaggcacaggctgatgcttgctctagggcttcaatacccaggacacaggagcaccacagtactgacctcagtcacccatccctatctagccctcgtttggatgctaccactgacttcctcctttcaaagaggatttaaagcacgttccacttgacaataccaacattcctgtatttgggatttatttatttagttacccaacttataactggaaagttaattagtgtgttctctttgtgttaatagaatagctataataagtgtcttatcattcagcactcactcctacataatgacgccaggaaataatcagttccttcacattttctctctctctcctactaaagcaagctcccacaagggcaaggattagatattcccttctggactagcagcatctagcagtcacctgtacttagcagatactggtgttcaaattaacgcataaaaaggaagaggcagaggtgaaaacagaggcaagaagtctatctcttggaacattaatactgcccaggagttgacaaaccttggcctaacatccagtaaatgcatttttactggaactacaccaagcccattcatatacattccccgtggctgctttccattcacaacgcagaactgagaacttctgttgagtgacagaaactttatctggctcccttcagaaaactatgctgacccctggtttacagcataataggctggttatacttttaagaaatttgagtcctgagttaatatggaatatatctacacttttaaatatttttaaatacatctacaattttaaatatttttaaaattaatcaccttttctcaagccaactcatcaaccattttgaaactattattaaagacccacttttatgaaaactaacttttggcatatccaatgattttaagaagataaaggttttaaagtgtctccacttgttatcaacccatcagttctaattttgaacaaaactataattaaaatgaaataaaagagaaaaaccaggttaaaaaattccatccttcatctatctggctccatgggaagaaaaccagaaccacagactagaagtaatataagcaaataatcagatcttacatcaaccaaggaagcacatgaacaattttggcaatacaaaactatcctttgagattgagctacctggaaattgcccaaagaaaggtctcaaactgggatgctgaggagtggttcctggaagataaaattctaacaaaagtgatcctgacaatcctaaagaaaacttgaactgtctttactattagctaaaagaaggaaaacacagacacaaaatgacagtttgatacactgtaccttgccaatgtttcatacaatgtttgtgcgacttccttatatgcatgaaaatcgtatggaacagcttgaagattaggacatagttgtttagcatgcccaaaaaacattccgttcttaatgccaagttgcctagagcgagaacaaaacacaatggaggttattctaggaagttttcaactcaaatatttatcaaatatgttgatatctccccatgccactaatttataatttccacttaactccattctcattagggattaaagataggcattaaaatttacagccttgttttcccccaaaagtcacaactgtctgaatagtgtaaatgacacatgtagatgtgccaactatgtcattaaaataccaggtttggctcttgtatctgaagctttctcctaaaactcatacctctggcccctttgcagagatgccagcatgccatatgctggtgatatcacaaccaccacagagcaggaatatgctgtcaaaaagaggttttcttcccctaatacaaggcacagtttggccagggttcatcccccaaagacaaagaatataaacaaaagaactacacaaaacagtgctatgtgacaaacagacaaaatgtactcatcctattaccacccaattcccaattgaccaattccatgctcctgaagtggctccacagtggttgagatgccaacagcattgtacatggtaggacatcactctgggcaggagccagggttccagaactttgagggacctaattgaaaatggtaaattttaaatctgtgtgtctcagtgccccacattacctttgacatttggagcattcaccacaaaactataattatggaattatacataattagtaaaattctattttatcactctgtaaagaatcaagaaaaaaaattatagtaaaaacaagcaaaataataaagcaatgtttcaccaaattacatattatataataggataatggttattctatatatatgttcaataaatatttactacacagcatggagacgtgccttgttttaagaaacgtatatacaaacagttgccaattactcataggcctctggcaccctcccaacatccagaccatgagagccaagaagaaagagtcctccaagttactcagcagtagatgcaaaatcacatgcatttttatgtttataaaaatagtaatattataaatggtctcagtgctaagtccctagtagataagaaatacctaagaggaaggaaaatgacagagttgtaaagaaaacaattcttgatgtgtcgaggacttagcgaggtgctgggtataggatggcaaataaagcaaactccatgacctccatggggacaaccttgcacttgcctagaaaaggatgacctatggtcaacaggctttgtccactaatgaagaaagtagatacctaacagtttagacatatatgtagaaacataaaatagtttagaaactttatcagaaagcagaaaaaaggtctggtgttgaaaagggtaaatttcaggtaataattatgccagatatatagattcagcatgtaaaagctgagtttacaaattaaagataacacattttttaaaaatgtgtttataaggccgggcacagtggctcatgcctgtaatcccagcactttgggaggccgaggcaggcagatcacctgagagggggagttcgagaccaccctgaccagcatggagaaaccctgtctctactaaaaattaaaaattagcgagaagtggtggcgcatgcctgtaatcccagctacttgggaggctgaggcaggataatcgcttgaacctggagggtggaggttgcagtgagccgagatcgcgccattacactccagcctgggcaacaagagcgaaactccatctcaaaaaaagaaacccaaatatgtttatagtccaggcgcggtggtacacatctgtaatcccagcactttgggaggccgaggtggatggatcacctgaggtcaggagttgagaccagcctggccaacatggtgaaaccctgtctctactaaaaatacaaaaaaattagccgggcatggtggcacactcctgcaatcccagctactcgggaggctgaggcaggagaatcgcttgaacctgggaggtggaggttgcagcgagccaagatcgtgccattgcacctcagcctgggcaacaagagcgaaattctatctcaaaaaaaaaaaaaaaatgtgtttataatccctataaatatcatgttcttatatttacaatattttcattttcaaaacattaatttacacaaaaattttccgaagcacattacttagtaaaatatagtacatctacttatgtactcatgtaaaatgtacccagagaaaactgtttaagagccattagacactataaggaagttacaaacaaaaaacgaaaacctttttcctttggtttgccttaggtttgccatactaagggaagccaaataccttgagttgatggctgggaaatgagctttgttccatagaaaataaatgagtaaagacaattacaaaaaagtccaaagtgtctcaaagtgtctcttcattaccgtgactcatctattacaactaaaatcccatacaggataaattaccaaaacttcgttaagtgtatgctgcaaaaacagcttattcctacatttaaagcacagaggacatattctgtctggcaatatgctttgttcagacagttgtatttggtgttggattcaacaatattaaaaaattgctggccgggtgcggtggctcactcctgtaatcccagcacttttgggaggccaaggcgagcgggtcacgaggtcaggagttcaagaccagcctggccaacatggtgaaaccccatctctactaaaaatacaaaaattagccaggcgtggtggcgggagcagtaatcccagctactcgggaggctgaggcaggagaacggcttcaacctgggaggcaggggttgcagtgagccgagatagcaccactgcactccagcctgggcaaaagagcaagacttcatctctgggggaaaaaaattgccatcaaaccactgtcactgtccattctacatactaaaatacatccataaagtaagaaaggtagtgggtccttacaaaagcacaagaaaatggggtttagaaattatatgactttaaagatctgtgattctaggatatctgtgtatcgttacctattcatgtacaatctaccttctcactgattccatataaagtttgctctctactgtaagtataggccaactactaacagcagtgcaaactgtgacccacatatacacattctactttgtatttctaccatttcatattcacattctatcctttgctggccccattattaagctatgtatagtgaaaactcaccagtgcatcaaactgagcagatcatccccacaatctagtccccactccaaactcagtaacatttctcttatgcaaattgttaaaaaaattttcctcagataaggaaaatataacctgttggatggccacaaaacaagtatccagaaactattttctagaaactttcactaggaatagccttctagaaaacagaaaatcacaattaagggacaaaaatcttacggctgcattttttttttcttcaagttaaattcattttcatcactttatgtatcttcttaaacatctgcacttaagtggcacttgaatggctcactatatagtattctgtcctcatatagtcaccccaattattttgcaaggcatgaagcttgaccaaatttataaaggtaaatttatatttaccgtgggtaaatataaatgcaccatccaaacacccaacagaagcctagtgcctacacacaattgtggctcctggagtccaaagccaccagagctggtgacactttcacctggaggcagccctgctccccagccagcattcatcttggtgggggactgggtatgaaggtataaagggagagaccctgcagaggcagccttagcaagggtaaacggagctcgcattttaccaactagcgaaattcaaggactgggaatatttctgggcttcatcacaccctccagatactgcacataactgtctagccatctgaagtccaggccaccattcattaacttagtagagaaaaagagactagcctactgagcacaacataaactcagctctagagtgcctgtggtaataaaaagcagtataacaattcaaaacgtatttgtatttgacttaattatcatttaaagtaagtttcaattccttggccacagcatcaagtgacaatgaaaaccattaaaacataattctgttaatgagaaaggcaaagttagctggggaggaaaagtttggcatgtcatgaatggaaaacagtttaaaatataagcatgcacgtttgaacttaatgctttttaacttaaatatactttaaataaaataattagcaaatttaaaaaaaactattatgattagacgatgctgagctcaaatattttttcttcagattagatgcctgaatagccacaactctgaatcaagactaaaaagatgtaactaggccaggcacagtggctcacgcctgtaatcccagcactttgggaggctgaggcggatggatcacgaggtcagttagccatcctggctaacacggtgaaatcctgcctctactaaaaaaatacaaaaaaattagccgggtgtggtggcgagcacctgtagtcccagctactcgggaggctgaggcaggagaatggcatgaacctgggaggtggagcttgcagtgagccaagatggtgccactgcactccagcctgggtgacagagcgagactccgtctcaaaaaaaaaaaaaaaaaaaaagatgtaactgatctaagactctgtttcgatttgaaattattgaatactttaacacttgccagcaatgtgtaagggcttgctgtgtgatataggtaaaaatgtctgtgtttggttgacaaggaaaaaaaaatgaagacttctctttttaattattactccctctacttttacaactattccaattatttcaaaacggttttttaaattatgaggaagatatatatatatgagtgtgtgtgtgtttcttcctatactgaaacagccaattataattatggtttcagatcactataagataaagacctatacaaaaagttggtgctaacaagttgacaacactcttaacacttttaagtgaagagatattaagaatgccaataattcaattatttacttataattgcataggcaaatgggttttaacactaaaaaaactgagtatcaggaagtatggattacaagattttttcttagcaataaaaacaaaagattagagggaataaatattaaagtcctcttccattaaaaaaaaatctaattcttttatttcactcttcaaaagacagtaaaaacgatgatccccaatttcttttggttcctactacatgacctattggttctcatcagggaactagtaagctgtttgtttaaagttatctagcactggtggggggttgtggggggcatagatgagatgattaaggctaaaacctcataacacgtctgtaacatttaaatccacttcaaaagattatagttcaagaaattatataaaaataattaaccaaattattcattaagaattgtaacacacaacttctacatacctggcctcataactacaagatgcaatttcagcccttgacaaaacagaatcaattccatttgcttgcgcagaatctggattctcccacaatgatgaatctggtatatctgctttaaaaataaaaaaaaattaatggttatatgttataaactgattttccctcactttttcaagaaatttgttttccattactttcatataaaaatgttcagtaaattccaaatacagttatctctattggtattatctccttatctaataaaagaaaactctaaaatggttcgcttccattatattcttcatcagcagataaaaacttataataaattcaaagtgtcctgggaggtttgttttttttttaaatacaccagaagataaatataaaatatcctataacacacagtccctggaggtggacatggatgagaagtgatcagggagatgaactccctcttataaccttaaaaggactgtacagctctcggtagtggggaaaagttaacgaaaaatataaatttctctgaatattctttgctgtttcctaaaagaactatctgtaaaacttaaagctaactaacgggtacaacaaacatgaaattcctaccatctatctgatcaaacaataatttagtaggtcacaaaacatgaagaggtttcatcctaaattcaagctttttcttttgtacacatgtcacattatcccccgctacaggtaattgtattttggtttaataatgcatgttcaattaaaaacattcaagtgtgatcagagtatcgatgctttagagaacacaactggagcctagtgtggcttaccaacatctcttaatatccaaaccaaatttacaactttacacaagaaaacaaaaccacacactctggagagcctactggctgcatgccactttacttcctttgccacctttagcttcactagtaattgagaaataaattaaaacacaacttcatcataggtctcttgggatactactattaggttccaggaagagtatgctgtaaaaaaaaaaatcacattctaaaaccacaacctcagccacatctctactattataaacaaaagtaccatgagtaaaacaaacccaaaatatatcacttcagctattccagacaaatctattttgagtgcactgtaacaacacataactaagaaacccagcatttctcttttgtttatttcagactcactgttctgtgaagtcagccacgttaatgcaccaccaggaaaactggcaaagtctctggcttcatgggcttaaacaactcttcctggtttgaccaataatcatcagcatctttcatctaactatgcaacccatacaagcatttctggatttcggcaaccatatatacacagcataaatgcaaatcaaactgactaacatctcgggtcaaatcctacttgcttcaaaacagcagagtgtgtaatgtgagctagtttctgacatatgaataacgtatgctagctatactattacaaattaaagacagaatcccaagcagattacccagtgtttctggagggttttaaaagggtaaatataaattttaatagtccattcatctaagctgaaaaactgtaagaatttcaggactgtcagtatcacacttcaacagagggtgctactagaccccaaaaaaaggagtgctgaagcttgaacagccacaaccaactgtctttccaaggtgtaaccatgagttatgccttacaagttggagaattacctgactttggtatctgaagggctagttatctaagatattgtcttgaaaataacagaaaacttatgcttgaggagagaacagtctctgtggtccatgcgcccccagtgccctggcctgagaggcagcaccatcgtgttcctctccattgggctggctgacctgttccacagtgcagcagagtgcgtgggtccctccacgagcggagtgagttgcttcatgtgagattcagggaaatgcagggacacactgtcctcactggagggcaaagtagagaactgctcatcaaaacttgacaaactagacgggcacatggagaatgtggaggaacggttggagaaatcagaggccaggacccaagtctgtgaaaaagaaatcgctgagaataaatctatgactaatacgatttttaaaactgttgttctttagaatgaaaactgaagttgtcgatgggatagaaaacatctgtatcctggaaatccaggaaggggtaaaaggccccaaccatgaaatttggagcataaattgttccaaacaatgagatcatcaatgagaagtgtgactactgagtactgctcaggaagcagcctccaaaagaagtcatggatggatgagataccctggttgcacggggctaattaaagagtttttggatacgacaactaagaaactaaagtttcaaaaaggactaaggatgctatttgtcctaatactttgtctagacatataagccaaacattagaactgatcttttttttttcaaagctagtgcacagaagccaaagattctaattcctaaaccgatcctcaatatttttatatttggtgccatgtctgataatgacccagagaaagaaagatcagggaataacaagcaaagaggaacaaaagcactgaaaaaagttctgagcacaagcttagttgtaatcaaactttataataaaggataatctattcattttatatgtagcaaatattctggtgagctcctaatacgtgaaaaggcttaggatataaaagtaaatgacatcaagttaaagtaagagtataaaatacaaactgtcatataatctttttctagtgacgggacaatctccttttgacaattttcaatggcaagtgaaatttaaatatttctcctaatattaccttctggtttaccacccacatttagatgtgaaggggatgtgattatagaaggtcattaaaatgttataaaaattaggtgactaaactgatgaagacaagtaaccaatgacagtactgtgttaataagccatttatagtaagattgtaacagaagaaaagacaaaagaggactagctctctgctactcctaaggaatgtgagcttgtcaaggttaaaattttaaatgtaggctgccgataaaaggacgtgtgtaacaagactacctaccagagagactctgagcactgaagatgctactgcaagtatatacatggtggtttttcttctttcagcattctttagtatttcataaatgcctaatatatgacaagtattgtgtacttccttaagctatttcttattttctagaacttaagatttcatctgtttaatagcacacagaaaatacaaaaagaaaaaccaacctaccacaaaaaccatactaccaatacctaagaaactacctataccataatacaagtaaatctcaacaagttcagtaacagctactccacatctactcatgacacacaaaattctagaatctcaaaaatctctgaaaagatttaaagaccaagaaaacctttataaaacttggaaataaatgtacacacaaagcataaatatgtatctgcaattatgttatttcatacttaagaccacataaacagatgatcaaaaccaacaaaaagactataatcccaaaaaaggtcctcagagatgttcgctggctttccttttgccttaatttcattggagtcattgtgacaagcccaacgttttataactgacaagggcactgaaataactgcaataaaactaaactgcatgctttccatttcactgtatatctaacttctgactactttctgggtaatatatttctgagaaactaattttaaaaattctctttggctttgcaaaacaaccatgagaaaactaatcagttaccaaaaaaaatttaatttctaagaaaacatttctcagtgaatttactcaggggaaaaaagcaatagacacatgaaaatcttaataagtattatgactagtacaacttatgattttgcttattaatatccaaaattaaaaagtcaagagaggcaacaaggttatttctcataacaggttcactaaagcatatggagaatgattactggtgtttacttttaattccaataaattaaaagttctactgtttgttattctacttcctcatacaaatcttgagcaagacaaactttaacattcttactgtgatacaataaccagtaattaactctcacaatagaaagaggcttctttaaattctgcccatgatttttatccccaatctaaatttatacaaagcaaatcaatcatatcttgtaaaacattcttcactctctacttcaggaaaatatcaccctccaattcaacaaaacctaacagtgacatccttaaaacccctgaatgaaaaagctaattgctacaactctgcactcatttctattaacaaccatgccaaatagcaaaatccagaagccatccacaggagcactaagacttcaaagagagctcatttgtacctgctttgcctttcaggattttattctggtaatactgccactccagctgggggttagcgccaggacgtaaaggtgcccttcctgtgcctctgttacttgtaacagccactggttttcctgtgaggaaaatattaaattatttctgtatgtggtacaggaatgttaacaacatgtaagcaaaaatttttcaaaggattttaaaaacatgccttttttttctttagctttacttagacattaatccttaaagaagctaatactttaaagattatcaatcaccatgtaaatgtcatttaagtttcttagcacctccagaaaagccaattatttgtgaccattttgatacatttattcaacctgaaagcagcagtcaactcagccttccatggtttttgtttgatttcgtactgtaggaaagaggcaactcaagagtctagattcagacttaagtagtggggaaagaaaaactaaatttttttttgtatttctagagttaacatctatacttatctctcaattttacgcaacagaaactaaatacatatgcataggaatcacaatctgacctaccacattatcaaacatgagcatacagcccctcaatttttgctttagtataaacttactttcctgtatcatttccttttgtatgcatgttaagttacaagattactataaatttgtaaagcaatagcagggataaatatatatttacttaatgcattattctgaggaccaagaaataaaatcaacaatgcattaaaaagctactctatgaaaatcaattatttaacattctaaaaactcctttcagagctgaggaactactacccatgacaaaaataaagtcctggttttaacacagcagcttctgtgccatagtgattccttatttaagggaagaattgattctcagaagaaaacactaagttatctctttcagacagaggtaaacactgaaaaacccagaatgtatgctttttaaaatactgactagttcacaaatatctgcaatttcactaagacaaagactgtccagacgacttaacacattttagcaatattcaataatgcaaaactatcctacaatcaaaaagttgggatgttcatgggcatcaggacagttaatcaagttatttgctcaagagaaagcatagtgacccaagtctcaaagacaagagccaccataaaatttccattcattaacaaggaataaatacagataaaaatttagaaaatgcccaatacagatcctgcctacattagtcttcgatgacatatccttcagctgaagatgaatattcttccctgaagatccctatagggagaaagaaaaactctaatttccctataccttccctgataatcgaatatagaaaatttggaagaaccgattttcccaaggaaaatcataattttttaaaaaaagattttgtaatctctttgaatatatatttataacaatatatcagttttcttaaaacataagcaagaatacagacctttgagatctggtctatttcgtatacccactgatacaaagaagcaatccatatcaacatgcattatacagctctgatgtctgggagaattcaatactgacatatctcctagaaggaaaaagacagcattcaaaccccaagctaatttttactatttaaaacatcaggtctagttaattttagaaattatatttaaaacatgcttacacccagaatggagtctttttaaaaaaccagaattgagtacagattatttctatcacctcaagagaagccaaatttaattaagtctctaattagtcaaaaagtgcatcttaaaattatttcactgtgctgattattttataaaaatacaaaggtgttggcatacatttagttacatgaagctaagtaaaactttttttgatgatcactattccatgcaatctacaaacgcgcctggataaaataacaacaataaaagtgactactattatccagtgcttggtaggtgtcaggcactgctgttaagaggtttatgtgtatgtatttatttaaattctcacaactatgaggtaggtaatcgtatcatctccatcttgtagactaaaagtttaagtcacatagcctattattaaatggttgagctgtgattctgtctcaagcagtctgatttcagagcctttaaactaccatgttgctgttctaagtacttaaaaacagtctataaaatgtaaatctgtacatttttatccttatgccattaaatactattaaagatcagagctgaatgacatataccacatttaaggagataaaggtgagtgtcctcacctaaggacaaaagcttctaatcatcctgagctacaaagagattcatcagggtcattttaaccctaatccaggcacaagcagagctttcctctattatcagtctcatccttagcctgttcgtctggtcctctaagatacacaaatcctggaaaaagaaccctgggcttgtaaaaagttctgatctcataaaggagtttttctcaggcttaaaaatattagtactgagggtcagtctttataataggcttccaaaaacagatatcccctaacagttttggaccactccatttaccaaactgtgactgtgatagcatgtacctaattctcccccaactttttttttgttttttttttttttttgagatagggtctcactctgctgcccagtctggagtgcagtggtgcgatctgcaacctcaacccctagggctcaaacaatcctcccgcctcagcctcccaagtagctgagaccgcaggtgcgtgccaccacgcccagctaattttttttttctttttggtagagacacggtctcactgtgttgcccaggttggtcttgcactcctgggctcaagcaatcctcccgcctcggcctccgaaagtgtgcgaattacaggcatgagccactgtgcccagcctgctcatgtattcttaagctcacaaccccatgaggcaaacatcatggactatctatcacttctattcacaaagaaaactaagactcggagaggtgaactaacttgcccatagtcctgcagcctaagagtggcagagtaaggatttagattcatgctaaactatctaactccaaagccagatacttccttactaccctctatattatctcaagaaatgattcataaaataatcttaatcacaattctgctgtataaaagtatttttcaaaatatcatataaacataatgcaaacaactcaaaataacgcttttaaacattcaagtagtacagaatgcataagccagtatctaccaaatgctttcatacaataacaaaatttctcattttattcccattcacagaactaattaatcatagttcttagaagcattaagaattaaataaccttcaggtaacaaggccaagacatgatgtaaggataatctagtatctatattattctgaaatatttcataaataccaaaaagcattttttgactaaaagcacataggaatacatcaaactcagtaaaacataacagaaaacaccccacatagagtctctatcactttctaggacagaaccatgagcttctctctatacctcagtttccacagctataaattatagagtattaatctctgaggtctctccccataaaaaaatcctataatctgtaaaaggaactaaaatttcaaaccagatactaatttataatgactggcccagaaaaacagtatgctactgtgtgtgcatttgtttttgatgacaagaaaagtattaaaaaacaaaatacaatgaaccaatgtacttaagatgtgaaataatctcactgaaagtttaccactgttaattacaacagctctatgtcaaaattaaaaaatcattatgatgcaagcttctagaaattaacaattactcttatcaaaccaatttcattcttacaggagtttaagcactggatagatgttatattaacacagttcaaaacttcaccaactgataaggtctacgtgaggaatgaatgctcagaatcccaaccatcttactgtttaaattctctgaaaattttcagtcagccacaattatatctaattgttttaaaaatattttaataaattagctttctatgttatgcttactgtaacttacatgatttgacatacttagagacttttatgagaacttcatattgaccagaaataccaataatagcataagagcaaaatgatcaagcatgactgtttcttaagaagacaattttaataagtatctacctgtgtcagttacaacaagtgcagacctgcctgttttcattttttttaacttttcccttcctggaaagataccattactttgtctttgtagggtattgacaaactcagtcaattcacacttccacattgatatgtgatgcagtcttgaatgagaatagaagtttgaaataaaattgcagtctgaaggtttggatggcactgaaggtgctgccttgctaaacgtagatactgaagaagtgctttttgtgcttgaaggcccctgaacagtggagtggtgagcaccattgattttagtgttactgtgcaaaggtgataatgagaaagaattagttctgtgtggattccgcaaagcatctgtgtttctggtgctttgctgcaactgctgcagagtgcagtctctgaaatcagtgctgctcttctcagccttatcctcctcctgggaaaaggctggagaaagcctgctggcaacactgttgaccatgggcaccaagcaatcctgtgtctttaaggcaccattagagctaggagtgtgtccattaaaaatggcagtgctccctctgggatgcggaattccattctgtttccttcccggagaggtctgctccagatccacaaaactaaaatcattattttcatcttcttcattccaactgttcatgccattgactttgacttcattttccgtttcaatcttcttaacgatgtgatttctaaagcaggaaaaaatttttgagttaataatatctgacttttaggttaaaacaattttttcatttcatcattttcttagtggtacacagtttggtatttccccctttaaaaacagaaaattcttatattgaatattgacaatgaaaaaaaaaaaccctgaaacttaaaccacaaactttatattctgatttgacaaaagatcattctttgcaaaagtagcaagataactagaaaaattctagaatattaacagccctttaggtgttttttgtttgttttttattttcacttcagatagtcccaaagaagaaataaaatagaacatttctcatggctgaagaaaaacccaaaaaacttttcagttatttttcccataaaaaattaattggaatctataagctgtaaatacccagttctgaagcacagtgcttggcatttactacatggtcaataaatatctgctgaattaatatactacaaataactttcataaaaatggatttaaaaaccttacttgaattcttattcctagttttagtttttatgaaaggtactattcaacacattaaatctaatacgaaaccagatggtttcagtaggaaaaaaactgactatattgattaacctattaatgagctaactgttgcacaaatagacaaaaagtaaagccatgtcaatgtgtgggggtaattcagtaaaatttacacctagaaaaataaggacgcttgccttactgagaagggaaattgcacttcatttctaagaaatgcatatttagatgccagggtggtacaaggcaatctggaccaagtttcctgatgacagctttataaatgcagaacccatgacaaatgttatgctaaagtcacatcctggctcctctagacgtttgtttagaaatgcattcacgagaatcatctaagtaacaaaaacaaaaacctgaattacaaagcagtaattcattctacttaggaatgtccaaatgtccatagcattaattcaattacagcgcaggctccagatgaagggctgccctacagagtagtaagccacaggtgaaattaccacagtattatcaggttccacctaaagcccctcaccctaataccaacttggtttattagtaatgagagcctgactacacagaaaagtcccacaagctggatgatcacccatttctgggttagctcaggctctggctaaacatcatatggaatgtgacaggcaactgtgagtagatgccatgctcacagatgatcatgccagtgatggggaaaaagacaaagtagatatgattaaaagaagaaaaaaagaaaacctaatttgtcacatgcagagaaagttcagcctcttgagataaacagaatgcaagggagcaagaagtcacagatgagcatttcaaagaaatgtacaaaatgtactgaatataccccccaaaaaaaccccagaaaacaacaaaagtgatgtacgtcagaaagtcttacatctagttttgtgtcaaaaacattcagaccctttacatgcattatagcaacacatgcaacagaaagccatatattggcaggaaaatacattgttaacatacattcttgctgtactatagtttctcagcctagacaaatggacatttgcaaagtagctgtactggaaatatcacgggtagagatacattttttaggcaatggcataaatgtattaagaagtaaaatctaaaaggtaatttcttcctaaagtgtcacaaagaagattttgaaaaaacatatctattttctacttttattaatgtgggtaagaaaagaaagctaaagctacgtattctgtgaaaaggttttctggtattatttgctatataccttgatagcacattaaaaaaaattaaaagctacaggtaacatgaaaaatatttgaatatgcttgtgagtacaagttaaattaacaaatgacaacaaaaattacagaaggcagtgatactggatcctctcagattaattagactcctggtgttttcgaaaaaaaatatatccaactcccaaagcaagcaatttaataaataaagagaaggctaaccataatgaaccacctgatatacaaggtaaggcaacccaccaattaattgtgaaacaatttatccagggttgcaattaaaagcttaaattaaaaaaaaaaagcagccacatggaatagtctagattcactttcaattctataaccaagggtcaccaactaaacttccatttatatatttacatatttagaatgttatgaattttgaatttttcaaaaataacccagaaatattaacattttcattgtctttctatgcatggaacacaacaaaaatatagctggtgcagttagttccatttttgagaaagcaatacagcaaattacttgtgaggaaataattactttcataaaaatccatgaaaaaacttattaacaattaagatccactagtttaaggtgagaaaccagtatgactgtaaaaacttacttacatttatgaaattatcattataaaaataattcatttttagataagacactcatacacacatatttcaacatgtttattataagtgaatggccagggtttgtatctgcttctgtctgactgtaacagagcaggggccatgctcactgctaaaaaccagctttgtggccaggcgtggtggctcatgcctgtaaccccagcactttgggaggccaaggaaggtagatcacaaggccaggagttcgagaccagcctggccaagatggtgaaaccccgtctctactaaaaatacaaaaattagccaggcgtggtggcacacgcctgtaagcctagctactcgggaggctgaggcaggagaatcacttgaacctgggaggcagaggttgcaatgagccgagatcataccattgcactccagcctcggcaacaagagcaaaactccatctcaaaaaaaaaaaaaaaaaaaaaaaaccaaccagctttgcagtaatccccaactagacaaacttacaccctgttgttgagctgtttggctatattgcttggacctggcagaggatcctcaggtctgcatacaggattaaagctgagacctttctgcacactggactgcttggtgtacagctgatatggaatgtaggagaggagtcgtccagctttgatgctgaaacaaaaagcaacaccaatttagagttccatacttggtgacaatgagcttcatgaaaaatattcaatgtccttaaagatacagtatttcaccaacaacaggtcatctgttttcctagtttattccttcttgctcggttttagtggtcctaatacaatatgatcttagagtggggaaaaactgcaagcacagagctgaactagtcaatattttaaacctcatgactttagtatttaccaccctgtcaacagttaacagagaatcatcaagacttcatcaaaatctcatctattaaggttttccaagataaataaactgaataaggatgctcaatttccaaattcatgtcagaaactgtaaaataaaaatataggacaaaataaagaatctcaacttcaagagtaataatttatactatttttatgtatacaagaatggttaagagccaaggccatttgaagatatgaactctacaagggccaaaactaccatgtacatcctcacagcatatcacacaacaccactcaaatccaggggaacaccagtgttctaacgctaggtggtactagcactgtaactgaagttcccaaatgtctgcttccttttgtacttcagaactaaaactaatttgattgcagtatctaaaactgacattttcttgctaataaactgagttatatatggctactctacctttaaaattatcatttcacttcaaatttaaaaataaccaatcaatatacttatgctatcatccaaatttcaaaacaagctactttaatattagaaaatatttcaaaacaacctctggattttaaacctaaaatatataccaaggaatcatccctcagttatttagaaaaagactgataaataacatgataaaaatatgtttcttattgtctcataaatccaagacttgacattttcattttcttaaatggtgtcacacaaaactttttaaaaaataatcatttaagaaatgactgaattggcttacagaatactaattaaaaataactgagtcaacaacttggaatacaggaaaacatactaacagattctaaaaacggaactatatatgatacagagtatgtcctttatataattatgtcaatatatatttaacaattctacctaaagtaccttaacctatatcaaatgctataactattaaattatgatggtaaagaacatactatactagtcgcaagacatgtaaccaaatggatttatgaccaggctaaatgttttaccaaaattcaggttacattcaaaatacattcaaaatttcaggttacattcaaatattagaatcgaaaccctaaaattcgactattttttactttattcttcctcaaaccaacttttcttccttttttttttttgagacggagtctcgctctgtcgcccaggctggagtgcagtggcgcgatctcggcttcacgccattctcctgcctcagcttcccgagtagctgggactacaggcgcctgccaccacgcccggctaattttttgtatttttttagtagagacggggtttcaccgtgttagccaggatggtctcgatctcctgacctcgtgatccacccgcctctgcctcccaaagtgctgggattacaggtgtgagccaccgcgcccagcccttttcttcctttaatagttggtctcaattgcctaactataaatctttgttctgtggtattatgtatatcaaactcacttgcttcccccaccaaaagaagtacagctacttaatacctgaaataaaatcctaaccttagctttccatcctttatcatagatagctataactaagagacaagtagagagtgaaactacacccactgtgccagctgcacatctcaggtaaaaccaaaagtgcaaggaacaaaacgccctatgatcattctcgcttttcctgccctactgacagcatgctggagtgatgcagactctacaggtactctctatggtcagcactgatcatatacaagggtgtcaggccttatccagctcctaacaagagccatgtggccacccacagaattcttaggcttacataagtcagtccatggagactgctacaaaattagacagccaatttaaatactgcaagtctcaaatcagatatcctcagagatactcaataaaaagaattaaagcccaatgcactacagtaatgttagtgaagtaatgtcagttataatttgaagcctaaaccactatctatcagttgtatactcctaactacccctgcttgcccatttatctatctatagatatatagacagaaacattatctgaaagcatatttgtataagacctttttaaaaatctctctgggattaatttctcacatttactatttcccctcttgttctaagcgcaaaggaactgtactgacattttctactattctttcaaaaccaaaaggagaggataataaaaaaatccatctttatccaaaagataatactacacggtttccttatacactgagttttttcatgtacattgaaactatattctgatatatacatgaaagagtttacattctatacaacgaatcaaaacatagtcatagcaagtgaaatattcatctattttgggaagtcttactcttgctttgtcctacagcctctgcgtttaggaacaaaaaaaaaaaacacaaggaatggcaaaaaaaactcatgagagataaaattgcaatcaacttttatttaaatgagttgcataagcactctaatatttaaacactgaatgtaattagaaaccaaagttttgactcatatgtaagcacatgacaaacgtatatggtttgggagtttagaaagaaaagataaactgaaagtcctactagtagatcccattgagctggcatgaaccagaacaataaattatcattctgtctcaactcccaacagatctatgtgaccatctaatcacgggatatacaaatataaaaaacccacgctacaaggttctcaatctacaaggatcaacacaaaatcaagaacaacaaaaacaagaacaatctgtagcaacttaggacaatatttttaaattatgctccatgacactcctcaggtttggtgggccagtggggtacgtcatagcagcttctcatctattccacatttcaaatttcaaggtaaaattgtctcaagacaaagactgtgacaaaaattttttaaaccattacttttaatacactatgtacaagtgtgagatttacaaaacaaaggttttagtaaaataatttcacactttaatgtacacaggctcctcatgaaaggattcccttgcctcttcaaagtcagggccctataaccatgcctacattaactcagatctactgacatacagacatcagggaactgaaattaaagcaacaccccacatacttacaagtggcagttccttttcaaactgctcgaataaaaacaaaaactaattattcagaagagtatgtaacgtttattaaatagctaatacatgttaaaatttttaagtataataaaatctcattaaaacacagctaagaagagatcaaccagggattagagtgtgaataaaaacagtgccatgatttaaccaaaaggattccctgttacaatgacataatggactcctggcatttaagatatatgccaacactgatccatttccacatgggccatctataacaagcttaattaaatggtaaaaagaggacacaaacaggattcagaacacctggactctaaaacctactctgttcttgggcaagtcagtgagccccactggccctgtctcctcaaatacaaaatgaggcccataggatatataatcatgctgtccaaaatcactcttaattatttaaagacaaatgattaaacctcagtccagactaagataaaatccattaaagtgaattttaactatctaagttgctttttctatcttatgatctccctaggcgcatctggcaaaaagaacacgtgcaaaacaagcaactgtaatggaaaatagcattttcttttctttttcttttttttgagacagtctcgctctaccacccaggctggagtgtactggcgtgatctcggctcactgcaacctccacctcccaggttcaagcaattctcctgcctcagcctcctgagtagctgggattacaggcacccaacaccatgcctggctaatttttgtatttttagtagagacaggctttcaccatattggccaggctggtcttgaactcctgacctcgtgatccacccaccttggcctcccaaagtggggggattacatgcatgagctatcgcacccggccggaaaacaccatttttctaagtaaatcaattccccccagcaagatcgctttcccctcaactctcctcctgtccacagaaattccccattccctccaaagcctaactattgcccccagataaaaactctagctctagtgacaacacagctcaactctgagtgatccaacttcatatactaagaccaagtcctttgaagagacacatacctaaaagccattttaatcaatactatatcattgatagacagtggttaggtcatgagaccacagtgcaaaggaaggaatcagtgggatgttatagggacgagcctttgactttatccctccaggtttaaaaaatccttaatatgtaaaatgttatttatttgacttttttttttttttagacagagtctcactttgtcgccaggctggagtgcagtggcgtgatctcagctcattgtaacctttgtctactgcaacctctgcctcccaggttcaagcgattctcctgcctcagcctcccgggtagctgggactacaggcgcgcgccaccacgcccagctaattttgtatttttagcagagacagggtttcaccaagttggccaggatgttctcgatctcttgacctcgtgatctgcctgccttggcctcccaaagtgctgggattacaggcgtgagccaccgcgcccagccaatatatttgactttctagagatagtaatgtacttttgaatttttggaattttctaataattgctaatgttacagaataaaaataaaatagtaacagtagcttcttatatattacacctctacaacatgctaggcactgcaccaggttgtatggacaaatgatttttatttctcacataaccacagcaggcagatattagccttctttcacaaatgaggaaacaaggtcctgagtgactgcataaagttttttttttttttctttttcctgagacggagtctttctctgttgcccaggctggtgcagtggcgccatctcagctcactggagcctcccatctcctgggttcacgcgattctcctgcctcagcctcccaagtaaccgggattacaggcacaagccaccactcccagctaattgtatttttagtacagacagggtttcaccatgttggccaagctggtctctgcccacctcggcctcccaaagtgctgggattacaggcatgagccaccatgcccggccaagcataaagtttctaaaattataccaggttatatggatactgaactgccgagtttggaagttctgaagccaagtatgtctccagagcccaggcccagccttttccaccacgctgcttctccgtgaatttatgcggctaaatacactatacaaaggaactgagttaatacttaatttgtggaacagttaatggagggtgttataattagtaaaagcaagaactagaaaaaaaattcagcaactgacttaaaaagataagcaatctctcatacactgattataatctatccatacataaaattactactttaatattttacttcttttataaatcagtaattgctcatatgtattacatacctcatgtcatttaaaaatataaaccacttaagttttagctcatctccaaggtttcagatgacatatttaaacttaggaagtcaatatgaatgtcaccactgatttacaacttatcatttccaaaccaacagcagagaaaccacaatataatcattaaaaaacagtaaataatactgcgactgtactccctcctttccccctactcctagcattctaggtccacattatcttgatgtattaccatgctaaaaacctatgtgatagacaacatggtataatgtactcatacattactcattctttctctcccaacagaatataaactccatgaggtagtgaagggatctttgctttgttcattgttatttcccaagaacacagaacactgcctagtctttaagaggtgcacacatatttgttgaataacacgcttgctccaccttctcccataactgcttcctgacactttcctgagtcatcacccctaattcctggcaaacacattaacatgctacttttattaggatgccaaatcctaggctatagtattatcaacatgagcttaaacggtagtgttgtttaagacattatttttcaccctgtcaatcaggaggcaatatattagttacaattttataaaagaaatagaaaggccatgcgcagtggttgtagtcccagcactttgggaggccaaggctggaggactgtttgagtttgagaccagtctcggcaacatggtgaaacccatctctacaaaaaatcagccaggtgtggtggcgcctgcctgtagtcccagctactctggaagctgagatgggagggctgcttgagcctgggaggttgaggctgcagtgagccatgatcatgccactgcactctagcctgggcgacaaagcgagaccctatctcaaaaaaataaataaataaaaagtattctaactttaaaaatttattaattaaatttaataaattaaacttacctttccacaatccattctggtcgaattactttttccccctttaattctttaattttggcattgggaagatttgtggcaataatatgtgttgttttagatctggaataatatacatggtattgacctccatgcaacatcattagttttctcaattcctcagcggaaggatctgcaaaatttatattaaaatatattaagagtcttatgtgtaagaagtagaaccctaatgaataactccttaaataggtcaactttaagaatgtcattggttcaccttctccttggctgtgttgccagtaaacaaagctgggaggtaaatcacaaagtgagaaagctatgttgcttttagtacatcccccttccctggctgccagacaaccaactaacacaaaaacatctaagaagtgcctagcagagcaaatagggacctcaagtaatgaatcaaatactaataacagtacaaatatttttacattttttactatacttagcatatgaccttgatattgtgtttttaaaaattaacaactataaacccatttatgaatcattttacaaagactaatccttccactcctccagagtatacaagaggagtcagataaataatagttactcatatttactaaaaaggagacttactgtagggcttattagtagattttacttctagaaagctttataatttttatttttatttaagaaaatatcttaaaacttaatcaaatagtaaatattatccagttccctaatatgaaatttcattaaggccaaaaaataaagtccagcaaaacaaaaaagactgcaaaccaagaaacaccaatttttttcaattttgtttcaaatgatttattcttaataaaactacagaaaatatcttatatgtcttaaatattggaaatattttaagaaaatatcttaaagacacaatgtgacttatgcttccccctaagaagaaatgtctgattcactaaagtcatattatggcctgcattactagcatcacattaatcatcactgttctctttctttcacctatcatcctaatgaatgctctaactcacacctcccctaacaacagctgtacccagggggagtttccacatgtggcttatcgcaagcttaatcccaagcaatataggtccaagtatttaaataaacattttcattatgacaataattaggtgagctttagtttctagaagataaaaaactaacagcacatacagacataccaggtttgtctaaattttacagcacaaaatttgacattactgattacaaatattagcactattcagtagaaaatattatgcaagccacataaataaaaattttctagtaaccttattaaaaacagtaaaaaggtgaaattaattttatttaacccaatatatccaaaatattatttcaacatgtaatcaacagaaaaaatctgagatatttactttcttttttcttcttaaatctctggaatccagtgggtattttacatttacaacgcatctcaatttagaatagccatatttcaagtgcttaacacatgttactagcagctaccaaactgggcagtgtcatacaaagagatttaaaagcatccttttaaacaaaatgaattcaaaattaataatggaagttttcagggttaaggttaagttaaaaactgaactacagcatcagagtgatttaatgtgaaacagtagaaattaaacagctagccagtcaggaatctacagttcagtttctttctctaacactaaagaacctggctgatcttatagaataacagtgagaagtatcaaattaaaggctacattacaatgcattaatatgggcaccaaatccaatgaaatcacagaaatctaaaaaattaatttgcaagttaatctgtaactttcctaaactaattctatttaatgacttaaatagaaaacggctgtcctttaccgaataaaaagacacgtcaagaacacattaactttccatatacatactcataaagtactcacccgtctactagctgctctttgaaaactaattactccagaaatttggaactggaaaatacattgcccttctactggatgaagttaagagggctctttgaagttcacttctgaaagctcttacatattcttcagtgtgaagtgaagcatgaaaaccaatctagttaaaaggcaagatcacataaactatggaataagaccgatctgagtttaatcttagctttcacactcctgagttgtgtgactttggagaagttgtttaacttctttaggctttctcctctttctccataaacaaagctgttacaatgaaattagtctggcatgtagaggtcactcaatatgaaaactgctattattataaactatgatcacactagaactcctttcgagtaatgtatatgacctcaggatcctgccctagactctacgaaaaaaaaaatgacagaagacaatatacataggctgacacatggtgacccaaagtttcaacaaaaacagacctgccaatagtgcactatggacagcagccagggaccactttgtcaggtccaacaggctggcatgctaactgttggcatgcatggtcgctggaagctaccctattttgaattttttttttttaatttttacagcagtattcctctctggttctatttcttcaatactagaacatactcccttattacaagtccaaaagaacatacacgataactgcagatttgcataataaattcatttttgtatttaacactctcctttaattcagcagatgtggggttaattagaaaaaaaattgggagccaagcacagtggctcacacctgtaattccagcactttgggaagccaaggtgggcagattgcttgagctcaggaattcaagaccagcctggacaacaaagtgagaccctgtctctacaaaatatggaaaaaaattaaccaggtgtggtggtgtgtgcctgcagtcccagctactagggagtctgaagtggataccttgagccagagaggcagagtttgtagtaagctgaggttgcaccactgcactccagcctggttgacagagccagagcctgtctaaaaaaaaaaaaaaaggaaaagaaaaaaaaagggggagataatatccaacatcatgaaagctatatgacattaaacattgtgtgacacactgcctacagaacccatctctgcaatgtactgtaacagttaactttctccatagcactgataatctgaaattaccatgtctgtttgtttacttgtttactgtcagattcccccctggaacatatgctctttgaaggcaggaaccttgtctgtcaagcactttcatatccctgacataaagcaggtgctcagtgagtatttgctaaattcattaacatcctcaatgcatcccagactcctgcctagaatccaccctccagcaaaagtggagtacaagtggtataaatacttaaaatctcaaaacacttattcactcactcacaaattagagacgccatataatgtattaagaggacagactccaaagcaggaatgactaaggtcaaatcctggctccatcatttgctagttacttggatttcaggcaagttatttaacttctcagaacctcagtttcctcacatgtaaactggggataataatagtgtctcaaaggacttctgtgggaattaagagctaaaaattataaattactgagaaaagtaacttgcatatagtaaaaattatgtggccaggtgcagtggctcacacctgtaatcccagcactctgggaggccaagggggagggatcacgagatcaagagatcgagaccatcctggccaacatggtgaaaccccgtctctactaaaaatacaaaaattagctgggcatggtggcacgtgcctgtagtcccagctactcaggaggctgaggcagcagaatcgcttgaacccaggaggtagaggttgcaatgagctgagattgtgccactgcactccagcctggcaacagagcaagactgtctcaaaaaaaaaaaaaagaattatgtgtcagctcttaacaatattatcagtattatttttaccatttcttaccccaaaccgggaagcaagaaggagctctagagctaaagctgctctctattcacacaaaacattaaattttgcaattcataatccctcctacaaatccttctcttgttgcccacccttcagtatatactccttcaagaatgtccttgatgtactagcaaagaataaacagaaaataaaaaatcaaaacaggccaggtatggcggctcacacctataatcctaacactgtgggaggccaaggcaggcggatcacaaggtcaggagttcgagaccagcctggccaacatgatgaaaccccgtccctactaaaaatacaaaaatcagctgggcatggtaacacgcgcctgtagtcccagctactcaggaggctgaggcaggagaatcccttgaacctgggaggcggaggttacagtgagccaagatcacgccactgcactccagcctgggtgacagagtaaggctctgtctcaaaaaaaaaaaaaaaaaaaaaaaatcaaaataaaacaaaactagattcagggaaattctatcctccaaatttttacaatcaatgtcactgttttgaaatgtcagagtgagtgcttttctcctcattgttctttgcctttttattttttatttagagacagggtctggctctgtcacccaggctagactgcaatggctctatcatagctcactgtaacctcaacctcctggttcatgcttgtaatttgaaagatttgggaggctgaggcaggaggatcatttgaggccatgagtttgagaccaacctaggcaacacagcaagatccgtcttttaaaaaaaatccacaaaaaaacaaaaacaaaaacaaacagaaaaggctgggcacggtgggtcacacctgtaatcccagcactttggtaggccacagcgggtggatcctctgaggtcaggagttcaagaccaagtctgaccaacatggagaaaccccgtcactactaaaaatacaaaattatctggatgtggtggcatgcgcctgtaactccagctacttgggaggctgaggcaggagaaccactggaacccaggtggcagaggttgcagtgagccaagatcccgccattgcactccagcctgggcaacaagagtgaaactccagctcaaaaaaaaaaaaaaaaaaaaaaaaaaaaaaaaaaaaaaaaacccaaaaattacgtgtggtggcacacacctctagtcccagctactcaggaggctgaggcaggaagatccgttgagctcaggagtttggggctgcagtgagctatgatcagtctactgcactctagcctgggcaacagagcttatcttaaataaacaaataaataaaattccacaatactcctactattagttttattttgcagaacattctatatgcaactaaatttgaggtttaactaaaaccagacatagtgacagacaattgaaagcacagtaaaagtaaaagccatatacaaggaccacaatttagcccacgtttagacctaaagccctacaagtaaaatgtcacaagagcaaatgccaccatataacatcaaaacagccatatgaagaccactttcacgtctgtaggcccagcttatagaaagttttgctcatctggttaaaacaaattctataaacaaaatttttaaatcttgcacaaaagctttcctagctagatctctattgagaaaacatttactatatgcaccatttcctcctgcatatccaaagaacttaattaattgttgactgtgctatataaatcacagaaagaagtgaggtgaatggctgcttatacctcctttgctcctaccatggcaacatcttcattatttcatttgagtttcacaatcttatgaattagaaaagataacttattgatgaggcaacagagaaaacttactgtgcatacccttctgtctttggactcctgtccctcagtttctgcagcagcaatactactctcttgactcttctcacccctaactacctcagacttaccaacagagtcaccacaatcaactaaaagccacggatacactcaaccaaacaaaaactgaagaaaagtttcaaatgcttagggaacaaatttttgagtaccaactaggtgcaaatttcacatcaggtactagcaaaattacaggaggtggcataaattaatatggtaagtcttctatgtcagaggttcaattcctccatctcttatctacaagatgagagtctcacaggaaatggaaggagagatattatatatccatacaaaataatatctgggaggcatttatttccaaaaaattagacttgtcaacactaaagagaatcctctcctaaaacaccacatttgtatgtttagaaaacatcaatgtaagctgtcagctttcaaacaaatccttatttgaaatataagtctgttacacttgcatattcccccttgtttcattttgtgaattgtgctaaagtacttgtccgggcccccctccacctgctttttcacaaacttcagcagtgccaaaatcaaaagacctggtcttttacccatgtactaaaggaagtagaaaataacctgaacacctctttccatatgaactgtcccaatctcacaccactaaagtgcaaccactgtccactaagtctgaagcactcactccccctgggcagctttcacaaaaataaacatgcccagagcctacctcccagattacaatgcaggcctcaaatgtggcccattccttaagactgagttgatttagcatctgagtgaaaatattttaacattctgatgtacaaatacaaaacctgttatttatttattcattcaactaatacttattgagtatctacaatgtgccaggcaaggttctaggcactggagatatggcaatgaacaagactcaagtctgtgccccgtgatagcacttgtattccactgaggagacaaaaataagtcatgcaagtaataccattttaggtgcaaataaatgaagaggaaggtggataaggggttagagagcgactggagggcaaagtacacctgttttagataggtgaagtcagggaaggtctccgtaaaaaggtaacatttgagcagagatctgaatgatgaagacctgaggaagcagaaggaactgcaaatttaaggccctgaggtgttatctctaatccatgtttggcaagggattactatacataaaacaggcttcctaacgccaaagaacttaatatagaattaagacctaacaacacaagacaaaatccaggtgtcaaaataaatgtttctagcaataatgctatgaattatatatctctctatataaaatactactactatggactggcttagacagggaaggaggcaaaacctaactatatctggatcttaatgaatgaatatacttccagttcacagaagtgaggagggaaggagtttttcctcagaggcaaaagaacaaacagaaacacagaactgtaaaagtaaaaagacaaatctagaatatcagggtaatcttgttgagcaaaatttaagaacatgaggttgaaaatgtaggtcagaattaggactagaatgtctttctccattttcatttggaaaatgcctatttatctaagaccaagctaaacatttcgattcctttatgaagtattcactcccactcccaaaggcaattgtttcctcttctgtgttggcactcaccctcctctgttgatgtctaaggcttagagattactttttcatcacaaaatccacattctccatcaactgctatctcttttcaaacatagttcctaacccacaagcagcatccaaaatatatctgttcaatcaactaaagaaaaataaaatgggatataaggtctgtaaactagaaaactcaacatagtaaagatgtcaattctccccgaactgatctacaggtttaatgtaattcctatcaaaatcccagcaaggtattttgtggataaatgacttattttaacatttatataggtcaggtgcactggctcacacctgtaatcccagcactctgggaggccgaggcaggcaaatcacctgaggtcaggagttcgagaccagcctggccaacatggcgaaaccccatctctactaaaaacacacaaaaaatgagctgggcatcatggcatgtgcctgtaatcccagctactcgggtagctgaggtacaagaatcgcttgagccagggaggcagagggtgcggtaagctgagatcataccactgtactccagcctgggtgacaaagtgagaccctgtctcaagaaaaaaaaaaaaaagagagagagaggcgtaggtcctagaatagccagaattatcttgacaaagaagaaacaagtgaaagcaatcactctacctgatatcaaggcttaccacataggtacagtatttgatatagtgtggtactggtgaaggaacagacacaaacatcaatggaagagaacagagaacccagaaacagatccaccaaaatatgcctaactgactgtgttgcaacaactggaaatccacaaataaaaaaaaaaaattgtaaaacctcaaaatgaaacattaacttcaatgtaaaacataaaactataaaatctaaaaatatagaagaaaacatttgggatctagcaccaaagtgacaagttcttagacttgcaagcacaatccataaaaggaaagatcaacatatcagatctcatcaaaattaaaaacgttctgcaaaagaccatttcaagaggatgaaaaactacagactgggagaaaatacctgcaaaccacttttatgacaaagcagtagtctctagaatatataatgaaatatcaaaactaaacagtaaaaaatactaaatccaattagaaaatgaggaaaaaaatatgaacaaatgtttcaccaatgatgatgtaaagataagaaataaacacatgaaagaatgttcaacattattagccacgaggcaaatgcaaattaaaatcacaaagagatacaacaccatctattaaaatggataaaatgaaaaccactgaatgctggcaaggatgcaaagaaagttgatccctcatacaaggctagtgggagtataaaatactacaaccactttgggtaacagtttggcagtttcttacaaaaactaaagatgtaactattacgggaaccaacaactgtactcttcttatactcatacaaaaactcatacacaaatgttcatagcctaccaagaaataactgtgatgtccctaacagatgaaaggttaacaaactggtacatccacactatgaaatataactgaacaataaaaaggcaacaattttgatgacctgacagataatttatgctcagtgaaaaaagccagccccaaaaggttatatgctgtatgttttatttatataacattcttgaaatgacaaaattataaaaatggagaccagattagtggttgccaggagttaaggaaaggcggagaacagaagtgggtgtgactatgaaagagtaacatgaaagatctttgtagtgtggaggccgggcgcggtggctcacacctgtaatcccagcactttgggaggccaaggtgggcagatcacgaggtcaggagatcaagaccatactggctaacacggtgaaaccccgtctctactaaaaatacaaaaaattagccaggcgtggtggtggccacctgtagtcccagctactcgggaggctgaggcaggagaatggtgtgaacccgggaggcagagcttgcagtgagccgagatcgcgccactgcactccagcctgggtgacagagtgagactctgtctcaaaaaaaaaaaaagaaagatctttgtagtgtggaaatgttctgtatattaactgtatcagtatcaatttcccagttgtgacactgtttgcaagtttattacatattaccatttggggaaactgggtaaagggttcacagtatcactatgtgctatgtcttacaactgcatgtgaatctacaattatctaaaaaaaaattaatttaaaaaatggataggccagccatggtggcccatacatgtaatctccacactttgggaggctgaggcagaagaatcgcttgagcctaggagtttcagatcagcctgggaaacacagcaagaccttgtctctacaaaaaattaaaaaatcagctggacatggtggtacacacttgaggtcctagctacttgggagcctgaggagagaggatggcttgaacctgggatgttgaagctgcagtgagccgtgatagtgccactgcactacagcctgggtgacagagggagaccctatctcaaaacaaagaaacaaacaaaacaaacaaaaaggatagaaggcaaagaagtcaatcttaacaagcaaaaaacatttttggggccaggtgaagggaagaataggttgacaggtgaactattagagggtcttccctccaagttcaagttcaatgttaactgggttggaaggtatagggactacgaaatcatgagaggctcaaatggctgaactgggagctttaaaggaatcaagaacacttggattattacagtttgtggggagcatggttaagaatcaacaagaagggacaccacagcttcttttacagtgaaaactgcatctcccaggtttgcaaactgttcactggaatgaagtctctttcctccaaattccttttcagagaactttctattttctttttttcactctatcgccaggctggagtgcagtggcgcaatctcggctcacttcaacctccgcctcccgggttcaagtgattctcctgcctcagcctcccgagtagctgggactacaggcgcacgtcaccacgcccagctaatttttgtatttttagtagagacagggtttcaccatgttggccaggatggtctcgatctcttgaccttgtgatctgcccgcctcggcctcccaaagtgctgggattgcaggcgtgagccaccgtgcctggcctgaaaactttctttcacaatagcaatgagcaaaactgacaaagtctgcacctttggtgcttacatgctaatggagaagaaagatgataccaaaatatatatataggcattttacaaaatagctgaccagtactcctcaagactgtgaaataaagcttatttttttaaatcaaaaacaaaatagcacctcctacttgtcttattacatctaaagagttatttttacttgctaattgttaatgctgttttatctataaagtggtaaagtattcactaaaacttaatttttctaaaaataaagttattttacagcaccacagtttggatatctcggtgaaattcagcataatggaactttatttgtacagttataatgaaatcttaataacaagagcaaaaatattatcatctctatcctgcagaaaaggatagagataataacagatctaaacagaaaatgttttacagtcacacaaaaattagtgataaaagcagatttagaattccagattctcaatcaaaaagtgattactgcaatattcatttttcttccctcacacaaagaatctctttttcttcctcctatgtgaataagggtgctctcttgaactggagacttccatgactggctaatgtaagaagcaatgcctgttttcattaacgttttaatttttcatagagcatctcaggaagtccacagagcttgaatttgtcaggataccttcctacacagaaaagttacaagctttctgcatgtgaacttcccaatgctgcaccagcatttattttgagatgacattcttggactaaattcatcatcaatgatgcctaataaaacacttaattacaagcaacacactcttctcttactaaaccagataaatgtaccagttaattaatacttaactccaattcaacaaatatgtcctgaatgattgtgtccagtcactgtagaggcactaaggatatagtgatgaaaatgtagctccagctcttgtccagtaaacagacaactatggaaaggtctgaagaattctaagatgcagattcattcagggagccatagctccagaagagcacaagaagtcacctaaatcagtatgaagacagtcaaactatcaagggaaagcgaggcatggagacctgaaagatagcaggtatcagccagctgagaaggggacaggggaatatgtaacagactgacacaaatatttacagccattcacttcaaaaaatacaatgaaatgataagaagaagaatccccaagaaaatagagaaaaatttaggcagaaaacctggtaactaacaggcaagtgctaactgactttacagttcagcgaaagataaaactgaagctggccatatggaagcttggaaagaagctgcttgttaccagtaaaacaaagagaaagtcatgaaataaacacacaggcaccttcaaaagtggatgtgtggataaattcatccttgaaactgtgcaacaggcaaagaagcatttgcacatttctttcctttcaccaagaataaagactacactaccccttccagataccggactcaatgacaataggcacagctggtggggaggaggtaggaatgagaaaatgaatagagagactaagtgaaattttacttcctaaactgtgagaattcaggtcctttccttccctgcttggcgacccaaatgctggcagtttacactcttctacagacaagagagtaaaagattcttctctaggaaatctgacactgacacacacccacacaccaccccaccctaaaggacctatggacaatgacatctagagatttaccaatgaaatggacctacagtgaagctcacagtttacaagtcctactacccatgtgtggtaatttcccgtttttcattttaaacctcacgtgactttttgaaactatgtactttgataaaagttaaagacaatggcaggtaaaagcaacatggaaaggaaaaagaagtatctaagcagatgatttatttcttctcatcttacaatcatttgtctataataaatgagtaaaaatagaattttaaaacaaatcattctcaatcctaataaaaatacatgccaaaatagggttaagtaaaaagtactcaacctgtgtatccattaacatagatggcaactccactaaaaattgtagatgaagtcccatccttctgcatagcagcatctgatcgaaactgttcctccaatttctggaccttggcagccatatacccaccctagaattaaagaaaaggtaaaccaatcacaaaggttacattttctccccccttttttgaaaaaaaaaaattttaaaaactaaataaataaatggaccttattctgtgctagtgaccagaacataatgatgacctcataaacataaaccataaggcaaggcaataaataaaacaggaaagttgggccgggcgcagtggctcacacctgtaatcccagcactttgggaagctgaggcaggcggatcacctgagatcaggagtttgagaccagcttggccaacatggtgaaaccccgtctctactaaaaatacaaaaattagccgggtgcagtgccaagtgcctgtaatcccagctactcgggaggctgaggcaggagaattgcctgaacccaggaggtggaggttgcagtgaggtgagatggcgccactgcactccagcctgggtgacagagcaagactccatctcaaaaaaaaattataataaataaatataaatacataaaacacataggtcaaagaagaattttccctctatcaactcaagttttaattttattacattcttatgattataaaagttacttttaaaaaaagctaagtcaataataataatactggctgggcacagtggctcacacctgtgatcccagcattttgggaggctgaggtgggcagatcacctgaggtcaggagttcgagatcagcctgaccaacatggtgaaacctcgtctctactaaaaatacaaaatcagctgggtgtggtggtgcatgcctgtaatcccagttactcaggaggctgaggcaggagaatcgcttgaacccagaaggtggaggttgcaaacgagctgagatcgtgctattgcaccccagcctggacaacaagagcaaaactgcatatcaaaacatagtaataatatcacaaaatattgttcttatgtacacaattgagcaagctacaccaaagtttaaaccaattacaaatttgacaagtggtctcagagcatattttattttatttttttgacagggtcttgctgttgtcgcccaggctggagtgcagtggcacgatctcagctcactgcaaactccgcctcccaggttcaagcaattctcctgcctcagttcccaagtagctgggattataggtgctcaccactatgcccagctaatttttgtatttttaatagagacgggatttcaccatgttggccaggatggtttccaactcctgacctcaggtgatccacctgcctgagcctcccaaagtgctgggattacaggtgtgagccaccacgcccaacctcagagcatattttagactggcttccactatctcccacatacagagggcttaaaatgaattatttcaggtaaaaatgaggcaactggataaaccagtgtagtcctccctacacatgggaaagaatacaatgaatgctccagtggctaaattctggatctaatcaatctatttgatagtaatattaactttcattagataacattcacctcacaataaatattaaaaaataattttttttgctaaacatcttgacagatctagggattcaactatacttttcctgaactttgatataattaagcttgatttcaattattaggtctttaaattaaaggtgtaggtggctagaagtacatgatgtttttttcccaaaatggaaatgactgcattatttttgctgattattaaaatattatatgctcactatgaagtttcttttcagaaaatacaggaaatatggggaagaaaattaaaactggtataatcctattcattaaaactttggggtgttgttttcaaagcttatttccataactcagagcacagaggttttacaaacatataatcatacaaaatatttctttgtaacacattgttttagtcaaggttatccttccaggttgagatatataaagctgaataatgactgtacagtgctccactatacacagataacttatttgaccaatcccttattattggatatttatgtgttttcctgtttttctgtattattagcaatgctgcaataaaatcatcatatagtaaattattgtgcactaggcatatttatttcctcagggtaaaattcctgagagtaaagtttaggggataaagtttataaacatcataaggctttcaatacactgtgaaaactcaaagatgtggtgtctaaagtaatttacaatttagaaaacaacttaaaccacattataacagaagaatgaaaaataactagacagttcgatataattatttttactcttttaaaacacacccatgtttcccagccatcattttcagctcgcttcctccatccacctcgcctcatggtggagcttctgtattggggaggaaaaaaaaaatgtcaattttataacataatgtatttctaaatgatattttatttcaatatcaagaaaatgagaaattaaattcaaatgtccaactgatgaaagtatacaatattaagtaaactttttctgaagttctccattctccagctttacaagtgaaatttgtctataaaacaccctcctacacatgtttaaattgtaactcttatatttaaaattcaatagaaaaatatctttatgcattcctgagcaccaatcctaacattcacttacataaaacaccaaatccaactaacatggccatgcttactttacttgttaccattatataagacaatctaacaaaacatttcccttcatgagttgtcctatagtgtggcttttaaactctgtctttgctattacatactggacacttaagagttcagtcatagcctgattcacatattctgccaaagccctagaagaagtcaattaaaaatgatgcagaaaagattatcattgataataaactataatagtaaatctgtcattctccttaaggcaacacttacttaactaactatactataaaaccaccaggatgaccaaatgatggctcacattaagtggcagctggctcagtggctagcaaaatatataattcataaaaagaggctaaatgaaaccccttgtaaagtcaaagccttttaacacaaacagctacattttgggctatgactacatttattcttaacaaaattaatatgacttctattaagataattttcttctagtaactatatacatgtgtatcaaatggttaccatatgaagccttatatattatccacgtcaaatcagctctgatatgatctatgagaattttttacttaacaacaccttaaaccatgacactttaccccacacacattagcagataatttctttctttctttttatttatttattattttttttgagacggagtctcgctctgttgcccaggctggagtgcagtggcgcaatctcggctcactgcaagctccgcctcccgggttcacaccattctcctgcctcagactcccgagtagctgggactacaggtgcccgccaccacgcccgattattatttttcttttttttgtatttttagtagagacggcgtttcaccatgtgagccaggatggtctccatctcctgacctcgtgatccgccggcctctgcctcccaaagtgctgggattacaggcgtaagccaccgtgcccggcctcttttttttgagacaaagtcttgctctgtcacccaggctgaagtgcagtggcacgatctcggctcacaaccacctccgcctcccgggttcaagtgattctcctgcctcagcctcctgagtagctgggattacaggcacctgccaccatgcctggctatttttgtatttttagtagagatggggtttcaccatgttggccaggctggtcttgaacctctgacctcaggtgatctgcccgcctatgcctcccaaagtgctaggattacaggcatgagccaccatgcctggccagcagatattttcttatgaatatttttattcttagtatactgcaggatttggtttttgtttgttgacatttataacaatttgaatttttactgtcacccttaaaagatgcctaaaagacatgcagaagtgttgtcaaaaggttaagtcccaacagagagacaagataatacaaacgttttaggggcatgtgcaaggtgctccgagaaaaggtggtaaactgattaaccctgaggagagatttcttttttaagtctgatgaaggcaggaggagcatgaatacccaatgtgctcattatcaagtcccagaagtaccacatgctctgttaaatatttctcctgttttcaagaggctcattttgtccagtcccaacagacttcagcccttaaaggaaatctgggagatacattaacacacagcactggactacatgtaaactgaatccatacacctgctggaacaagtaaagagtttgggagttctggccattatacactaaaaacacataccccgataattaaaggcagctattaaactgttaaataaaggtaaataaaggagtaaagtgtattttaatacatttggtggcccaatcatttaagagatccagttgtgtaacgtctgttgtatacctactgcacaaggccaataagaaaattccttaatgatggtttaatgaggctagaagcatgaaacacagttataatacaaaaacaaaaattaaaaaaaaaaacagctattaagggttctttcccccaactccaaagtaacaaaactattccagacaaatgtttaaaactttaaaaggaaaaggaaagaatgaaggactgaaaattttagcttcgtcatttccaataacttgactcatgaacaacaaactcctattgatccagaaatcaaacaatcaaaaattactagccaacattccaaagaggacaaaaatcttcagagatctgccaccccacctctcttccccaaaccagattatttttccctctgagaacatttggcaatcctagaagagtggctgggagactgggcaaagtttctgacaaacagtgctaggagagaaaaagtagagtccaagggtcttccaaggataaagattgccgcaattgctatcagaaccctatgagtaacaagaaattggaagtagacagaccaaactttgcagaaactgtattcattatttcaatctctgaaaacagattaaggtgatcgtgggccaggcgtggtggctcacccctgtaatcccagcactttgggaggccgaggtgggtggatcacctgaagtcaggagttggagaccagtctggccaacatggtgaaatcccatgtctattaaaaatacaaaagattgctgggcacgatggctcacgcctataatcccagcactttgggaggccgaggtggacagatcacgtgaggcggggagtttgagaccagcctgaccaacatggagaaaccctgtctctactaaaaataaaaaattagccgggcatggtggcgcatgcctgtaatcccagctactcggaaggctgaggcaggagaatcgcttgaacccgggaggcggaggttgcggtgagccgagattgcaccattggactccagcctgggcaacaagagcgaaactccatctcaaaaaaaaaaaaaagaaagaaagaaaaattagccaggcatgggggctgtttctgctaatcagcagggatcttcgaaaaagagactccgccaatgcctctgtaataacatccagggaaaagttctccacactaagatgactgatttgcttctttaaataggactttccctagaacggaggagggcatttaatcaggataccactacttgacagaaatatccttcagaaataacacactccctctgtttttatcctgttccaagcaacctcctgaattacaatgtgtcctcttgactaaacctactcactaagaagtgactgccctgtattgacaaaccatccaattatcaagctagacttgtaaacaaaaattgccttctagttttcagaggaactcttgcagaccaggctcccaatttaattccacataacttgatgaccttgaggaatgtgataacagtttctgaaactgtgattcacaacctaaaataacctgccaatctctccttatccagtaactttaacagggcagccaattactgtgtttcaaaaaattagtttaaaaaacggatgaagagtgaatacatgaatgcaaaagtacccttacccttaacatttagggtacaccttcaataaacattaactactgttatagtaatctactctgccagtctacagagtgaaaatcgagtgagactacacacgtggaaaccctttgaaaactataacacagagaacatcattattttaagtcagttatccatggtctacaacataatgataacagtagactagatacggactcaaatcccaattctacgactgcctaacaatgtgattcagagtgagtctaacagcactgagcctaacatttcttcatctataaaacaaagttcgactgcagaatctttgtggggccatgactggatgaagggtggatatggtggggagaagaaaaaagttgggggtaaaaacagcaagcaagcaaggttccagtctctaagcccaccttcaattttagcagccatgctttttttcccccgtaagttttaggtttagggtctgaacaagattgttcttgaagaaaaagcacgacaacttgaaaaagactgataactaagagtaatgaactaaaaactaagtacaaaatttcttggttcttttctgtttccatgtgactctgtaagacagtcacatgtggaaatctcccaaccctcgaaaggttcacaagctaaaactcacctaccagctaaaactcaagtaatcaaattataaagaccaactgaattacaggctgtcaatacagccatgtccagtccccagtgctaacatgcagtaacaactagccaggtgaggtaaggttaaggcaaatgggagagcagctctgtctatgaggagcccagggatcctgaatgcctacacaagacttcctctttccattctctcaatagggatgttcaaaactctatcaagagtctcatcaaggacatgcttatttaaaaatataacaagactacttatgcatgcatttttcctaatgttttatcttttgctggaacacactactatcagttcattctaaactttattctgctttctttttactatagttattggtagattttactatctaccccgagaattatgtttatcaccaggaacattcattttcatgtaaaaatgatatttcctagcactctggggggccgaggcgggcagatcacgaggtcaggagatcgagaccatactggctaaaacggtgaaaccccgtctctactaaaaatacaaaaaattagccgggcatggtggcggtcacctgtagtcccagctacgtgggaggctgaggcaggagaatggcgtgaacccgggaggtggagcttgcagtgagccgagattgcaccactgcactccagcctgggcaacagagcaagactccatctcaaaaaaaaaaaaaagatatttcatctatttacaaaataattactagcattacaaggttctaaacagttcatcacacactagaaaaacttccactacatatccacaaaatgttcaaatgttcagtgttaatctgatggttacatatctgtaactctaaagtctgttgattaactaatgaaattcattttgagtggcttttaatcagtctttattaatacagtcatatataaatgtatacatttgtaaaaagcaaagtagaggttcctcttcagactctcctccccgtgtaattaggaataaatagtaacttctcttagaagcaaaatttattcaaagacctgtgctaacattcttaaacatctgctagccgtaataaagaaatcaatgtactttatgttcttagctcccacaatttagcctaaatatttgccccggcaagcttatactggtccaagcaagcgttaggtcatagcctgttcctcttccttatttgaaggtgtttttacctttctctacattccacaagttacttcctccttcctttgttctcctctgcctttgcctcttttaaaacaagattggctaagttgctagccaatcagaacaaatacagaatgtgaggtcctgttccagccaatggaaaccgggcatagcagcagggtggacgcatcaggttataaatgacccggtctcctttgttcggtgtactctcatggcaaaactgctggcgagtgtaccctttctgcagaaagtataaaaatggccttgctgaggaaattaaatttatgttcaagtgctacttctttacagcaccagggaacaagcattccaaagaggtttatcctatctttatgtaatagttatctaagaaatatttactgaatgtagttacaaattgacatgcaaagaatatgcaatgaatgaatgtgcacattatagtagcataacataattcatgaatatgacacaaatgcaaagaaagcagcctgtggccaccccttatctaggcaaggttgaaacacaatttgcctttggtgccctgccatatctctactcaacacctctctgttttcagtgcctctttatcttacttagctgtcaattctctgctaaggcatttattgacaactaaggaactggttaataaagggcttaaggtatgatccaacccagggtcatctgtgtttaaaagaacctcttcatgaccattcaatgaggaaaggacaatcttttcaacaaatggtgataggaaaactggatatcacatgcaaaagaagttggacctttacaccatgttaaaaaaaaacttaaagtgtacaaaagacataaatataagagctaaaactatcaaactcttgggagaaaacataaaagcttcatgacactggattttgcaatgactttttggggaaaatgtaacagaaaaaaacagataaactggactacataaaaatttaaaacttctgtgaatcacagggcaaaaaagggttaaaaggcaatccacagaatgggagaaaatatctgcaaatcatatctgataaggggttcatacacttaccaatataaagaactcctaccataaactgtaataataaacacacaacgccactaagaaataaaaaaaggatctgaacagacacttctctaaagaagatagacaaatggccaataagcacacaaaaaaacgttcagtgtcattaatcactatggaaatgcaaatagaaaccacaatgagataccacctcacacccagcaggatagctactattaaaaaaaaaaaaaaaaaaaaaacaagtgttgataaggataggaagaaattgggcccccgagccctgttggtgggaatataaaatggtgcagctgatatgagaaacagtatggcagttactcaaaaaatctgaaatagaattatcatgtaattccacttgtgagtatatatccaaaggcactgaaacctgagacacaaagaggtatttatttgtacattcatattaataagcattattcacaatagccaaaaggtggaagcaacccaagtgtccatccacagatgaatgggtaaacaaaatgtggtatatacatacaacgaaatactattcagccttaaaaggaaggaaattccaaagcgtgctacaacttgcatgaaccttgaaggcattatggtaagtgaaataaaccattcacaaaaagacaaatactgtatgattctacctatatgaagtatttaaagtagttaaattcagagacagaaagcagaatggtggttgcgggtggagttactgtttaacaggtagagtctcaggcaaggtgaagagttctggagatggatagtggtgatggttgcacaacaatgtgaatgtacttaatgtgactgaacagttaaaatggtaaacttttatatgtatcgtaccacaattaagaagaaaagagttttttaaaaaagtagttctgaagctggaaacactgtataggcacctgcaagctgcagtggacaggatcttcaggtggggtgcaaagctgggaaaaaggctacttcaagaaatctgtacagcagtacctgggtgttttgtttgttttttactttgaattggcagtagtgggaggccatttgtagaatttacaagaaccaggtattgcctttatgagtgactaagtacataaagtgctagcacgcatgccctaaaaaaagtttggtaacagtctgctccaatgtgctcttattctgtcctttaatggtaaaagttttaacagcacaaacagctttttatgtaacatttagatataaaaatacagctgtttgtgggttttgttttgattcaaccttacagaccatcattgtctacggctacagttttcaaacaattgctgaagttgtacgggcactacagacatgcacatcccacaaactagtcaggttttgatcttgaagggactctcaccaaggtatataaaacaaaacaaaaggccgggcctggtggctcatgcctgtaatcccagtactttgggaggctgaggtgggcagatcatttgaggtcaggagtttgagaccagcttgaccaatgtgatgaaaccctgtctccaaaaatccaaaaaaaatattagctgggagtggtggcgcatgcctgtagtcccagctactcaggaggctgaggcaggagagtcacttgaacccaggaggcagaggttgcagtgagccaagatcgtgccactgcactccagcctgggcgacagagcgagactgtctcaaaaaaaaaaaaaagaaaagaaaagaaaagaaaaaagaaaaaaattcagacacctaggtgaagggcacaatttcccagaagtacaagtactggctctggaaacctctacttgcttttagcgactgattctaaaccaagccaacagttcacattctaagcatagtgctgcgtgtctttcatgtatttaagatatcttttaaaaatatacaagtctaagatatttagatcaggctttattcctaacctaataaaacccatttttgccactttatgtgttttttttacaccttcagcatactgaaacattttcctgttgctaattttttctgctgcaataaaacaatttctgtaccagatgagatactatcttgataaacacagaattcaaagaacttcaatctatcaaagtggcacacagcactctccacagaaaaaattacaggttttggtacataagccttttcttgaagtaagtatgatctttccatcttttcttgggacattctctattattccttcatcactgacttgtgtttatacactgctttgtaatgctaagtacagtatgcaatcctgctaggtgttccttttcaaaaatagtttttcttgctctatttataaaagcaattcgtgtttattgcagaaaattggaaaatacagaaaacagaaaaggaaagaattacccaaattcctaccacctaaaaaaattcacctattaactgacactttatatttccttccttttagtgttcctttaatttttaacattcaaatttaatttatttacatttcacattactagtaatacctttcacttctgaagtatccttagttttccaagacccctttacatctaccatttatctttacaactcatccatagagtgagtcagccaagtcctatttattttgcacacaatagttgacttctagggtagagaagctaaaaagttctgtaaggctgcactgctggcttgtggtacaaaatcatactcatcttctacaaaattatgttcccaaatcttcaatggaaaaaataataatggtatcaatatgaactgctaaaaagttaagaatactcctattgatctgaagtaacctaacacaattcaacaaaacagatgcttcttcaccaggtaatctagcaacagtctggatcataatagagccatatatgtaacaaaactaaggaagaaaacaggtcctacaattaagctccatctagaccccaactagtccatattgataagcagaagtcgggagcgatggctcacgcctgtaattccagcactttgggaggctgaggcaggcgaatcacatgagatcagaagtttgagaccagcctgaccaacatggtgaaaccctgtctctattaaaaagaaaaaaatcagccgagcatggtagcaggaacctgtaatcccagctacttgggggactgaggcacgacaatcacttgaacgcggtaggcagaggttgcaatgagccgagattgtgccactacactccagcctgggcaacagagtgagactccgtttcaaaaaagaaaaaaaaaaaagaagtagagattcaaagacagcatcaactttgttgctaaccggttctctgaacttaagcaagtcataatcagtcatattttagttcctccgtatgtggaaagagttggacctgtttgaaatgcttgttccccggtgccataaagaaacagcacttgaacataaatttaatttatttagtaaggccatttttatttcctgcagaaaaggtacactcgccagcagttttgccatgagagtacaaggaacaaaggagacagggtcatttataacctgatgcgtccatcatactgctgtgtctggtttccattggctggaacgggacctcacattctgtatttgttccgattggctagcaacttagaactttttaaaagaggcaaaggtggaggagaacaaaggaaggaggaagtaacttgtggaatgctgagaaggataaaaacacttttaaataaggaagagaacaggatatgacctaatgcttgcttggaccagtataagcatgccagggcaaatatttaggagcacaggtctttgaataaattttgcttctaagagaagttactatttatttctaatcagatggggaggaaagtctttgaagaggtacatctacttttactttttacagacctgacaaattctagagtcttttgcaattttttaaatgtacatgattctgcgcttgaacccaggaggcagagattgcagtgagccgagattgagccactgtactacagcttgggtgacaaagcaacactctgtctcaaaaaaaaaataaataggccaggcacagtggctcacgcctgtactcccagcactttgggaggccgaggtgggtggataacaaggtcaggagttcaagaccagcctggtcaacatggtaaaaccccatctctactaaaaaatacaaaaattagtcaggcgtggtggtgggagcctataatcccagctactccggaggctgaggcagagaactgcttgaacctaagaggcggaggttgcagcaagctgagatcatgccactgcactccagcctgggtgacagagtgagacttcgtctcaaaaaaataaataaatgaaaataaacaaatgtgtatgattctacacatctagttttaaaaacgctttcaacaaacacatacatattatgcaactttacgtaactttttctatgcttgccaaaaaacaacaagatgtacctatccacagatgtggctgtgcagtaagaatcctaacccaaacagatgtttggcctttgcccttggttcctgggaggtaatcctttcttttcccccccttcacatggtccaagatgagactgggaggtaacctctaagcccttagaacgtccaccttatgggagcagtgactcacgcctgtaatcccaacactttaggaggctgaggcgggcagatcacaaggttaggagttcgagaccagcctggccaacatggtgaaaccccatctctattaaaaatacaaaaattagccgggcatggtggcacacgccggtaatcccagctactcaggaagctgaggcaggagaattgcttgaacccgggaggcggaggttgcagtgagcccagattgcgccattgcactccaggctgggtgacagagcaagaatctgtcaataataataataataataataataatgtccaccctgttaagtgcttttgtttacctgggggctttgagccactccagatagttttgcactgtgatttaaggtgaagggctttgagccatgtattatcaacctcctgaagggctgaaaactaaaggtcaaccatgccaacagtcaatcatatctaagtgaccaagtcccagtacaaatgctggacaccaaggcttgggtgagcttccctgataggcaatctccatgagtagtgtcacacatcagtgccagaagttggcaccgtccataacttcgctggcagaggataactggaagtttcgtaagtggactcttctgtgtgccccatgcacctcttcccttggctgattttattctgtatcttttcactgtaataaatccaaccataagtaaaagccctttcaggagttctttgaacccttctagccaattatttaacctaaggatggtgtggatccccaaacttgcagttgatctcataagtgagggtggtcttgggaccccaactccacgatggcaaaacggcactgtcctccagtattcattcttctttcttacttttagtaatggaacacctctcccgcccctcttagcaggaggcagagtgggcaaccagagactacatttcccacgctcctctcaaaatcgggggtggccatgtgactaagttctggccaaggaggtatgagcagagtgatgtgtacaaaaatatgaaccatattcctaaagaaagctgtttacttctttttctgggatgcagttgtgaggtaacccagcttcaaccatgggaataaggacaataccctatggaagggctaagcacacagagaactgtggaacccctaaaacactgaggtgctcacctactacggactgcctatctacctctggactattacaggagaaagaaaaacttaaaaattgtttgttccattgtattctgaagtccctgttacagcagcttagcctgtaccctaatgcataagtacatctgagcattttaatatgattttgattcaatatctatataaattaaaaatagacaaacaataagatgtactgtataaaaaatatttggatatattaaacctgaaaatgtataacaaacatttgtatgtcccagtttgaggctgatctgattaaaaggaaagcgtctatcccaaacaattcaatacaacaaagagttttctcttattcttcttgttattcataactaccaaaaaaagatgcttgatttaacaaaatcaatagttaatacaaactgaagggggcttcctgaaacaacgactaatgcttttcttcccttcaattacagatttccatagaaagggaaagaagtagagacactgttttaataaagtacctaggaggctaggcacagtggctcacacctgtaatcccaagactttgggaggccaaggcaggtggatcacctaaggtcaggagttcgagaccagcctggccaaaatggcaaaatcccatctttataaaaatacaaaaattagccgagcgtggtggtgcacacctgtaggtagtcccagctactcgggaggctgaggcaggaggatcacttaaacccgggaggcagaggttgtagtgaaactgagatcacaccactgcactggccaacactgagactctgtctcaaaaaaataaaaaatagaaagtaccaaagagaactgccttctctagttttccagagtgcggccaaatcacccactttccaaacaccttcccctcaattttcctgctttcctgtgttccaaaccacatggcccaattgcatttattaagcatctccactaggatgttctacacatctcaaagtcagcatgtccataagcaggatcaagctacgaaggaacacaaaagaatgttctagagatgacatgataaaaattaagagtctagaggaaggaggaagaagccactgatcttcactaaggagaagtggtataatctcacaggaaagccaaatgattatctgtagaaaagttcaaggttgcaataaatcagggattccaaaggccacagcagaagagctagtaacaggaagaacagaacttagctgaagaataaaggaaataatatcaaagaagagggaaatatatctaaagcagtaattctcacacgtgagcatgcatcagaatcactagcacagggcctgttaaaacacaagatgctgggccccaactccaacgtttctgattcagtgagtctagggcagggctggaaatttgcatttccagctggactgcggcacacactttgagaaccactggttttgcctgtacctaaaaatgtatctatagtggtgataatagagaaaaggacagttcagtggtaacgagaaaggttatatacagtagagagaatgatgctacaacgtgtcctaagtagaatgaatttcacatcaggagtaatgcaattcaccaggtgaaggttttaattagattgcaggcgacaggctgggcacagttgctcatacctgtaatcccagcactttaggagaccgaggtgggcggatcacgaggtcaggagatcgagaccacactggccaacatggtgaaatcccgtctctactaaaaataaaaaaattagccaggtgtggtggcactcccctgtagtcccagctacttgggggctgaggcagaagaactgcttgaaccagggagtcagaggctgcagtcagccgagattaggctactgcactccagcctgggtgacagagcgagactctgtctcaaaaaaaaaaaaaaaaaacaaaaagattacaggcaacaaaatctcgcctgtcctgccccccacttccccttaccccaaattccaggtctgagctaatggtttttctccattcacttagaatttactataatctatagttttcaaggtgagtaaaatgagaataaaccacaatccaaggttatcagagatttgcatataactataatatgagatctgtaatcccagcatttttggaggccaaggtgggaagatctcttgcgtgagaccagcctgagcaacacagcaagacctcatctctacaaaaaaaataaaaataataaaaagagccaggcatggtggcacacacctgtagtcaggaggctgaggtgggaggatcgcttgagcctggaaggtcaaggctgcagtgaaccactgcacttggcctgggagacagaacaagaccaaaaaagtaaaaataataataataataataataatacaagatcctgcattataggcactaatggaatgcaataaatgcacagagaaaacagccataaatctcatgttcgagaagacacccaagaaagcatcactgagaggtagatctgaactaagaacaatcagtaggattttacaggatagaaggtaggatagaaggtaggtgggaaggggtgacatgaaggcaaagatttcaggaagaagaaaaattcataattaaaaacataaaagggccgagtgcagtggctcacacctgtatctcagcactttgcggggttacggcaggaggactgctcaagcccaggaattcgagatcagcctgggcaatgaagtgagacccttgtctccacaaaaaatttgtttttaattagccagtcatggtggtgcacgcccatggccacagctacttgggagagtgggatgggagaactgcttgagcctgggaggttaagactgtagtgagccatcatcacgtcactgcactcaggcctagactatagagcaagactctgcctcataaaaaatacaaaaagatgtttaggacaacattctagaacttaccagtatgtaggaacatggccagatgtagaggtagacaaactaaggtaggtggagaaatataacagaaggccttgaatatatcatactaagaagtttaaaccttactttgtaagttttaagcaagtgtaaattgggtgggagagtttctggctcctgagcctagcctacaccataacgtataaatcttagcagaagtcctcaccttgtgcattccacccacacaagtcattagatctctgaactcacaaggtaactggcataaacaatgacacataactaaaaacaaatccctcagagcaactgcaattcaaaaatatagtcaaactctttttttctggacctgctatcagttccagcattcacaaatcccttttctcacaaatgcttctattaaatgtaattccaaataaacataaaggaagcagaagttgtcactgcttctggaattttcccttgcttacaccaagaatatatttaaaattatatacttttaaaaaaacaaaaacattacaacatgctacattcttcaagacaccagaagtcttattcaatgtaacaatttagcacactataatctctgaggaacagtgagttccaagataattcaatataatcttcaagtgacaatctgaaataagattaggcataaataatatgcaaaagaatattaacctccaacacagtaaacttgaagtgttagtaactttgactcaagtgctaaaattcaaaacagcaattaagttactgaaacattttacaaccctaacacaaatagattatcaatgcctccaccctacccataaatatctcacttcataatttcttcttccaaataactaatgaataattacgtacatctaaaagtacaaattcaagaccaataccaaaattcagattttttacagccaattattaagctttaaagtatcaagtatacagtttataacccaagctacaaaatttatgtaattaaaacatttaactcaagtgaataacccaagttttaaattatattgtatcaataaaaaaaatgttatgtagtaattctcaacagaaggcaatccttctatccatattcaaatgcaacctgttccaatttttaatacaacagaggtaactgggttactatcactactactagttttagctgtcataaattgagcaagtgtctgttctcacttctttagccagcattgtgtaataaagaatttggggcccaggcacagtggcacatgcctgtataccagcactctgggaggccaaggcaggaggatcacttgaggccaggagtctgaaaccagcctgggcaacatggggagatccctacacacacacacacacaaaaatttaaattagccaggtgcggtggtgtgtgcctgtagtcctagctactggggaggctgaggcaggaggatcactttggcctgaaagctggaggctacagtgagctatgatagcaccactgtgacacagtgagaccccgtccctaaaaaaacaaaaacaaaaaaatttgactggccattgtctgattcctggaaaactctactcttggagtctcccaactgataggagtgtctttgttatccatgaatccataatgggtcctccttggcccacagctgagtttctattaacagggtgactcccagtaggcccctagtttcaggatggggcctggccatgctggaaatgccaaccatgtgaatagtgggttgggctttgagcaacctgacatcagcctaacaacttgacctccagggagaaggggactggggactgagttcaatcatacctatgtaataaaagtcccataaaaactccagatgctgtagagtaagtgaggtttcctggctggcaatcattcactgctgtactggaaggatgacacgtcctgaggacatggaagcttcatgtttgggaccctcccagatcttgttctatgtgtctctttaattggctggtcctgatttgtatcataactgtaattccaagaacagcactttcctgaggtctgcgagtcattctaccaaattatcaaacgtgaggtgtagtgggaactccgaaagttgtagccagttggtcagagtgtggataacctgcaagtcctggagtttgtagctaatataagaagtgaggagagtcttgcagactgtacccttaacttacgatgccttacctaactctgggtagcaggtgcccaaattacactacagctataaaataggatatgctgccttacttctcttcccaggactcttaagagaattaaatgagaaaaaagttaggtaaaagcactctttaagatataaaacgttgtgtttgcttcggctgcacatacactaaaattggaatgacacagagaagattatcatgagaaaaaattctgtattaaaaaatttacactttgggaggccgaggcaggcgggatcacctgaggtcaggagttcgagaccagcctggccaacatggtgaaaccccgtctctactaaaaatacaaaacccagctgggcgtggtggcaggtgcctgtaatctcaaccacttgggaggctgaggcaggacaatcgcttgaacctgggaggaggaggttgcagtgaaccaagatcatgccatagcactccagcctgggcgacaagggcaaaactccgtttcaaaaaaaaaaaaaaaaattttttttttgttacggtctttaagatattgaagaagaaattgttaaaacatttgtaaagttcagaactgtccaggttaaatgctttaaaaaaaaaggcttaaaataaaaagctaaggagtcatcaagaaattgaatttattatgagtaaaatacagaacttaatgaaaaccatttaaaagagcaaaaaatctaagtagtttcaactacataactcagaccagtgcctaaaagataaaaatgcattaagtccattcctagaaatagcaaatgtagaaatgatggagcttagagaatgtaagatgcagccattattttgtgactaaacctccaaaaagttcattttagccttgggtatgatcaggaatgactgaggtcagtaagcaacactttgcttaataggctatgagtttgaatacgaactactcacatcacaaccaactttttttgcccatcactacctaatattttaattcaagcacaaagccatgggacccgactagtctttaaaaggtttctcaaagcatcctatgtggataaggcagtctcctgcctatatgagaaagtatcattttcaactgcattataatagaggacaaaatttttttctattatgttccaatgataaaatcaagactttaaatcgtaattttacaagaacatatcgttttattttccaccctcttgaatatgagatactaagtgttgctggtctttccctcagtaatgcagggaacagtttggtgtagcagggggaaaaaatggccttggggggaaaacctagggtctcatcttatttctcctctttagcaggcaaatgactcttggggtctcactttcctccagtaagatataatggcattgcctctggagtctgtaagattcttcctacccctgacattctgaggtgttgagaagccaataactcataatttagatattcttacaaattaaaaaagccttgcaaggaaatgtcagaaaccattaaaatttatgtaaaaacatcccacctatgtgttcctccttattgaaggagatccaggtaaagatctcctatgtaggctattatccttagcaaactaacacacgaacagaacaccaaacaccacatgttctcacttgcaagtggcagccaaatgatgagaactcatgaacgcaaagaagggagcaatagacactgagtctacttaagcgtggagggtgggaggagggaaacgagcagaaaaagtaactattgtgtatcaggcttaatacctgagtgatgaaacaatctgtacaacaaacccccatgacactagtttatctatataacaaacattcatatgtaccccagaacctaagatagaagtttaaaaaaaaaattgccccatagtcagcaggaaacacatcactagtaacttttactaaatatttacttgctacctccaatttagccctgagcaaacttaagacatttatgttttcttaaatctaatgtattatatgcaaaaccttttcaaactatttacaaagctgaagcaccaagacacatgattctttgacttatttttaatgacttttaaatatgagaaaaacattaattacgatgcaagtcatcatcctattaaaacatttcacttataatacaagcatttaagtatagtagtagtagttaaatctaaaaaaaaaacaaaaaattagccataaataatgatgaagctgccagtagttaacaacacacactcacaaataatgagataaatttaacggcaagcttccaaacaaaaaccttgtcattttaaggtgtcccacagcagaccggttatgacctcgggaactggcctgaaatcttgcctcctttcttgtgtaaccagccaaataacaacacctctctaaatctgtttctttataatggtgccaaccttatacggtagctgtagatattaattaagacactgcacctaggaaagagcctagcacacagtaaataataactcacaattattaaattttggaagaaatgttacacaaagcagcagccctttgacttttaaaaaaaaatttacacctagggtttaggatcctattacttgttaaagttcagactgagaaatgaaataacaatcctacaaagaagcattttactaaggacaagtgaatttaaaataactggtattatgcaagttcaattaccacaggcagaatcttagtttatgagaataattcaagttgtattagctgaaaatatctattattacaaagtcactgtctccatcaattctttcttctcttatttctgtatctgctaaagaaaaataaatcattatgaaaagaacagaaagatacagagcacagctgggttactttaagttccaattaataaccaaatataatctgaggggaaaaacccagtgaaagaagggagaaactgaacacaactaaagatgataaaaatttccttcccaaatactacaagactcatatttcaactggatcttcaaggactttcctgtctgaagacacgaagcctccagcaagtcctttcatcaccacaatcagatctccagctgaacttcaaagggaactctataaaagccactctggtgggcggttgttgagataatcactcttagcatcttctacagattgaaaaataaaaaacctgacttacacattaagaccaaacaccagtcaccattctcaacagtttattttttaatttgctctagacatccacaaaatgtattttttaaaggcgttccataaatacaattttggtggctaacaaaaattcagcaccaaagtaataaatataaaatttagccagacacagtggctcacacttgtaatcccaccattttgggaggatgaggcaggaggatgaggcaggagactgtagcccaagagtttgagaccagcctgggcaaaacagtaggaccccatctttacaaaacattaaaagactagccaggcatggtggcacatgcctgtagtgcaggctactcgagcgcctgaggcgggaggctggcttgagcccaggaggttgaggctgcagtgagccgtgatcacaccactgcattccagcttgggcaacagagcaagaccctgtctcaaaaaatgttaaaaaagaaaaaaattcaattaacccacctttatctcatgccaaaatacaaaatcctaagtgaacaagctaatttcaaatagttcctagaaggtttaaaatttccctgttctgggctgggaccagtggctcacgcctgtaatcccagcactttgggaggctgaggcgggcggatcacgaggtcaggagaccgacaccatcctggataacacggtgaaaccccgtctctactaaaaatacaaaaaattagccgggcgtggtggcaggtgcctgcagtcccagctactcgggaggctgaggcaggagaatggcgtgaacccaggaggtggagcttgcagtgagccaagatggtgccactgcactccagtgtgggcgacagagcgagactccatctcaaaaaaaaaaaaaattaccctgttctaagcactttacatacattaactcaattattactcaccataatcctgtgaggtaggtattattacagtcatcctacagatgagcagaactgaggcaccaccaagttattaacttgcccacagtctcaatcagtaaatggtgggagccagagaattctgaccctagctgtctgattccagagccaatatttaaatcaactatactattcatttactcaacaagttttactgacagcctactatgtaccaggcacagttctaagcactggggataaagctgtgtacaagtcagacaagacctctgctcgcttgttgagaacagggctggcagcaaacaagtctaaggggggaaataaataagtgggaaaaaaaaaacagtgtatcttcacctagtaataaatgctatggagaaaaagagaataaagaataaaagattataaaggaaggggctggttcctattttagaattagaaaaggcctgaggcgatgacatttgagcagaaacacaagacaagacatgaagagccttgaccacttagaggaaggggtggtccagctaaaagaatagtaagtataacatcctaaggaagaaacactttgttcaagaaccggcaaaatgactatgggactggggtaggttgctgaaagtcagtcacctagtaagaggtaacgttagaagctggcagctgccaaatcatgctatgccctgatggcgactaagattcaaatgtaagtggttcacaggatgcttttagaggacactaagcaagaaagtgacaatctgatttacatttttaaaaagatccctctggttgtcaaggtgaatccctagggaacagtcagggagcaagagaaataaaccagtaaaggcactatggaaacactccaaccaagagataatggaacttagactaggattcatgtactgtttataagtagatgctaacagaagagcctgcaacctaattgcctctaaagagcctttttaatatcccttttcccgtctcgtctcctgacttgcctttggaaaaaaataagattattttttaatgtccatgttaacgcttcagttggtgctattatagtaaaaaaaaacttttcatttttaaatgttctgtttaatatactctatgattagtaatacgccacatatacacacccatacattcttgaaaagcagaaagacccacaatgctctttagtgtaggacttgttcatttatttggagacgagaggtacctgtcacctcttctgattacctttcctctcacgctttgtctctagcacatcctggctcattctagattgtgaactgcaataaacaggtataccaaagggaatatgtatttactgagcacctcctgagtaccatggtgtcactagatgtctcacgtttaagaactgatttaatcctcagctacccaaggtgggaaatggtatcttcattctacaaacgagaaaaaatcagagatactagtaacttaacttgtccagtcaccagctaacaatttgtagggccagaaatctaacctccatgtaactgtgaacttcctgtctttccactacagcagctatcaaagaaagtgctttcaaatatatattatatgtagtcactgcaacttcttatgaataatgaccagtttgttgctggtgaggacaacgtttccttaatgctcttatgtagaatcagagttttgaagttgcgagtgggaagttggaaatgtagtgatcttatatattcaagcacattattttttaaaaattatgttctacttgagacctcatagaaattaattttaaaagagcaattcccatctttacaaaaaaaattaaatatgtacggtttaccgtaaaatagcggttaaggttctacaacaaaagataggagtttggtacagactctaccctcaaaaggtcctacacagtaagagaagacagggctaaaaagataaacgcaacacaggaaaaggcgcaaatagcctaagaattgaatggaagagagccttgtatactggagaatgattcctggaagaggaactttaggtgagctcttaagtgtccagtacaggaaggcagggaacaatacgcagcactggtccctgcacgggcaaacccaagaatatgtgtgaaaggttggtggacagatagatggttcccacaggctgatttgctacatacagaactccatagaaagaaccaaggttatggttggtcctaccctacctaaacaggaaatggcttattctcggagactaaagtgccaagtccggaaagaccagacagatacacagaattacagactgttacataaagtccttaatagttacaagcccttgttgtgctatgtgctagtctgcattattttcacctaaatgaaaccatttctacttagtacatggcgtgagaagacgtggagataaagagaattagcagacgtatattatctgcaatttatcttacggaggagtacattaaggagtgttatgtgagattatttctttacaaactgagaataggtaggaagagcagcgaaacacagcgcggctcggtgcgcccagagcggcgtcactgtaacagtacagaagtgggcaaggggctctcggaaggacagttggggaacggcgcccagcgtatttagcgaacggacaagcagcaaggaaaaacaagggagcaacaaccgccttcggacattccgaccggttctgggatgcaccggggacgtcgaaggcggggtgcggaaaaacgctgtggctggagtgcgggtgggagcggcggctcgaccgggtcgacattctacaaacgcttgtggaacgaacgcccgaacgcgcgcgtgaatgaatggcgcggaactgaatggccggccgaggcgccggcgcaggaggaaggagtttgcggcgcggtctgaccgggccggcgggatgcggccgggcgcggagggaagggccgctgcgccaggggtcggcgcggggcggcccatggggctggcggcggcgcggggccggccgcgccatgacggaagggaaggggaggggaggtcacacattacataacccggcggctgcgagcgtcaggggaaggcgccgtggacagcccaggccgcgacaggacggccgcgggccggggccggggcgacgcacccctcccccgcgccacctcaggccgaccgcgctctggccgctgccgggcgggtctgcggcgcctccgggcgacgcgtgtccgatcccgcccctcccccaccccgccgccggcccgggggtcgctcaccttccgcgttgccccagaccaccatgcccgggcccggcggccttctccggccttgcggaccccggccccgccgccgccagtgccctcgccagggaccagggaggagggccgggggaaggcagccccaccgctgagcagcgccgcggtccacgctcccccacgctcgcggcaaccaaccccgcgcgcgctccgcggtggctct

SEQ ID NO: 2148 - DNA, 89544 bp, Homo sapiens; identical to SEQ ID NO: 2147

SEQ ID NO: 2149 - DNA, 19586 bp, Homo sapiens
cggtcagctgagttcgccggcccagggcaggcggggcccgagcctagcggtaacccccgggcagggcggggccgctcgcagactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtggtgagtcgcccgcggcccggctcccgccgttctctcttcccaggggtctagcccgtcccctgccttggccacgtgcccatttacctgtaggggcggtgacggaggctctggtgcaccttggctgtgagctgcagaggagcagagagcggcccggcgcggctgcgcggggaggcgggcgcgcggccgggaggttctggggctggtgtgtgcggagcgaggtgggcgtgggggaagcgcgcgggcgggatgtgcttcctcgggtccaccccgtgcctacctctcccacgtcccggcgacggagcgcgcggggctctgggcggggagcccaccgggccgaggcgcagcgagggtgaagccagagccggcagggtcaggtcccgcagggcgcaggcgggcgcttctcgcagcccaaacccgggcggggagtgcgggaacccctagaactatgctgggagccccagataagaggaaggagatggtgacttaagtgacgaagtgatgttttgtccccaccgccttttaaagggagaagggggtaaaatttcatttggaggatgattgttacgcgagctttcagagttcagatggcgtcaagtggccatcgagtcaacatttaacaaaatgttaccgcataaaatattgtcatcgagttatctggcagctccgcagagaaacttcacaggcatatgcgttatatgacataatttgcatggggaagggggtcccttcacgattcttttatatggcaacctgttcttggacctggcagggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacggtcagtttcaaagaaacacagtctgggatccggagtagaaagaggccgtttcccgtgaaggccatagaggcagtttccaggcgcctgggtgacctgtctctgcacttccctctctgcttctccatccctgtttcctttccccactgtcccctgcctggcctttctttggctcattttctgccttcctggggtcttctggttaaaaagaccattggttccattcattggctgtaaccgcgggtctttaaaaaactttgtgacttccttgaatagaaagaatgtcttactctggatttctacaagcgctgctgagccattcccagggcaggcctttgtctctcccgcctttcagtttgtttgcccatctgcattttggcccaagctttccccatttctcagctgctcttacattatttcttttttcagaggctaccctgaccttctagtcctctgcattaaacctcatcaccgcagaccgttttaattcagcacaggtgtatcgagcacaaattatattcttggttccaatactttcagcactggtgggcattcatgtttcatttaagaaggataaattagtgtttctttacatgggctttttgtcaaagtggaattttgttgactttactgatcttaaaattaacgcaaacttattgtaaaaacaaacaaacaaaaaaacccaaaaaccaaaaatcaaatatataacagaaaatgaaacttctaggttttcctcttccctaaagataaacaacaaacattcttcttccttctcctctctctctcacacacatttgcttttgaaatatgttcattcaaaaaagtattttaaatgtttacaagctaagttatttatgcaagtaacttaccaatctgatttgagtttaacgggttaaaactaaaaaaaaaaatcaaaaacatcttcagtttttttttttttttaagtaagatggatctggctggtaataggtagagagccccaggtgatcaccgaaaagactcttccttggggagccaaatcctaagccaggtttaggatttccctgggaggtagaatttgcagcccaggtaaaaccagcaaaactctcctgttatgtggggaggggagcgaagagcatggctttctagagaggtgagagaagacttgttgagaaactgaatttcatttccttacggaagttggagaacattgtggtacaatgttaggagaaaggttttctaaaatcagtgcagtctgacatcttcaacaccagggtcttttccactggagcactgcagacatctgcaactttctctgcctacgtgggtgtggttaaatagaccctccctgagtgcagggctgaaaagtggagagaagttagttcttgggacactcacacccaggaggggggatcctgcaggtactaagattgcaaagggaaagagagagtgaggctggtcctggagcccactaggaaggagccagcggaaagcagtgactggacaagggaactgatttctctgctgatgtggccttggtttctctggttcagagtaaagaaaagcaaccaaacctagagagaaacatccttactctacaaggccagacgggaagttctgtctttggcttggtttccttttctacaaacggggttggattctctctggagagctttccgggggccactcagcagtctctgattcagtgggatgttctcagctgctggcccaagggagctcacctcttagctcttcccctgcctggttcactggggggctgctccctcccattagctccctacccctaaagacaaaaatagcagcctggagggggcagagttttaggggaggttgtaagagggcacattcttcagaggagccactcttacgggggaatgttcctgccccacagaaactggccctggggatcaggactctgcctgaccctaaaccctacttcttccctcagtcggtaggtctgcttaatggatcctgaagaaggcctgaaatcatgaccagacccctacgccccgggatcctcctgtagtgccttttgataagaagcactgccctggcttctctctcctccttccacatgtgtagggagaggtagctctgcctattcatgaagcttcatccctacactgtccttcatttggcccctggtgaaccgggggccaaggtgtgatacctcttttaaaactcattcccttcacactggtgttgtgactcatgcctgtaattccagctacttggaggctgaggtgggaggatcacgtgagcccagtaatttgaggcggcagtgagctgtgattgcaccactccactccagcctgggtaacagagtgagaccctgtttgtttcttttttttttttttttgagacagagtcttgctctttcacccaggctggagtgcagtggcatgatctcgactcactacaaccttcatctcctgggttccagcgattctcctgcctcagcctcccgagtagctgggattccaggcatgcgccaccacacccagctacttttttgcatttttagtagagatggagtttcaccatgttggccaggctggtcttgaactcctgacctcaagtgatctggcctcctcggcctcccaaagtgctgagattaggggcgtgggccactgtgcatggccccctgtttctaaaaaaatgaagaataaagtgttgaattaaaaaaaaaatcaacaacaccacaccttattccccttcttagctctccttagctggactgcagtaggctgggatttccaaagaagtgttgtgtaaatgctaagggagaatgaaagcctggtggagagatttaaggcagcaattggagggaacatttttctccacacctaacaactgtagttttccctggcattcaaaatttgctggaaatgatcactatattatggtaataataaatcccattctccaaaaagggaccttttgggttttagcttggtgacaagagactgctgagttacgaaggtgagaaccgtgtggtggaaacaactggcttgacctcaggaaagcagcttcacttcacagactcctactgatgtctttatgagccttggatcatcctgtagacccagtgcttcactctcttcctctcagcatgaatcctgcccactctgcaaggctttccagggagttgggggcctggccattacagggcatttggggatttgtttctttattaactgagttcaaaacgtgagtctcaccctccttcaaagagctctggcaaaaccctgcccttctccacacagagaagtggtcttgggggtttctgactactgagccctagtagaataacttcaggtacgccacgtttttccttcatgggactttgcagtggagacggggccgtgggctgactcaggtcagcctcagtccctctccctcctatggtggtcccctgtccccgctgctccccctggagctgataacttttacccatctttgacccaattcttcctggggagaagagcatctgagattctagaaaagtgaggcagaggccaggcgcagtggctcacacctgtaatcccagcactttgggaggccgaggctggtggatcacctggggtcagcagttcgagaacagcctgcccaacatggtgaaaccctgtctctactaaaaatacaaaaattagctgaacatggtggcgtgtgtctgtagtctcagctactcgggaggctgaggcagaagaattgcctgaacctgggaggcggaggttgcagtgagccgagatggcaccactgcactccagcctgggtgacagagcgagactgtctctattaaaaaaagggaggcagagaggtgtggtgtgttgggtcagtgagtcttgacttgctgagctgggaaattgggaataagggacaggtttttgttttgttttgttttgttttttgagacggagtgtcgctctgcaacctctgcctcccaggttcaagcgattgtcctccctcagcctcctgagagtagctgggattacaggcgcctgccaccacacctggctaatttttgtatttttagtagagatggtgtttcactgtattggacaggcttgtcttgaactcatgatctccacccaccttggcctcccaaagtgctgggtttacaggcataaaggggacaggttctctggaggtgtgaggtgcctgtccacttaggcttttggcacattttcagcacctcctctctgaaactagcaatgctataaacacacatacacactctcctctctctctgtttctatttctcacacaattcacacacttacatcaggtgtgtaaggaattccacttcattgcactgactttctacatattagtggggctctgcacgatcttggtttctactgagtggattcactccattctgtgattttttttccttagggtcctgcctcagttggcggaatggcggccacgggagccaatgcagagaaagctgaaagtcacaagtaaggctccatttcattccaggttgggttgggtggggttgggttgtttatagagcatatgttgtgccacacatttttctaaggacttgacatatattaacacatttgatgcttgtgaaagagactgaggcctggagggattaatgactcaggaggttcgtacattagatggttaaagacctccggggtcgggtgctggggcctcagctcttgattcttaggacatgttgtttcagaaaaccagacaagtccctgctcaaatctctgtctagtaggtttttcctctatgtgccaatttcttaaacaaaatcccctgcttatcactcagctctgccttggttctgaattttaaatgccttcttatttctttgcagtttgtcatacttctggtatgcttggcatgacaccacttgtgtttaggcattgctagaaaagcaagaatttcttgtcttcattctgattcctatgtgaactttaatccgctgattattcttattttctcacccccccagttgtctcccacctctgctggggttacctgggcaggccttctgtcctgccgccatggcctctccccagtcttggtggcctctgaccttggcaccacccagggttgtggtgacctctggccccccttgctctggactcctggtcctttgttcctctgtaacttccctgagacctctctgaagtctcacatgtgacagctgcatacccaggtcataattccatatggacaatgctcttctcctcctccattccccagaagtcctggtgtccattttggagtttctggtgcctgtggacattccctgcagtgattttttttttttgagatggagttttgctcttgtcgcccaggctggagtgcagtgagtggcgcaatctcagcttgctgcaacctctgcttcccagtttcaagcaattctggtgcctcggcctcccaggtagctgggattacaggtgcaagccagcacacttggctaattttgtatttttagtagagatggggtttcaccatgttggccaggctggtctcaaactcctgacctcaagtgatccacccgcctcagtctcccaaagtgctgggattacgggcgtgagccactgtggcctgcctcagtgattattttttaattgaactaatagtattcctggtattttcagtcattgacagccaaaaatgccttgtccccagtttctggagctcccctccttcctcctcctgccatggcttgaggttgaggcctagtaggaggctggtgggggtggaggggagtggtagaaatgaaggctggagaaaacagggccggcacaccaagtgccaagcaactcagtgagggtttcctccccttccctctcttcagtaattattttaccctcccttgttttatcctcagctatctgctaatcatgttccacttgctgaaaggcagtcaggtgtagagctcaggagtacagcctcttaggaaggatgtgaccttggactttgaatggggttactgatggtacttagtttatactgagagtattaaatgaattgatatgtgctagctattaataacttcatttctaccccaagtcgaaagccttccatgagtggaactggatcttactcatctttatgttcagtacacccagcacaggatgcttggctgttgcgagatgcagccagcattttctggagccctcccacttccccttccccagtacctcaggcccctgtgtctcacccatctcattttcttcttgtctccacatgtgctggtcctaagctatttgggcaagtttatataaaggttgatactgctttctcttccctgctgataaactcctggaatcagaagccagttttcattgctttcttttttttcctttttgtcttttattgagacagggtttcgcccttttacctaggctggagtgccgaggtgtgatctcagctcactgcaacctctgcctcctgggctcaagtgatcctctcacttcagcctcctgagtagctgggactacaggcatgcaccaccacacccagctaatttttgtatttttcacagagacagggtttcactgtgttgtccaagctgatctcaaactcctgggctcaagtgatctgcccgcctcagcctcccaaattgctgggattacaggcatgagccaccgcgcccagacagttttcatttcatttcatatatttcttttacatggtagatgctcaatgaatatttgctagatgaataaagtggtagaataaagcagaataaagtcacttgaaattatgtgtagactagagaaatatttttttccaggtagtatgtctctgacttgttattttaaaatccttcaaaaaataaattggggcatctactggttcattatggtacatgttaaatttactttttaaattttactttattttttatttttagacagtcttactctgttacctaggctggagtgcagtggtgtgatcagggctcactgcagcctcaacctcctgggctcaggtgatcctcccacatcagcctcccagggaggtgggactataggtgcatgccaccatgcctggctaatttttacattttctgtagagtcagggtttcaccatgttgccctggctagtctcgaattcctgggctcaagtgatccacctgcgttggcctcctaaagtactgggattacaggagtgagccactgtacccggccaaattttcatgttttaaaataattgcctgtcttcacggttacaccctacttccttcttcttcatttctcagaatcaaggagaaaagacaagtattttattttgaaatatgtgacaaagttgtcttaatcacatcctgttttgttattttgaagcatgactcttagcccttctatgttgtactctgtgtatttctaacatcctgaaggaggagaatggaaatgttacttacatgaaaaatagttgtcactaaaggatcctaaaatactgtggggtgtgcagatcgtcagaatttcagattggcctagagatcaaaaaggttttctgagaaaagttcaaggatggtccttaccacacgtgattctggatttggtcgcttgaaaaatggccttgccccacatcccagagtagaatgaaccctgattctggagatccccccaatagcttgtcaggaagaggtgggcttaggggcaggcgggtgtggctctgtgcttcaggcaggctgctgtgccttcctgagcagggttttcagcagattcactagtgcagtcagcagagtccctgcctgcccatacaggagacagtcacctagccccctgtccccttatacaaagatctccctgtctctgtgtataaccctttgtacttatgttttctatatcagcctttctgaaatgttcaggtgtgagctcacctgggccccactctaggggaattgatgggaaggaacatttgacagtcatgaaaggaggaagcagtcaggtataggccatctgtgtgtttggagcctgggtgtctgctgttgatgagtgccagatagaaatagggatttgataaaatgatagataaaataggatgggaccatctcaaccttgtttttcttgtctgtggtgtgttacgtgggattcagagatatataagacgtggtcatggcctccagaaatttttgttctggaggtaaagttattacattaattatgtataccagtgttaaaatatagataaggtgtaacaagcatcgtgtggggagagaatggacaatgtctgtgaggggggtgcatcccttatttaacagttatttccaaatccgtggcagctgagaccttgcctctcttgtgtctttttcttttctcatgagttagaatgaggaggagacatgaccacggggttcagggcagaaagtcagactcagaaggaagaaaaagaagtccccaattgctctgacatcagcatcccatgtctgcctctgtttcctgtaagggagcccacccatctctaggactcagaaggcatacattgttgaaggagctacgtttgaggctggctctaagggacttcgacaggcttgagggactcatctagacctggggcatttgttttgtaaggaaggttttattggaacacagacacactcactcatttgtgtgctatctgtagttgctttcacatgtctacggtggacttgagaagtagcagaaatcatgcagcctgcaaaaccacatgtatttattatctggccttttatgaagaaaagtttgctgatgcttgctctagaccagcatgtgccacgagcacattttctagcagataaacagatgtcttatcttgtcactcctattggatatcgtgctggagaagtggtagctagtgtaacaaaaacaaaaacaaattgaaggtatgcagattggaaaggttatctctgggaggtaggattagaggttgtttttccttctatttctgttcatatttcctatggtaaacatagtagttttaaaataaattcaagtttatacatcgaatgaacttgattagaggagcaactggctatactccctactccttgtatgggtagatcaaacatttccatctgtgtactttcgtgtgctcttctgatttcatccctgttgccctccaaacagagccatgggagcaacaggggttaagagggaggagaagggggaagaacagaggggaggcaagtgcggaccttggcaatgttggggttgtcttatctccgggatctggccctgtctttctcccaccatgagcctcgtgtctgacataggccacttctgtgataatgtcggctgtcgggcactgatgttctataagccttccactttcttgttttttaacagtgattgccccgtcagacttttaaatccaaacatagcaaaaatgaaagaagatattctctatcatttcaatctcaccactagcagacacaatttcccagccttgtttggagatgtgaaggtaagaggccaggtgttgacaccttggaatttgccttaagatcaacctccccctatattatacaggtagaccaacccacaaatgcttgagagaccacagctgacaggtttatgaagacataatgtttaccaaatttttgcaagtttttaactttcaagtatgtgaactagcaagtaaaactatcctaagtagtgccaaattgttccctaattcatcttttgcaaatttagtgcagtcatgcattgtttaactctggaaatacggtccgagaaatgcagccttaggtatttcatcattgtgtggacaacatagagcgtaaccacacaaacctaggtggtagagcctactacttgcctgggccatatgcctctaggctacaaacctctatagcatgtgagtgtcctgaatactgtaggcagttgtaacacagtggtaagcatttgtgtatctatacatatctaaacatagaaaagctacagtaaaatcatggtattatataattttctgggaccgctgttgtgtatatgtgattccttgcttaccaaaacatcgttacatggggcatgactatgcatttgaaactatatataaaataaacttcctaatgcttcattgagagaagagaaagatgtaaaaatttcctagggaagcaaaggatagtaaataaaggtcattgtattttgtttgtaatataagatacatattgatattctgtttagttaattgcctttaatgtcttattttgcttcatgcagcttccagttaactttttctacaaagtcttaagtcccttagttctgatttatcttaacgtaggactttgaaatgtctaatgggtaaagatgaactgacatgtagaattaaaaatcaaaatataccaggacgctagaatccagtgctgctacatgggatcataattaaacaatagtgttatgtcttatcaatcatcctgttctttgatagtgttggtttcaaatggtggacaacttcccatgtgcttttaattcattaaaatttcattcatcctattaagttaatccgtagtgatttttattccaggctatggaattttcttttttatgtttagagaataattaataattcttttcttttatcttcagacttttttttttaaattttttgacctggagtctcactgcccaggctggattacagtggtgtgatctcagctcactgcaacctccctgtcctgggttcaagcgattctcttgcctcagcctcctgagtagctgggattgtaggcacctgccaccatgcccagctaatttttgtattttttagtagagatggggttttaccatgttggacaggctggtctggaacgcctgacctcaggtgatctgcctgcccactcccaaagtgctgggattacaggtgtgagccactgtgcccagccatcttcaaactctttaaaaacttactcacttaaaaaaattttttttttcaaaaccaacattttcttacatgatgttctgcaaattaaagtttttacttctctgagagagacccatccagaatagctatcacttcctgagcctcctctaggcttcggctggctcttctcaagcattggctatttggcactcaagtaaccaggcgagagagcggtcagtagcccattttgtggggccctggtaacacagagggacagtgaggagttgctccctctgtttcaaacccaggctgtctccacaggccgccttctacatgacggagggaggccgagggtgcacaggacctggaattacctcctcagagagagcaagggtctggattcctgcgtttgtggagctgactgccttttgatgcttggccgcccaccctgaccactcaccagggggccttgttaaagcagattcctgggccccttagattcagcaggtcctggtgaggccagtgaacttatatttttagcaagttcattggtaatactgatgttgctggtctaggggccccacttgaggacctctgctatagacagtgcactaatgggggtctctcttctctggctgcagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtgtgagtacctgccttcccttgtgctcagtctctaggctctgcaaccccctgtgccccacccctctgcacacacagacagctggtcccctaacacctgcttactgtaaatggctgggagcagggtgagcccacagtagctgggattcagagattattgaactcaggctatcgtccttgaggctcagtctccaggggcgactaagtacacaaatgcatatacaccgctgtctgtctacacagtgtgagggtggcaggtgcagggagttagagtgcttggggtgtagaggaaggacagtagggggcgccctgcctggagcaggatggaaggagagcctcaaagtaccaggcctctaatcccctctaccacctcacagtgagttacttcaaaacacattttgatttagcaaggagcatggtgaacacagaaatctccagattctaccatagaagtcttttcatttttcagttttgattttgtcaggagcaatataaatgaacagctgcagagtaaggaaagggaaccccttttgttgagatgtgcacccctacctctccagtcagctgaggacactagctatgtcaaccaactagaacatatcagggagccaagacatgactaggttactgataatctgcgcaagcctttcctgtgtgtaaggctccgtgaccgattctagcagggatgcctccactgtatggctctgccacaggaacagcccctggaaagtgctgagttcatccggggagaggcatcacagaagttgtgacactagggggggtgctctgaagaggagagcaggagaaggaggtatgcagagaccccaaagagaggaaaaggcacaggcagacaagatcagcaaagcatcctgtgtccagtgggctgaggaaccagctgattacttagtttgtctgaagcagagggtgtagggagaaaagagaaaggagataaaactttaacctgtggtggggtgtgggagaatagggtgggtatttatgcagggcttcaaatgctagaaggagctgtttgttacctggcaatagcagactgctgcttccctgctgagcccctgggtccgcagctgttacctatttgacaaattgtgtcgatcaaatggggttttgtctttgacagctttgcatacactttaaagtttcccaaagtgttactagttcttaaatttatatttaaaaagtttatctttcatcactatgtcaatgggcatgttagattgaattacatcacatgaaacatcagccagaacattgacaaagtcacaaccttggcttaacatgggtgtttctccctggttccagcatggtatgggcattccttctatctcaatcatgttgcatgagctcataaagctgctgtactatgcccggtgctccaacgtcactatcatccgcattggcacttctggtgggataggtaaggtctgcagaggggcctcttgccctgtgaatggatgagggactggggcatgccaaggcagcttctacatggtgtggcattagagacaaagagttcctttcttggctttgttcaagggaagcttgttaacaggaggtgtgaaaagaagcttgttttgttgtttttgtccaacctgttctcccaacccgcaccccagagctaggcagtagaagggcaccacaccatgcatatgggggaaactcatccttttggggttacacaatttgtgccttcttgtctgcttgattctgtcttattctttctaatcccccttcttctccattctctcctttcctttgcttacttttcctcctccctaatcctgcagggattttgaagcaccttaggagaaaagacacaggaaaatcaaaggggggaagagagaggcgcagtacaaaactcagataagtgtccttaaattagcttaaaatgtccctatcctcaacagggacattttttttttgtttaaaaaacaaagatggttggccgggcgcggtggctcacacctgtaatcccagcacattgggaggccgaggcgggcggatcacaagatcgggagatcgagaccatcctggccaacatggtgaaaccccgtctctactaaaatacaaaagattagctgggcgtggtggtgcacgtctgtagtcccagctgctggtgaggctgaggcaggagaatcgcttgaacccgggaggcggaggttgcagtgagccaacatcgcgccactgcacttcagcctggcaacagagcgagactccatctcaacaacaacaacaacaaacaaacaaacaaaaacccccacaaacatggcaaagaaagaatgagatttaatgagaaagcaaaagctaacaaattgttgaattgtaagccaaagtctgttaggcagatttgttttaaatacgtggtcttgctctctggggttccaactctgtgccattctttctgctaaaaactgggttctagtgattcctgctcccaccgaggtgttcagagctcagggaagaagcctgcatgtgccctagagaaagttgagctttgccgctgctggccaggcctgtgtgtacttgttccaggctgtctagggcctggactatctaggatttatagcaattctagaatttaagtgtcctgaccttgaaaggggacttgctttagacccaaatattttgaatatgttatcttgtctcttttctttttgttatatagagagattgatgcataaaatctgtgtttgtatgactgtaattccaagtttagcgaaattgtccctaggacaacacaccaacggccatgagctgtctcggtcctgcaagcttagtctccgatgctgcccacctgacacagctgtgcatagcatgctggcctctgccaggaactctagtgaatggttcttgagttcttgctctggagtgatttttaaaacaatgatcagataattctggagggagtagtatagattttgaattttcctcaattgctctgtaaaaatggaaagagcaactagggagcaaaaccaaaaaccactggacacagttgataataaaaggtgatgtgctatcctcacaaaccccaaagtatgaatgggtggagacaaaaagcctcaggatctggttgtgttggcagctgctcagggggaagctcaaggcgatggacagacctgagaacaagagtcccaggcactcctaggaaggtgcagggggacatggtgaagatggcagctgacactggagggggcctgtgcgtcccaatgtgagtgatgctggaattccaaggggcttgaccactccaggccctgtgggttcaccaaggcatcagccaagctctcctctagctccagccccagtgctgggagaagctgctgaaatgagactctgaattgcccagaacagccgcaggagtagcaatggaaagaggagttcagatacatgtggggagcgaagcaaaggtctttgcaatcggccatgttttttaatgtttcatgaaaacaactgacttgggagctctggaaaagatctgacttcttgttccctcccacatgtttaggaaaaccaattttgcattaaaataagtatcagaaatggatcatagttatcttagtccctgcaggttgatagacaagatgccattgactgagtggcttataaacaataggaatttatcgcgtagtctggaggctgcgaagtccaaggtcaaggagtcagcaaacttggtgtctggtgagggctaactttcggattcatagagctctgttttctccctgtgtgctcacatggcagaaggggcaggcagctctccggggtccctcttataagggcactaatcccactcatgcaggctccaccctcatgacctaatcacctcccaaaggccctgctgcctgaaaccatcacatttagggttaggatttcagcctatgaattttgagggggaaaccagcattcagtccaggtccataacaatggtcaaatcccatctaaaattattataacacaaagaataaggggcagagtaatgtccctacaaacaggaaactactccaggaaggcacgcccagaacatagaaactggaccctaataatgcatcaatctgagaggaaggccaggtaggtcaggagttggtcatagctcacctgggtttagggtgtgggacttcattatactgttctagtctgccttttgctggtttacttttcaagtatttgcctgaaatcttaaatattaacaaggtatgaaacagggatcaatgaaacacatcatggtatatggttcagtgacagacaacagtgggaaatcgccgtgaatggaagcaagaaatatgggacaaagtacttgaaggttcctggccatttttattttattcttttttttttctttcgaaatggagtttgctctttttgcccatgctggagtgcagtggcgtgatcttggctcactgcaacctctgcctcctgggttcaagtgattctcccgcctcagtctcccaagtagctgggattacagacacccggcacaatgcctggctaatttttgtatttttagtagagatggggtctcaccatgttggccaggctggtcttgaactcctgacctcaggtgatctgctcgtcttggcctcccaaagtgcttgggattacaggcgtgggccactgcacccagccctctactttgttttttgtgcctttctcttccatagtgtccataatgatcatgcattaattactttcatagcttaaaaaaaagttgaatgggaaaaatgggtcactgtgtatttgagaacagtactggatgcttcgtgtttggatgtgtgggtggatctgcttctttcttccatatgctctgctgtgtgctccctggctgccctgctttaattttattttgttttacaccctgcatatcttgatgtctgcttttttcctcaggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaaggtgaggcagcggatacgaggaggcatctttcagccagggaaccctggtccgtcccctgagcctgccttctcgctgtggactggcgtttccacttgccaggctgctgtctcagttacacttcgcccagagtggttataatgacccgtttgagtggtcattataggcaggacctggatgggtcttgcttgtccctgtgtccttctgggcatcagtggcgctgatgtgttgtaggagcttctcacatgcatgtggttctcatgtctccatgtgtgcctcagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaaggtaagcggcacttgatgggcctcggcgtcccctcctcccttcacttctgctctcctggagcccctcgctggggcccctcctcctggggcaccccgatacccatttctggtttctgtttccgctgcccccaagtcactttctgacatatgtgttgtcaccacaatgctgttcaatgtctgactgtcacaccctgacaaaatgcaggattctcagtgaccttgtgcaggaaaaatgacaaaaaagcttttgctgccccatgaggctgccaccaggtctataaaaaactcggctttcaaagcgctttggctttctgaattgtggttcatctaccctcaaggtactagccacccttgaaggccagctcacagctctgcagaattcccttatcacctcggccaaaacgtgcctttcaaggtggtgcttgcagccctgagctggtcctggaatggtgaattccttttggaagcaggcacgagaataagggagggacagggcagggtggtgtcagagagggaggagtcttccgagcccctggaccagcgcctttccctcccgcactccatcctccggccccgcctgactgcatgggcagcctggtttcctgaggaggcagagaggctgctcctcagagctcgtgggttcttcatcccgtccctgtgaaatgttagacccccggcaccttgccttgatgtggtctttgtcctttgcagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacattaaaaaaattccatgca

SEQ ID NO: 2150 - DNA, 173823 bp, Homo sapiens
tcaggaaagatgcgttattaatctagcaagattcaattgttaaatttacaaaataaggattttacttcaaaaatcttatttaaatattagaatgttatcctggtctctttcatcgcttttatgagacctgaaagaaatttcacaagatacaaggcttttaatactcagacagattcagtaaaacaaacaaataagacaatatgtaactctagggcaactggcaaattaaccatttgggagaaggctggagttagaatcttgtcccacatctgaactctccgaatggtgattatgagtaacagtctgatgacagataaaccttgattttcatcctggtttcccatttacttgttacgtgaactggaaaaattaacaaaacttcttcgtacctcagctcttctcacctgcaaaactaggatgtctgctaaaattggctgttgggtgggttaagcaaaacagggtccatagtgcctatgcaaggtaccaggctcctcagaagtccttgatgtctgctggctaaaaagaaaaaatgaaaaacatactgaaacaacacccctctctcagtgattgacagaacaaataggcagaaaggcagcaagtgctgatcagacctgaacaccaccatcagctaacttgaccaaggtgacatttacagaacactttgctcaacaacagcagaatacaaatattttaaagttcaaatgaaacatctgccaagttagatcatattttgggccattaaaacaagcttcaataacattcaaacgattcaagacacaggatgttctctgaccacagcagaataaaattagaaatcagctacataaggacatcaggaaaatctcaaaatacatacaaactaaataatatacttccaaatcacccatgaatcaaagaataaatcaaaagggaaattagaaagtatttttatctcaataaaaatgaaaacatatcattttcattcagggatgaatgctaacgcaatactccgagagaaatctgtagcactaaatgcctatattaaaagaagaaaggtcttaaatgaccttagctcttatgtgaaagactataaaaagaaaaacaacttaaactcaaagtaaacagaaaaaagtaaataataaataaatactaaagatcaaagcagaaaccagtgctgtagataacagaaaaaaaaaaaaaatagagaaaacgaatgaaaccaaaagctagttccttgagaagatcaattaaattgacaagcctctagccaggatgataacaacatatcaaagacacaaatatgttgtctttgaataacaacaacaacaaagacacaaattgccaatatcaggaatgagagaggtgacaacactacactttttacagataaaggataaaatggaaatattatgaacaacttattcctatacatttcacagctgagatgaaatagaaaaattccttaatgatacacattaccaaagttatctcaaaaagaaatagataagctgtatagtcctatacttctttaaaaattgaattcatagttaaaaagtttctaataaaaaacttcaattctagatggcatctctggtgaattctatcaaacatttaagaaagaaatagttccaattctagtcaaacccatccggaaaactgaagcagagagaatatttccaaatttattctaggaggacagcgttatcctgatactaatatgagataaagacattacaagaacagtaacaaaaaaacaaaacccagggtcccccattgtcactggctgcttctcccttgaggaattctcctccaggtctctcagctccagctctgatgcaccctgatttgctccagcagctgactcagcatggccccaagcctagcgcatctccacacctgtttgctcatttgcttttactggattgtgagatggctgaggaatttttttcttcataccccagtgctgagaatgtagtaggtatttggtaaatattataggattcagttttgaagctgggaggtaggttgaacataagtgttaccagaatccaattcaacctggaatgctgtgataaacataggaagtctaacaggaataataatgaactgtatttatgaccacgcaataaatagcaccattatggagagaaaggtacaggagcaaagacattgctccgcaataaaatttaaggatgggtagggaggtgttgagacctccaaagatcctactggttgacacttaaattcttttttatttttatttatttatttattttttttgagaaggagtcttgctctgtcacacaggctggagtgtagtggtgcaatcttgggtcactgcaacatccgcctcccaggttcaatcaattctcccgcctcagcttcctgagtagctgggattacaagcatgcgccaccacattcaactaatttttgtatttttagtagagatggggttttgccatgttggccaggccggcctggaaatcccagcctcaagtgatccgtccacttcagactcccaaagtgctgggattacaggcgcgagccaccacacccggctgacacttaaattctgactatcccaaatgattagtctaaattaatcatgataattccatttcaccatgatcaatttaggaatgagtttgagggaaaatattcttggggacttcctgaaaaagtttcctcatatctaatgataagaccgaaggagatggtctcctccttccatggacatttcatctttggatgtgatccctggacctgtagcagatatcctgcaaccaagcagggtgtcctccatcctgaggcaaagccagcacacagcagaatgcagagatggcatctgccctacctctcaacttctggttttgtagataacacatttccttgcagtttcagtcaattagggtcatgttttacatcatttacagtcaaaactattgtcaaaggttataaataataatataattgggggctgcattagtgtaagtatagtttctaaggcaagtgtgaagtgtgagaaattagttaggtaaaagccatgctgctgctataacaaagagcccccagattcctcagagcaaaacaggatccaggtttatttttcacataagcagggggaagttggcacagttctcatcctagaaaggcagctctgtcatcttcagcacaaggcttctaatcttgctccaggtatcactcacacttgggaaagaaaaaagagcatgaaaaggcacatgcctgatgccttcaggagcaagttcagaagcaggacacattgctctctataggggctgtgaggagctgcaggggaggtggcgtcagtgcctgggcagtagctggggcctggacaaagcttgggcagtgagggacagacagagatggatgctggtagccatcaacatttagcatagcacaaatttttcctaatcatggtactcctggactattgtttatcattaagaggagacacaagaagtacaaacaaggccagaggagaatcacaaggagccaaccagcagatgaggtgactcaaagccacatcatgggaggacggtggtggtgggggctgatggggcttaggctggggaaggaagaccaccagggctgccaaggcaggaggaagaacacaacacttcctcacatgtgtgagagattatcgtgtggagaagtggttaaatgattaattttgactccggggcaaagaccttccatttggtggagtttacagagcaggttatggctcaacatcagaagggaacaaaagaacaaaagaataatagcagttgaagtcactcatgattagaataaagaaacgccagtgagtcacatggaggagataatacagacctggtggctcatcaaggaggtattatagccctcaaacaggtgaagatgaagaaaacattttcccttacaaacaataatgcacctgtatttgatctgctgtaaaggtctttgacctatgatttaccaacttccagtgtgcttaagtctagtatagagataagggcaattgaaatgagactatgtattactgatatataggagacttatgattttaaaagtcatcctcatctttgtatgagtttcttagtctcataagaatttgaatttcaggactggcctttagcacatgaatgtcttctctgacccagcatgctgaggaacaggcttggacactgacttcccactgacctcaaaggcagtgctgttcttgaacaggacttacttcaaatgcaaggcagaactttttattctggaaagaattgtgcccatagaacagacactggcgatcatatcgtttttaaaaaatgatattcagctaacaggttgttatattagtaactaaactagaagttcttgtcctatggagagaatctcaagtctttgaaaacatattctttcctacccttcactcaagtaatttatctgctctgaaaaatgccaaaaacataccactgtgccctgcccagtgccacagacatttccacttattttttaggctaagcagcaaatgtggatccaaaagtggaagaaatcagacactgctgatggcagatgtcttgccaataggtcagatggctgcatgtttttaatcaagcaggccccatcacctgagagcagagatcaaattatcaaggtggtgtgtgtggacagctttttgcagccactggcagactcagtttcctttgtcaatttctgtctgggatacgatgctgttcaaaatgctcgtgagacttttgtggttaaattatgctgaaacatggtgtgttttgaggagcaagttgtcagccaactcaatgataccaccagtgggagtaggccataactcaggctcagctcctgtatctctgtgtcttggtcagattctctaattactcttccacccacacttcttgctgatattctctacggagatatttggttactgatacaaacatattactcttgtcccaaataactcagatttttttagcgtctgagaatggctccacctttacagagtctaaaagatgacacaggctcttccctccacccctatttgggttttggtccagcagaaagtgcgaacatatggtgcggggcccacagatgaggccaaaatctcattaggtagaaatctgagcaattcgggatgtccaaatactgcagaagctcagatgccttcatgctttggagctttcatctataaaagacacttggggaaaggataaaccatgggctgggtgggagaaaggaggtgcccagaaagagcacttgttatgcacatttgtgactagactattctcttgtttgctaggaaaaataattaatatttgcactggtttttaagttaataccattttcaacttattgtaattttgtatgctataacaacctcgttattttttaattattttttttttactttgagataactgtagattcacacacagttgtaagacataatacagaacactcctatgtaccttttaccaggttttcctcaatggtcacatcttgcaaaattacaaaacaatatcccagccaggatattgacattgatacaattaacgtaaagaacattccatcaccaagatcccttctgctgtccttttatagatgcacctaagccttcttccttccttcctcaccgtcttttcatccctgactcctggcaaccacgaactgcttcccttgtctataatcttgtcattttaagaatgttatattggcctggcgctgtggctcatgcctgtaatcccagcattttaggaggctgaggtgggtggatgacttgaggtcaggagtttgagaccagcctggccaacatggtgaaaacccgtctctactaaaaatacaaaaattagccaggcgtggtggtgtgcacctgtaggcccagctacttgggaggctgaagcatgagaatcacgtgaacccgggaggtggaggttgtagtgagccgagattgtaccactgcactccagtctcggcgacagaagactccacctcaaaaaaaaaaagttatataaatagaatcatatagtatgtaaccttttgagtttggctttttgcactcactcagcataattctctggagattcacccaggtggctgtgtggatcaatagtctttttgtctttattgcttagtagcattccatgatatgaagggaccacagtttgtttaaccattcactcagtgaaagctatttccagttcagaggtgtcacaaataaagctgctgtgaacattcatgtgcaggtttttatgtaaacctaagtcttcacttctttgggatctatgatccagataatttctgggcgataagttttcatgtttcattttataagaaactgccaaactatttcccatagttgctgtaccattttacattcccatcagtaatgtatgagtgatgtggtctttgcattcttcccagcatttggtgttgtcactattttttattttagtctttctaaggtatgtagtgatatatcattatggtcttaatttccagttccctaacggctagtgatagtcacatcttttcatgtgtttgccatctgtacatcttcttcagtgaaatgtctgttcattattttggtccattttctaattagattatttacatttttactgttgaattctgaggcttctttatatattgtagatactagttctttgttgaacatgcggtctgcaaatatttccctccagtctgtggattgtccttccatcctctcaataaagtcatttgcagaacaaaaggtttttttttttgttttgttttgtttttttttttttttttgagacagagtctcactctgttgcccaggctggagtgcagtggcgtgatcttggctcactgcaagctccgcctcctgggttcatgccattctcctgcctcagcctcccaagtagctgggactacaggagcctgccaccatgcccagctaatttttttgtatttttagtagagacggggtttcactgtgttagccaggatggtctcgatttcctgacgtagtgatccgcccgcctcagcctcccaaagtgctgggattacaggtgtgagccaccacaccaagccagaacaaaaattttcaatttttaaagttccaatttctgattttctcctgtttttttctcctgcaaatttgacagtttcatgttttgcataaaacattgttcatgatccattttgaattatttttgtatatggtatgaggtataggtacaagttctttttgttttcttttgcttttggatgttcaattgcatcggtaacattgtcaaaaatgctattcttccttcaatgaattgcttcagcacctttgtcaagatgagtttggcatatttgtgtgagtccattctgggatctctattcctgggatctattctgttccaaggatctttgtctcttcccctctgtcaggaccacatggtgttgattgctgtggctgcatagtatagtataaccaccttctgtgcaaggcatccagttcctcccctctccactctgacccaccatccaataaaccagctgtctatgagagttataaataatgtcacctgcagattttgaaaaaagatgctcaacttctgcagggtgcagggtgttgtaggtccttcaaaggtcagtgcatatttctaaactttaataattacatttccttactcctgcctggcaacaggacaaggatgttggtcaaaaaaaaaccacagtaacttatgaaagtagagactgcaaggaggccctggcaagcacaaatctctggaaaattattcaactcaggacaactgcagcagaaaactttcctaaggtctctactttttcaaggacaagggctagtatttcagtaatacttaaattgattataaactagcaagagaagccaggaagaaggtcaccatgagaaaagagttcctccctacagtcccagagatttgtataacctcattctatatttacttgaattctgaagatcagatagaataaatctccacactggtgtagtgaatgatgacattggtacacccatgtgtgctagctgtaacttggaccctctgtcttcccctcaagaaaagtctactgggatagtggttgagtgaacatggctttgaatagggaaacccttgaatctgctctaatttttcttctccttggtcctacttaaaatcaattaattgtcaagcctttcaactatatgttgagtaataaattattcaagacatagttaagagtgcaaaaccagtgggaactgctgtactagattttaccaaagatagacactcactcccaaaccgctggggaaatggattcgatctttactaaaggtgttgtgctggtgacatggatgaggtatgtctttggggattcttacgtgattttatcccttgagaatgagtcacttacctgaggaggaggcaacaggagctcctgacctcagaggctctcctacattcctgcgttctgtaacttagaaagccattgggagtatacattgatagctatatggtattttagggaagactcaatggcatttctatttaaaagtattatttaaaatagcaaaaaaaatcatcttttgttattacttgatcttttccacagtcaaatactcagataatctacttgttttataattttaatgataatcaacatgtactaacatacaaacatcattcttataaaagcatttataaattaagatctacacagagtaaaaaagaagagtttgctaattttttgagtattttgttttagttttgtcagattagtgaaactaaatttttcaaaaagctagaattaatggaaaactataatactttcttcaaatatttacatttgcttaaatgtatttgttttgggttgaattgttcttcctccagaacaaaaaaggcactggtggatgtgaccttattttgctgatgatcaagctaagataaggtaattagggtcggtcctaatccaatatgattgtgttataaaaagagaaaatttggacacccagggagaatgccctgtaaaaaagagaactacactgccacaagccaaggagctaagggaagctggagagatgcctggaacagatccttcaccagggccttcagagggagcgtggccctgctgacaccctgaccttggacttctggcctccagactacaagagaataaatttctgtttgtggcactttgtcatggcagccctagcaaactaatgcagtattttacatattcttttgggaaataattgtagtttgcaagactccaattgaaatagaaacctcaaaaagaagccagccgacagtgtattttagtccttgagaattcaactttcttgaaccctgctaggagacaatttggcccaagtaaataaattatgtgttcacagtcatacagaagccctggtttatatccttagtgcctcgagtgccattctagcacacatctaaataaaagggattaacaataatatttcaacttcattggagctatgtctgccaggaaggaatgaatcagcagccacaaaaacattcctgcttgtgaagtcatcccgggaagacttagtataatccatgaaagcagagagaattcatttcagaaggctgtctgcttcaacatttctctttaggttttaagttattcccacttccaatatattaagtatttgtaagccatatctagttcttttaaatttaattagcttttcttgtgatgtccatcatgggaaaaattccaagacatacttagaaacatagaaaagcttagaaaaaataagaaccattaaaacaaatcatatctcacaactatgaccctatcattttgtcatctctttacttgagtaatacaatagcttcttttttttttgagacggagtttcactcttgttgcccaagctagagtgcaatggtgctatctcggctcactgcaacctccatctcccaggctcaagcaattctcctgcctcagcctcccaagtagctgggattacaggcgcccaccattatgcccgctaattttttgtatttttagtagaaacggggtttcaccatgttggccaggctggtctcgaactccttacctcaggtgatccgcccatctcagcctcccaaagtgctgggattacagacatgagccactgcgcccaacccacaatagcttctttttaaaagcgtttcacttggaaataattttaaacttaataagaaagttacaagagtaattcagaagtactcagctaccctttccagagccacctattagcattttcccatgcttgctttattagttgcccttttctatccatatacatcacccaccacttctttttgctcaataaccagttcactaaatatttactgagtgctggtctctgtggaagccacagtggtggagagaaagtcatgagaactcagctagcaagggcagaaccaggatgtgagagcaggtgagaatgatcatttttagttaagtctaggaatatactggtccttaacatgctgaatgaagtctgggaactatggggtgcattcttcctgagcatacctcatttgaacttgatgtttgcatccttaccgacccctctcggcttcacatgaagaaacacatcataacataggtccaagtggatacaaaagttgctcaggtttttgtccataattttgagatttgtactttccaagttccaggaatataatgttttctgagtggacatagttcactttcaagtcaatgttgttcatctttggatccccagcctctagaattgtgcctggcacaaaaatacttgaggaatgcatgaaacgtgaaagtgttaatagtctctattaaagctatagacagcacttacagcatgcagacacgaactcctttaactcctttacctctctcagtggtctcatgggagaggctctactactgtcctccttttacagagtaggatgtaaagacaccaagaagttaagtcgctttcctacagtcacccagccagtagttaaaactgaatcactccacagttgctcaaccctcagacctgcctgacctccatgtttatcagcaggagttggggcatctctagggcatcatactttctgcatgttcaggccgagttgatatttctttctttttttttttttttgagacagagtctcactctgtcgcccaggctggagtgcagtggtgcaatctcggctcactgcaacctctgcctcccgggttcaagcaattctcctgcctcagcctcctgagtagctgggattataggcgcccatcaccacagccggctaatttttgtatttttaggaggcacggggtttcactacgttgaccaagctggtctcgaactccttacctcaagtgatccacctgcctcggcctcccaaagttctggaattacaggtgtgaggcaccatgcctggccaatatttcattttaaaaagccccttctagcctgtttcttcctcaaggattcaaacttagtgttcagatacattgcatcatctgttagaaaataccaaagtcaatgaagattcagtaagtttacagaacctaactataactacaaaaacttctagatttgagggaactcagtaaatttctttgacagtcacctgtgacgggggctacgtaaacgcattgggaaaagctaagtattctaaatcttctcattattttacaaactggcaagttaaaggaagaagctgagagaaaattcaccctcttgatggcttcctgctcctaagtaacactgaccagcagagttcagagcacaaaccttgctgaaaagagtggctgtggactgtggcacgccagtcttcacagattgtgttggggaccccaaatgtgaaagggaatgcagattttccacagttataaaaaccatctcaccttcctcctggcaggtaggtgctaaggaattacactgaaaaaaataaaggcaaaaatcctctaggagagactctgtgccctgaggtcaggcgctcccctctggatgttcctgccttacgcaatggtattcacaaaagcaaatcaagaggaaaatatgtggaggaaaaacccttctgacatctctaaattgcatccactgactagtggcctagccagctcctgcaaagtggtgagtcatcgcagtagagaagaggcccgagcaaggagcagggcaagagctcggaggtccttctgcccaatcagcagcagcccccggctgggaggtctcttcggggtccaaggctacatagctgagaggccacagagtgccaagaaccgttaagggggccgagctggcaagggggagaaggtgggggctggcaactcaccgcattttgttgccatgagtcactttaaaaatacaaagaacaatatgatttgtaggtggttattgatagctccaggcatccaatccttctagtttataaagatacaaatcttaattattaatggttaagatgaagaaacaaataaatgccttgaagttaggaaattcaaacgaattgtttcctcagatcccctcacacaaaaaagggtctgttctgtaaagtccagcttgcttggcctattccaagaccaatgacattcctggttctttcccagggaggccagctaaactcatgttgcagaaacttgagttctgcaggcagaaacccacctgggagccaggtgagagagacccacccttggcagcattaactttttgccaaacatacttttgataaatacctcataaagtgatagtccagaaagcgttgtgttttcctgtggaatgaaaccaaagttatgattgcattgttgctgaaaacgtcccactcatacacaagaaaagtaagtcataagggcaaagacagcacctacaagcctccaccatcatttgagggaaattcttttctcagccataggaaattagtatagattactatgtgttgtaactgtataaggactcacaatagtgtgtgttgtgtatataaaggactgctcaaccatattataaatttaaagttcttgctagttatatgagctataaaatatataaacaaattaagcgggtttaaaggaaagagatgagccatacgcctttaaaatgctgtggtgggactttgttttcatttgctttttgagacaggttttcactctgtttcccaggctggagtgcagtggcataatcatggctcactgcagccttgacctcctgagctcaagtgatcctcccacctcagccttccaagtagctgggactagaggtgtgtgccaccacacctggctaattttgtattttttgtacagacaagatctcatcatgttgcccagactggtcgcgaactcctgggctcaagtgatcctctagcctcggactcctaaagtgcttgtattgtaggcgggagccactgtgtccggcctgttgtaggacttttgaactgacaatctttttgtccttaaccttagtagtaaaggctctgatgttgtattattaaatataatactgacatttaacttgagctatattcctattttttttaaaaatatcgatttcatttttattaagaatatgttttaatacttaggaatgaatgttgaattttatcaaatgcagccatggaaaaaataaaatgatagcttcctccctgtttggtgaaggttattaatatattctttttttatttattatttcatttatttttattttattcatatatttttattttatttattctattgcccaggctggaaatgcagtggtgcgatctctgctcactgcaacctccaccttccaggttcaagagattctcgtgcctcagcctcctgagtagtggggattacaggtgtgcaccatgccgggttaatttttgttggccaggctggtctcaaactcctggcctcaagtgatccacctgccttggcctcccaaagtgctgggattacaggtgtgagccaccacacccagcccagttatatatatatatatattttttttttttaattttaattttaattttttttttgagatggagtttctttctgttgcctaggctggagtgcagtggtgcaatctcggctcacagcaatctccgcctcccaggttcaagccattctcctgcctcagccttccaagtagctgggaatacaggtgcccgccaccacacccggctaatttgttttgtatttttagtagagatgggttttcaccgtgtgagccaggatggtctcgatctcctgacctcatgatccgcccaccttggcctcccgaagtgctgggatttcaggtgtaagccaccgtgcttggcctattaataaatttttaatattaaaacatttgtatcctgatttaatactcatatgatcatgggatataattttcttaatctgctgctggattctatttgttaatgttttatttagatttttggtatcaaaaatcaataagactgacatgtagttttatttttaatttggaatatttttgtccagtttttagatcaataaattgcttgtttcataaaaacacattcggaagcttttcttctgtctctgctgtggcacagtttgaaggtcgttctggacttacatgcttcttaatagtttggtgtattttctctgtgaaaccatctgggactggtgcttttggagggatagaacttcaaatactgtttcagatttctgtctctactcaagtcagtttgttgcataataaacaatgataactgttctctccttccaaaattttataatttatttaatttcctaaaggttattttctgtttctcatttttattttgtatatgaattgtactcactttgttcatcatatttagatacattagccaataatttgtcaatttaattgttcgtaaaaagattcatctcttggattacttcattttgctgttgatttcattaaattatactttcattctttcaacttctttccttctgttttgcttagtgtgtgtgtctgtgtgtatatttgtgtgtgttgtgaatttttcctatttgagctgaacacacacttagtttacttttatttgttgttgctccactttatataccatgggatttcgtctgtcagtgctttctgctaagcactaattagcagtatatattgtcctttgttttaatcccatcattcaaaaataacaatatataccttatggtttaaatataaatacatacaattatctttcttctaaaattttcaattaaattctttcatttttatgttacaaatatagtaaatactatccattttttctcctctgtataaatcctctattttattttatttattatttatttttgaggcagagtctcactctgttgcccaggctggagtgcagtggtgtgatctcggctcaccgcaacctctgcctcccaggttcaagcaattctcttgcctcagcctcccgagtagctgggactacagccgcgtgccatgacgcccagctaatttttttgtatttttagtagagacggagtttcactgtgttagccaggatggtctcgatctcctgaccttgtgatccgcccacctaggcctcccgaagtgctatgattacgggcgtgagccactgcgcctgacccaattttattttattttttacaaaattggtcattatattttcttttcttaaaaattatgtttttcctatcatttgcccaattttcatatgcacatttaaacagttttttatgattaaaacaataataataattgctaaataaataatttttttttttttgagatggagtctcattctgtcacccaggctggaggtgcagtggcacaatctcggctcactgcaagctctacctcctgggttcacgctattctcctgcctcagcctcccgagtagctgggactacaggcgcccgccaccatactcggctaatttttttgtatttttagtagagacagggtttcactgtgttagccaggatggtcttgatctcctgacctcgtgatccgcccacctcggcctcccaaagtgctgggattacaggcgtgagtcaccgcaccgggccataacttaaataattttaactcacttggagatgacttgattttcaggggtaggaggtatctaggtgtcagtaggattatctttttttaagtccagcgactttattagtgtgtgttttattttttatttttattttttctgttttctgtttttttttttgagacgtggtctcactctgtcacctaggctggatcacccctcactgcagcttctacctcctggaccccagtaatctttccgtctcagcctcctgagtaactgggaccacaggttttgtttttttctttggagagatagggcttcactatattgctcaggctggtcttgaactcctgggctcaagtgatcctcctgccttggcctcccagatgctgggattataggcatgagccactacacccacccatgttctagttttaatagatgtgaatccatttcttccctgggacacagttcttttttaaatatataggtgtatatctcttttccagtaaagtcttttaaaattatattttaaaatatttttttctgttcaaattttctgggcttttttaggggagacactaattatagataccctttccgtgtcttacgcacattcttcctggtctgatttccatgtgtattacttttcctaaaatcaattttaactttttttctcttgcagaattttcccaaatatgtcatccatatagtttattctcttttctgtgaatctatttgctttatttttttcttttccatttctttcctcaactctgttaattcactgtctttttatttcatcttggagttctttcatcttggcttcaaactgtcatttcaaagagacatttttttttttttttcattaacttaacctttgtgtggagaacatctcggttacaatttttacctgttgatggcaattgttttcaaagttatacccttcatcttcacttttggtcatttttacatactgctttttcctgaagcagatttgcatagatgcaataattatttgcttttattatttctactcctctctacatgtggaagttcaacttttcataaacggtgttcttccctgggttgttgtgaattagggcccgggaagggctggggcagagagcttatagcaggtacttcatgttctcctctgccttcagagagctccttcattgccactcagtcatgtgaacatgacagctctgggccagcagagtatctctctggatctcagggaagttaccactggaagctatttatctttggggcatggcactcatccttctttttcactgtgtacctggcacatggtgtgtctattggtgttgatttttctatagtttgcaagtagtgtgactctaggtctgtgaaccaccaatagttcctcccctaggcagccacatcaacaaacagcttcctacaaagacggcttcctgcacgttttgtccttcagtcctatgtcccaggaactctgtggcattaggtctcagggagattccttaaactctttagtgctctataatctattcgtccaaaccaggggcctttgttggctcctccagatacactgtctaacttggagaattctgtgtgctcttggaaatggtagcatcctttctccttttggtctaagttttactgttcttggcatccattcttgagattactggtcacattctgggccatagatttctgggtttttttttgtttctgggaagatcgagtttccatttctgtttctcagtctccttgttgatttcagttgtaatcagaaataaggggcagacagatacttatgctaccattttcaactggaagtcacatcatggactttaaatttttaagtggttctttagttctggccagagcatatcttatcagcagtatgatatctaaagaatatttatgcaaatggaccttataatttggaaaaacaactattccaaaactcctttagaacttaaattgctatgaagaaaattgacataaataattttgcatggtcttacctcagcagcttggtaactagaaatgtccactaagggactctcttctgtccttgcctcccctgtgttgttggatgttttttccagaagggggagttgtaggctgtcggacaaaccattaatcttcatcagaagttcgtctaacagatttgcaaattcatccaagtagtaattctgaagggaagaaaattagattagtaaatgcattcaagaatctcattatccccctttcctcattatgtgaagcatttaggggtatcatctgtagacagtattgggctatgttaggaaacatactgactctgcctgcagttagaagacctgggtgctgggcctactcttacatctctatatctcagttgcttcaataataatgtacgtatacagatatacatgtaaatgctacagttaataatgcctacataaaaaaaactattgaatggatttaaaggcagtaatgcatcatgctgctatgggaaaataaggtcattctttcatcccttcgattaataaatctttattgagcactattaaaaaaataaggcaataatggatggggaagcacatgacagagaataaagccctatcaaaatgtacagtaccgtgattacatatgactgccttcagaaccttactggatgatgcttaaatatcacctgatatggtttggttgtgtccccattcaaatctcaacttgaattgtatctcccagaattcctgtgttgtgggagggacctggggggaggtaattgaatcatgggggctggtctttcccgtgctattcttgtgatagtgaataagatctcatgagatctgatggcttatcaggtgtttccgcttttgcatcttgctcatttttctcttgccactgccacgtaagatgtgcctttcacctctcgccatgattctgaggcctccccagccatgtggaactgtaagtccaattaaatatctttttgtccccagtttcagttatatctttatcagcagcttgaaaatgaactaaaacagtaaattggtaccagtagagtggggtgttgctgaaaagatacccaaaaatgtgaaagtgactttggaacttgataacaggcagaggttggaacagtttggagggctcagaagaagacaggaaaatgtgggaaagtttggaacctcctagagacttgtggaatgactctgacaaaaatgctgatagtgatatgaaaaataaagtccaggctgaggtggtctcagatggagataaggaacttgttgggaactggagcaaaggtgactcctgttatgttttagcaagagactggcagcattttgccccaccctagagatttgtggaacttagaacttgagagagatgatttttagggtatctggcagaagaaatttctaagcagcaaagcattcaaaaggtgacttgggtgctgttaaaagcattccgttttaaatgggaaatggaacataaaagttaaagaaatttgcagcctgacaatgcagtggaaaagaaaaactcattttctggggagaagttcaagccagctgcagaaatttgcataagtagcaagcagcctaatgttaatccccaaggccatggggaaaatgtcgccaagtcatgtcagagaccttcacagcagcctctcccatcataggcctggatgccaaggaggaataagtggtttagtggactgggcccaggttccccgtgctgtgtgcagcctagagacttggtgccctgtgtcccagttgctccagccatggccgaaaggggccattgtacaacttgggctggggcttcagagagtggaacccccaagccttggcagcttccatgtggtattgagcctatgggtgcacagaagtcaagaattgaggtttaggaacctcagcctagatttcagaagatgtatggaaatgcctggatacccaggcaaaagttttctgcaggggcggggcccttatggagaactgctagggcagtgtggaagggacctagtggagctgtgagaagagggccaccatcctccagactccagaatggtggatcctctgacaacttgcactgtgcacctggaaaagccacagacactcaatgccagcccatgaaagcagccaggaaggaggctgtaccctgcaaagctacaggggcagagctgcccaagaccatgggaacccacctctggcatcagcatcacctacatgtgagccctggaatcaaaggagatcattttggagctttaaaatttgattgacctgttggattttggactggtatggggcctgtaaccccttggttttggccaatttctcccatttggaacagttgtatttacccaatccctgtacccccattgtatctaggaagtaactaacttattttttattttacaggctcataggtggaagggacttgccttgtctcagatgacactttggactgtggacttttgggttaatgctaaaatgagttaagactttgggggacttttgggaaggcataattggttttgaaatgtgaggacatgagatttggagggggccaggagcagaatgatattgtttggctgtgtccctattcaaatctcaactagaattatatctcccagaattcccacatgttgtgggagggacctagtgggaggtaattgaatcataggggctggtctttctcatgctattcttgtgatagtgaagaagtctcacaagatctgatcatttataatgggtttccacttttgcatctggatcatttttctcttgccaccaccatgtaagaagtgcctttcacctcccaccatgaacctgaggcctcccaagtcatgtggaaatgtaagtccaattaaacttctttttgttcccagttttgggtatgtctttatcagcagtatgaaaacaaactaatatatcagccatgaagaaagtgagtattcagtgtgcaaacgcctggtttgatttgtttacatgcatgtctggggtgactgaactcaagtaatgcacctaaggctctatgttttggatagaagtttgggtttgatagcaggcaccaaaagcaaatgactaactcaggggacagaatacagcatgtctgtgtcctggggaagaccataaactctgtctttccaactgtacaggtcactataaggatatagtgagttaaggcaggagaatgtgcttggtaatctgtaaagtgttttagaattgcacgggaaaattccatgagttccactatgattgagactaattttgtggctttgcaaggagatttggcatggaaacatactcatgctttgataactgaaagcaaaattctgcaatgaaaccatcatcttgagtgtgtgctatcatgctcagtaatccaagatctcacagcttacgtgattctcaaccatctcagcctcttccaactttggtgtttccagtctcagaaaggtgaggaccttttcccacatataagcagtgacatctttaagtctcacaaaagatttactttgaaaagattttcttttttggggtaaagtcatgagaaaacctctcagctaggaaaaagaaaaaaataaagacaaatttcatgttagcagcctaaataaagagctttgttaacgtgataaactatgcaatggagattatatctgatgatgctactttacgagcttttggtaaaatagtgatttcttggtgaaaaaaagcaaaatcaggaaaatacctctcctgaattgaactaaatggcagtaagatgatctcagcaatggaaattcattgtattataaaggttgttttcagtatctaactttggagactgagattatcaacgcgatgtgcatgcccatatgtaaagtctgtgtctcagtttcagtgtcccctggtgaaccattctgagctgtgggtgagcctcaggagagaggcctgtgcctgtgcctgggagaccagaaagggtcttgggctcagcaagttgttgtgccctcaacatgtgctctataagcctccaggtggtttatttcttcactgcaggctgtaagctgttagctcaaaagcctactggtaacaaactcgaatttttacacatccaattgtttaaaaaataacccaaacagggctgggcgcagtggctcatgcctgtaatcccagcactttgggaggccaaggcaggcggatcatgaggtcaggagattgaaaccatcctggctaacatggtgaaaccctgtctctcctaaattacaaaaaaaaaaaaaaaaaaaattagctgggtgtggtggtgggcacctgtagtcccagctactcgggaggctgaggcagaagaatggcgtgaatccgggaggcggagcttgcagtgagcagagattgcgccactgcactccagcctgggcgacagagcaagactccgtctcaaaaaaaaaaaaaaaaacacccaaacaaacattttagccatttagagcctgtcagctttacacaccctgcaaaacctcaggggacagctgttacccactgataatgttataaggccccaagctgctgctggcttcaggagctttctgacccagagcctcccctccatgctgctaagcagcatcgtctaaggggtaagctctctctctgctgcccctctcccctgagatcgcccttgctcttcttcctttttggatggttcttggcccctacgctgtaaacctgtggacagtttcatagcatgaagtatgagggagttcccccacatggaaacacttcaaaacattacccagataaagcttgtgtgtgttatcatctcttgtggtcatatgtttgttcttgattggtccccaaatccctcgaacccctcacaaaatttcagaactctgcaaagatgctcaggagcctgaaagggtaggccattggtgtgtaggtctgaggcctcctggatttaccagcaacacacccatggcagacagcaagacctgactcttccacccagagacctcaatgcaatattgcctgcctgtctcagaagatagcatccaggtgcctaagcacgacattcaaggccctccattcctgactccaaccatccttttcaacataatgcccacttgacccagaactccagcatggccctccctgcatgccccctgtctaaaatgctgctctcagcagtcatcaccatgagtggaactgctcatcaaggctcactctcctgttgtatgaagatttcctggtctccctaggaagaataaatgagtctctgatctaagtttcttgctctttgaggacacttctagttaggctttaaaattgcctatcattgtgtaggatctgtatgctgagaactataaaacagtgatgaaaaaaatcaaagagtatctaaataaatggagagaaatacagaattctaggatcaaaaaagcttaatattattaggatgccaattccccccaaatttgatttataattccacagcaagttcaatcaaaacaccaacatgattttttaaaaagatagtaacaagatgattctaaaacatattgaaaggcaaaagagctagaacacctacagtcaaaacagaacaaagctggaggactcatccatgctactttaagatttgccacagagtgaaaaagacctcatgggattggctaaaggaaagatcaatggagtagaatagagaacccagatatagatccacacagatacagtcaattgctttttgacaaagttgtaaagccaattcaatggagtaaatattcttcaaaaaaattgtgctggaaaaattggatattcatttataaaaaacaggaactctgttccatacctcacatcttacattaaaattagcttaaaacagatgattaacctaaatgtaaaacatagaactataaaaattctagaagaaaggccacgtgcagtggctcacgtctgtaatcccagcactttgggaggctgaggcgggaggatcacgaggtcaggagttcgagaccagccttaccaacatgacgaaaccctgtctctactaaaaatacaaaattagctgggtgtggtggcacacgcctgtaatcccagctactcaggagactgaggcaggagaatcacttgaacctgggagacagaggttgcagtgatctgagatcacgccactgcactccagcctgggcgacagagtgagactctgtctcaaaaaaaaaaaacaaaaaaaccaaaaacaaagaaacaaaaaaaattctagaagaaaataataggagaaaatatgtgaccttgggtttggcaattcatttgagccaggacaccaacagcaaaatccataaaagaaaacattgaaaaactggcctttatcaaaatttacaacttctgctctgtagagatgctgttaagagaataaaaggagaagctacagatttacaaatcacatatccaatttaaaaactgtattcaaaatataaaaattgccacaattatttgtatatgccagtcttcccctatggactgtgagctccctgaggcaggaagcagttattatctttgtttcgccattgcctgaatataatgggcattctttagttttttgttgaatgagtgagtgcatgaatgaacaaatgagtggattgatggatggatgggtgggtggataggtggacaggtaactagtttggtgagtaggtgtgtggatgggtgatcgatggatttatgcattcatggatgagcaagagtagggagctaggatcattgataaaagcaaaggactcgggcctgagtgttgtcaaggtgtgaacatgagcaatcacttttagtttccctctagctactaaactagaataccagtagacttttaaggactgcagagaatttttatccacttacaaagcttgaatattaaatttactgaacttgcagtgggctctacaatgtgtcaggaactactaccctagaaggcaggcacaccaatatgcctgctaggaatgtggctagagttcaaaagcagacaaaaaccaatagcacaagacaatgggtgcaatgaggaggcatgctcagagcctttgggggtccaggggagaatcggtgctgggagagcttctagagggaacaccacattgaccctgtcttagaacttaacgctgaacgagtcacagtggagggatccgagggaaggcatgttcagtaagtgtggacagcatgcctataggcttagtcaagcacagagcaggggtcccaaccctgagccttccataggaacacctgtagggccttctggaaatagaagtgatgagtcccacccttgtgatgtgggcatagcaatcctgggtctggctgggcagagcaggtcggagcctcggcagggaggggtaaaatataagacactcagtaacattttaatttcaggtcaacaacaaataacttttaacataaatatgtctgaactgctgcagggggcttactaatactgaaaacttttccattgtttactgaaacttaactgtaactgggttccagttttatttgctaaatctgttgaccccaagtccaggcaataggacaagaccatgggggagactcttcttccactgaaggagtttaagccatgtatgacatgactagatttgccagtggcaggtcagtaggagggcgtgaaacagggagccattcctccttcagccgctagcctggagaacacgtccagtggaggtggctgatgggagtgcaactctgataagatggaaagactgagaaaaggcaacagatacccctgaggcagtgtgagattgcagatgaagttcacagtaagaaatgatgtgattcagtgcagagtgaggggggccagggaagcttcctggaggaagtggcaccctggggtggctgctctcgtgctggactattctagagtaagggagagtcaaaccaactgtgtttgacggacctgacctcccagggcaggtgagctggacggcagggattcattaccatgagatctggcctgtgttgcctggccctgtccacatggaccagagtttcaccccaacagcaaatgaaacttttacaaaccataacttgaaagttggggatgtgtttacttaccattccaaaacacagtgtggcagagactattaaaaggatcccaaagtaacaagccatggcccgctggtcagacttggaaaggccaaggaggcagtctttttggcttcttctgggaaaatgaaacagcagcccggggaaggcgtctgtgaaggtgccaggtggtagaacccacatagagagcagaaatcggtgcaggtgggagagggcggccagcatcagtgcccccaccagctgcagaaagaaaatccagagagcactgaccttgtcacctcttcttaggagtggaagactcaacttccaaatgttgaaaatagagacaaacttggaggggcagttttgggagtgtggatcaatcatgtcatccctggttttgaacccaaaaggcgtatgtcaccctctcacccatctcccaggcctccctcctcccaccccaccagcctcccacactgtggctggtctccctcctccctttcaagggctcttcctgccagtgccctctcctctcctcagctgcctcctctgcctatggtgacaagcggcctgctcccctggcctttggcccccttaggaagccatggttgccatgagggggcagctccctcatgatctttatgtcccccgcacctggccagagcttagtaaaataaatcacttaggaagcatcaggaaggctttccaattttgatgtagatttggttcaggttaagtttcatggtcctggttgtcgtaacagactgggaacttggcctgggatctgaggggttgtatcactggctccgttcatgcttctcactccatctgctccaaccagccctggtgctgacaagtattttttcagcctggatgtcagaccatcaggcggtcgtcccataggtccacatggggctgtgtgtgtagactgtggacgggcctacagagaggccctacctagctgcagctatagtcatgggctgcattctgtgtgggtgcttgctggattcatgtacaagcctggacaggtacccaaagacttccctacaaatgcactaggactcgttttagtattacttactccataagtgaaatcagacatcagtggaactcagaagaaagaaagcacaatctatgagtctacaactggacaaattgagctgtgtggtctcccggtctccccttgatgcctatgcatctatacttgctgcacagttagaattctgctacttaatttggacacaaattatttatattctgggcttttttttccttacataaaagcatttttggctgggcgtggtggctcatgcctgtaatcccagcactttgggaggccgaggcgggcggatcacgaggtcaggagatcgagaccatcctggctaacacggtgaaacaccgtctctactaaaaatacaaaaaattagccacacatggtggtgtgtgcctgtagtcccagctactcgggaggctgaggcagaagaatggcatgaacccgggaggcggagctttgcagtgagccgagattgcaccactgccctccagcctgggtgacagagcgagactctatctcaaaaaaaaaaaaaaaaaaagcagttttgcatgttgctaaatggtcttaataatgactagtttaatcactccataaattctacatgcatataatctcaaaggccagtagtaaccttcggggcaaatgtcgttaatgctttttctggaggcagaggttgggcaaatggctggtgctcgcaacagtgagctggagtgtgggacagccaggttcaaatgctgctctctctgactctcaggttcgttctctctgccctggtttgctcagcatgttcctccagtgtaaggtgaatagggcttgcagaaccccttccctggagcaggagacctgtgcttggtgtcctgtgtggcttggatcctgacagccagagcctcctaactcagggcacttggcctagactttccctcagccctgattgcaattctttgctgtactagggcctgtcaggttggagaaagctctttctctgctgggaccagatcggaatcaacagcaccccaggaacttcatcagggctccaagctgtactctgtacctgttgattcggagcttcaccctccagaccagacttcagggctagccctggatgaagacttggctgtgccctgttgtttgagacaggaaatcctgagaatcttctaagaagaactgtgcctgtccatagcttggttgtgatagttaaacgaagtaatctatgagaggcccaaagtgccattcctggcacttagagaaagctcagtaggtgataataactacttatattagtaataataacatgctgttgtaaggtatagtacagagcaagtgtttcctaaatcatggttattgttgtcatgaccataacttactatgtaactattgatatcagttatctaaaaccacactgtaagggattagaagactggaattctagacggtgtttaaccttgagagcagtttgtttttcccttgagaaaggctgacgagtacacagatcaatggtttacaagggaaatcacctgataaaggggagagttcttacccctgctacaaagatgctggggagtgagtggcgcatcatggaggagcaggatgccattgtgttttgaatgccaggaagatagacgcattttaatgtgaagaggaataagaggattccccggagccatcgagccctctgagacagaagaacataacagtcagtgtgccatgccagtcactgaaaggtgcagacatattcacagctgtcagtcatgcataaagagttcattggatttgatgatgttatatagacccatgagtctccgagggacatcaagtgcagatgtctgcagaggagaatgagttggaactaggggtaaatacaaatcgtaacgcattttgagaagacctgctctgaattctggcctggccatttctttgaacaccaggatggagcaggtctagcaggcacacacagatgggactctgtccaccccacgtctgttctccctgtctgcgcctcagtctactgggctataagaaaatcatcaccacagaggggactcaaagaagtatttagtgcatgcttatttcctttcccccagatacatgtacagaatagggcaccaacactttccaagtaggtttttaaaaacgtaatccttgcaaatacgggaggcactccactttatatctctagagtctacggctcagataaacagtgtgaacagacaaacatagtacaactggggggcatggcagacccaggggcaaacagccttatggactcgtccacattcacaaggcctctaggaaggctgctcccttctcccctccctaccaggggcttatggggaaagtacttttgggtgtatgatctcatatgctctcaccaaaattataagcccaagagaaaagaaatgacagctggatggtttaaaatctatatgggcaatgaatcaaggttttctgtttgttttatttcctcagtaattgggacaaagtcaacaatgacttctgacaaccaaaacctagagaagctgtgagtggctgtcacccctcgggttcccttcagagcaggcagggccgcacatggttgaatgggggatgaatggggctttagccagcaccggccaagaaaaatgcaatgcaagctatgggtagaattttctagtagccatgttttaaaaagtataattaaacagagtaaatttgttttataatatattttgtttaaaatagtacatgtaaaatcataaaaaatagcatcatgtcaatatgtaaccaacataaaaattattgagatattttacatttttaattttttttttttttttttttgagagagagtctcaatctgttacccaggcttgagtggcaggatctcggctcactgcaacctccgcctcctggtgagttcaagcaattctcctgtctcagcctaccgagtagctggggctacaggcacatgccaccatagtggctattattattatttttattttttttgcattttaatagagacagcatttcaccatgttgctcaggctggtcttgaacttctgaactcaggcaatctgtcagccttggcctcccaaaatgctaggattataggcgtgagccaccacgcccagcacatttttaattttcatactaagtttatgaagtccagtgagtattttacactcacagcacatctcagtttggactagccacatttgaagttctcaatagccatgtgtggctagtggtgactattggacaacacggctataaacctcctgtggacagagtggaagggccgctttcttgcctccatctgattgagggatgccataaagccttctgagtaattgccattattatgactttcatttatggaacatctgctaggtgccaagctgttccaaggatatgtttgaatgtgcctgtacaaatacacacacacacacacacacacacacacacacacattcaaatcctagcaaaacccccaaggtatgtatcatagttctaccttattaagacttgaagaaagttaagaaacttgcccaatggcacatggtcaaagaggagctgggagtgagttttaggtctgctgattctaaagcctgtgcattttcattttcacacactcaaatcatagttctttaatcctgggtgttaaattccatcattagaaagtcatttgtgtttatcttgaagatgactcgttcttcctgcacctgggatgcagcctacattgaagttagagctaaattcctctaactgtctctacagagaataatttgacaaacagcacaacaggtgcccacagaagtggaattaggagggaaagccgtagtgtgggcagaggccaaggtgccagaacagagacgggtacatgagggcacctcagaagacaaacatggtctacactgcacatttctgaaaagctggccctgaacacacagcaacacagcaacagagctgaatggtgtgagatacaggttcctgccttgagcactcctgggtcaggacaatgtggaccatgtccttggagggccgttccattgcattatagttctgtgcttaggaatgcagttacccaggaccccaagaccagaggccaattccagtgcagctcctatatcaatgtgagtgaccttgagccagttgcttaacctttcagagcctcggtctagatgggtggcatactagtacctgtttcattagatggttggatagctcaacatacacgtgattatatagaatttatgcagtgcctggcaggagctaacctcaatacatgtcagctcttctcagaagctaattgaggaattggaaattggcatctgccctagaaaggatccccagggaagaggggctctccccaggtaagtttttctggcaggggcagggaacataatgagaaagataggacatcagtggggaaaagggatataaggatgaactcacttcccaaggtcagaagtcaggaggaggctatttactgcaagtcaccaggtcagtatgtagaccagattcatgtttgccctagtcatgcttctagaaaacctcccctgtccgcatcaggtgaaaagaacatcctacattcactctgccccctattcctgaggcccacacctgctggccaatcagtgactaatcagatgctcttgtaagctgtgcactgagagacagaaagctggccgctatctgtgggcctttaagcacaggcaagggagtgtcaggcatgtcggcattgtagcccacaggaccatgcaagactacagttacatgggtaagccagaactcaaatagtaggaagcgggttgactagcagagctatactataaaaggtagaccaggaagcctgctgtctgtcccagagagagatgccaataaattaagcagccagtcctcatcgggccctaatattggtaccaggggagcagtagtgaacaaaatagatacattctctattctgcagtttccagccttgtgggggaagacagtaaaccaaataattgcttaatgcagatttcattagatgctgataagtgcctgcagaacaggtccctggttggccttggccagcccagctcttccccttttattgcttatagttctcacaataactgttgaatgtgctaggaatgcaatatccggagataaggaggaactacatggaagagcgtgggctctggtcatgttcctccaagaagaggatgccctctaacactttagcacagcatgttatgttcccccagcttatgaaacttcagggcaggcagctttccaggctctctgaactggtgcaagcgggacacacacagacaggattctgtcgggacacacacagacgggactctgtcgggacacacacagacgggactctgtccaccctggtcagctttcctgaggtgggggcactggctcaccatgcagcccaggcttctgctgtccctgccaatctgtgagtgacagttgctttgccttgcttgtgcgagtgttctgtctcatcagattcatgtattctttcacttcaggagaaaagccaaatcttctgcttgggctcctttagaacctgtttctttcctctagcctagggagtttctcttgcttgcaacaaaatgatctccaacaaagaggcagggactggggcactggtggaggaagcagaagtgtagaggaaacgagcctcatcctgcctggttctccttacacagcggacaggagccaaggggtgagagggaggttgtggggcagatgaatggacctggggagaaggggcctgaagatggaggggaactggcccttgttctctaggttgctataggactcacccagccctgggggtggccctggggccctgaccaccctctagatgggaaaaggaggacaagggggttagggaggggctagatctgagggcagcagggcaaggaggcagagtatgtgggctcatcttccaccaccacaggaaggcagcgtcccatgctgttgtggggggatcctgccccatctcatcagccccctccccagggctcgtccaggcccatctgtgcacatttgcctggtcctcctggtaggagcccccatccctgtggggaaccattccctgcaggaagggctgcctaggggaaggaggtacagggactttgaaaccagacttctctctattgagggacctgatactctgtgagctttggtgtcttcacttgcagagtggctaatactgcctgcatttatgactgtcgccagaatgaagagagaaaatggtgtgtctaagcaagtcagcgctagcctccttcctccatgctgcatcaacacctgcttcctgtgccccttagcgtcccctggaggcactgggggaattccaggctcttgagttctgctccacgcagaatccacataccccagtgttcaaagcatgtctcaagctcttcaggcccttcactgtcctggccactcccatctgccagctcagagcatcatctctcgatatcaaacaaatctgttgtctcgcaccttctagagtttgtgtgacctctgccttttggatggcatcacagtgcatggcctctatctgcatggccctgagcacaccgtgtacctgattccatgatgccataagggtgaggtccataaatgctcggcaaagtcctctgtgaaactggttagtgacatctccagcaagagtaacaaggtggccggaaactgcatagtaggtgaggctcactccaaccacggagagctggaacatccaagagaaaggccctcagatggctcctgaggaagggcttacctggcaccccatgtgacacgcgtttgtaagttacagtcatgagtcacttaactacagggatgccttctgagaaatgcatcgctgggtgattttgtccttgggggaacattatagggtgcacttatgcaaacatagacagtcccacacacctaggctatatgagacagcctattgttcccaggctacaaccctgtgcagcgtgttcctgtactgaatactgaggcaatcatacacaatggtaagtgctggtgtatctaactatatctaagcatcgaaaagatacagtaaaaatacagtacaaaaggtaaaaaatgatccacctgtatcagcacttacgatgaatggcacttgcaggaccagaagtggctctgggtgaggcactgagtgagtggtgagtgaatgtgaagccctagagcattactgtacgctaatgtagactttataaatgctgcacacttaggctacactaaatttgtaaacacgtttttctttcttcagtaataaattaaccttagcttactgtaacccttttacttaaaaatcttttaatttttttaaactttttgactctatgataacacagcttaaaacacaaatgcactgtacagctgtacaaaaaatattttccttatatcctaattccaaaagttttttctatttttaaaaattttgttttaattttttatttttaaacttctttattaaaagctaagatacaaacagacatatttagcctaggcctacatacaaggtcagaatcaagatgtcattaggtgacagaaatttcttagcaccataagatcttatgggaccaccaccttggctgaaattcgtgtggtacatgacggtaactgtaacaacactaaatgatacctgatctcaaatgctgttttgagattaacactacagagggagaaaactgcaataatgttggcagtagctagtgcataatcaatttcttatttaaattattttttcaagatataaacagtttattgttatttttcaaaagaaaatgacacaagagaggctacctccagccagttccttggctttcgccagtagctgaggacgcccttgtccatcatacggtagagttgaacacagaggtggatcaggctgagtgccaggaagaccagctggtggagagaatgtaaacaaacaagatcaataggaatgctgataaattgttttttgaaggtctaaacatgtgaccagctcccctgccaatcacctttgagtagctaggatgcaagcccatttcctgttctgcagaggtttaatcctaaacttgctcttcagtaggcacttggggtgtttggtgcctctccacaagtcaagcactcacagaaactccatgccaggggttagaacccaagatggtctctgcactcagggaaagcacggagtatgggcatctacggccaccaggcctcccgacctccatgctgatcctccagtccttccttggcactgctcaaaagagtgagtttctgtgtacatgtgaaatagataacatatgaactatatatacatatatatactagttttctcagccaagtaaagtcttctaaagctcccttataagcactttcttaaagttctctatgtgattctctctccagtggtgagttacctgttgattcatgcctttaatcactaacccaaactcaaatttagttatggatttgcaaggaactgaagcacatcagcagggctttatgcatcttctctgtcctctgttggagttatgtgcattgtgtcccattggcccgctgtaaggagctacacacataatcaaagcagggttcacttttgggtgctgcaaggtgtttaacagcagtgctgtgctgagccttattggagcctgaggcaaagaaactatcaggaaaactgatcctgccattgcttacaatttccatattttgtccaatatgattttttgatatgaattctgatgtttataaatattgcaccagaatactgttcaccttgattaccaagtatttgtggtgccccttaaatttgatgcccaaggtaagtactttatgtgtctcccccaggcagaccctgaccagtggcccatgctcccaccctccattgcgcccacaccagcgcgagctgagctctacacaaatctcagcctttaccgggtcactgaacagtccctagagtctaaaacctcttgggactcccctctcttcactgctaaagcaaagtaaccttgacctgaagagtcagcaggacttagttcttcatagcagaaaagtcaactacaggcagaaaatcaggaaagttcccaaggaataactcagagtgacttctggtgttttggattgttcagtgaagctatgtggacatattccatctcaccaagaccctgggtactgtggactgaagatttgtgttcccttgaattcacaggtggaagccctaactcctagtgtggatatatgtggggatggggctcctaaggaagtaatcaaggttaactggggctctggtcctataggattagtgtccttacacaaagagactctagacagctctctcttgctctctttccctgtgtatacccacaaagaagaggttctgtgagcacaccgtgagaaggcggccatctcccaggactagagacctcgccagaacctcaccaggcttgatcttgatcatggaattccagcctctgggagtgtgggaagtaaatgtctccttcttttttttttttttttttagacggagtcttgctctgttgcccaggctggagtgcagtggcgcaatctcagctcactgcaacctccgcctcccaggttcaagaaattctcccgccttcagcctcccaagtagttgggattacaggtgcatgccaccatgcccggctaatttttgtattttttcagtagagatgggttttcaccatgttggccaggccggtgttgaactcctgaccttgtgatccgcccacctcggcctcccaaagtgctgagattacaggcataagccaccgcgcctggccataaatgtctctttttaaagcacccagtgtaggctattctgttacagcagcctgagctaaatccctggggggatctaaacatcaggcccaattcccccgtgatgaatttggtacctcaagacagctctatatttgcccttgccacacatgtgaagattggtttccccactgggggtcttcttcgtctcatgccccaacccttagtgtgatgcttgctgcaagaaggggatgtgacaaagagtgtgaccggaggggcaggtgaatgggtagggaactagtcctgtctggtggagaagcccagcccaggtgaagccccatcttcctgtgcacctccaggaggcccaagaggcaggtcagctcacctggggaagcatgaggtggtactgcagggctgagtcgctgcggaagatgctgaatgactccaccagggatgaggggacgagactccccgtagggaggatctccactctcagggacacgctggtgaagagttgggttggagggttatagagagtgaagtgcacagacacagccctggtgctgcggtcaatccacatgctggccctgagtcgggacagggctgtgtgggcttcagtcctgtaaaacagcacacactggggtagggcagggcagggagaaaggcacagaagtctactgaggctcccagctgcaggtcccatgctgggaacaccctatgctagactttgcaaggacacacagtgcctgggcttcaaggggcaggacagatggccctctgtatctaagagacctcatcaatagccctctgtcctctctccttgccccaccctcttccctgcagcagcccaggggaccctcaggcaggagggacctggagaacggaggcctccatttcccaccccaacccatgtgaggcagagatgtccactctctctccccagggactctagaatattcattgttctttttttttctagagaccccactgtttggaacaaacaagctgggagaaggcagttactaaatactaactcgtatttagtaacaattaaatcatttcctttttaaagagtattactcaaaggctcacattattgtaactgtctagacctccccgttgctctaagaccatccgtgttaccactgggtcagcacagctccaacccagtgtgaggtgcatgctgcttggggagccacgggtggctgtggacaacagtgtgactggctggatggggcaggcggcctgacctcagacctagctgcaacatggggtcgtgcttgttacgcacttgaacctccacccctcaccctcaggacatgggaaaagtagcacagggcctattccacagagctaggtgaggattaaatgagacagtaaacacccagcttggcacaaggtcagcatgcaacaaatgctccttatattccatgagctacagatgttctagcaaccactttttgaaagaacgtttgctctgtgctctcccacgtggaggcctgagcctgtgtgatgcttctatcattcacaacaatgacaagtctggctggagcccctggcagtggtgcgctgacctcgcaggcctgtcaggaggctgcacctgctgcagatgcgctgcgtccagcaggcaccagagctggagtggcggtggcaggcaggatgagccccggcccttcgaatctcactgaccttgttctgcccaggctgagcacacagtcctcccttgtcccacagcccccaggaccattcagggtcacgttttggttctctgggtctatcaggtaggggttctcagggcctccaacttcgggactacatgtaggaatagagtcttcgatgagtgctgaaaatggcctgggaggctgcagaacaaaccagcagtcagaagacacagatactattcccaaggctaccctgcaatccggggtctccaggcctggccacatgtgaacacctgctctgtcctgcaacatggcacccttctctcctcataggatcgttctgcagcctgtttcgtggtctacagactctagctcaagctacaggatcaaggttctacccacagaaggttggcatctgagctgtgtatggttctaaggcttagaccacttgaagacttccccatcatgagatgccaggtaaaatgcctgtctcagggcataccctccccattagaaaaagatatgtgaatattctatttttagattgtttgattaaaaatcctagttttgcctagaatgccagtctctaaggccaaagagtgaattgaagaaacctgcagcagaacgtcaaggaagaaagaggctttgggaaagtgttcataaaggggaaggaaggaagggcgaggctcgccctctccccagccccggcactgacaattccaattaccactgaactcacagagaagttcaaatgatctgccagggtcctgccccaatgttgcctagacttctctaattccatttattcttggaagcaaaaggaaaaggaacatcttaccttgcataaatgcctaggaaaaacttttagctgcctaattacggaactgcctattaggtagcattttcctccaagagctccaggctgaaaggagaaaaaagatgatgaggactgggtgtgctgtggacttcaaacctcctcatcaagcgtgctcaaaaggcgtggggctctgggtaactccacctgctaccatagaggtcagagttttattttccttccaataccattttagggatacaaccaacattctaagaaggcagcaacaacctccccagacttgtcctggaaaagggttaacgttcaaatggtgttcgtaactttcgtcacatgagaatgctctcttttatcttttttgaaagtttctccagtgtcatcaacccaagagactatatagaatacaacaaaataaaattataaataaactgctcaaggaatatggacaaatatatttctcttttttaaatttaaagacagagaatagctctgttgcccaggctggagtgcagtggtgtgacctgagctcactgcaatctccacccaccgggttcaagcaattctcctgcctcagcctcccaagtagctaggattacaggcatgtgccaccacgcgcggctaatttttgtatttttagtctggagtgcagtggcatgatcttggctcacttcaacctccacctctcaggttcaagcaattctgcctcagccttgcaagtagctgggattataggcacgcgccaccacacacagctaacttttgtatttttagtagagacagggtttccccatgttggccaggctggtctcgaactcctgacctcgtgatccacctgcctcagcttcccaaagtgctgggattacaggtgtgagccaccgcgcccaggatatttcatttttaaacatgggaaaggggttgaaaataaaagctgagcaaggaatgggattatgcaaaatgcatattaactttttcttccgaacttgggatcaacctcacctctttctggaagcttccttgcacttcctctgttttggggtggttcttgtgtttccttgtcagggtattttgcacacggaactagaatcttccatttcctgacctcccaccccatcagcctgagggctcctgaggctctgccatagcccttgtgtctatctcaggcctgggaagcacaggaatctggagaatcccgtgcagctcagcagggtgtaatgggatggggccaatgggttctggcaggaaaggaacaggatgctctgctgggacccactggagagccaccggccttacacctgcatggtcattcaagaacctatgcagtgctgcagttcagcattagtgactgtttcacccactgcaagatagcttttctgagatgatctcctatgaagaggagacggaaagctcacctgagcccccggcacacgggctgacggggtgcctcccgggtacaggccatccagaagtgtggtcagactccagtcccaccagtcagcgatgtttctcaggccacccaagcagtttctggcatttcttaatgcaagaacaaaaataaaaagttgcttctgcatcaacaagaacaatgaaacgtgagaacaaaagcatgttttcttgccaatttttctctcattcagatttcaggtactctgcaggaattaaactcaagctgcttgcagcgtgaagcatgaaaccctggaactcactttgctccttagtagcaggagataagagagaatggcgggtgaagcacttgttcatttgctcactccatcagtcactcaacaaacattactatgcaactactaggtgtcaggcactcttctaggcactgggaaacagaaaatcaattctctgccctcctatggggaaacaggcaacaaataagacaaataagcaaacatatactatgttgtgacaaatatgaaggaggaaaaaaaaaaagcaggaaagacaggcaagtggtggggtaagcagatgttcaagcagccatggaagcttcagtaggtggtgatgtctagcaaagacctgaaggtgagggtggagcccgtggtcatctgagagagggtattaaaggcagaggggacggcgagggcttccgcaagcctgaagggtgggaaggtgtcggggccacagggctggtgcagagggagcgccggggctagggtaaacaagggaggctctgggacacacagaccaagacccagtcctctctctgcactgactgccgactgggcgcagcatgtgactggcctcccaagatgcctgtgagtggcagatgtgaagacatagatgaagtgcagtgttggcacaaacactagtctgttttctttccaattaacttcttcattatgtttatagatatgcttcatttttccaccaaggaactgatttaagggagcactgaaataacatcaaatgaatgaaatttatcatttttagtttgctcagacactgctataaagccacatgcacaggccaaggctgtgcatggcagcagcagggtgtccatttggctctgagctacagccagaggcaaaaggataaaatcaagtgttcctacgagaaagcaaagtacctctcacctaactctaaaaaactttctcatacatagcttcccatgaagagtcactgaagaatggaaaggatggggtgctcatcaacatgccctcagcaaacagaaatggctctgatgtggctgtttcatccaggtttctctccacaaaaaggggagaccaaaatagttctcaggaaaaggaattttgtcataaggtgagaagaagttagaaagtcacccaagtacacacagttgaatgcctggtccagcaccagatccagactactccaaagaatgaacacactatgaatcattcagatgatggccatggctttggtaaacgaggcttgagagcaaagttgggctgtagacagcaggcctggagccgactcttactgtgagagccaattttgcacaactcctcccaactccatgttcagtgatgtcacattggtggtgtgaaagaccatggtggttccgggcgtggtggctcatgcctgtaatcccagaactttgggaggctgaggcaggcatatcatctgaggtcaggagtttgagaccagcctagccaaaatgatgagaccctgtctctactaaaaatacaaaaaattagctgggcgtgatggtacgcgcctgtaatcccagctactcaggaagcaggagaatcgcttgaacccaggaggcagaggttgcagtgagtaaagatcatgccactgcactccagcctcagtgacagagtgagacttcatctaaaacaaacaaacaaacaaacaaaaaaaccatggtgggaggatttacaccacggaaattggctggcagatgctataaatcagtgcttttgttctccagttattaactgtttccagcacaccacaaagactatgtttacaggtaaggtgtagaacggacactccactgttgattcagagcagattttgcagataatttagaaaaagtttttaaaaacctgatagtcatgacaataattggacaatattaaaaaaatcaaagacaaataaatgtcactagtgtatagagtaataaagagatgcagtagcctcaaccaataatctgtatatactataaatgtgttcgaaaatttccatatggctgggcacggtggctcaggcctataatcctagcactttggaaggccgaggtgagtagatcacttgaggccaggaatttgagaccagcctggccaatatggctaaacccccgtctttactaaaaacactaaaattagccagacatggtgatgggcgcctgtagtctcagctacttggggggctgaggcaggagaattccttgaacccgggaggcagaggctgcagtgagccgagatcgcgtcactgcactccagcctgggcaacagagcaaggctctgtctcaaaaaaaaaatttccatagcatgtatgagtaaaagtctagtgaattaatttatctgactggttttatttcttttttcttacgaagaaatgatctcttatcctttcaagtatttgatcttcattggtttatacatctttagaacttaatctttgcaggtcttttattgggtgctggttcttaactctggacttctctacaagttttgtcaaactatcaaatgcagagcaaattggaggcctgccagagcacccagagggtggaatgaagcaacagagaggcatcaggaaaggagaacacagatggagacagagatgggaggcataaggtgagcagatacatctctgcaaatattcacgccaaaggaaaggaagaatgagccagggggcacagagatgcagtgaaaagggcgggagggtaggaaagaggcaaaggatggctggaggtgaattttcaacagaggaaagtgttgagcatctgctgtgggaagcaagatgatttgacgacaaacattgtacatttatagcaactaatatgatccattttctgtgtttttaaagaataaagtatagacattatagccatgttgagtttgcaccactttcggggaaatggtatcacttcttgacacttgcttccctattggaataacattaagaaactaagttaaaaagccctgaaaataacccaaagccaaaaggcccaatggccagactgcagacatctcacacctcactcctggcacacccaaagtgcaggtagtgaaccaaatgagccaggagtattctggccctgtctgtattagttaccgcaattatataaaataagcccacaaagctggctaaacaatgcaaaagataaaatcagctgttattttacttttatggcacttggatagaacgcttgcttcattgattggtgctttatttgctggtttattttttgttttattatttttttttggaacttcatgaagtctttcataagttcagaaacacttcaaatacaacttaaatatggcaaaatccaagaacgcaatgactactcagtagtccagttccctccctttatagatgaagatgctaagtccgagcacttgccagagtcacctggcaaccaaacatgagttgggggcccagtctcggaactctgtttcatccatttccactcctgggcttatttagcttctctatctggaatgctagtaaatgccaaaccctaagttgttgttgatgtttcaggattaggtattgggggctagggggtgagacggagagggtccactttaaacattccattaccaaccaggatacttgaatatccctgcctggtggccagagcacccagaggcagtgaggttttgcatccctatgggaaacataaggtctatgtaaatccaggagttgtgaatgtgagcacatcaatctcatgtgcacctgagagatctcacaaacattatctcagctgcgatatttctgatttgaatatcaagaagcaacaattcatatgagaaatatgtcaaataatgttgacttgtgaaatgtgagatgaaaaataaactagcaaaagccagaggtttttcatgtttagatttccatttccattgaggacccaaattatcactttgttttgcacacagcaccacctactggcacaggctgtgcacttgcacggataggagagctgaaaagttggtcatggatggaaataactgctggtttcacaaatgaggaggcagaaaattccacttaatttcactattacaatgctcagcagaaaaaaaaaaacaaaacaacttggattactgagctacagaacacccagactcatagcactgggacttccaggtcttaccttacgagtgggtcacaacactgacaaaggggacaatatccattagccattatcttgctgcgtatgaataaccctctctcacaaaaataaagataaatatgttctgaaataattgataagattaaattgactttccagccactcacttctgccaaaaaatccaaccaaaaagtatttacgtcaaattgaattacttagtcaaaggcaacaaacacactgatagagttgctgcataaatgtgtctttaaatattcaccagagtaaataaggtaactcctggaacacactgaattattgtatttaccagcattgaaatcatagcaaagaaccaatattatttcatatcatgcactttataattcaaagccacactgccttgaaaggactatcagactgactgtttgtggcaggtgaaaataaagcctaaccatggattcaagaacaactctcaaaaaaaagaagactacattaaatgcacctgttgatgacaatatgcatcccaattttagaagcactgagacatggaaaagaaatatgacacaacaaaatgctatcatgcttgcctttgcctggtggtatcacggaaatttttctgctttacacttttcagttctgctagatttacctatgatcaacatctactacttatagaaagaaggaggaagaagcaaatgaacagcttgagaaatgatcaagaacttgagaggtgttagaaactgaaggccgggcgtagtggcgcacacctgtaatcccagcactttgggaggccgaggcgggtggatcacttgaggtcaggagttcaagaccagcctgacgaacatggtgaaaccccatctctgctaaaaatacaaaaaaattagccaagcgtggtggcacatgcctgtaatcccagctacttgggaggctgaggcaggagaatcgcttgaacctgggaggtggagattgcagtgagctgagatggcgccattgcactccagcctgggtgacaagagcaaaactgtctcaaaaaggaaaaaaaaaaactgttagaaattgagtgtcagttattacgaactgcaaccataggctttgatagaagaactctgaggtctccagcaaaaaagaaactgcaagaccctgttttggcacagaacttaaaattccttcaaatatccttgttttgctatttaccccaaacgagatgctaagaacgtgtccaaagtctgtgaatggaagggggttttattactaccagggaaatggtgacaatctttccagtatttcatatgtgggatgtgaaacatggggaaggtgcacacaggctatggaatagtgcaatggccccagatctggaagagttacccaaacctcctaccttgtaaattctttccggatagcttgattgagggagtattcatcttgggaaaatctcccatatattacacacaaaagcagaagcagcatgaggatgtccatggaaatgtctctgtaagaagagtttttaagttagcatccatacagaccctgtatgtaggtacctgagtgcttcaatttgcaaaagatttattattattattattatttttgagacggagtctcactctgtcacccaggctggagtgcagtggcacaatcttggctcactgcaacctctgcctcctgggttcaagcgattctcctgtctcagcctcccgagtagctgggactacaggcacgtgccaccacgctcggctaacttttgtatatttagtggagacggggtttctccatattggccagactggtctagaactcctgacctcaggtgatccacctgcctcagcctcccaaagtgctgggattacaagcgtgagtcaccatgccgggccagaagattttaaatgaaactcggcttttaaatccctgggagaaaatttttgtataatagtgtgagatgtgtgttggggtttatttatttatttattttgcatatcaatatcaagttttcccagcactttttttttttttgaggcaatctagctctgttacctagactggagtgcagtggcacaatctcagctcattgcaacctccccgtccccagttcaagcgattctcctgcctcagcctcctgagtagcagggattacaggcacccaccaccacgccatgctaattttttgtatttttagtagagatgaggtttcaccatgttgagcaggctggtcttaaactcttgatatcaggtgatccacctgccttggcctcccaaagtgcttggattacaggcatgagtcaccatgcccggcccccagcaccatttttaaaagatcatcctttttccattggatcatctttctctctctgccaaaaaatcagttgagcatatttgggtaagtctattcctgtgttctctattctgttccattgatttgcgtgtctatctgtccccaaatatcatgctgccttggtttctgcagctgtatagtatgtcttaaattcagatagtgtgcgtcctctgactttgctcattgttttcagaattgtttaggctattctagttcctttgctttccatataaattttagaatcagtttgtcaatatctgtaaaaaaaagcttgtggtattttgccgggcgcagtagctcacgcctgtaatcccagcactttgggaggccaaggcaggcggatcacgaggtcaggagatcgagactatcctggctaacacggtgaaaccccatctctactaaaaatacaaaaaaaaaaaagagccaggcatggtggcagacacctgtaatcccagttactcgggaggctgaggcaggagaacagctcaaactcgggaggcggaggttgcagtgagccgagatcgcgccattgcgctccagcctgggtgacaaagtgagactccgtctcaaaaaaaaaaaaaaaaaaaaaaaaacagctgtggtattgcattgaaactacagatcaaattagaaagaatagacttctgaacattactgagtcctccaatcaatgcacacagtctatctctccatttattcagatcttcctgacttctttcatcagtgttttgtggttttcaacatacagatcctgcacacgttttcttagacttacatccatgtacttcatttatttggtgctgttgtaaatagtattcctttttaaatttcaattgttcattactggtatataggaatataatttacttttttatattgacttgtgtcttgcaaacttgctaaattcacttattagttccagaaccctttttttttttgtaaattatttgggattttctgcaaagaaaatttatgtcatttgccattagatggttttatttcttcctttcaaatcaatacgtttttaacttctttctcttgcctattgcattggctaggacttccaatgtgatgttcaataggtgtgatcggagaggacatttttgccttgtttgatatcttaaaaaacattcgatatctctctattaagtatgatgttaggtgtcgagttttcatagataccctttattagctcagggaactcttttctattcctacttctagtcctagtttgctgagaggttcttttttttggatgaattaatgttgaattttatcaaatgctttttctgcctctattgagacgagcatgtggtttttcttatttagtctattaatatggtgaattacattaattactttcctcctcgtgtctcttccagtccataggtatcatctttatttatttttgcttctttgcgatttatttgttgagcaagtggttatttgtactatagatttctgtcttgctttccagggtgatatcaacatactcttactgtaaactacaagttggcaaaataacttcatcagattaagattggactgttttgggtaggttgcctcatagatgatggtgttttcccacgaggaaacacataatgtctgatgtttctctctctctccttctctcttttatattgaccactgttaatgagcaatgcccagattcattacttcattaaaactgcaaaaatggtcaggctctaattctattacctggtccccattcattagctggaattcctctctaaagagaaatatcccccctcctgttatgtggtttcccaggggtatggtctgtataggaaaggcaggctttcactggcttttataaagttggtttctgagtgtccaccaacattgatcaattacattgtgggtgttgttaccagctcatggctttagatagatttcatgaacttcaattcagtagtttctaatcttgatgtcaaattatcccatgtttgaccaatgtgagcctcttcaaactggcttcttggtcctctgacaatgactctagcagttattaattgctcccttgcctaagaaacattccaggttcatcttgtacattttccatcaccaacttcaaatcaggaatcccagttacttctaattctttttggtggaccaaatctaggtgctaaaagtgtgtgttgcttctgggctgtttctaggccttttcttgctggaaaaatctaggaaaatatttttaaaaacccacatgattccatacctatactttcaattcaaattcaggactgcagagttttgacttccttgaactcaaatctgtaccttctttctctcatatcaagaattccacttttaaaggataccaggaatgacagaattagaaaataacagaattcttcatttcctttaccccacaataaatcaacaatgaaaataaagatactaacgctccactaacaatatgattggtgaaaacagctttagagttttttcccctagttcttttccgtccttagagactaggtttatatggtcaaatttttaaccttaacacagatttaaaaaaatcttattccttctctccccataagtaactattattatttcctaaaggtgcctggattgcctttcccttgttttatttagggtgagcggatctacaggcacgcatattcttgtcccctttcattaagcagtgggcagaacagcatacccgctttcctctacctggcttccctcctgcagcgaatcctgcaggcctctccctaggagcctggaggggtagtcttcatgcttctacatagctggacactactacactgtgttcctgtccctccagcaagacgtgtgggttctttctaggatattctcattacaaaaggtcccacataaattggtttgtgtgtgggtatgttcatgttttacttactgtgtctgtaagagtgattgtaaaaagtgtggatgctggataaatcgtaaatgaatctatcattgtgtagagacttcaaatttcccccatagtggctgtaccattttgcatttacaccagcactgtgtgaaatgctctatttgacatagcctcactaacagagtatgtggtcacatttttggattttcacagtttaatttgcaattctcttactgtaagtgaaagggccatttgaacttcttttattctgtgaactctctgttcacttttccagtccactttttttttgttttaaagagttgctggtcctttaggccaggtgtggtggctcatgcctataatcccagcactttgggaggttgaggtgggtggatcacttgaggtcaggagttcaagaccagcctgacctacatggtgaaaccctgtctctactaaaaatacaaaaaattagccgggcatggtggcacatgcctgcaatctcagctacttgggaggctgaggcaggagaatcgcttaaacctgagaggcgggggttgcagtgagttgagattgagccactgcattccagcctgggcaacaagagcgaaactctgtctcaaaaaaaaaaaaaaaagaatattaaaactttgttacaagtattttttcctagtttgtcactgccattttattttacaaatagtttctttttacgtaggagttatttctttctcttcttcaagttttatgtaatccaatttacttttattttccctttttgtgtctggattttaagtcatagggaagttttcctcactgaaatcttagagaaacttatacttaagattatgcctaagtgtattttgttgtatttattatttgctttgttgaatatggtcttgtattaaatctctgacttttgcttgtatataaatatgatattggtttttgtcttttaattttataacctaatactttactagttttgcctgtttcctaaatgctttctctgggcctgttctgcttggtttggatgcttcccccagcagcgcccccagccaccccaccccagagggctacgtcctggcagagctgggtttggttagttctgagggctgagctggcccagcagctccagacctccagaccttgcactcacctgtgaacttgactctgcaaactcctccaagatgcgcccaccacactcccagtgaacaacacctacaggagcttggagttctattctcagatacatcaggtaccccatccttcccgccaccatgttccgtagctgctaagctatagggtgggtgcactctctggttggtccccacctgagtgcctttggaggtgtgtgtggtgggggccatctcatttaattttgttgtgcatgttttctatgggttttgtttttgctatcttaattactctatttttatgaggaggtttgataagattaaaaaacttggccactgctccatcttcctggaattcctctcccactctcctttaaatgtgacatcctaacacaaccgcagctcttctccttggaaagggatatgaaaatatttaaggggaagctaatggtgtgccacactgtatgaagggattgttttttaaggaagatggttggaagtgcttctgtgacatgctattttttaaaaaactatcagaaattcccaagtccttgacaaactacatgagaaagattggtaggagaccgaattcatgttccgaatttgaagagggattttagctagcatttagagaaggctccttgtggtggctgccatccagcaccaccatgatgggagggggatggtaccactgagagaaatgtgttggaggtagaagttggagagctttgccacagcatgatagttcttaaggtttgtgttttatctaaaagaattcaaaatattttatgagaaccataacacagctgtgcatatctgaatattaaacttatttttaaataacctgtcactgggctaaatccatgccctaagaagaggtgttgcatttatcttacagcttccacattcctgtgtgtcccagctggagaagcagaagtcccagaccatgtgctaagcacacgtatggggtgggatgaaatccaattgtgtgtgtgaatccatgctggattcatgaagctgaggcccagaggaggaagctttcttaatcaacttctcaacatgggcaaattgtggaactgagttttctgacttcaattctgtttccctgaattcctcccatctgctgggcagcacaggttgttatataaataaggatggctctggggacagcaaggtggtccccacctccactccccactcctccaggagaacaatctcccaggaggaccagcggcagtggggtactccctccgagaagggagctggagtggagcaagccctcccgacagaagccgccacccacctcagggcagcccgtgtgcgactctctctcctcatcctctgtctggtgcccctcagctgggccttggatggtggatgcgcccagcgcaggtggcgagcttgttgtcgggcagccaagacctgtcagggacaagagtgctgtgagctgcgggctggtgggtggaaggagagaggcccctggtgctcctgccaagccaaggaatgtgtcattgctgtgctgtgccttcagcctggcatttgggaacaaagaggtactttgtatggataacatagaccaggttgttggggaagggatcagagatgggggtagacccatttttaaaaatctgctcatgtcccaggcaagtttttttggcagggattgcagttgggctattacaaagagctgctgtacacgaggggtatgtctactactgtcaaattacagcagcaattatcttgggcactggcacagtattttctcttagagactttcaaggtatgaaaaaatcattttaaagtatagtcttagcaagaaatgacctttcttttcttttttcaaaaatcaattttactttcatactctgttcgtgacagggcataacagtagccagataagtgaactcattgtaggtattcattcattcaacacacattcactggatcaggcactggggacatctgaggaaccagagacagtccttcctcctagagactctgggcttctaggaacttgacagcaggaatgtgaacaatataaagctgcacatgcagagtgttggggcttaagttactcccttcagctgttgtgctgttctgagaaaggaacacgtgtggcggagagatccgtggggaggcttgggtgtaggggggcaccccaactctaagatgctaatgagccatgcataggtttggagatgccagcctggccctcaggatcaggctgaattcatcagaaggagcctcacctctgaggttgggatgatagaaagaaaatgaacaaactggcagcacagcagggcacagctgtacgaggggagaagaggaaggagagccttccaagcagaaaggaaagctgagatccaacaggtatgagggaacaagggcaacgttgcttctcaagagctaaggtgctgcagggcggggggtgcaggaggaaagggcaaggtgggccaggtttgggccccagactcccctttactgcagtgtagcctgggtctaattgcttcacctcatctttaaatggggtgcagggatgctgcctaattcatcaggtgttataaggaacaaatgatccgataaatgtaaatacagtgtagatgtaaaacagcataatgactagtacatagcctgtgtgcaccacccatcttcagcagcagcagccttggttttaggcagggctgagaggcctcagacaggtcctcagacatggagtttattaggatcctttgcgaggaggagggtggagatgaggagaggcccagaccggggtctgactctcaatgcactgggattgggtccttggtcgtaagtgacttgtggttattacaagagtacagaattgcacatgcatttcaggtgcttagtcaatgagcctgtgaatgtctttgcggtggccagcagacctctctcttccttcatatcattcacactgcccaacagaatgctacacatacaacaggcaaaactgaataaaagaaggaagaaagggagggaggaagggacaaagggatgaaggcagggagagaggaaggatggggaggagtacattttctgtgggttcactgaagggcaaatggactaaaagttctccaaaatcatggccaagaattagagttcttacttgcttcagtattttaaaatatgctcattttcttgatgctctaacttctttaggattggagttaaaaaaaaataagtcctatgtgttcatctatcatacaggtatgtgcaaagaagcataagaaattaagacatcccatgggtctccaaagatgcaacccaatctgaattcaaagcctacattcagatatgcatgatagaatataaagtagttttttaaatctcaatttgcactgcataggtaattttttttactttttcaacctcgcctgcacagtcaggaatactgcagcttgaagagaaggggaggcgagtccaggaacgttctgccaattcagagtccagatccctggtagcctcacataaagactcagtaaaaaagtggttgtcagctcttcttttccaagcaaaacccaaggccatgaggcatacctggaaggaaaaacatgacagcgcagagagccgccctatgtctgtgttcattccacacagagctgtcctcccgtcccctaatcatgaacaggactccatctcccagttttaaagacaccagtagtcactgccttggattcccagcccaactactcaccaggcatggccccgcccaagagacctaaattctctgagttcaatttcctcaaataaaaaacgtgggttaaagtggtaccctcctcaaagatttttatgaggattaaagaacaggcccatgtgcagcttagcacagagcctggctcctggttctctccaaccacagctgaaatcagggtataaagaaaagtcatacacaaccaaaatgaagcctctatttccccttcccatctaggtcccctgctgatggaaggcacttctaccatggagggtgtttcttaccataagtggctgggtgatgaaaatacagcagaccacggagagggacagcaggtgcagccactgcacacattgctcctggccaaacctgcccccagggaaagtgcagtggtcagccccctctaagggagcaggccacccagcagtcattgctgcctaagcacagggacactgcctgagagggcctatggcctcgccgtggcaggaagcctgctgtgggggtggtgctggacatgggcagtgtctttctgctcatcggaggggaacccttgtctgccaagaggacatcgacctccctgaagctgcctagtgggaaagagaaaggaaaacccaacaggcagatgaaacagagcacagagaggggaagggggaggaaaatgggttggggtataataataataatagcagcaacaacaacaaagctggatgctggcgggtgctccgcaggggcaggcatgatgctaacaggactgctttcatatttcagctgctcctccccaagccctaagaattaagctctctgatgttcctattttacagatgagcaaactgaggcacaagagaggtctaagtacctgcccatcctcacagagtgattcaacatctacagttgaggagaggggagagacgggaagaaagggccttggctttgaggctactctttgtggtttatgaaccacactgagtgaccctggggtctccgatggcgagtccaagctgtacaggagccagagaggtaccatgtgccggagtgacaggatcagaatctgtgacacatgcatcataatccctgtcccgaaggcatacgctttttcaaatgatgggagaccatgaacagtatattctagccagagttcctggctgggaacctgctcctctcaggagctctgcagctgggttccttccttccttgggtgggcgtcctgcagcttcttgtttaatatctggaccccatccaggcctgctgccatggcagagctggccaggccaagccaccctttgggatctgcataggattttatttaccccaggagatgggagggagaaatgagggagaaaatagcaatagtgacatctggagcctgcatctgatgagttcccagaaatgcagggatttgtttacaaatgcgagactttccatctgaggacctgaggatgtttgaaaaactctacagctcacctgtaggctagaaatcctgtccccaaactgcaggccaaagaagcggtcccacaaatggcccacactgcagagctccaccaaggctgaagggcccttgaccactggggcattagtccctccaaaccactgctgggtgctgcggaagagtaggacagagacaaggcagcttaagagacctcggcatctccatccacgcggagtgtggtggtgaatcttaggtgtcaactaggctgggtcgtagggtgcccaggcatttggttaaatgtgatttttgagtgtgttcggggttgggggtgtttccaggtggcattaagatctgaatcagcagactgagtgaagcagagggccttcctagccacaggcctcctccaatcccttgaggtcctgaatagaacgcacaggctgagaacaggggaactcctgcccgactgctgagctgggacattggtgctcacctaagggtctggggtcaggatgggggtggtgagcagcaactcctgccttgctgtgccctcagaaggcttttggggatctcctcttctgacctgcatagggacctatgggtccccaacatcagaggcagagaggtcagtttccatttcagaccccaaacaactaagcaggctgacctggaatctgagggtctgccctgatttggatcaagtcccacacaccacaagggacagggctgtgactggtcccctgcagttttcaaccttccctctctgctgtgtgatttccccagggccagatacaggaccagaaggttgccccatacagctcttcatacctctgggtgcagccgtcttagctcgttttctagcaactgctcttagaggcaggatgccatgtcaacctagggcaatcgagtacaacacctttcaacaactaagaagctcttgctgggaagctggtattaggcaaaccgagggacactggctgaacataaatcaaagaatgtgagctgtggccgggacagtggcgttgtcctaagccacaccttctccacaacctcatcggtggctggtctgccagtgtcagccttgcactcctgagtgctcccttccagcccaggccacgtgtccagtttgtctgggagggtcgtcggtccttgggatgagtttcccttctgatctactgctgatacttgtgcctacgctgaaggctcacctgcctgaagcttgttcactcacagaaaggatcttttttgtgccccactgtgtgtaaggtgctgtgcagcctgggcccaaccaaacatagctgcacgcacaggccttgccagtcactgtgaacaagcacctgaatccagcacacaaggacctgggctgagctggagcctcgagaaaaccatctgctcatgtaccatgtggctctaggatcccaaagccacacatccctgccaggccaggcccaccacagtctcctctttgccatcatttggccaccctcctaggattgcagcaggattcaatcaccctgggcacagccctggttgttctagggtaatccctgcctctaccagctcattgctgagattccagcataattggaagctgggactatcgttcactgtcattagcattaaaacatgcaaagcttcaaactccagaatactttaaaaaggttatgagtgtattattggcttttaaaaagatctgaccaaacttacgttaagtacctgccagaaagcaccaagactttggaggaaagctggacgcctcagttttgggtgggcccatgcctggtttttagatgagactagagtattcagtgacatttggcccaattgtgactctgcttgccctgcctctcccaatggctgcaggtctgctggactggcaggaagggggctgtggttgcaagccacagttaccttgagtgtggggagggcagcagtggcttttccccatcagagaagtcctgctgtggtcagccccatgaacctgcagcttaggggctggacaagctgtgccattgtcacttgccgccttcctttgggccctgccactcccagagagaatggctgatgcaggttgctagaatgacaaggtcatgccaaggttaatatctccacagacagggcttcacacgtgacgctcaacagtggtgtggcttgccgccttctcagaggacaggcctggcatgggcggggtgtggtgctgaggcctctaaagacttctgagggaggaagcacaggcagcctgggagccggctcctttgtaccccttgggggacggtgggtgcccctggggaaatgttggtggcctaacagcagctccacacagtcagggtgattgcacctggttctctgggaggcatgaccctgccacagaggggaatccagccaagagcaacgggttgaacaaagcctccaagtggggagggcgcagagctccggcatggtgtttggggtatggggggcacactgtgtttccagcagcggatcgagagtaccaccctcaggaacaggagtggtggagctgccgccagagagttagagcctggcaaacagggcaccatgtgtgccctcacaggtcccacaaagcagaatcccacgtaagcaaaggggcagtcacacagatctgaaaagcactatagcaatggggtaacgcagctgtgccattggaagctgccctccaactgccccgtgtcacaggcctctttgagacctggaacggagctcccagcactggggcagcttctctgagcaccctcctcacaaggaggtggagaagctcactgagcaatcaccccgagccttgctgctccacagtgtctctcccacggtcctgccggtatttactgagtagacacacagggctttctgaattcttctgggcttcacttccttcctgtttcaggcctctgctgagaccccttctttctgacccacctggagagccgggttgccatggcatgtgtcctgggaaacgggacctccctctagggaggacggcccccagccagcacaacaggtcttgcattgatcttttcctgtgtccgtctcaccttgagcctgacccatccatggccagaccatagccaagggaggatgccagagaaatctaattgtttgcatttcatgctagaagattagctgctgcgcataatgattgatttaccttgcgtggctcctgtgcgtctggtatccttccccaggaattaggacctgattcaaaaaaataaaaatccaatgtacgatgctttggggtgatacatttaaacagggatatgtttaaggattagcggggacactactttcttcagcaaatactcttccttcctgactcagccagaatgagtatttctgagaggataaggctagaacgaggacttttgttgatgcttcagtcctgatgttggcttgggcaaccctcacacccacttgaggctgccctaaggaaacatggcagcttgagaaaaatgtttaattaataaaataaatggcactagcaactagaaaatggattcactatccatctgacaaagacctactttacttagctggtgaaaagtatttagatgtccctcagaaaaaaaaggattttataaggttcatataaatgtgggcaaataaaatggacagatgacagaaaataaaatgacttttacacacattaaatgatgctcaatgttactcataataaacataatgcaaattgaaaacagaagatacaatttctacttagtagattggtgcaaaaggctcagccccacggagagtttctgagagttttaatgtacatttaccatggggtgcctcggtctgtgctcctcctctaagtgggctgtgtggctccactcgggcagaccccggggcttcctgcagaaggaaagaggtggttcgccaagcgtgttccccagcaatgaaggggctgctcaggagaacagggccatgaggacaagtcgcaggtaccttgctgagcctgaagagcagggacaagagctgggcccctggagaagccaggagggtacacaggagacccaccctgaaggatccaagggtggggctgacgtccaagtggggctgcaacaaagcaacagcagccattacatcaactcaatatgagtcccgcttaaaacgcagtcattgtgtaattacaaatacatgtaatgtgaatacatacattatatttaataaaagtgctctcttcatgaatcatgaattttaagttacaattcaattgattgattgattgattgagatggagtctttctctgtcgcccagcctggagtgcagtggcaagatcttggctcactgcgacctccgcctcccgggttcaagcgattctcctgcctcagccttccaagtagctgggattacaggcatgcaccaccacgcccagctaatttttgtatttttagtagaaacatggtttcaccatgttggccaggctgctctcaaactcctgacctcaggtgatctgcccacctcagccccgcaaagtgctgggattacaggcgtgagctactgcgcctggccacaattcaatttaaataatgcttcatgttcaatattcgttctaagaaaaaaatagaactatatatagaactgatatgatggatacaagcagaaggaatccagcaaaggcttcttctaccccaggagtgaaaaaaacacaagaaatcattttgtttcttcttatacaaatcgttttggattgaacaaatgcttgccgagcacccactctctaccaggcatgtgctccatggatggaatcatggctacaatccagcaaggcatcaacccacaaggtaccaatgaacagagaaaagtggttagtggtccaacatcagacaacatgtcggcttcaaagaagaggccgaccgtaggtttcctcaccacaggccctggtctatttccaggtggacggagctgttcccttcctgctacttgatgatatttctttatcctctttttacaaattctgtgcgctgttatttttttaatcccaccaatccataattgttattggatctctctgatacctggtgtcataaaggagccactatgcccggctgtcccatggatgggtcgctgacccccacctcggaaacggaccttgtcaccacattctgcagccacactacgacccagcggtgaacccggtgggctgggtgcatgaatggccatgatgttgtcgtagtaaacaagtcagttttgcctcagtccacgtcctgctgtgttgttttttcctcaggaaagagagggtctccattttaactgctgacactgatttggaagtaatttactacatctcatgaggaacaatcagaccagagttgccagtgcaaactggcatcttgagggaaaatgtggccatcagaatggttctacgttcttttgtccagaggatttatttaaaatctaaatgaattgccaacttaaaaaaaaattcaagagtgttctcaaagacaaccggctgccagcctctctggaaaagttctgctgctgggcctgggcacgagctcccacacagcagctgtccaccgagccagcagagtcagagctgtgcagggccacccagtgccacaccgggcagagccctcctgttccttctctggtccccaggcagccaggcttgcttcccctggtttaaacttttctcggagaactgtgagctttgttgatttcttaggcaaaaaggggccacagtgtagtcggatctggaagctgctataaggaaaagcgatggctctcacctgctcttgccctccagcagcaaccagggcagtgagacacgcgtagacgcacagcagggagaaggacacggtgaggcgcggcgtgtgcaggtagcggctggaggagggcctgctgtacaccgacagccagacatggaaatcctccaggtactctgtgaacttgcaatagaaaagctgaaacggaaagcaggagaagtgttccctgacatggagcatttctgtcagcaaagcaaagtactgttaagcagtgatcttctgagcagagaccacgagctttctggttcttccatcctagctgcttagctgtgtaccaggtgggctgtggtgcaggtagacagcactgcactccccacactctctggctctgctatcctggctggttagctgggtactaggtgggctgtgggtgcaggtgaacagtacctcattctaagcctcttgaagctgctcctccttcagccttcttggcagcccccttgctacagccacactgctatcacgctggactctggctcacctggccttcctctggcacctcctgagctttggcacatgcttctccgagcttcacctgcatgggtctcaaatgccttcactcccagcctcaggagaccttctctccagagcttctgatcagtctctccttggttctccttcatattcctaagagactttcaaaaacccctccactctcagaactttccctggcaacatagttaatttcaactgggctttgagtacactgagagtggggctgagtcacctccacctctgtcctcagtagcccacagtgtctggcacacagtgggagatacgttgtttaggaattgcactaaattttaagttccaattcaatttaaataatgcgtggggctcaatattgttctagaaaaaacaaaagtatatacagaactgctcttatggaatatgagcagagcacagaagcgaatgccagaaaaatcgtactaacagaatgagaatatatcttctttatgtaaataaactagccaacaagcaacgctcaattcgcagcacacacaagtgctcatacgtgactaaattaataagcctacatttctcacaaaaagctctcaagcacaacagctggaggataagcaacgtatgtctcccgttgttaactatggttcctcagccaaacagtcattctcacatggaaacagtcgtctaagaggaagccccagttgaatggaccttcagttttagatgttgaagaatttccacatgctgtggctgattgaaaacttgtttcaaatcctttgtgatcatgtttcttactagcttagcaatatgtcaggcctgaaaatgccaaggccttgagcctgggcctctcatcaacgcaggtggcaacagggcgggttggaaagaaagcccagtggcctggcaaggtccggcgacactggggactgtctgagttcactgggcttttaccactgtttgagacccagcttcaggaagtactcatcagggacacagagtcacacatgaaagttcccacaatgttgtcattaccataataaatgaaagaaagttataaatgcccaacaggtcttcagcaaatggtcatgcacagtgggccactatatagccctgaaatgatgttttaaaaattcatgaagagacctactctaaaatgttgaataagaaagtgcaaaatgcagctaggtgtgttggctcatgcctgtaatcccagcactttgggagtccgaggcaggaggatcacaagatcaagagatcaagaccaatctggccaacatggtgaaaccccatctctactaaaaatacaaaaattagccgggcatggtggcgtgtgcctgtagtcccagctactcgggaggctgaggcaggagaatcacttgaacccgggaggcagaggttgcagtgagtcgagatcgtgccactgcactccagcctggcagtagagtgagactccatctcaaaaaaaaaaaaaaaaaaaaagaaagaaagtgcaaaatgcatgacattatcatcacaattgtatgaaatgtgtttgtatatagggaaagacggaaaggacatgcaaaaatcacgacttccatggttagtttgtgaggttatctgttattctgtcactctggctatctcctgccatcctggacctgaccacatctataccacatctgtaattactctattgatagttatctaggttgtttgggacacacatagggcactgaaaagtctttaattacagggctctggacatcacagaccaccagcaaccataaattccagcaatgctattacaattacagagaagcattactacaataattaataattgtgaagggtaattaatccatgcttggatggccactcaatgaatgtatcatttaatattttgatatcgtggtaattaactaagaaaagaggaatacactttagaagagttcaaagacacaactgtggcaagcgaagcagagacaggtgccatgctctgccggtcagccaggtgcgccacgagaggccacctggagggagcctaccttccggaagccgagtcccccttgcagacaggtgagctcccgctccacgcgaccatcatgcctgccggcagacagccagcactgggcagggaagaaccagccctgtcccgtgtgcagctccttcaccatcacgtggctgatgaaccagcctggggaaggcccacggctgtcgtgccagaggcggatcttcctcagcaggcccagttgggcaggagcgctggaggcacacacagcagcatctcagccgggtgggtgacagtgtggtcctggcatcccatcagccccaatgctcaccctcaaggcactgatggcccacagagggtggatgggacatgtcaaaggtgactgacatgcagagtgacatgtgaagccccctggaacccggccagaggatgggaaatcccaccgagcacagtgaccctgcactcaggccttcaatatccaccagctttcccaaaccaaagttacacaaatctcgttcatgtatttgtctctggtgtggattagtctaaagttaaccttttctctcttaatgaagacataatactccaaacctataaatatcatacatgaaatttaccaggagaaaaaataatttagctcagtcctttcatattttctaagacgccaggtgcttgcatcctatcttgttaaattcactctttctccaaccccaccatctttgtgacaccatgtgtcacaaactggggacaaacctaattaaggtcagaaggtttagtgtcatagaaaacactgattatgaactttactagtatgtaaaatcagtaagtcttctttccccaccctccttccttccttgcctcgcataaacctattgtttaatctactcagaataataaactaaaaatacatcataaaattgtttgtatataaatcgatgctcactattagagaccaatgttatgtattctactgttttgtatttgtgataaggttacaccaattctgattggcctctctttcccaaatctagcagtgaaatattttggaatacctcaggataaaggtgtgtctggaattcctttcaaacaggggcttctctggacaggagagctccttggtttctgacagtccattgtcgccacataaaacaatgtacacctcaaaacaaagaacaggggtgggaactcaggctatttcacagcagacaccatgcaatgctgggcagggcttcctcgcactttctcccagcgtcccacccttcctcaaaaccatctgcacggtggagtgccacagcctagagccaggggatgagtgggcacgtccagtcccaggcttccctggagagccagaggagagcctcgaagtggagcctggtagaattggccatttcctcacctatttgatctagaaaagccagatcccaactaggattcgggagggcatttgttttctcatgagggcgggagaacaccacggtgggcacaccattttcctccctgtggtttggcagggagatgccagaggagcctggacgcagagtagggtacccatgcacctgtgggcacaccctggggaggcacatgacaatctggctgggcttgtcgttctcactggtatcttctgtcacacagaaatgaacaattctgatgtaatgtcacttatcaaattttcatttaagaaagatatttctgtttctgaaatccttccttactcgaaagtgtatattttctttgactagtttctaaactttgtgttttcacctttctgtctctaatgttctggagttcattttttgtgtgtatgatgtaaagatttaatagtacctttttctacaagggcagctattgttccaaaatattttttgaaacagtgcaccctttcctgtggtttgtaagacctctagtcttccctagaaatccctcctcagtacctctcccgaggtcatgacacgatctcaggtgctacagtttcaaaataagcctggatatcgagttgggaggcccctgccttgttcttctcttgagagttggcatgactggtcttgtaattctcttgtattcttttctacctgaattttaggatcagttttccaagttccacaaaacactgtcctggaattatgaatagatttaattggatttaacctcattatgccttaggttttcatttgtaaagggggtatattaatagaatttcattcacactattattattaatgttatagattaatttgggagaaatgacaaaggaaaatcggctttctcatccatgaacatagctctttatttggatctcttatgcatatcagggatagttccttcatgatggtcttgtatgtggggtttgatgaattcacttctaggcaccccaccattttttactgtgacaaagaggttcttgttttcaactccatgttataaatagttattgctgttttatagagattattttgatgattttttcttaatcacaaattcagcaagtttctttaatgttattagtgctaatcattagagtgaagatgcttcttcatttgctatgtagacaacctcatcctgtacgaagaaccatctctttctcccttttggaaacttatattcctgttttatttcttgctttattgtttttaaccaggatttctagtacaatgataaatagcagtgctgacagcagacatcccttagaaatcatctaaagcttcaccactaaatcttcctttgttaggttaagaacattcctatgtgtatgcattgcttgtgaatatatacatgtatgtttatctgaaagacaatttaaatatacagttggtagacgaagggcttatggtgagtaaggaccacataagctttaaaaatgtgttgtgtccccatctatcctactgcactgtggcaccccatcttattcatcctcccatctaactctttctcatccacaccccaatcctattgcttccataaagtaaccatggttccctcgggaaatggaagcgtgagttccaagggcagagggagtctccctctctgagggatttgtgtcacacgcacttcgaattgcacatggctctgccgggctcaatttctgcccctgcagacctcacctccacagctcaccgcggcacccctgctccactgggcccagtgctagactatttcctcctcctccaccgcatccttcttcccaccccatcttcatcctccaccagcttctctgggactgttgtcttcagccccaagctcagaagagtacaactcattctcagagtctcaaagatccactcagagacagaacatatctccccgggctgctttccacagtggagacagaaggagaagggattggagcagctgcagaaggtgaaggggtctgctcttcaccctgacagatgtgcaggccaagggagggcagtggaaagggcgggcaagctttgcctcagcaatgagatgaggctgctgtgacaggtgacagacggggcagccaaatcaccaaatcctcacttctgatgttgacactgcttagacaccatcaaagagtacccccagatgctcgagctacctttgaggtcaacctggccggagctcggaagccagtgtcaatgacgaccgcatatagctgatggcccggcagggaagcttcttgcagaaagatgtaaccagctttctttttttcatgatgatctacttgtctacttttagcgaccaaaaatccataaagaatcacagaacccataataaaaatactgggaagcaagttttctgggtggctataaacaaaaggagagatataaagaaaattgctcatgaaaatagacatataggaaaagactgattgccacccctagccccttacacacaaaagtccctgctgggcttcactgatacatttttacacttgctggaagctgagttagaagggctttgaaggcagggagctggcctgtggtccagtgagcagcaccccacaagcatggactccagaaccaaagaaaccttgtaatggaccagcctctgtgctaggtggctgtgccatgctgggtctgaggaactttcattgtgaactatggctaagaatgccagtctcgctgctattgtaaagattaagcaatacaaatatacaaaattcttgaaacatgcaggtgccattatgttcctccctctctccctctcctgctagcagaacaaggctaggaggcattggcaatgttttggagaccctgcctgtgcctcccaccgcccctgtggatggtgctgcttgttccctacctgtagcctctacctacctgttcccaggcaccaacactggctggggtgagatcactgaatgcccacagttccgtagaatgacattcatatcaagctgctgtgcagggactctaacctaactggagtcttacagatttgtgatgggatctcagagggtgggcaccagggtctatgtcacacggggatgttgcccgccccatcccctagcattctgctctttgatttaatctgaggattgggctctgctcttggtttctcacctgccctcttttttcccaccaagatagagcctgttcagagctctgccccacgagctctgcagggtgctcacatccttccacctggacaatactctgaaacctttcggattctggccagatagcccctgtagaacttcaggtgttgcctctctctggacatcttccagggctgcttcccccatggtttgccccagccccagtggtatcaatgccgcagacaccatggttgaggctgctgtcttctgagccctgatcactgaatggccagtgacctgttctgcacccaacatctgttgcattagcaattcatatcttatttactaattatctggtccaccaactagtctataaagtaatacgattgatgaaataataaagtaaggtagagtttcttactatatgaatataaggagaaaaaaatttaacactcaacaccccagaaaatgcagactctgccctagatattcattcagcaaatatttactctaagcattgtattaaatgtagggtgacactgatgaataagacagggaaggttcctgtccatatcagcttacattcactttactcatatctcagagtctaaatataaccatttcatataaaagtggctataaaaatagtgtacattttaaatctattatctaaaatgggatactccagagagagaaagagggagctattaataattaggctgtgacaataaacataaaccaggacaggctctttaggtattattgtcactgtagatatcaaccctatcaataataattgaccaaattcacactgaactaaaactaaacttaaaagtatgaaaagtatgttgactttcttgtgtttacaaatctctcatcagtgaattcaagtatagagagacaagatatataagtatatattcaactatataatatttaaagataattatctactaatatgcacatttcaaaaatgcaatgatagtaagtaacatggatttcaagcacccccggaattatatgtgggcatcctgagtgaacagtaaaacaaataaagtctatgaagtctttatgtaggaaatggaacttacctctgtagcttggaaatgtcactcacttcaaaactggccttcagctttctccttaggagagcgaatgccgcgaggcgatggtagctaggagggaaatgcggatgaggatacagaatgtgtggagagagcagctgttgacagtgtaatggcatgttggttaaaggaatgagaaaaggaagaaagagtgcaataatgataactttatgactaagacccagtttaaaagattcacctgacacctaagttagaaatgagggacacttctgatgtgccagagttcttcacatctgcgtgttggggcacatggctcccatggaggctgtcctgagatgcaagactccacagcatatggcggtcttcatgacagccctccacagcatggctgcagcctgaggctctcgggtcccagtcacagcctagctgtgctgctggtcaagctctggccaactcctctgcctaagcaccagttcctggcattacaaatatcctaccctgacaatcactgtaaacactgtctccttttttaaaaataaagtctatctcaccctcattatcttgtgagcaggtcctaggtgttattgatttattttaaattttttgtttgtttgtttttgagatggagtcttgttctgctgcccaggctggaatgcagtggcgtgatttcagctcactgcaacctctgcctcccaggttcaagcgattcttgtgcctcagcctcccaagtaactgggattgcaggtgtgtgcccatctaattttgtatttttagtagagatggggtttcgctatgttggccaggctggtctcaaactcctaacctcaagtgatccacctgtctcagcctcccaaagagctgagattacaggcatgagccaccacgcctggcctgttattcatttttgtacccttggctcataaaaaagtgcctagcagagagtagttacgtaatggagaatgaatgattgcattaatgcatttatcaataatttaatatggaagcaaaatattgggccattaccagtaagtttggatgtgctcctagcaatggcattagaaaaatttaagagtgtaacataagaaaatcaataaatggctatgaattgcactgctacggtatgatctggatatatttgcctcctagcaggaaatcacaaaatataatgtcttatggcttatttgttttttaaaaggaaatgactatttctgcttctaaatatgactaataattgtttatcctaatgaaaaggtaagggcaacaaaaaagaatgatctgagcctcttatagaattgttagtctgtcagctagatgacaaacaatttctaatttagtgacatgactcatatgcccagaaattcctgaggaggctgttcatgtttgcgcagagacttttcttgcctcagaaagcacaccttcaccaccaggctgtggagggtcctctgaagatgagggactctcagggcaacatgggggcatggtgagagctgagggtcccacctgcctgactacaaactgcgtactcaaaggatgtcagcacttctatgataagaaaactgacaggttcatctatcactcatccaccgactcatgtcttcaacagacacttactaaacacctcctccatgacagtcggtacgggaaggaggaatacgaggacagtctataaagcagcccttgctccttgggagcccatagagtgggagaaccaaggctgacacacgaactggctatgagagaactgacacaggctggagagttgtacaaaccaagagagctccagcttcttatggacaaggttcaggaaaggctctaggggttgggccaaatgcagaagacaaggcagtcatttactaaaaatctcagattctttctcaaatgtgtctatacctgcagttcactttttcaggagaagtccctggttgtggagagaaacgttcagatttccactctctcttgtcccaaaacaggcatcggatccactggaaatgtactgtatagttcactgccttagctaaatatctgtttggaggttttctgtcatagtcagcatccaataaggataaatagcctacactggcatctaaaaagagaaaacataaataaaaagtacaacctgaggtttgcagaaaggcattctccatttcaaacgcagacagagtaggcagataggtggggacaaggactacagatgagcaagaactgaaagacagcatcaaattctagccatttcctgtccccgaagcatttaaatttggattaaatccacccagtcaaagctcctggatgcagatacgaattgaggaatggtagagaattgggaagaaaaacagtgtttctagcatcccgtatgttccaagtgccccctgacaccctgaacaggccacaccccctgaccttagtggggatggaagagggttgagtcagtttctttagctgccattcaagcccacttcctgctcctcgccagtttgtcagccagcctgcgaaatttcagtatacccagggtctaaacccattctggtaaggacagcacaatgacccatggagttttagcctatcattttttttttatgtttagcctactttttatatttagaagcagaagtatttaacattctacttatttaaaaattgcccaagactttttaataagtggtgttgggacaactagacattagccctttgtaaaaatatgggcacctcatgctataaaaaataataataaacattagcaaatcagatatctaaatatgaaagaaaaaacaaaaacaaactgcacaagtactgaggaacacatgaatgacttcttttataatctggacataagaaataaattttgaacgatggttcaaaatctaagagtcttacaagaaatggtggataaattactattttaaaaatagccctaacatataaagagctcttaaacatcaagaaaaaacaaactcaatacaaaagtgggcatatatgaacaattcacagaaaaaaagtggataatggctttaaatatatgaaaaaatacccaacttaattcatataaaatgcatattaaaatgaacatttctcaattataagactggcaaaactcaatagcttgaaaatacatccttttggcaaagacgtgggaaaacaggcagcttcagacactgctggaggtaaacgtgacaatacttaccaaaaccacataggcatttaccatccgacccaggaacagcctatctaggaattaaacttgaagatacactcctccccctacatgtaatacagtatatgcacaagtcttccatgtgaatacataggagactggctgaataaactacggtccatctatacaatggagaagcacatagcagttaaaaaaaaaagatatcgatgaataaatacatacggagtgatttctaaatatgtaatttaagtaagaaaagcacaatgcaaatgagtgtaagaaataaggggaaataatgtgggtatgcatgggcttattttcccaaaaagaaacatcaggaaaacaattcccataaaattataatcatcgaggctgggcgcagtggctcacgcctgtaatcccagcactttgggaggctgaggtggaccacctgaggtcgggagttcgagaccagcctgaccaacatggagaaactctgtctctactaaaaatacaaaattagccgggtgtggtggcgcatgcctgtaatcccagctactcaggaggctgaggcaggagaatcacttgaacccaggaggtgaaggttgtggtgagccaagatcgtgccattggactccagcctgggcaacaagagtgaaactccagtctcaaaagaaaaaaaaaattataatcattgttcttcacagaactagacaaaacaatcctaaaattcatatggaatcacatagccaaagcaatactaagcaaaaggaacaaatctggaggcatcacattaccagacttcaaactatacaacgaggctatagttaccaacacagcatgctactggcatagaaataggcatgtagaccaatggaacagaatgcagaacccaaaaataaggccaaatacctaaagccaattgatttttgacaaagcaaacaaaaacataaagtgaggaaaggacaccctattcaacaaatggtgctgggataattggctagccacgtgtagaagaataaaactggatcctcatctctcattttatgtaaaaaatcaactcgagctggatcaaagacttaaatctaagacttgaagctgtaaaaattctaaaagataacatcagaaaaactcttctagacattggcttaggcaaataattcatgaccaagacccaaaagcaaatgcaatgaaaacaaaaataaatagataggacctagttaaaccaaaaagctccttcaaagcaaaagaaataatcagcagagtaagcagacaagcaacagagtaggagaaaaaatttgcaaactatgcatctgacaaaggactggtatccagaattcataaggaactcaaacaaatcgcaagaaaaaacaaataaccccatcaaaaagtgggcaaggacctgaacagacaattctcaaaagaagatatgtaaatggctaaaaaatactcaacaccactaagtaatagggaaatgcaaattaaaaccacaatgagataccatcttactcctgcaaaaatggccataatttttaaaagtcaaaaaataatagattttggttgtgtatgtggtgaaaagggaatacttttacactgcctgtgggaatgtaaactagtacaacagaaccaacctaaatgcccatcaacctacgagtggataaagaaaatatggtatgtatgcaccatggaatactactcagccataagaaggaacaaaataatggcatttgcagcaacctggatggagttggagaccattattctaagtgaagtaactcaggaatggaaaaccaaatattttatgttctcacttataagtgggagataagctatcaggatgaaaaggcataagaatgacataataggactttggggacttaggggtaaggatgagggggtgagagataaaagactacacatagggtgcagggtatactgctcgggtgatgggtgcaccaaaatctcacaaatcaccactaaggaacttattcatgtaaccaaaaaccacctgttccccaaaaactactgaaataaaataaaataaaggaaacaaatgaaaacaattacctataaggactaggtgataacaaggtataagaataaggctgttgaaagatttagctctgaatacatacatctttaaatgtgctttagacatctgaacaataaaaatgtctcacaaattcaaaacataaattaatgttaaaaaatggggacgggcgccgtggctcacgcctgtaatcccagcactttgggacgccaaggaggatggatgacccgaggtcaggagttcaaggccagcctgaccaacatggtgaaaccctgtccctactaaaaatacaaaaattagctgggtctggtggtgcatgcctgtaatctcagctacccacaaggctgaggcaggagaatcgcttgaacccaggaggcagaggttgcagtgagccgagatcacaccattgcactccagcctgggcaacaagagcaagactctgtctcaaaaaaaaaaaaaaaaaaaaggataaaagtaaggcttagcattaagtacatgcaaaaaagtgaacctagctgtatataaaacgtatagcaaaaacccacagagaaaataattaattcaactaacttttgactatgtgctcttactgtaatatatcatgtaagaatgtaaagtcaaaactaaacaaaaaatctagaaagaaatattgaactttatctggtaggtttgtgattgttaggggtacaggtgctttaattctaaaacgatttggtgtatactgtaggatagagcaaagtgaattttgctctttggaaactggctctcaagttctcatattttggcaactggaattctcactgtaggagaatggggatctgaacacacaatgggagaaagtaataaggaaccctgggtgttggatttgaattaaggcattgtgattaactcattttacacacacatacacacacacacacagacgttaaatcagtgacgccccaatagcaatgagcaaatgtgatgcgcagttcttgtgttctaatgtcatttcccatcaatgagccaagcctcattgaggacatggccggttccaaggaagggctggccaaacacaggataagccaggacacgctggtgtcccagaaagtaaagaagcacttgaggattgtgatgtcatgtcaagaaaacctcaggaagcatcttggaggagctcccactggaataatttgtgcatcaaaaagtaaaataatggaggtgaactaaacacattgaattttttttttaacacattgaatttttaagaaacaccatgcaccatagagacaagagagcaagagtaagacagagagagactgaagctcttctttactgaagaatgccagctaattcatggtggaattagcaaatcaccgttttgtagccttctatgtacctatatcacccatggatccttaaaatcatggggtgacagtttgtaaggcaagaagatactaaggtggtctcaaaagtatcatctcacaaaggggaaaatggagagattggaggttctttccccaagcaaattaccaaacttagcaccatcgcctatggaatatgctgccaatcatctgtgaactgaatttaatcatgaggaaacagtcaggcaatttcctgaatgtacaacatgcagaaaataactaacctaagctcataaaaaaaagtctgaaaaaaaggcaaaaattgggagggtgttgtagatttttaaagggactatataaaaacacagcaacaaaatgcattcatgaactttgacctacttctgattaaaaaatataaagagctatagaaggcatttggggggattttaaaaatttaaatgtggataacagaatagatattcttgaattaatgttgatttcttttccttatgataatgtactgagttttgtagggaatgcccttgttttcatgagatgtttaagtattcaggggtggtatgtcatggggcctgcaactttctctctaacggcttgtcctctccctcaaaaacatcccccacccacatgtgcacacctgtacacatgcagataaggcaaatgtggcagaaatcaacaaatggtgaatctcaaggaaaaggatatgggtatatgttgtgcgtatttttctaattttctatcagcttgaaattacaataaaaactgtgaaaaagaacacatgaaatgcaacattaaaaaataccattgagaatttgaatttgatgagcaatacagtttgattcatttttaaaagaaacaaatactggttctcagaagaaaataactatatcccagtaaacatgtagagacaatgggtctggcgcactcactgacagtcagaagccagctcctctccagggccagggcctgtggaagtcagtgtaaggcgcgtgtctggtgagttgcctgtgggtgccacttcagcccactgagctccagtttcttgcttttttggggaaggggttactgaggctcagaatcctaagccaccaggggcagaccacggagaaggggtgagccccaaacttcacactctgcccccacactgcttcagagggggtcctgtgccctattgatacgtgagacacagagacgtctcagaagtcctgggtcaactctgaggtcagggaagctcagcagaggttagtttgagggaagcaaggcaggagggtgcttcaggcaaagacttagcctgagcacaagcagagccctaaggatcaggaggaggcgccagagaccacctgggaagagatgggtagggcagtgagcagcaccagccactgcatcacaaggatggcgctcatcatggggcagtttccatgtgtgggatctatagtggagcagtttgtttataagcaagcagagaaaggattctgatgtttttgtcatgaataaagaaaaacaccactatacatacaaaggttataggggatgttttaatcatgtaaacagaaagggaaaataaggcgccctgttcactgacctttctgagaagcagcaggtatataaatctgcacaattgactcatcccagaagtagatctgcttcacaagaaaatcagagggagtaggtttctcagagaatctaggagataaaaacaaaatagggatttctcatttttttcttctctctcaaaggttttagtcaaatttctatcaagagtttactcaatttgtgcaaaacatccttgtcactgcaaggaggtagcctgggactaaaaagggtcaatgtgcttaattccacaacaccacctggtctcttagtaaaaactcctacataacactttcaccctgcatctcattaaaaacaaacactttggccaggcacggtggctcacacctgtaatcccagcactttgggaggccgagatgggcggaccacctgaggttgggagtttgagaccagcctgaccaacatggtgaaaccccatctctacttaaaaatacaaaatcagctgggcgtggtgatgcgcacttgtaatcccaactactcgggaggctgaggcaggagaatcacttgaacccgggaggcagaggttgcagtgagcggagatcacaccattgcactccaacctgggcaacaagaatgaaactctgtctcaaaaacaaacaaacaaacaaaccaaaaaaaaaaaaaaaaaacaccaaaaaccaaacaaacacttcagtagcaaacaagtacaagaatggccagcacagtctgtaggaataagacaaacagcactggctacacgtggttagggaggggcactgcagcacccacacgtatgtttgcatgtttgtgttaactctttaccgtaacctgtttgcagataaaagatagcaagcacaaaactagactaagtagtagtcttagtagttagactcagaaattcctcagaactgatttaccttttctgcatgtgacttaaagaattaaattaaaatccaaactctaagcagacagccacttttagacatcgaatgcttagctcatttggcagaatgagagtcaggccaataagcagagattaaactgcgtgctaagggctgtgtggacagcgcctgtgtaagatacagccttgctcacgagaaccctttaatctagttgagatgcccacctaaccaaccaggagcagtagaacagtgagcatctttgccacatagactaaacacacggggactccgagaaggaaggtgatcaaggccctgcccatccagacctccaacgaactctgcagactggtggtttccattagcacatttgctgtagaatttcaaagaatcttttcaatagtcacttaccttcccaatagtcaattaccttcccaggtaatttatttattaactggggcctatacaaatctcatgaactcaacattcctgagaaaaataattattttatgaagtttccttagatatataaatttaaacacattttctccttttggaaaaataaaaaaaaatcttgctcagacctatactgaaagaattagatttctaaatgagactgtatgcattatcactaataattataatgcttctcactctaataatgttaacaggcaggaattcaaactcaaaaaccaaagtcaggaagcttagcatccaaacagcagaatagataacaatttctttaaacaatgagcctcattattgctttaaaaacacaatttaattcactgattttttgtcacaaaacattcttaaggacaatatgtcttactccaatctcattgtagctgtcaccatcaacacaccttactagcaacatgacgggaaatgcccttgtaacaggtttggaaaattcaatttctatctgtagagattcctgggggttttcggaaagctcagtgaactgatggagattcactttatcccgaagtaatacaaatgtcgttttatttctcctattatcctgtcatcacaaagaaaacaagttaagcaaaatttgcctttggtaaaataaacacattaaaaatcagccagcacagcctaaatgaagtagagatactgagaaaggctctccttaccaggccatcctcctccccaaactcgaccatcacgggtttccttagccattgcctgttgatgggtcttctgctggagcaggtatagaggttgaggcccacaactccaccaatcttggggaacaaagaccatctcagagcaaatgacagcaagcaatggacttaagtgagaaaagcagcaaaccaaagtatcgtggtgctgctattacacttacataaaattatatgcctgatattagaagctagcatacaaaaataaaccagttttactagtcaggatggcaggattggagtgaatattatgcttcatttgcatcattcttattaaaattaataatttctaaagtattttgaagtattttttattttaaaagctaatgcaaaagaaatatctgctcattgtagataatcaggaaggtatagaaaagtatatgcaagagtggggccgggcgcggtggctcacgcctgtaatcccagcactttgggaggccgaggcgggcggatcacgaggtcaggagatcgagaccatcccggctataacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaaaagtatatgcaagagtgaagaatagctattctatagtcccattgctcatagaaatcatatttcaggatgttgagtatcaaattttgctatgtaatagagtacatatttggcagacaatttagttgtctatatgtatatctatatatttttttgacacagagtcttgctctgtcgcccaggctggagtgcagtggtgtgatctcagctcactgcaacctctgcctcccaggttcaagcgattctcctgcctcagcctcccgagtagctgggactacaggcacgtgccaccacactcggctaatttttgtatttttagtagagacgggtgtttcaccatgttggtcaggttggtctggaactcctgaccttaggtgatccactcgcctcggcctcccaaactgctgggattacaggcgtgacccactgtgcccggcctcagttgtctatatttttgcagtcttcccaaattactaaaattccctgattgacataataacaattagctatatatgaactctatccctatgctgaacatttaggtacatttctatttgagttataataatattgttttgagcaaataaatacgacaagacatcttgttctgaacaaatcttttctcattttcctagtgtagattcttacaagtgtaacagtgtaggccaggttgttgctggatgcctagttgacaaagtgctttccaaaatgtcacactgccgagcaccctggtttactcactgcatctccacaagcagtaagtgtttttaagtaattgcacttttgtaaggtaaaaaaatcattttaatttgtgttttttattgattgttagtttgaattattttcctatgctgattagccatttccatttccatttaaaaaagcaaatgctgtaaaagatgagcattttttgaccaaaataagatgtacctaatttgtccatacatccatcagacatttgatgggtcaccaaatgagccacgtacttgagccagactggggtcgggggctacagaaatagagaatccttgctctctgcccttccaaactcactcatggtgaccctggggtcattcacaaagcttccgagtgaatgtctacaaaactgccaagtggctgggacaatcctccctgacttccccatcctcacatccccctttcactgtggtcccctgttcctcctgacctctcagggagccaggggccaccctgcaggttcagcccagcagtgcctctctggtgagcagggaggatggggggtaagcactgccatgtcctcagcagccccttcttaagcgtcattcaggtatactccgcatttgatgttagacccatatcttcatcgttctaaagacacgattggccagaatgcttgcataatcactgcatcacatgctgcaaccccctagagccttctgttctctgacaatggattagaaggcctcaaggaaacagtgaatgggcccagtgtcccagatacaagtgacatctagttttgccaggagttttctggagaagctaatcttctaagaggagtagagtcagcaacgtgttctaagtgatccctcttggcactgagagggtgcaaacatgcaaaaaacaggtgcaaatatgccaacctagtttctctttttgtcatttaagcccaattactgcaaatttgaaatggtcattagaagtggcaggtcatctgtcagcttgtacctgcccaggagcttggctccctggatatgggttcttcttgaagagtatgagctggctaatgtagcatgggctctgtgtctccgccccagcaggactgtgcccagcaaggtcaccaggtaaatgcacctggacagatcccaggctctggacagagctctgaaggttgtaatgaagaagggtccggaactccatctgcccagtgctaacatggttcaaagagagacaaccctgaaacatagagcatagggagtgggatgtttataacacaaatgcacaaactgtcttgaatccagactaggagagaggggaaaagtagttaaaaagcccatctcaagttagattggatggcaggaagcaagagcgcaggtcttagggctcagcgctgggtaagtaggcaacaaatgttcttaaacacttgtgagtaatgatgatgattattagtaggttcagatagactatttacttgctaatttcccaaatgttacagtagccatccgttaaataagccagcaggactggagagggatgctaaattggtagaagaggaacgccagaagcctattcacttactgcttcttgaaagcactggccatttcataaagtaaaaataaaaaagtctcggagacaatttccaaagttaccagagcagaaataaatgaaataaactttggcctttttaagaagttatgtatcagcagggctacttttaaaattgctgcatgcaataaatcatttgcattacttcacataattcctcaaaaaaacagaaggtatcctgagaaataatgtttctgagtcaaacatcccaaatatcccaaatgaaaatctaccaaaacaaaaaaaggataaaatagaagcaaggtttcactggaaacattataatattaccatgaaatacttaaaattcaaaatgaaagtctccaaataccaaaatgccacccagaagaatgaacacagtacttcagaaactgattctgtttttggttttgagaagcaattacaaatacaggttaacatcctgggatatggaaacagtatttttatggatggagaaaaagtgtgacttaccaacaataaatctgagatgactgtaattccttcttcatgtcgatagacttcctccttcgagttttcttgctcagagacttcccagactctggatatgagaccgatgagctcaagcctcactcctttgtcaatcacaaatggccccgagaactggccttgagcaaggagtgcccgggtgtacttgaggatgagaaccgcactcataaagcctagctgcatgaacagaaaagatgtaaataaaatgcctggccttgagcaaggagtgcccgggtgtatttgaggatgagaaccgcactcataaagcttagctgcatgaacagaaaagatgtaaataaagtgcctcatggcatatgatgcatatattcttgcctttttcattattataaggaattaaaatgactgaactacgggctaagagaactggatttaagtccaggtttggtctctaggtgactattggccagcttcctaagtagcaagctgctttttgatattcggcctcttgaccaaaggaaaacaaatggtctctatgctttaagatgttatttgttttaaaccccaacgaccactttgcaaatcccttcacaaattggcccccacctcctcccacagccttctccctccccattacctatgtgcattctattctcaagccatgctgaatctcttattgtacccaaagaatcgaggctttttcttgatgccctccagattcctctacctgcagtacctttaccctcatttggactggcagaatccaatcctgcttttctctctctctgtttcttttcctttttttttctttctctctctctttttgtttagagatggggtctcactctgtcacccaggctggagtgcagtggcacaagcatagctccctgcagacttgaactcctgggcttacatgattctcccacctcagcctcccaagtgctgggactaaagacatacatttttttttttttttttgagatggagtttgactctatcgcccaggctggagtgcagtggcacaatcttggctcactgcatcctccgcctcctgggtttaagcaattctctgcctcagcctcccgagtagctgggatcacaggcacccaccaccatgcccagctaatatttttttgtatttttagtagaaacggggtttcaccatcttggccaggctgatcttgaactccagacctcatgatccacccgcctcggcttcccaaagtgctgggagtacaggtgtgagccaccacacccagcctatttttctgaactgttaatgtagtcccctttcaaacctacacaaagtagaaagaatagtatggtagtataatacgtctatcacccaactttaacaattattcactggaatattttttcttctattctctacttaactttaaaaaaatatttagaagcaaaaagcaaatctcaggtattatttttatccatgaacactttagtgtgtagtgctgatagatgaggattctttctaaaaatatgcccacaatgccatgatcacatctaacaaaactacgagtctttactacgtatcttttaaaaccaacctcaaatgtctacgagacaaagtcagctgcatcactgcttgtgtttatgcagaattttgtcattcttctgatcgtaggactaagcatatttattgaaatgtatctgtttgcaacttcattcatcaatgcttaaaagacacagactaatctttttcttctttgtaccttagcagctcctagcaattgctaaataaatgtgtgtccatgaaatgaaactgagattctgttttctattggccaggcttatttaaccacaatgatatctaatggcttagatataccttttaaaatctagttcttccaccacaataagattaaactaatttggaaatgcgtttaaactactattgaaggccctttacatgaggtagcttaccatggatattaggacttaaatgaaagaataatctttaaaattaaacaagtgctttaaagaatatattatgcccactttcacaatgcccacttttttgaccaaaaatatcagaatggtcactttaagaggacaatcatgttcatttttatttcccactctgaactaagaactgtggcagaccctggggttcagagatgcacaagagggacaatggcaggaatgatttgatctctaccagattcatgctctggagcctcatgtagggtcatcgatgggaagtaattccatttcccaggtccctcgagtccaggtgagcccatgtgatgctcaccaggggaaggtgagtgcagcgaggtgtgcacctgcagcgccacatgaccgacaggcagcataccttctccatgtgctattcccctgacttaggaagccacagagtggaggtattggggcacaagatggacggggccagagtccctgagtcaccacgagggagacacccactgaacacctgctacggaatgtgtgtgaatgaagaaaaaatatctgttgtattcagcttctgggatttcagggttatctgttacagcagctaacattattttaactaatacagtttgtatcttaagaggctgagtagtctaaagttggaagacagatgcacaaaaagaaattacaaatcaaaggtgttgaagtgctaaaaacaaagtcacgtacaaatttgtctcgaacaaaatgaactctgccttcagacctttgtgaagatttcacggagaaggtggcatttgaatctacccttgaggagaaagtaatatttttccaggggaagaagtaacctgctccagttatgggaaaacataccatttcaaggacataaggggcatcccgaatgcctacacagggaagatgcctacgttgggttgtgtgcacaatgaggtgcagagagtcaagtggaaatgggtgaagtcctcgtatgatacaaagaacaattgggactgggtacggtggctcacgcctgtaatcccagcactttgggaggccaaggcgggcggatcacaaggtcaggagatcgagaccatcctggctaacacagtgaaatcccgtctctactaaaaacacaaaaattagccgggcatggtggtgtgcgcctgtagtctcagctgctggggaggctgaggcaggagaatggcgtgaacctgggagacagagcttgcagtgagccaagcttgccccactacactccagcctgggcgacagagcaagactctgtctcaaaaaaaaaaaaaaaaaaaaaaaaaacaattgggccaggcgtggtggctcacatctgtaatcccagcactttgggaggctgaggcaggtggatcacctgaggtcaggagttcgagaccagcctgaccaacaaggtgaaaccctgtctctattaaaaatacaaaaattggccaggtatggtggcgtgcacctgtaatcccagctactagggacgctgagacaggagaatcacttgaacccggaaggcagaggtttcagtgagccaagattgtgccactacactccagcttgggcgacagagtgagactctgtctgaaaaaaaaaagagcaattggattgtgtcctcaaactactagaaagccatcaagtactctgaacaaacagatggcatgaccaggtgtgttgcttataaagacagatcatcagaagagaggtgaatgatgatgccctcccacctagactggaggttgttggagtggagcagcctgagatgaggaggggagactcaggcaggagggatggtaggaggacagggccatccagcccccgttcctgtatccattgcccatctctcttgagcgcctgccatgcgttacacctatggtatttctgtggtgaagaggaagatccctggtatcatggagtcgacattccagtgggggaagagcagcattaaagaaataaatgagatagttgctgttgtgaaaatattgaaggggatagcccataacaggaagagaggataataataattaccttcagatggtgggtctaggacaatgtctctaagaaagtaagtagcatttgtgctgagtcaatgaagggccagctatttgaaaagccaaggggagggcacagcgggaaaaggatcaaggcagtacccctggaggatggttaggaagcgggagaaaagccaggaaaggaggacagaaggaaagaaggagccagacactgcaggtgcataagatgtttagcttctattccacacgcaaggagaagccacggggagtgctgagcaggagagtggcactcactgactcaggcttttacaatgacttgactgctgtgtgtagcctgttttctaaggtggcctgagaggaggcagagaggacaggacagtgagagaaactgccaacctggatgagaaatgacatttgcttggatttgggtgaagcgcagtagaggcaggagaggtaggaagattctagctacgtgtttgaggaagaacagatgggacttctttataagtgaatggatgaggggaagaaaggactccggtgacacctgggctttaacatgggattctgcatggacggtgctgccctgtcctgggctgaagaaagtaggaggaacacggggttggaaggggttgggggaggagcccactctgccatgctgggtctgtgcagtttcggcccgtgtggaaatgagagcgtgtagttatacgtgcgtgtctggggagcttgagtcagctttgggttggaggtgtgggttgcagagtccctatcagatggatgtaaagtggaaggagtggatgagatcacacagggaggaggtgtggacagagaatctaggaggcccaagacaaagctctgagatactgaccacgtaactgtagatgggaagagccaacaggggtcagtcaacaaggccaaccaagaaatcatgtcgtgaagcctagagaagagcgtgtcccccaaagcagattgagccccacagaaggtccccggcagggagagaatggggagcagaaggtgtccagtggatttggccagatagagatctgctgtgactttggcaggagcagcggcagtgtggatggagatggaagccaaagtttgatggtctaaaatgcacgagaagccaggtgtggtgacgtgcatctgtggtcccagctactcagaaggccgaggtgggaggatggcttgagtccaggagtttgaggcaggctgagccacacagtgagaccttgtctcttaaaaaaacacacacacaaacaagaggcagcaagtatagcccataacaggctcagaactcactttttaaatgctctgctgtgaagaggaacatgaaaagttaggtggaagctggaagcaggtttgatttcactagagggatttttttttaaaataagtgagattctaagcatgtgcaggatcattcagaagaaagaagtggaagcagcagcaaagagtggaaaatgaaaagagaaactctggagaaggcaaggtgggcaggagcaggactgtgccgcctgcacccatgcaggctaggcgttgtccaacactggggcacccgtcactcagattgagatgagggacaatgagaggagcctggaggagagctccacacaaataaagggagaagcctatgcaggggctggagattccttctgtggtgacagagcatggccatagttagattcacagactggaggtagatgagagaatgatgcgtgctcttctcatctctcaagcagcaatgcagggggaacatcagctgacggggaggaaagtgtgccagagactcaagaagaaaagaaggtgtgacgaaggaaaaacccaatgccatgtgttaccaataaagaacaagccccttgccaaaattattcatagcatggatagtacgtgttctcatccatttctactttgggattccaaatttcttcctttcttccttctttttctttttctttcttttctttctttctttctttctttctttctttctttctttctttctttctttctttctttccttccttccttccttcctccctctctccttcccttcccttcccctccctccctcccctcccctcccttcccttcccttcctttcctttcctttcgtttttttgatggagtctcactctgttgcccaggctggagtgcagtggcgcgatctcggctcactgcaacctccgcctcctggcttcaagcgattctcctgtctcagtagagtactcctcctgagtagctgggattacaggtgcgcgccaccatgcccggctaatttttatatttttagtggagacagggtttcaccatgttggtcaggctggtctcgaactcctgacttcgggatccgcccgcctcggcctcccaaagtgctgagattacaggtgtgagccactgtgcctggcctagattccaaatttctatattcaaaatttctgagatgggctttgctattcagatgaattcttaagggaaaatcacatttctaatctaagtgtcaaactatgattctggacagtgtatttttcaagaactgatcatgtccctcaaaactatataaaataggaaaatatttctgggaaaaaattgcacttaccttattagagaagctcacgaggtccctcaacataagaacagaaccaatcatttcttcctgaccagaagaaacaacaataaaacaaaaagaaaatgcaaggagagggaaattagcttgtttgggttaaagttacagcttgcctatgtagaaatagtacagattccctgctttttggccaaaagaccaattggaggccagaccttctgtacagagaccattactgttgtctctggttttccttggaatccagcatctctcctgtgtgccccctagacatcctcagcacactccatcagggaactgacacgagggctgatgaaataagggtgcagagctaagcaacaatttatttattattttattttattttattttattttatttttttgagacggagtctcgctttgtcgcccaggctggagtgcagtggcgcgatctcagctcactgcaagctctgcctcccgggttcatgccattctactgcctcagcctcccgagtagctgggactacacgcgcctgccaccacacctggctaattttttttttttttttgtatttttagcagagacggggtttcactgtgttagccaggatggtcacgatctcctgacctcgtgatctgcctgccttggcctcccaaagtgctgggattacaggcttgagccactgcgcccagccagagctaagcaacatttttaaaaagaggaagaatgagaaaaaaattacatcaagtgaagtatcttaaagttgtaatgaaataagatatattctttgtagatgtgaatattctctattgacagttataagatagcagttgcataaatgctgtgagcaagtacagtcacatttgaatacatggtaatttcttcagaagttgcacaaaatcatgaacttaactctccaagataaaatcagactgtttcacataagttttacttacacaaacttcagcagaattatctgtaacaacgattgacttggtcattctctcttttataaaccagcagcattcatttgtgatacatatgagctgaatagagagaccacagccatgtatgggagctgagctggctggccctcttggtctcatttcttgcctgtgtttcataagcatgaccacttgctagtgagccagccagtcatgagccctgccacttgataaaggtttacagacactaaactcaccctcctctgagccatacctgatctacaaaagccaatctgcatactgaagaaattaatgcatcctgtattcgtgaccattggttgcaggaggcagttttgtcctccttagacaaacgactcaggattctggtgatcacagtgatgtagttcctgatttctgtgtaactccccatcagctggagggtagaaaggtttttcaggctggaattatacctgaaggaaacacaagagttatcattactgttccaacacacggcaaaacttttcaccctgactaccaagagtgggatgggatttgttgcaaaaatacctcttggacagggcagggtagaaagagaatgatacaaaggagaattggtctgtgcaacggaaactctaaaaagacactgtaagtcataatataaaattttacaaaaactccttttatcagaactaaaaaaggcacaagaaaccagatactaatatagaagcatcatggcaaatgaaggaatgtattccagagccagacagagataccaccacgctacagctggccggagtttatgactccgggtttcaataattgcgcatttatttacttatttacaaacagcatacttacttgcactggaaaagataacacagtattgtgaaaagaggcctatacatgaggtcaaaggccagtttcagcccttgttctgcaatttatttgctgtatgagcacaagagtattgtttaagagaaaaatgatcctcagtttccaaatgtataaaatagaaattttcatctggacacaccgcagtgggtcattgcaagaagtaaattaattagaaatcatgttctaattgattagaaaatgcatcatgggctctatacacgatgcttaagttcacccttgaccaataagtgatttatggagactaagaccctaggaagccaagttaaagataaaaagaacaaataaatctgagcagaaacatcactggctgcacaacgaggggaaatatactttacagaattcgtcttgccaaactaataaacatataaaccaatgaccaaacaaacaaaaacaacgacaacaagccaggaaaaggaggtaggccaatacccagagtggctgcaatatattatctaaaatgtccagttatcaatgaaaaattatgagacatccaaagaaacattaagtgtgacccaaacatgagaaaaataagcaggcaatagaaactgcctatgaggagactcagatgttggaattagcaaggactttgaaacagctattataaacatgattcaaagaatgaaaggaaaccatatttttaaaaatcaaaggaagttagaacaatgtttagtcaaatagagactatcaataaacagatagaagctataaatttataagttacagagagaaccaaatggaaattatgaagttatatgtataataattataacaaaagaaatgttcaaaagtaaatttgagaaaagaaagaatctagaaacttgaagacagagtaatagagattataaataacaggaagaaaaaagtaggaagaaaatgaatggcaactcagagaaatgttgaacaattaagttcatgaattatctttttctctcttcttatttaaaaagccattgcataaagacatttctacagagctgtactgttgggcccataacacacagaaatataatgtaacaagaacacaaagtctaggcgtggtggctcatgcctgtaatcccagcactttgggaggctgaggcatgtggatcacctgaggtcaagaattcaagaccagcctggccaacatggtgaaaccccatctctactaaaaatacaaaaaattagctgggcgtggcggtgtgtgcctgtaatcccagctacttgggaggctgaggcaggagaattgcttggatccagggggctgaggttgcagtgagccaagattgtgccattgcactgcagcctgggcgacagggtgagaccttgtctcaaggcaaaacaaaacaaaacaaaaaacaacaacaaaaaaaacacaaataagggaggtggaaataaaactatacaagaataaagaaatgacactagatggtaacttaaagccacaggaagatatgaagacaaacaaaaatactaaataagattagcatacattaaaagcaatttctaaaaatatatttgtgctctcttctccagtttctttgaaagacagaaaactggccaggcgtggtggctcatgcctgtaatcccagcactttgggaggccgaggcaggcggatcacctgaggtcgggagttcgagaccagcctgaccaacatggagaaatcccatctctactaaaaatacaaaattagccaggcgtcgtggcacatgcctgtaataccagctacttcagaggctgaggcagtagaatcgcttgaacccaggaggcggaggttgcagtgagccgagatcacggcactgcactccagcctgggcaacagagcaagactctgtctcaagaaaaaataaaaagacagaaaattttataaaacaataattacaacattggactgttgggtttgtaacactgatagatgtaacatacataacaatcataacacaaaaagggaagaggaaatggatctatagaggagtaaattttctacatcttgctgaaattaatataaatttgaagtagtttctagtaagttaaggtgtatattgtaagccttagtgcaacaactaagaaaatatctaaaaatacataataatcattaaaggagtgaaaatgatatactagaaaatacttaacataaaaggaggcagtaaagaagaaatagaggagcaaagtaataatgagacatgcaaaaaataagcaaaatggcatacataaatccatccaaccacatcaataataatattaaatgtgaatagattacatgattcaaccaaaaggcagagattgtaagactatacacaaaaccaagattcaactatatgctgtctactggagactactttaggttcaaggataaaattaggttgtaagtaaaaggatggaaagagacatgcaaacagtaacagcaaggcatgtagagtggttatgtttatatcagacaaaaaagaaattagacaaaaacagatagttgcaataaagagggacatttcctaatgataatgtaggtaaattcaccaggaaggttaaaaaattgtaaacatatagggacctaacaacaggttccatatacatgagcaataatggacagaactgaagggatacagaaaactcaaaataataatactgtcaataatggatagaaccaccaggcagaaaatcaacaaggatacataagactcaaacaataatataaatcaattagacctaacagataaccattgaacatttagccaacaaaatcagatacatattcttttcaagtgcacatgggacattttctagaatacaccatatagtaggccacaaacaaaactcaataaattttaaactactgctattatacagagtatatcctctgaccatgatggaattaaataattagaaatcaatgacaaaagatatttggaaaattacaaatatgtaaaaaagtaaaaaacatactcctaaatattataatcaatggttcaaagaagaaattgcaacaagaattacaaaatgctttgagattaataaatgaaaacaccaacattctaaaacacattggatgcagctaaatcagtgcttgaagggaatttaaagctataaatggctataaagaagatgacgaatcaataatctaatttttcaccttaagaaacaacaacaacaaaaaaaaacaagagcaaagtaaaccagagcaagtacaaggcggggaaaaaaagaataaaaattagtgtagaaatgaatgaaatagagaatagaaaaacaaccacaacaataaaaatcaatgaagccaaaagctggttttttgaaaacatcaacaaaatgacaaatctttagctagactgacagacaaaaaataagagagggaaaaagagatgacttaaattactaaaatcaggaatgaaattgatatctctactgaccatatagaaataaaaaggattataggagaacaccatacaaaactgtatgccaaaaaaaatagagaatgtagatgaaatggaaaattcctagaaagaaacaaactactgaaactgactcaagaagaaacagaaatctgaatagtaaagatactgaatcagtcatttcaaaatttccacaaagaaaatgccaggtccaaataactttgctggtaaatgtttatagaagaatcactacccatccttcacaaaatcttccaaatacttgaatgcaaaggaagctaggtgtggcggcacacacttgttatcccagcactttgggaggccaaggtgggaggattgcttgagcccaggagttcgagaccagcctgggcaacatgatgaaattagccaggcatggtggcatgtgcctataatcccagctacttgggaggcggaggtggaaggatggcttgagcctaggaggtcaaggctgcagtgagccatgatcatgccactgtactccaacctagacaacagatggaaaccttgtctcaaaaaaaaaaagaaaaaaaaaaaaaaaggaatacttccaaattgattggggccagtattattctgataccaaaaccagacaaagacaacacaggaaaagaaagaaaactacaggccaatacctcttatgaacatggacacaaaaatcctcagaaaagtactagaaatcaaatccagcacacagaaaaagatgtatacatcatgaccaaatggaatttattcccagactgtaagagtgattcaacatctgaaaatcaatcaattttatataacttgtatcttagtttgtgctattataataaaatacctgagactgggtaatatataaagaacagaaatttattttcacagttttggagtctgggaagtctaagatcaagacactaataggctcagtgtctggtgaggctgctctctgcttccaaggtggcacctgttgctgcctcctccagaggggaagaaggctgtgacctcacatgacagaagggacagaacgaccaaagagggcctatctagttccctccagccattttataaggtgactaatttcatttatgagagcagaacccttatggcctaatcacctcctacagacaccacctcttaactactgttgcactggggatagtttgaacaggaattttagagaggacacaaacatccaaaacgtaacaaattaatggactaagggacaaaaaacatataattgtctccatagacctaggaaaagcatttaacaaaatccaatacgtttttataatgaaatacacacacaacaaactaggaatagaagagaacatcctcaatctgataacggttgtctgtgaacgacctctagctaatattaatatgaagtggtgaaagactgaatgcttcctccttaaaactgagaagaagaccaggatttccacgcttgccacttctgttcagcgttgaatggaggttctagtcaagagaattaggcaagaaatagaaatggaaggcatccagattagaaagaaagaagcaaagctatctctagtgacagatgacatgatcttatatagagaaaatctcaaggaattcggtaaaaaactattaatactaacaaacatgttcagcagggttataggatacaagatactccccaaactgatgtacagacttgacaaatccctatgaaaatcccagttagcttttgttttgttttgtttttctaccccctgcagcaggagtctggagccccagtctgccccagccagagcaaggctggagaggctggccggcaccaaagccattgtcccatgcctgtgctgctttgtttttgcagaaatcgacaggctgattctaaaactcatatggaaatatgagagacctgaaagacccaaccttctaaaaagaacaaagttagtgggctcaggtttttcagtttcaaaatttactactaaactataataatcaaggcagcatagtactggtatgagaagagacattcagactaatggaatagaattgagaatcaagaaacaaacgttttaattaggttatccattataaaaatacagataacctacataaaaatgggtaaagtactaagcagacatttcttcaaggaagatatacaaagcatatgaaaagatgctcaacctcatcaattattagagaaacgcaagtccaaaccttaatgggataccacttcatactaactagaacagctgtgaacaaaaagacaataaccagtgttggttaggatatcaagaaaccagaactctcatacctcgttagtgggaatacaaaatggtgcagccactacggaaaatagtttggtagttaccataggacactgtttccattcctagttacctacccaaggaaaatgaaaccacacactcacacaaaaacttgcacataaatgttcatagcagtgtgattcattatagccaaaaagtgaaaacaacccacacatccatcaactaattaatgaataaataaaatatgatatgttcatacaataaaatattattcagcaacaaaaaagaatgaagtactaatatattttgctacatagatgaaactcaaaaacattcacatgctcagtgaaaagacagttacttaagatcatatgttatattatctcatttatatgaaattttcagaatcagcaaacctgtagatattaaatagatttgtggttgtccggggccggtgggaggaagctgggtggtgggtaaagggagtgactgctaataagtcaaggttttcacgggatgatgaaaaattgtctaaaactagcttatggtgaaggctgtataattcaataaattattaaaaccaaggagttgcatactttaaatggatgaacatgtggaatgtaaatgatatctttaaaaactgtttttaaaaaagaagaaagtgaggctgggcgcggtggctcacacctgtaatcccagcattttgggagaccgaggcgggtggatcacgaagtcaggagttcgagaccagcctgaccaacatggtgaaaccccatctctactaaaaatacaaaaattagtcaggcttggtggcgcacacctgtaatcccagctactcaggaggctgaggcaggagaatcacttgaacccgggaggtggaggttgcaagtgagccgagattgtgccactgcactctccagcctgggtgacaggcggagactctgtctcaaaaaaaaaaaaaaaaaaaaaagaaggagaagaaagtagctttataggctctgaagcacctgcaagaatgccatgcaaatatgagttagcaggattgcagtgatagcacccggacttttttatttgctccatcttaagaagatgagttcctgacatgtttttgacgcttgttaacaacttgggggagagccaactctggaagaaatacaaataatggctaggatgtctgtgtggcattgtgttactcacaggtcctcgcccagacagtcatttccatggtagcggggcagcacagtcaccaccacagtgcacggctggaccttggagcctttgccatctgtgatttcagtggaaaccatgactgtgagggaacatgtcagaagagggtcatcttggacatgtgggttacagagatgcttcttcacacacagacagcatcttctggatgactaaaactgtgacaagtgctgacaaaggggccaggctccgagccacagggagcccagggagtgaaatacaaactcggcaatggactgtcaaggcttggggttatagtttgaccagttcctacatgatatatagaaatttaacaggcctagaaaaaaggtgaagaattctgacagaggggactttttaaaagacataagacctatttgggggacccaggaattccttcatgtaacaggggtgcagggctgtggtgaggggacctgcagatcaggctcagagtgcaggtgatggccagatgctaagggccacaggcaccgtcataggaaccacatagaaagatcgacgcccaggtgtgccctatgtatctttataacaacattttcaacctgaaactcagtgccaaggattggggacttaattttggaggttgacacttctcaagatgtggtctatggacacttgcagcccaagcgccaggcatctcgtctacaagcaaattccgtgctccatcttctccccacaatcctgagtcagtggatactaggtgggctctggaggcagcaattttaacaaatacccttaacagataaggttggtcctatgcacggatatagaaaatcccaaaggagcagtttttaggcaagactccacttattttgacaagctgagtctgcgccacactcactcatgcaaaagatgggacaagaaaaggtatgtattaagtatttactatattgtatttattttgcttatgttcgcccccttacaaatcttgagttcaggtattcataggaattggctgtactgatagtgacaattacaaacaaattgtggttgtgaatgatttgagtaacatcactaaccctgacactgctctgggactgtgacctgaaatttggtctgtaaatttatgttaagaaatctttacttccaacacagagctgaggccctggcccaaggtccttctattggaacatttgcccagcctaagtctcacataaccccgtacgcagcttgacttcaagaaaactcaagatcaaacggagtacaaagtcactgtgatacaaagcagagcatgattatgaagatctcaaaatgccctgctcagaagttttgctcaatataattgatttgtatctagaagaaggtacaagtgtttctaactgaaggtgacaggcaaagtttcatgaagaagaaggaacttcagcttggcttaaaggagaggtgaaacttaaataaatcaagtgaatgaactagttcagacttcaggctctaataatcttaccagtccaaattaaagaaacttctagatcagtgactctcaaccttccctgcacatcagaatcttccaggcatttaaaaaataaaacagaaacttaaaaagtcaccaacccccaagatttttatttaaccagcctgggtttgcacatgtcaagataccttcctaaatggctgcatgtctcttatgctcagttgaagccagttccaagggactggtttagaagtaaccacaacctcaggaacagggtcagagcagaaagttgtaaacactgtgggattcattttgttttgaggttatgttactaacatgctaactcacattcatttaccccacattttgttccttagggggataccttgatttggtttcatctataataaatgcaagattcaccagatatgacatatttcattagtaagtaagaaatgtcctgattttaaatatttaatttatatatgaaaaaacattctctggcattttatcatttacagtgtatttcagttaaaatttaagatataaaaaactgatttaatttattgatattactaatgttctttctgcactaaaaggtagataataaacctaaactgaaaagcattaaactgatcaaggtgattttattttctagacacagtttagtttttgaaaaccaggaaaaaaggtttagaactgtaggttggcacagctagtgactccaactggcaccatagcttacctttgtaattgtccaagtgctcaccagctggcaacacaaaataatactgggtgtctctcccatggtacaaagtgtgtttggaggtgtttcctatctggtaactaaattcataatggaagtcctatgatccagtccaagggagcaaaaatagtataaatgaacacactgtgaatgatatcacaatacatacacacacagctgagccttcattgtaccaaggacattctttacagccaggaagagggtaagtgacaggtaagcagcactcccagctgcccagagccctgggccctgcagggctctccattcaccaagcccaaagggctcctcgaacaacactgagattccccaccagtgtctgtgtcctctccttgtcctggaacctccccacagtcacaaatcagactgtcacagccccctcagggtgaagggccccagctgcccctcagcttccacactgctgggcatcacacagcaggaggagcaggagggaggggtcggggtgcctcaagggaaggccatggtctgggacctctggaggacaagggtggggcttcctacagaaggggtcaggcagaagggcagggaggtcagtgtcctggctgagaggatggagagggcagtgccagggtcacaatatcacaggctcctgtcctgcctgcccatcacctgaggcattcatctttttttaaatttttttttgagataagtctcacactgtctcccaggctgctgtgcaatggcgcgatctcggctcactgcaacctccgcctcctgggttcaagcaattctcctgcctcagcctcccaagtagctgggattacaggcacctaccaccacacccagctaatttttgtatttttagtagagatggggtttcaccatgttggccaggctggtttgcattcatctttttaaatccatcctctcatttcaccctcacaagaccctgagcaacaaaatcacaatggtcttctccatggcccagagaaagggtgagggtaagtccgtgttagaaatgtgcctggggagggaaagggccaggctcctctcctcactttgggtcacgtgcctgcctttttcttgggggcagcattaacggaggcccctgttctaaccaggctgcagggcagacgactcctggtgagcaggcccttgtctctttgtgaaattctgaaccttctcaaccagggggccactttgcactcctctcattagtgtgtggggaagcccattcatgcctaaccaactttccaacattcaacggcaggctgaaatccttcacaggtgggaaggacattgctgtccattcctacagcacccgtgactgctgtgactgccagatgccactgtcgggggtctctcaggacagacatggggttgtccacgtaccggttttccagacatgcagaagacactgaagacggtgtgtgcttccagaccatggtggggctgcacctgacaggccatgtcccgaggagccgggttgactgtcaagtacagctgagctttacccagtaagccatgcttcgaagctaaagagaaagatgaagcagcggtttcacccatgatggagaattacagcagcataggaataagtttttatagataaaccttatagcaggggttctcaaagtagggtccccagaccagcagcatcggactaacctgggaatttgtcagaaatgaagattctggagccccaccctagacctgctgactcagaaactgagactcagtgatagttttcacatacccttaggggattctgaagttctggggtttgagaaccactgcctatatgttcattaatataacaaacactcactgggtggggcaggtactatcctaggccctggggagacagaagtgtctccctacctgggagtcacatggcaaccacccagacagaaaccgaagcctgagggagagatgatgctaacagacccattacccagcagagcaaactttctccattctcctggattctctcaaaaccttagccacatacacacgtacgtacagcttcgttgaatgtatagcaccaatacaattttatattttgttttattaactatattaatatcataactattttccatgttgacatagagcatccaaaatcattgttgtaaatagcagcataagattacatggaacagatataccctaatacgcacaattattatccccaatgattaaacattttgcttattttccattttctgttattattgatcaccccataatgattattctcatacatatagtttttaaatgtttaatgtatttgtcttgagatggattatagaaatgaaatttacatgtcaaatggtttaaaatcttgatgatcatcatcctcatcgtaacagcaggtaccatctattgagcctctgctacacaccaggtgccctgctagacactgttcctgtattatcttatttaacagtcacattaaccatggaagacagatctcataacaaaagtaaaacccaggagaaaaggatgatgaatcctgcctggctgaccaggggaatctccacaaaagaagacacatttgagtgaggagtcttggggtatcagtcttatactgggcttaggaagggatgtggggaaaagaatgggcattccagccaaaataaccacagggaaagacttagagtcacgagggggcctggtgttatctgaagagcacgggaagggagggcagcagtcagcgagggtgtgcaaggctgcgggagagaaggctgacaggagacctggagcctgagtgcaccacctggcagccagccaaggacactgaccaggctggtgggccatggagagactctcatgtgtctcctgcaccattaaggaatatggcccagctaagagaactgtctttagacttgtcacttgggcaaatttcagaggcaaaagaaagaggtacagccaaaggcaaaaggtatttgttgaaacaaaagcaaacgctgcccgtcttgtatccaaagcagggacccagggctagttgttaaatgctaaacgtggaaggggcaggcagatgtttatagaaactgtgagaatcaagatgaccctcagggatctcattgagcccagcccagccagttctcaggagaaagtgaacctcgggtttcccacttgtatgacaatagagttcacagagaatgcaagtttgcaaattcctgataggttttaattaatgcaaaactgtggatgttgaaccaaacctatctgtagataaaaattgttggctgggtgcggtggcttatgactgcaatctcagcacttgtggaggccaaggcaggtggatcgctcacttgaggtcatgagttcgagaccagcctggccaacatggtgaaacccccactctactaaaaatacaaaaaattagccgggcgtggtggcaggcagctgtaatcccagttactcgggaggctgaggcaggagaatcacttgaacctgggaggtggaggttgcagtgagctgagaccgtgcctctgcactccagcctgggcaacagagcaagactttgtctcaaaaaaaaaaaaaaaaaaaggccaggcacggtggctcacgcctgtaatcccagcactttgggaggctgagacgggcagatcacaaggtcaggagatcgagaccatcctggctaacatggtgaaaccccatctctactaaaaatacaaaaaattagctgggcgtggtggcaggcagctgtagtcccagctattcgggaggctgaggcaggagaatggcgtgaacctgggaggcagagcttgcggtgagccaagatcgggccactgcactctagcctgggcaacagagggactccgtctcaacaaaaaaataaaaaataaaaaaaaaaattaagcccactgtgcttgtcatatggaatgaaaacctctagaaatgggggaaaatgtctagaagttctgcaaaacgatgatctcagattgagataggcatggaaacgcaagaaggaatgcagagcaagggtaaggcgaggcctgtgggtgaatttcaatgaacatcagtggcacaaaacaagcaataacacctttctagggtttaaatagagagagagagagagagagagattacggacagatttgcaggaaaggaatcaacttgtgcagttgtctagcataaataagatatatatatatatatacatatatatatatatatatatttttttttttttttttgagacagtcttgctctgtcgcccaggctggagttcagtggcgcgatcttggctcactgcaagctccacctcctgggttcacgccattctcctgcctcggcctctcgaatagctgggattacaggcacccgccaccatgcccggcaaattttttgtattttttagtagagatggggtttcaccgtgttagccaggatggtctcgatctcctgacctcgtgatctgcctgcctcggcctcccaaagtgctgggattacaagcgtgagccactgtgcccagccctatatatatgtaattttttaaaaaggcaactgcttagcctttacgctgatgtagacctgcaccccattccttaggaagagtaaactcacagagacgcagcaggactcctcatcctctgataaatgcaactgacaatgtaacatacccacagacacttgcaggacgtacgtctctccactgctcagagagtatggcttgattgtcactgtctgttctgtaatacctgcagaaaagacatggctgcatggaaatgacagtcagtggtctcaaggacagaggtcacacagagtccttggaaatgagttccactcttcccccaggggtgaaattaacatagatactagtgaaacatgccactcctgcttggaaaggttgctggttactgccttctataaacagcctgtcctgcccaacagaagcattactgaggatggtccatccatccctggctcagaaatgacactaatgtcccaagcaacaagagaattctgttaggatcttattttatatgtttataattatgttcatgtttaatttggcaattttataaatcatactataaagtatgattaaggaattttgaagctatttttaagtctgcagaatactggttatggacaatttttaacctgggtgtaactgctgaccgtggtgactggattacttccttagcagagagaggctgacctctcactacttaccctgaaaaaaggagagatcggaaatacaagattgatgatctaaacatggacagtttctaaaattacaatcttacaatagtacttctcaaaatgcttcaaggaaagggtgaagggaaaattatctaaaaatagtgtgaaatccagatcctccccaagaggtctgtaaggatggcacaatcacatgtattaacacgaaagggggaaatacaacaaattgagcaaaagcaccatgtctgggctgggaaattccattagaaattcaatcgctcttcaggagcagcttcattttgaccaattcatgtaaatccctgaccaccctacaaaaggctgtcacagaaaaggtgcgcaccaaggtgtctgggagcacagaacgtgcagcacttggcagcacccctcttccgctttggtctacacacatggatctcctggtagcaacagacgctaactttacttttgttagaagagtctcaggccatagtccatagaagaacaagcacaagtagaaaaggtaccacaattctaaatacttatctagtaaaacgaaaagttcagaagaaattgagggctgatatctaaaagcttcagaaacactgcaaattggagggtacaaagaggacattcatacctgaggatgaatagccttggaaaactgctcgacccagcagggccttgggccagtcaatcatgaggacaggctcggctctgcctgcagacagggaggggtccaccaggttatccccatctccagggctctcctcggcactcaagctaggtcctgatcctggaaagctggtgtccttagctaggaagataaaccaagccaatagatgttaaagaaaaaaagtcatgatgatcttaaagcattagtgattcaatgctgatattaataactatttgtactattgctggataccgcctatctaatataatgtcttcagcagccaaacatattcaagacatgtactttgttaacatgtaattagcggtccaaaggcatcttccctccctccctccctccctcccttcctatcttccttccttccttctgcaagatttattaaggtctactaagtccaggtactactctagaaataggagacacagcgtgaaccagatcaatggtgtccttgctatctggagttaatagtgaggcagtccaaaaaataaatgagaaaacacataaataaataatataaactcaggtaatgaaggaaagaaaagcggggtatgcagaggaagagagagtggtgtggaaaggaagtccttctgagatggaggtcagggaggtcctctctgaagactaagactagaaggagcccttcaagcatctgaaggaaggagtttccaggttgagtaaaaccaaaatgctgtgggaatgatctgccctagtggttggagggtgggagggagggagggagggcaggaggaggaaaaatgtggctggaggcattgccagggtcacatcatgctgggtgcacagccacgggcttttgtcctgagtgccctaggaagccactggagggacctgtcaggagagtaacaacagcctggtttgtggtgaagagtcctctgcctgtcatgtgatgagatgactgcaggcagcaagaagagaagcagcgagggcaaaggaagggctcctgcatggtctaggcaagaaggagtcgctgcacttcacttaggctaaggaggctcctttaagacttgaaaccaaggtcactgaagcaagatatagtaataaaacacaaatgttgtaaggaggaataattttataaatgcaatacaaaggcagatctttcttcattcagttgtattgattaagcacctactgtgagtacgaatgtgagcctctacaacagatctgcgtgtgtactgtaaagacttttaaatgttctgtatgatgatgttttgatatactgaagaacaaaatgaaacaaaagcgttctggctaaggagacagtgcttctcttggggctggggctagccaactcttagagattacaaaaggcccagcctgcaatgtgtctttgatttgcaaactgaccaatccagaaccacccccaacaaatcatcctgggcaactagagaccacccttaggcctaggatctgctgaaattaaactaactgattctaaactattcatccagccctgccttagccttgcctttctttgccgtggaaaacccaaaaaaaaccttggcttaagggctccccttgctcctgtctgctgtctcctgacctccctgcagcttccccatgtggccttgtgtggcctgccatgcctcttgtctctaggacctgggagtattttctttgtttttctctcctctgtggctgcacctgactgaccatctcatccaagaagagcacgacacacaggaaggaacatgggaagggctggagaagccgtgcagttggaagcagctgaggaggactgttgaaggaaacactgcctcaaatcagaggaataaatcattcattcatcatccattattccctcgatagataaatcattcactcatcagccatttatcgattcattcatcaaataagtcatttacctactcatttgacagataaatcattcactagacatccatctcttcactagacagataaatcagtcactcgctgatcaaacatctgttcattcgatagatgaataagtcattcgctgatcatcaattcattctacaatgtgtttactgagtgccaatgtgccagggaccgtgatccatctgggaacatagcataagctggccatggaagctttcctggaagagctcagagcagaagacacagacacagaaagagccactaagtgccaggtgccacctgcttcccagaggagggaataaatactgagctggtgtgtgtgtgtgtgttttgggggttggggggaaggcggggggagtggtggtccttacaagacaagcctgaggaagacttcccagagagaaatggagccagacctgaaggaggaggctcgctgagcagataacttaggaaggacgtggaggaaggcatttttggcagacgacactccatgaccaaggcatggaagagctgggatgctcatccttgggcctggggctactgttgggattttggagcatagggtgagagaagggcagaaagaggggagctagaaataaaggtttggttcagaccgtgccatgtaagagttcaacttttccctgtgattctgtggagctctcagtggctgtgtaagggaacaggtgggaaatccagattgcagaaaggctgtggaggagagctgagtggagagaggcagcaggcatagaagcacagtcacctggctgtcttcctcccgatggtattgcttcttgaatgtcactgtaataggcttcaaaatctataagaaaggacaaaatcataatgtttcctttaaaatcacagaatcccctgaaattaacagcagctcccctgatgggtcacattgtccttggtgtatttctagactccatacattgctctgtggattacaaaataccctcagtggtggtgtcttccctcactcatgacagctgggcaaggcaggtttcattgccccggggccccaggaggaggagagggagctccaataggtgtgtggtttctaagaataacccagcaagtaagttgagaccaaggctcacatatgggtctctgccaccacacccagcatcctatcctctcttcaagcgagtcttttactgttcttttagagaaaatgtctcactcttttcttttagaaggagagaaatggacacaagaatgccctgctgcaaatgtcgcctcctgtcccctcagccctcctttcccagaggcagaggagctcacagcggtccctccagccagccagccaagtctgggaggcctggagcacagctgaattgacaagagcatgcagagcatgagaccaccatagcccaagagtaagcagcaaaatcagtaagcagctgaggacagtgacagagagacagatgccaggtcagagcttttctcattattaccttttctctccattttttaagtaccagaatggtttccatccccctgaaacccaatgataaagtgaagcaattgatcccagggcaggggagaaggattaggaagccggtgtggagtaaacaactactgtagcacagacactgcacacacgggacctcactgcagcctcagaacctgccatgggtttgtcattttcccagttcagagatgaggaatccgaaactcgatgactattgcacaaccagcaagtggtgggtgtgaacctggcgctttctgatttaaaggcccatgttgatgtgatctcacaccttacccaccagattcactgcttccaaaggtaactttggtgcctagacaagagggatgacatgcaggaacagtggcacttaccagagaggtgagggtcagggctgtgggtgggctgacttctctcagagcggccagtcatcagggatcccttgctctgtggccctggctctaggtctagtgaaccttcctctggagcctcccccaggactgcagagtcccccgcaggaggaatccagtagactccagtcatgggctctgtgggggttccccttggagctgaagtggcaggttggccaagggtcacgggtgaaggttcccgtgagaatggtgtggtcgttgcatcaggatctgcagtgccaggctcagtgggcagcaggtttaactgtgatgactctgaaatggcaccgagtcccagcgagccaagcagccccactactctgcagaagggaacttaagcaaacgtttggcagtgttagaattttgcagcaaaaatataaaatatttgcttaaaaagtctacagactatgtaaggatgctatattataaacaaatctgttgtgaatttgaaaacctacacttaagagatacagggcagagagtgtggtgttggcgtgttctgtgttggcatgttggccaacagcaagaagcacatgtatggaagtagaaggcaggattcacagcgattgcacctgacgtttgctcttccaagtcgggggggagggatctgctgaatcctatgcactcccaggcatgacttattcatgggtattctagaaaaaacttgggatgtatggggtttctcttaatcctcactcccctacccgccagtaagtgatatggtttggatgttttgcccctctaagtctcatgttgaaatataatccccagtgttggagggggagcctggtgggaggtgtttagatcatgggggtggatccctcaccaatgacttagtgccctcctcgctgtaatgagtgagttcttgctctgagttcgtgggaagtctggttatttaaaggagcgtggcaactgccctgccgcctcactccttctctcaccatgtaatatgtcagctcccttttgccctccaccatgagtaaaagtttcctgaggcctcatcagagcagatgctagcaccatgcttcctgtacagtctgcagaaccataagccaaaataaaccacttttctttataaattacccagcctcaggtattcctttatagcagtgcaagaagggaataatacagcaagtatctagtataacagttttcaaaactgctgttagaatttatgataaaggatgaatagcaaagaaaaaaataccatgagcatataaatggcctctcaataaagcaagcttttacttgcaaccatgggagagcccaattctttgagacatatctaggggccatgatttactttgctgaaagtctaaccactgtatgtgtttccactgcaagttcctctaatctattcagcatgggctctgattcagaaaagttaaatttacctaaaagaatttggaatgcctctcttgccaagaagggcacaatcaccctctatgtcttcatgtatctgtggccgctgaggccagctgtacccaaagctctacttgtggaagctttgaatggcctcatggaggggatcttcaagaaatgtgaaggtcagcgggggcttggcaccagctctgttgtaggagctggctctccagctcagaaataaagctcctctgtttgccattcagagccacctctctgatcacaaatagtgccacgtgagaaatcagtctcgctcctggttcaaaccttcgtgtcctgcagcacccagtgtcctgacaccagtgcccagcacgctgcaacacattttacttagccctgataccactctgtgaaatagtaggatcctcatctttcaccaaagaaaattaaatcttagaattgcttaaagccaccagctggtagtgtgggagcaaggattggaaccttccgccctggttcctctgctcattcctcactgtgcagctggcccaaaagacaggcgaggtggtgacggacacagccctctgggcagtgtgtcacatcgcaggtccttctgaactgtggctttagctcaataaaactgcctacacaggtgttgggcgcagccttccatatcacactgaggtcagaagcagcccttgagtgtgtcacctcttctgctggtgcctcacaagtgttcacacggactgtagaggcaagaggggctggggaagcacgacggaccgttcaccaggcagatcagacacactgggtcataccaaatgtattttgcaacattttagcaatctcacaataaccctgagtttttccctcagaaaacaaaataaagctattaatcctttttaccttctatcctattcttttctgttgcattgactaaaaagagatcccaggaataagacagattcggtatttcactgcagtcctcacacatagcttgaagagagagttcgtcattccagttgacgaaggtgtctttaaagctgacccaggagatgtggacgaatctgaaatatataaattggcttgagatcttaggaaaataatgtgagggttctttggtcacattaattcatgttaggcatgtttaaatcaccctactttggatctttattaagggacttcaatagcaatgtcacagcacatatgatggcacatatggagtggccaacactgtgccaagctcgacactcacgtgatctgctctaacactgtgagatccagtgaggcaaggacactgccaccctacagagttcagagaggctgtgtagcttttccgagtcacacagcggtgagggcagagctgggcctggtcaaggtccctctgtttccaagcctgggctctggcccagctctccacactagagcagttgccaccacgtgatccctcttcgctgccttgcctcagggcttgcttctaccagctgcaaacccatcccctcccaaactttccccgtggccgtccacctttgtgattcccacacagcctcagatgctcacaaagaaagatgtctccactgcctcggccccgcctcttccctgtgcagggttgtgggtcatgggcagttcacacatcccatgcccacagcccggcgcccacctcccttgggcctgcattccatggctgccttctgtcaagccctctagtctctttgctgacccagcactttccagagtgcacttttatggtttttcataatatctcgggggtggtttgggatttaacagatttatttcctgtgggacttagggagggtttaaaaggccaggtcggtagatactctggggtgtgtgtggtacctggtgtctcccatgcaaacatcctatactctgcacctgacggcccacgtctcagaccaaggcctaagcactcgactcccagcacagggctgaggagccatggtgggagaggccacacagcgtcctcgcctggcactgggcccaggctgtgtgtgtgtgtgaaagggtgcatctgtgtgggtgcacagtggggtgatgggggtgcagacggacatgggcaaagagaggtccctccagccccagacctcctggggacatcatccacataggcctggaccttcctgacaggatcaaaagatgttcacctgatagctttggcacatattgaaagactattttaaaataaattctgtaattatctcatgagtagcagaggtatatagtacattatatttttggaatagaagtatttagtttgttaaatttaatgattaatgatttaaattgtgccccaattgttgtagccttgtacctggcatttcttcacttttagtacatatccagagcctcaaataacagtcagtagtcggggcctgtggggctccctgggcagtgctgtatgaccttggggctcaccatggcatggcccactcttatccactcagccttattttcatggctctaatcttgaaaccctgaattccagtccagggaatgaccttcaaagcagtctttctgatctctgaggacagcagatttgcttcctcctccaggaagccttcccaaaccacccagcccacaaacaggaccatagtaactgcccagcccccttgcccctaccatccatgatggaagcagttcgatctgcccagggccttccaggtgacatatagggctatgggcagagggtcagtcccagcactgcttcctgggtgggtgccagcttgcagccccgatgggagagtgtccaaagcaggtgggcctgggctcctgctccatcccgatgctcacttacataatgacccaacccccttagaggaggaggctgggaaacagctgcaactcacacccttcctgcacttggctcggtcctggtatcctgtgtttggtgtccgggggctgcactacacccactggcgctgttctggcctcagcgctacaggggttctgggtttggggcacatcacttctttgcctctgcatctttcatagtctcagacctcacaactgggcccacactgctgtcccctccatcctgtgatgcttggaaggcctgggcaatggccctgaaacccctggctgggaacttgatggctttgcctcctggcttcagtcccaagccccaggagagtccccgatctttcaggcaggtgctgtgatgggagggttcccgatgaggttccacttggaacccccggctgtgccagctttagctagtgtgcttggctgtcagatgctgcccagacatcagcccgagagcggggactgcttccccagccgctttctgaacagtcttctcctcctcctttgcagtgagaatcctgcatggccaaactccaaactgcttgctgtgcacagcagattcctttcacggatgctagcaccaggtgggaacaaacaccggtgagctgagctgtgctgaatacagggtcaggtacctgaacgccgagtcagggtagggggacaggaacacccgggtctcagaagagttccggccaccactggagaccctcagcatcacaaggaactgatcatagctgtcactgagccattgtgcctcaaaggaaacagtgggagccgcggcatccagttggtgtgcagtggaggagtcgaagcagggatgtgctggggagccagcggtggcgcattcccagtgatacctgttggagaagtcatcggagtggctgaggggagcatcaggcagagtcagggactaccctgtgtcactgcacgggttttccccaggtgagggggaccacaggggacacgtgctgggaagagatattgcttcccacattttctcctgtaactgaagtgggaggttgcaaaagtgcagcagcaccaccacctggggtgggctcaggccacccctcccgactcactgaggcctgactccagacagccttgtttccagccccaccaggcttcctaacccttctctgcgcacagcgacctcctctgctcacatgactgccacttcccaagtcacacagctgtgctgccctcaagtatgtcccaaacactgcaccccatcatcatgacagctccatgtgacagacaagaatgctatgtgagcccagttttaggaagaaaatgtatttgggaggcctcagagtgtttccctgtagcacagctagtgaggggtctgtgagatggacttcaggcatctctcctcccagtctcacagtctttctgcaatataacaattgccacacccaacaagataaacatggctgctccgtccaggtcaagcaggaagatgtcttccccaaccttgagccagtcttgctctagcagggatgcacactcaaacatatagttccagcagggaggaaatgctgctatggaaatgtttgtggctaggaaggcctggccccatcccgcagccataagcccttttcaaaggtgtcacctaaatgtgaactgatattgatcttttaaagagcatttctctgtctggtgtgcaggcacctcattctagacctttctgtttccagagcctgcataaagaggtactgtgatggctcaggaactaccctgctcagcaggagcactgcctccagctcacaggctgtgcagagcaactgcccctggggtttagctggaatattctatactcccagggaacaaattcagctcatttcagcagccacacatggagctcttgtttttgggcactgtgcaggtgctagggcatgcggatgtgaagatgagtaagacacagcctctgtctccttaggttgggtgcagggaagtctgcagatggctaagggctttcccagagcatgtgcatgaatcaaattggggagtccaagcagccttttgcctcctctcaactcaagaaacagcaaattccacacctggaatacagcaaatatgtgtgatcacaggggttgggaaaacaacgcaactcatctattgctttataaataaatattccctgactagctactacattccaggcatgggggatatatcaaataagagccctgccctccagagcagtgaccatagtaagtgagcaaaggctcgatgtcaagggtgactactgtgaagaaagatgccatcaaatcagggtaggatctgtcattttggagtctcagtgggggccccactgggaaggtgatatttgagcaatgagtgaaggcggtgatggcagatgtttggtgaactgagtgatgagctgcagaaggaacccttgctgtaaagagctgagagagatgcaagctgggtaagtccaaggaggggcaggaaggcaaacgggctgcacagtgagctgtggaggcaggaagggacagctgaagctgcaatgggttgggagaggtcacatcatcctcactggcactgtgaggacgttggcttttactcttgagtaaaaagggggtgctggagggtcaaactgtgaagtaaagtcttctgactgttttaaaagaatctgtctccaaaaggagggaggttgggaggtgggtgagggatgagaaattacctaatgggtacaatgtacagcattcagggaatggttacattaacagtccagactttaacaccactaatatatccatgtaacaaaactgcactcatatcccctaaatcaaaaagaataaaaaccaataatactagtaaaagaacctatccctgccttggagacagggctgcaggggaggatggaggtgtggagactggccaggagatcttacggagatgagcccaagaccctggcagctcaaaccacaatgtaccgggggtaggggaggtggtgtggaactgatgtttaagggagggccaaaaaaaaagaaaggaagaaaaagaaaaagtaaaagatgctggtaaagattttggcctgtggctgggcctgatggctcacgcctgaaatcccagcactttgggacgccaaggcaggcagatcacttcaggtcaggagtttaaaactagcctggccaacatggtgaaacccatctctactaaaaatacaaaaaatagccaggcatggtggcgcgcatctgtagtctcagctactcaggaggctgaggcagaagaattgcttgaatccgggaggcggagtttgcagtgagctgagatcgagccactgcactccagtctgggtgacagagtgagaccctatctcaaaaaaaaaaaaaaaaaaaaaaaaagagaaagaagattttggcctgagcaactggaaaggtccttccacgggtacagaaggcaggtgtgtggctgagatgtctcgagggtgtccagagggggcgctgtagggacgccgggactcacagcccagagtccggagaatggtctaaacagagaattcctgtctgaggctgttgcacatggatcatggatggatccacatcaggaccctggctgagcccacaggcgggaagcggtgtggatggagaagaggaccaagggctgaactgggggcagcctccagcaacaagagacccatctacctggagatgagcaacccgtggaaaccaagccttccacacaccacggcatctcactaaccaagaatttaacaatggtgacactcaagcctcatgttccaaaacagatcactctttaaacaccaccttaaaaagcgactcacattttacttccactcttttcctcaattcccttatattttgttcctaaataaagcagttaaacttaacgaaagttgatgtgcttaaaatttaaaactattaatagcctccaacgttccagagcctgcatttgcagaatgcgcggtctgagtagctgcgcagctctgtgtgggggtggtgctcacctgagagtcgccccagggtcgtcagggtcgaaggactgggtccctctgaggacaatgggggatgaggtggtcctggagaagaataggtgtgtgccctcggagatcacactgacaggggcctgggctcgcacctccaggcccacacagtagttgctgtacaccacactgccttcaatctgaacctgcaggggcaaggaaggacaggggatgtcatgcagggacaaggcagggactcactggagaaacacactagtctgaaaattagaaaggaagccgacgagtctcaacgcatccctggctccaactaaaacagtcttggtagtcaaaataaccactctactgtacgacatgagagctgtgactggagtccacgagaccatggacatcttcctatccaagcttgtgttaatgtacaaatttgggcatttcctagcttgtgaacacaatagagactttccatgtgtgcacattttatagttttcaaacctcctccctccacagtgaattgttcaggctcctggcttttgtgcaacttccttcacctatcttagagctgcttctttctaacccccaaacatatcatggactttaggaaatgtaaatgaaatttaagacaaatacttttaaacccaggaatagcagaacatgttataaataaaacattcatattgttcttttacaagtttgatgcggccaggcgcggtggttcatgcctgtaatcccagcactttgggaggctgaggtgggtggactgcttgcactcaggagtttgagaccagcctgggcaacacggtgaaacctcatctctactaaaaatacaaaaattagctgagcgtggtggcatgtgcctgtaatcccagctacatgggaggcagaggcacaagaatcgcttgaacccagtagcccagagggggaggttgcagtgagctgagatcacaccactacactccagcctgggcaacagagtgagaccctgtcaaaaaaaaaaaaaaactgacgcaatttgaaaaaatacagtctaatacttgctattctttcactgggtctcagccttgatcactctagattttcttcagatgcacacagttccctgctgatcagtctcctgagtaggaccaaagacaacggaacagctgtaggattagaactctcatttccaccttcaacctctgtttgctcagcctctccagctccaaggagctgctgagaatattccaagtatatacaaaggctggaggaggcaccaagcaggaagctgcttggggaagatgcagggctgttcaggagcaaaggaaacctgaggctctgactgtgaggtcagagacagcagaagttaccttatctgtcagaaggtctccaagacctagagaaagacacagaccccctgtgaagacactgaagactacagaagtggctcccagctcatagccaaacctccttcggagctcccattacctggcctgtcccataggctggacacatcttctatggcttgctgggtttaatttaaaaattacgtagtttatatatttagaaagcagagttttattttttaagaaagggattataatctgtaagcaggaagtgtagtctctggctaagaaattgaaagtaagtatttggaggagggagggaggggtaagaggaatttcagttgaatgcattatcacatattcacaggatataggagttatggatatctatggaagaggattgtgtttttgtgtaataagtaaacatatatatgtgctttatgtttacttttgggtggagacaatattgcaatgtattataattaggtcttttatgttaaaaggtaaagtagggacatgaaggcacttaaatgcgtagtcaaactgggcagaattagtttacggttggtgttttttattaggaaaaatttatagaaattagttttttgtttaattaaagtcatagttaaggcttgaggaatggggggttaattagttgatgtttggtggttgtagagttgtaattgttttaatactgtttattttaaggctagtgtttgtttagttgatagagaaaaggggagaaaaatcctgtggcaatgagaacagcttattttttaattgtaggactgtgtgatttcactcttgcctggccttaggtcttgtttataatttggtatcttattgtcataaagagtatgtcctggccaggcgtgatggctcacgcctataatcccagcactttgggaggctgaggcaggcaaattgcttgagcccaggagttcgagagcagcctgtgcaacagggtgaaaccctgtctctacaaaaaattagccaggcatggtggtatgcacatgtagtcccagctactcaggaggctgaggcagaaggatcacttgagcccaggagggagaggttgcagtgagccgagattgcagccactgcactccagcctgggcaacagagtgagaccctgtctcaaaaaaaaaaaaaaaaaaaaaaaaaggagtccgttctgtcagtcttataatcactattttaacattaatgttggtcagttgttgtgtctaaactgtgaaagggagggggcgtaatgaggcatatctgaccttgagtcccattatggccaggaactccattttttaagtattttctgggtccccttggccaagaggggatttgtttagttgtttgggggggacttaggattttatttttagtttacaggctctatctacctcccctactaggttgttcacacaagtgtgcaaagaccttatttatctccaaatccctccccccagcacacagccaggtacaaatagtgctgttttcattaggaaaatgaagagcagcctcaccctcctccactcgttcagtattacagattttcctttgcatttccccttggcttcttacaattagccacccatcaggtcagatgctccccaccaccccgaggtcccctgacattgaccctgctctgctctctattccccagctgccccctgcttcagcctctaatgacttctcaccttcactaacactctcccaacatcccatccttcagtctgtttcctactcgttcccaatcaacatttctaaagaagagtatacagcctgctgggaaagctctgctttttcctacaacctgcatctgaagtaatgctatgctaagcctggtctgcagcctgttgtcacttggcccatcgttacctgcctatttcgcgatgagataagtacagacactgagaggaagcttctggcaactccagcatttgccatcgctgtgacatcccagcacagattgggaggatttgcttcctcaggcaaggtcagggcagtttgggtgccgaggagctttgtggcaagccacacaaggcaccagatggaactgtgctcaataggactgcgtgccccacagcttaaaagaacaaagctccttcgctgcagatattctgagggtccctgatcaggttcccgcagcctggcctgcccactgtgcaatttgttcccagaatctcccaccaggttctgctcattatccctggtcttcttctagcctttgccaagctgttgcccctcccaatccctttctatgtctgtggacagattctcttttcagcaccctgtttcttgaagcctactcttttaaaaatgacctctccctcttttaactcgcatattttcaccactttttccagccaaaatgcaccaagcacatgctgagaatcaaagtgccaggcagtcaccgtgagtgcctcttggatgccctgccctctgactgtcgtctcctttcctttctgggtgattggcccctaaatggcagggccacacattctcctgacatcccggcaccagcacagggcttattcaaattaggtacacaggaaggttttgttatacacattggaaggagcttttcatcaattgctttgactgcatttgaacataatttgttctctttgggggaattaaacatttctcttaaaatccaatgcagatttttttttttttaaacaacctcccttttcctggatcgaacaggtgttgaattccaaatgctgagctcttgctccagggcgatgagaagcatgggtttcattgggccagtagagcagtaagtcagccagctgaccttggcaagggcagtgtagttcccatactccaaggtgtggctcgggaggatgagggtctgtctgtgagtgtccacagcagcagggagggagacagggagcccttcagagtccatcaagttccaggtgtaagaaagaccttgggaaatatcacagaagactgcagcttcaaacgtcactcccagcctcacaggctgagacctccatatctaagtatcaagaagagaagatgtctcattaaaatgtccatcacatctaatgtactggtaaattactagaaacttagtcttaactgtagatctcccattatttgtttgcatagtgacagaatggtattcttaggtctgggctttagacaacaccagaataaacactacatctattttatagacaaaaataaaaggttaaaaaaaaaccaactaaaataataagtaaatatttatatactcatgagaaaaaacttcctatgcataaaattaatggaaaaatagcaaagatatctgatatttgattacataaaaaatttaagcttccaaacgtcaaaaatataaatgttatgcttctgggttttggcacctatgtgtatatataaattttttaaatcaatgaatataataagaaaatcatttgcagtatacacaacagatgtttgctttccctatttttttcttcactgaaatattcttaagtcattctcagaaatcatgacatttaatccctaaatactaaatatacatctctaaaaactaagggaattttcctacatcaacacaacactactatctcaccttaaaaattaacaataagttcttagtataatttaaacctagtttataataaaatttcccttattgtctccaaaacatacccttgtgcaattgtttgatttgagatgcacaaaagttcttttgctaaaaaaaaaaaaggagagaggagaaaaaaattttcttatcaactagaactatgaggtttcctaaactatagtttggtcaggaaaataagaataaatgcttaattctttcccttaattaccaacattcagagtaagaagctggggcactagttacttccaaaggtgaccaatatgttacttgtgtctgcctgcttggtgggaacagcagaagcttctctttctctttcagcataattatttttaaaatattagcattattcattcaattgtagatgttactttttagatgctccaagtagcccatcaggggcctggggcactctccttggcctggctctggcaaccttctggtatgaccctggtagtcttttaaagtgatgggtttgttgcactattctttctactgttatttatgctttaaaatttccataacaaagaattttaaatgttaatagtagctgatacatatacaaaaagcatatttgctcactttaataagccaatgaggatgaggatatgggggggaatattagtgtctacccatccacaccccttactcctcccagccactctgtctttctgaagcccctccacaccccctactttgggctggagccagatgccacctcaagcatggaggagcaagccaggctagggggcctcaggatagagtctctgcctggccagagcgcctccaccctgcagatgctgggtgcagggtctcccccagagggattttttttttcctgaaggttccctaaaaattggaaagggaaggccaggcacggtgacgcaagcctgtaatcccagcactttgggaggccaaggtgggcggatcacgaggtcaggagatcaagaccatcctggctaacacggtgaaaccctgtttttactaaaaatacaaaaaattagccaggtgtggtggcggacgcctgtagtcccagctactctggaggctgaggcaggagaatggtgtgaacccgggaggcggagcttgcagtgagcccagattgcaccactgcactccctcctaggcaacagagcgagactccatcccaaaaaaaaaaaaaatcggaaagggaaaaacctggaggcagctgagaaatgggattttaagaaatcttggtgctcattataaatgaaagtttacttttgacattctttaggtgactttagttataattaaaattactttccaattactttttattgtttctattctgaatatgatatcattctaagatttgtcacaaaactgcccagatttatatgggttacagcaaattttaatactaggatgccaatttttagctcattcatgataataaacattaaaaaatatgaaatgcctagtgagagtgagagttggtccctcagagcggacacatgtgagctgctacaaaaacatctctaggcttgtcaagattctgggaaaggcattgtgttcttcagttctataacttgtagtaattattcctgtgaaaaggccatacacttgcagaacaatgtacagacagtgtaattgccaagttatttgtagtgatagaaaaccggaaacttggccaggcatggtggctcatcgcacattgggaggccaaggtgggcagatcacctgaggtcaggagttcaagaccagcctgaccaacatggtgaaaccccatctctactaaaaatacaaaattagctgggtgtggtggtgagcgcctgtaatcccagctacttgggaggctgaggcagaagaatagcttgaacccagggggtggagactgcagtgagccgagatcatgccattgcacttcagcctgggcaacaagagtgaaactcagtctcaaaaataaataaataaataaataaaaagaaaactggcaacaacagttgttcaatcagaggacattatatagtgatgtataatctttatgtatgatttaacagtaagacatcattaaaattatgtaatcaaaaggctgcttaataacaaaagaaaatgctcacactgcaacccaggtttgtgacaaacacacataccacatataaaaagccttagaaaaatactgaaaataaataattagacaaaagtggctatcacctactgcctggatttgagatgatttcatttttttctttatacttttagaaaacacgtaaaataaagaaaaaatgaccgggcagggtccttcaggtccataatcccagaactctgggaggccaaggcaggtggatcaattgaggccaggagttaaagaccagctagcctggccaatatggcaaaaccccatttctactaaaaaaattagctacgcatggtggtgcacacctgtaatccctgctacttgggaggctgaggcaggagaatcgcttaaagccaggaggcagaggttatagtgagccaagatcatgccactgcactccagcctgggcaacagagtctcaaaaaaaaaaaaaaaaaaaaagaaaagaaaaaatgaaattatcaatcttattttctgtgttttacagataagaaaataaaaataacaatgttttacagataaaaaactcaagaaaaccactctgtcccatgtcctaacagcagagtcaggacgggagccagagtcctcctgcctagggtctgtgctttttcctgctgtgccttttgctttagtccctttgctatttgggtccaaatctcacacccagagaacgcgttcccccagcacgcagacctgcccaacagcgtgggtgctcgctggtctaaaggtgggcaggggtattgcctgtgtgggggccgggaccctttccggattgccccgggcacttggtctctgcatgctgatctccaccagcaccctctgcgggctgacctcttggggtcagatgccacagaaagcagtttagcaaatgcagcttagtcacggattttaattcccatgtgtcatttgagcacctctgccctgaaaaggaaaatttgctctgaatcacaggcctcaaaggaatgaaagaaataaaaaccaaccctattttttctaacccagaataggtgttcaacagataaccgatcatgtcctttcattttggtgttacatatattcaaatgtttcattctcctgaaaatgctacagttcttagcataatccaaaaaaagaaaggaaaggaaaggaaaagaaaagaaaagaaaagaaaaaaaagaaaagaaaagagctccttaaagtgagctgtgctgaatgccagagtaatgcaggcgaataaagaacttattcacacaccagaccccagaaatgacactgtctcctcctgtccaggctggggtagccctccctcccctgaggacccaggtcacccgctctgaagcccttataggcactcctttgtgtaaattgcagtaggataaactggacaaagcctcgcttcatgccccaaactctcaccactccaaacagtggtcccaactcagagggaggctgaaaagaggctggtggaggatttcccagactccgagcctacctggactttcccaggccccatgttcttcaccaggggtggctggcagggctcgcacacgatgaaaagttgctgtcttagagtggaggcactgacattattgaaggcaaggacctccactgtaaattctccttccctgggacggtggaaagcacagaaatgaacaaatttatgttgatgaacgtcaggctttcattcactcttcatacccactcatatctgcagaattatagtatttgacagcaagtcatcccatgaataagaacagaagagtcaagggtcacaagactgatttccacagaggtctttcatcatttaatcaacagactggctccccagctagcctgggccaggccaagtaccaaactcccagaccgatgtcacatgctatattcaaacaatacatctatgtgaggggcatgttgcttccttctttgggcaaccctccccacagccatgacctggcccccttttgataacagaacagatctatatattttctctgtgtgatgggtaccccaacccataactggggggtctccggggatggtcttcctgttctatttcctgctccatggatcagttttcctgaccaatttcttagagtcctacaaactcaggaaggacaggatagatccatagcctgtctccgggtaaggggagcatgtcacagctgtggagagattcaggacagttggaggtgagagctgggtagctcctgacccagcaggtagtgctttactaaggaaataagtggttattttgcaaatgttgcaacatggataactacttaagacttctgaatttgaaagagaaaaatattcccatcagaagaccacaaatttgagtttgcaaggaccagaatatcacttgccatcctggagctccagcaagaaaggtagggcctactgataagaatgaagactagatggttttctcaggttgtcagagcgcccagggcacactctagagatgacagtggaggcaccgaataaaccatgtcacttccacagggcacaaaagggcttctggagctaccgagtatatcgccaggtacctaggccaccatgtgctcaattgagcatgcaccaatctacaagccactactgctcaattctttccttatgtgaaaatctatttctgatgaaaaagtcctgaatccatagttagtgatggggccattcagtccccaccaaagcgtggagaggctgcagtgtgggttctcatggaaatcttgcattggaggaagtttgcaatctttccctgatgccactgcctacacgaacctcattttctagatacttctgcaccctttgacatttccctacagcagcataaagttttgatgccagcctgaggctcagccttgaccatgtgtgtctccctactgaaaggattagatccacttgggtcctaggactcaccctagaggctcggctgggaatgagtgatccagccagtctgcaccttatcatatctccacgatgctttgtcccaggtacacagtggacactcagtaaatgcagagttaaaggacagagttcatgctcttccatatgacatcaaggcccttcacaatctgccaacctacactcatctcacccttctatatacgtcttgccagtcactccaaacatctcctgttggcacctcacttagcacctttgcccaggaccttgtcactgtttgggagcctctctcccatttccctttgtcaagctcctactcaagatatcactttcagtaagccatccccaccacatcacaggcctcctttgcagccacagcccctgtactgaaagcatctctttcctctttgtctttcccctggactaggagctccttgagaagcatggtcaggtcttatttgtctctgtgtaatcatctgtcacctacgttgactgacaggcaggtctctatgtggaacccaagggctgatgccttaagactctgattcccgcgctgtctgtagagagcactccgccgccttgcagtggctcacctactgtagacatggctgctggagctgctccccaggctgacggtgccatccccaaagtcccacaggtaggcaacatctgtgccgaagttgatccagcactcaaaggccacactggcatttaccagagctgaggagggggacgtgagccgattggccacaattttcttctgcaccctgatgacatggggctcagagaccacactgctcatcctgttggaagccttaaccatcacacgatacctgcaggatggggaaaggagggcagggaaggcagatggcaagacaagaacagggtcaggtctagagaaaccgtctgctatactttaagaggaaggcgggggagggggaggcagcatttaatttgtaagaactacaaaagtatctagtgattttcatcttattgaggagaagggggttgatatttttgactacccccctcttcattatttaattcatttctcaaagcagtaggggtaagcatcattgccctttcttagatgaggaatttcttaggtcacatgggtggccgagatagaattcgaacctaggactgtctgcttcaaagccctacaccgtttcccttagttcaagctgaagagaaatgaacgaaatcttcccttaaatcttatgttgagtttgcttcacagaaggacctagtggcccattataatacaaatgcaacagccataaaatgccttcggtagcagcatggtgatcttcagactgagtataggctgcagtacaaacagctactcagcaggactgctacttttactgaccattgggggatgctgagtctttttttaatgcttcttgaagttgtcctcactggtggatcctctccaaaataccactcaaattccaggggtattgtttccttggtaacagctgtaaatgtaatgtctgtgtctgtggcaaacacagttccatttgtgtagacagagacggctgtggcaaaagaaaggaaggtatgtctatgtcaacataggagggctggaatctccagagaaactagtacctctactttcccacttggtcatgggcttgagtgatggtgaggaagctctgatatgcatgcagattggcagcaaggatgcagctgtgggcacgcggtaggcagtgctggccctggttcaaaggccccaaagtgcttgcacaggaggtgctcctaaggccatagggccaactccctttgagattctgctagaaagggtgtggcacatggagctggcagataacagtcccgataacccaccttcccattccttcaattgggagccttaatgcctgtggtttcagaaaattcccagaacaaatggcagatgaacaaagaacctgttcaatgacaaatggggctctccagcagagccgataacaaaacctgctgctgcctacggctttcctaatctcagctgactgcgcgagggaggtttttgttaaatctggaattaaaacaaagacatacattgcatcttataccagacagtcatgctgtgccaagcctggctgtcacccacttgagtctgagaaataaaggacacgttatatgaaggaatagatggaaagtgatgtataaccacagtgcctaaaatgagaaaaaaaggagataagagaaaaagtcttaaaattaattcacttttatcatgcaacacacagtcagtatttttcatttttaactttccccctttgaatctcaataaatttcaaaattctaagcatgtgctctgaaatcagacatacctgggaaacataaacttaatcacagaatttctgtcattaaatttttctttgtatattttctctaaatgagaactccctgcatggtattaaatatgctaattcctttgaaatatgttaattactttgatagatggccttgtttttaaagtatttctcaatatgtacactaagtagtcttcacttcacaggagttcttaaataggggtctaataagccttgtgcttttaagtcctataagatgtaatgtaagattgtgcatatatgtatatatacatgtacacacaccatacacataccacacatatagcatatacacacatacataccatatacacaccatacacagcatatgcactatacacatatgcacatgtacacacatatcacacataccctcctatgacataccacacatgcatgtacatatgtatgtacatacatatggaggtggataccaaacactgaatcagattctgaaagagtactgtgatgtctaagaagatttagagcaactcatttatcataaaagggtattaagaaaggagggttatttattattactactgttcttctgcataattttctctttataaagagaaaatacttgtttataacagagataaagcagaatgggtattctgtccttcatcaatgcatcagaatttttgaaaaataaatatcatatgactaaaaatagatatatgataaataaatatcacatggtctcattaagcatgcctgaaaattaattctgagcacaatctgataatcaaaagtgttaaaaaaaaaagatatagtttacagatttgcacaagaataccctattatcaatctgtagggctggatgcaaacttggaccttcctattctaaatcctggcatggaaccatcggaaatttacaagaattgtgcccttgcactggctagacgtgctgcttatttattcaggtttagataagacaagtcaatatgaatgaccaaccggctagttagggtaggcaaacaggttaaaaaaatccttccatatgtatgtcataacttcttggatggagagtttctcactagtctgattataaacaggtacagccactgtgtggaacagctggaaagaattcttacatggatgagttcactgagactcatcccttcattggatcctcctttctcctgtttctgggaaatgtgaccccatcatcccacccatgtaggctgggcactttgggagtgcctctggctggctcccatttgctttgttgcaaagtgtagggactcttttttctacggtaagtggctggagttccccattcccacccccaatggcctctgagcttccggtccctccctctacaaaactgacatgaagcaaatacctcccttacaggtagctgtgcggataaagtggggtgacacgagtgaggcgttagcagtggataaagtggaatggatattttgtccttcatcaatgcatcagtgtgcacctggcacactcagtgagcaccggatgctttctcaattctgttttagctcaaggccatgctgtctgaccaaaatgtgcctccagcccgtgctgcaaggctcattatgtatgccagctcccacctcagatgtgccctgtccccacagttagataaagttcctatctcctaaaatctcccagccccttagccatatccttcctaagcatttttaatgtcgtgtctcatcttgctcctatgcatatcttaatattttcactaagataatagattccttgagatgaagactttgtatgactttatcttcatgttccctcagaacacagtattctgcaagacatattttctgaattagggaagaatgaatgaaggatgttgtatcaaatttagaactgctataacttgaacagtataagtaaagcggagataccctgcttcatttatagttgaagtgtgcttgctcagactccagacatacgtcttacttttctgattcacttgggagtcagcaaagacaagcacttcatcttcatggacactgctggagttcatgaacgcagacacggcctcatggccaatctccacataataaggcccaagctccacttcggttccatgaaactcgttataaataacagccttgagcatatagactccttctggaaaaataagaatgaacggacacttgatgaatttttaataacaagcataacagttaacatttgtagaatggtcaaaatggggtgattaatatgggaactgatacaggagaggtgatctttcttgtctcttgtagcagcagggccatttcatgggcatgtgacccatacagttgcacagagcccctcacgcaatggagctatgtgagtgatttaatgctctgctatcttgaaattcttcataattatttttagcaaggagtcctgcattttcattttccactgggccttgtgaattacgttgccaatcctctgcagtaggaaatattcataaggaagaaaatagatattagttatcccacagctagacaaataatacttaaacagccaaatgggaatatatcaaataactatgatgatggatgacaaaaatggtcccaaacccttatccgtttttcacacacttacaatacaactataatatgactctgtggctcctctcattaagtggagaagactattgcttcacccctcgaatcagtgctaatcatatggccagtggattttcaaagtgcttgcacactggggcttgccctctctttcttgtcttgggacctctgtcattgtcattgggaccatgtcatttccatgtgaatagcctggcctagtctgctgaaggatgagatacacatgactgagtctccccatggccccagccaagggtcagtctcctccaggagactggctgcagatctgtgagtgagcccctctaagaccagctcagacctgaagaactcccagcagaactgggagctgaataaaaggttatgttttaaggcactaagtttagggtggcttgttaacacagcaatagactgtcaatacaattccactgaactggaaagacattagcaattctctaacctcaactccctacacaatattcttaaactgtacatttgattgtgtcattccccagcttgataatgttaagtgattcctcatgtgtcacaggagcaaatctgtacctgagcccttccctctcagctgagctggttcccatcactcatccttgactccaccaggcccacaactgatgcatcagccacacaaaaccaggctccactgctcagacggccggtctccatcacaaatatgcccctgtgcaggcttatctcagtttacaacatccttctttgtgcctccatctggccaactcgcacctaccatgagcctctttgaatgacccaggcagaatcactggcttcacctggcatctgactacagaacgtgggccaggtttccctctcagactcactacattctctgtctttcttgtcctcaaacctcatcacagaacacttagtacatacataataaatgtttatcaaaggaccaatcaagtttacagaatggaatactgaagctcaaaaggttaaacaatgtgctataggcctagagtatgcaatgctttcttaggaattaagatagtcatttctctcttcacttgctgcatccaaattatatggaataatatgtggatctactagcagcataataagaagaaaaaagggaatgatcttaaagagtaaaagtctatctctggggaagaatagtgaacatggtagcatgcaggaggatttgggaatactgtgataagcagaggccagagagaagggcatcgtactctaagcacaactcagattaacatgtagaagaaataggtacactttcccaaattgtattctcatcttggaagctatatctcaaatgttgagacaacattcataactctattgcaattttcttacaatactgctcctcttaactgtgtccaaaataattttgcacaggaattttaatgacaagtagaaagtgaaatagatagccatgcaggtcatcccatgcacaggaaccagaacttaactaagagtgtgctacgtgttgtttcatgtcaaaaggcagatttcacgaccacaagttagaaaaggcagtttatataatagttaagaatacactccacggactcagaggaatttggcattggaaatctttgtgaccaaatcttaggcatatcttactttctttttttttttttttttgagacagagtcttgctctgtcgcccaggctaaagtgcagtggcatgatcttggcttactgcaagctctgcctcccaggttcacgccattctcctgcctcagcctcctgagtagctgggactacaggtgcccgccaccatgcctggctaattttgtttttgtatttttagtagagacagggtttcaccgtgttagccaggatggtctcgatctcccaacctcatgatccactctccttggcctcccaaagtggtgggattacaggcgtgagccaacgcgcccggccaggcatatcttactttcaagttgactttttttttttttaagatagagtctcactctgtcgcccaggctagagtgcagtggcatgatctcagctcactgcaacctctcctcctggattcaagcgattctcctgcctcaccctcccaagtagctcggattacaggtgtccgccaccacgcccagctgattttgtgtgtgtgtgtgtgtgtgtgtgtgtgtgtgtgtatttttagtagagacaggatttcaccatgttggccaagctggtctcgaactcctgacctcaggtgatccacctcagcctcccaaagtgctgggattacaggcatgaaccactgcacctagcctcaagttgactttagacttaacccctgataaaagatgtaatactgatatagttcggatgtttacctctccctaatctaatgtgtcgaattgtaatacccaaagttggaggtagagcttggcgggaggtgactggatgatgggagtggattcctcatgaatggtttagtaccatcctttggtggtgtccttgcgatagtgagtgacttctcttgaaatctggctatttaaaagtgtgtggcatctcactctctctcatttctgcttttactgtgtgctgtgcctgctgccctgtagccttctaccatgattgtaaacttcctgaagcctccccagaagctaagcaaatgtcggcacccgtgcttactgtaaaacctgcagaaccgtgagccaattaagcttcttttctttataagttacctagtttgaagtatttctttatagcaattggagaatggcctaatacaaataccaattccttactttattcataaaacaacaaaagaaaccaatgaatatgtatcaaagttgcagatgcttaaaattattataatagagcaagtcctgatgtgaaatagagatatacttagccttctacttaatcttctaggagttaatccaaaaacaaaaaggaaaacagtgaataaaaataaaaactttttctctctttgtttagtgaaactaggaggtagctagcatgttcagaatacaaaatagacgcaaaaactgctaaaagcggcaaatatcaagcatgcatgagcaggaaccgtattgaaggaagaaaacagaaaacgtcctaaagtgagaactcagttgccaaagggctcagtggctgtgaatatcatcaacacgcatacatgtgtgtacgcaacacacacacacacactccaccagcagttagttcagaaaaaaatgcaactctttaaattatgagtaatgctgtgaagaaaaaaaaaaaaagaaaggaaggaagaaaggaaggaaggcaggaaagaagaagggagggaaggataaagggagaaaaggagggagaaaagaccattcagcatgtacaagatactataagagtcaagagggaaaattcaggaaatactcataatagattaagataatttatcagaaaaacactgtccacaagaacaggactgaacaacttgaggaatcgttatcttctgagatggaagaccagagagcatctggtcttggaaggaaacaaagtcaacattttagagtataatggagaatggaaagtgtagaacacaaaagaagggatgcagaggaaaatatgaggaaagcggatcagatgaaaaaggaaaaacaaaaaagatttgaaaagacaaaagagaactaatagatgtatgccagtctcccaaaaagaaagctgacatattggaatagaaacaatgtaaagatctaattcaagaaatctttcctgaaacaaaggacacattgaaaaggtacaccatgtgctggagaaaggtgacccagagtggccagcacttagacacgtgctggcaaagctgctggagttgcaaataaagaaataactaccggctgggcacggtggctcagacctgtgatcctagcactttgggaggctgaggcgggtggatcgcttgaggtcaggagtttgagcctggcctggccttcatggtgaaatgccatctctactaaaaatacaaaaatcagccaggcgtggtggtgtatgcctgtaatcctagctacctgggaggctgaggcatgagaatcacttgaacccaggagatggaggttgcagtgagccgagatcatgccactgtactccagcctgggcaacagagtgagactgtgtctcaaaaaaaaaaaaaaaaaaaaaaagaaaagaaataattctcatgacaatcacagaaaaacattaatcaatgacggggaaaaaagaaggctgactttggaatcaccacaaggtaagaaagacagaatggagaatttcagggaggcttcttcagacagagtgtcagggccaccagctgaatttctgattcagtaggtctgcagtgggcctgagagtctgtattctaagccagtctcaggtggtcatgatgctgctgggccaaacttggagaaccatggttacaggagagaacagaatggaaagacaaccagattccccaggaaaagaacatgtgtccaaggagtccagagccagcacactgtcgttccaacataatggcagcaacagttttgaatatgggaacttagaggaagcttattgcatgaattttcctaaaaaaaatctactagaggacaaacttcagacaaccaaacaggaacaccatgccaaaaaaaagctgagtgaggaccgaatatattagctctagaaccggaactaagactaatgtgggaaagcaggttgatatgatttggatctgtgcccccaccaaatctcatgtcgaattgcattccccagtattgaaggttgggccttcagcactggcggtgaggaggtgggtggtgattggatgatggtggcagatttctcatgaatggtttagtgtcacccccaatccctgccacttggtactgtcctcatgatagtgagttctcatgagatctggtcttttaaaagtgtgtggcacctccccccctcttgctcctactccggctatgtaacgtgtgtgttccctgttcgctttctgccatgattgtaagtttcctgaggcttccccggaagctgagcagatgcccacatcaatgtttcctatacagtctgcagaactgtgagccaattaaatctcttttctttataaattatccagtgtcaggtatttctttatagcaatgcaagaacaaactaatacataagtagcagaaaaaaaggtaaacatttcatgttctgacaatgtagaaatcatacagtaaacgaaatttgggctggggaagagaagaggtaggagctgtggaataatgcagattgcctcattagtaattgctggaaatcaaaagacatgaagatttaacaaagcaattaagaaaggtgaaagcatatatgagaaaaaaatgagtaaaattggtgataaagaagagagaagggaagaggaagatgggaaatattctaatttcatcattgctcatagtagctgatgaatggatacgctaaagaaacagagggataaggacattttataaataaaagaggtcaactaaaacaaggcacaaacctttcaagtatcagaaggctaactcagatgaacatacaaaagaaagaaaagactatttaatgaaatgtattttaaaatgcacacagagcccataatgtaaaatatgacaaacatctgtcatttcaataaagacaaaaatcactaaactcacatatctcaaataagaatgatcagaatgattcacacagcaaagccaagtccattgtagagaaacatctaggacagtgattccaaaaggtggcaaatgaaataatctccaaaattgtgagaggctgtgtgatgaggtgggagtgcccatgctgcaggggtcttcataggcaaggcagggcagaagacacaaaggaagaggcttgggccacctgggttgttcaaggaattgggatttccagtgaaaagggtaaaacagggttatgttttcctactcaggacagagggccaaccctgtgggaggatcacccagaatcctgatcctcaacctcatcttacccaatgtttgcctctctctctccctccctctccatctgttttcctttctctccccttcctccctctctttctctctctcttttctcccccccaacatcccctctccctcatcagcctttcccactggtgggtggggtgtggttatgaggaccacggaaaagggtgagcaaaggggctcagcagatagcagatacctggagccagcccacactcaccatacaggagggacacagggctgcaactccctgtaacctcctgagcagccatgctgctcctaacactgaccacattttaagccataaagacaacatcaggacttaaagttaaaacagcagagaaaagatttgcttatcatgctacattaaaactagaaattaataacgaaagcagttcacaaaagaggccacatgacatgtgaaaattttaaatgtaaataataactaatttagcatctgagaaagaaaaggagcttttatctgaggaatgcaaacctcctctaaatgatcagtccccagaggcgcgtgggaatgagacagcagtcacagaccacttccctccttgggctaaggaatcctgtcttaaaactgctagctatcccatgagtggctataaattaacctaacaatgccacacacaggacaccgtagcccatagagtgtatagccaatcactaatcaatgtcatctgtgtaaaccaatgaaaattcctgacaaacagctttatatcagcccactccttgtggcctctttttgcttttaaaaacatactggtgacaaaggcagaaataagctcatatccaaggttactggggtctgagtcttccaggcagctgttttcactttggcacaagtaaacatttaaagttgtattttgtgtctctgcttctttgtaggtggacatatccaactgaaaatgtaaaagatgaaaaaaaatacctataaaagcaaaaagaagaaaataaagataaaagtggaaattaataaactaggggaaaatgtggaataaacaaaatctgaaagctagttctttaaataaactaatgaaaatttacccaaccaattaaggaaggaaaaagaaatacaacgaaataaaaatgatagaagaaaatacagatgccaattaaaataaaagaactataagagcctattttgctcatctctatgcaaaaaaatgttaaaacctagattaaatagataattataaaagaaaaaataacttgaaagaactaactagtggagaaattaaaattcttaacagatgaatttccatagaagaaatagaagaaggtatcactgagctactccaacggcagtaagaagaaagtaccagtcccagagtgttaaaaaggaaattctccaaaatagaatatatatttccgatgctattcaaactgtttcaggacaaataaaagacaaagaaaactttcacacagcactgatatcaaagaccaaaactactgcacaaaaatcaatgactagaaattgttctgcaccagccatttgaaggtgatccagtacctatctacctacctgtcatcgaggagaaaagctataatgaggcaactggaaaattggactatttttcaactgcatttgcaaatgcctttaaggattttggcatttagaatcataggtcttgctgttaccttctgagttctttctagagttgacctattcattaagtggaacttgggttctaagatttaggtgccttagtccactttttataaataaataaataaatgggggatcacagtgaatgggaggcaggactagattgcagctccaacttggatggacagagcagtgtgtggaggctcgcatagtcaatttttgctccagaacaactgcaggaataaatcaggaaagctgagaggacccacagactccctgaagtaagtggattgctcctgcaggacccaggagacaccccaaatactgtgctggtatacttggctgagagactcacaaatggttcacatcacagtactctgtgcagacaacccccagtaccagcctggaatctggtagactcgctgggtggctagatccagaagagagataacaatcactacagctcagctctcaggaagccacatccataggaaaaggggatgagtactacatcaagggaacacccacaggacaaaagaatctgaacaacagccttcagccctagaccttccatctgacagagcctacccaaatgagaaggaaccagaaaaccaactctggtaatatgacaaaacaaggttctttaacacctccaaaaaaatcacactagctcaccagcaaggagcccaaatcaagaagaaatccccagtttaccttaaaaagaataggaggttagttattaagctaattagggaggcaccagagaaaggcaaagcccagtgtaaggaaatccaaaaaatgatacaagaagtgaaggagaaatactcaaggaaacagatagcataaataaaaaacaatcaaaacttcaggaaacaatggacacacttatagaaatgcaaaatgctctgaaaagtctcagcaatagaattgagcaagtaaaagaaagaaattcagagctcaaagacaaggtctttgaattaacccaatccaacaaagacaaagaaaaaagaataagaaagtaagaacaaagcctccaagaagtctgggattatgttaaatgaccaaacctaagaataatcagtgttcctgaggaagaagagaaatctaaaagtttggaaaacatatgtgggggaatgattgaggggaataaacttccccagccttgctagagacccagacatccaaatacaagaagcacaaagaatagctgggaaattcatcacaaaaagatcattgcctaggcacattgtcattgagttatctaaagttaagatgaaggaaagaatcttaagagctgtgagacaaaagcaccaggtaacctataaaggaaaacgtatcagattagcagcagatttctcagcagaaaccctataagccggaagggtttggtcagtctcttcaaacaaaacaattatcagacaagaattttgtatctagcaaaactaagcttcatacatgaagaaaagatacagtctttttcagacaaatgctgacagaattcaccactaccaagctaccactacaagaactgctaaaaggagctccaaatcttgaaacaaatcctggaaacacatcaaaatagaacctctttaaagcataaatctcacaggacctataaaacaaaactacaattaaaaaaacccaaaaccaataactaaagtatacaggcaacaaatagcatgatgaatggaatggtacctcacatctcgatactaacgttgaatgtaaatgacctaaatgctccacttaaaggatacagaatagcagaatggataagaattcaccaaccaacgatctgctgccttcaggagactcacctaacacataaggactcgcacagacttaaggtaaagtggtagaaaaagacatttcatgtgaacaaacaccaaaagcaagcaggagtagctattctcatatcaaacaaaacaaactttaaagcaacagcagttaaaagagacaaagaagaacattatataatgataaaagaagcacattatataatgataaaaggccttgtccaacaggaaaatatcacaatcctaaacatatatgcacctaacactggagctcccaaatttgtaaaacaattactaacagacctaagaaatgagatagacagcaacacaataatagtgggggacttcaatactccactgacagcactagacaggtcatcaagacagaaagtcaacaacaaaaaaaaaaacaatggatttaaactataccctggaacaaatggacttaacagatatgtacagaacattccatccaacatacgcagaatatacattctattcaatagtgtatagaactttctccaagatagaccatatgataggccacaaaacaagcctcaataaatttaagaaaatcaaaattgtatcaagcactctctcagaccacagtggaataaaactggaaatcaactccaaaaggaacattcaaaaccatgcaaatacatagaaattaaataacctgctcctgagtgatcactgggtcaaaaatgaaatcaagatggaaatttaaaaattcttcaaactgaaccacaatagtgacacaacgtatcaaaacctctgggacacagcaaaggtggtgctaagtggaaatttcatagccctaaatgcctacatcaaaaagtctgaaagagcacaaacagacaatctaaggtcacacctcaaggaactagagaaacaagaacaaaccaaacacaaatgcagcagaagaaaggaaataaccaagatcagagcagaactaaatgaaattgaaacaaacaaacaaaaaatacaaaagataaataaaacaaaaagctggttctttgaaaaaataaataaaattgatggaccattagcaagattaaccaaaaaaagaagacagaaaatccaaataagctcaataagaaacaaaacaggggatattacaactgacactgcagaaataccaaagatcattcaaggctacttaatgaacacctttacacacataaactagaaaacctagaagagatggataaattcctggaaagatataaccctcctagcttaagtcaggaaagaattagataccacgaacagaccaataataagcactgagattgaaatgttaatttaaaaattaacaacaaaaaaagtccaggtccagacgaattcacaggaaaattccaccagacatttaaagaattggtaccaatcctattgacactattccacaagacagagaaagaggaaaccctccctaaatcattttatgaagccagtatcaccttaataccaaaaccaggaaaggacataaccaaaaaagaaaactacagaccaatatccctaatgaacatagatgctggaatccttaaaacactagctaaccgaatccaacatatcaaaaagataatccaccataatcaagtgggtttcatacgagggatgcaggtatggtttaacatactcaagtcaataaatatgatacatcacataaacagaattaaaaacaaaaatcacatgatcatctcaatagatgcagaaaaagcattcaacaaaatccagcatccctttatgattaaaactctgagcaaaactggcatacaagggacatacctcaatataataaaagccaactatgacagacccacagccaacataatactgaatgggaaaaagttgaaagcattccctctgagaactcgaacaagacaaggatgcccactgtcaccactcctcttcaacatagtactggaagtcctagccagagcaatcaagagaaaggaataaagggcatccaaatcagtaaagaggaattcaaactgtcactgttttctgatgatatgatcgtatatctagaaaaccctaaagactcatccaaaaagctcctagaattgataaaagaatgcagctaagtttctggatacaaaactaatgtacacaatcagtaggtcttctatacatcaacagagaccaagctgagaatcaaatcaagaactcaaccccttttaaaacagctgcaaaaaaaaccaaaacaaacaaacaaaaacaaaaaaaaaaaaccacttaggaatatacctaaccaaggaggtgaaaggcctttacaaggaaaactataaaagagtgctgaaaaaaaatcatggatgacacaaacaaatggaaacacatcccatgctcatggatgagtagaatcaatattgtgaaaatgaccatactgccaaaagcaatctacaaattcagtggaatacccatcaaaacaccaccatcatcttcacagaattagaaaaaacaattctaaaattcatatggaaccaaaaaagaggctgtacatccaaagaaagactaagcaaaaagaacaaatctggaggcatcacattacctgacttcaaactatattatgaagccatagtcaccaaaacagcatgggactggtataaaaataagcacacagaccaatggaacagaatagagatcccagaaataaacccaaacacttagagccaactgatctgcaacaaagcaaacaaaaacataaagtggggaatggacgctcttttcaacaaatggtgctgggataattggctaaccacatgtaggagactgaaactggatcctcatctctcaccttatacaaaaatcaactcaagatggattaaggacttaaatctaagacctgaaactgtaaaaattctagaagataacattggaaaaacccttctagacattggcttaggtaaggatttcatgaccaagaacccaaaagcaaatgcaataacaacaaagataaatagttgggagttaattaaactaaagagattttgcatggcaaaagaaacattcagcagactaaacagacaacccacagagtgggaaaaaaaatcttcacaatctatacatctgacaaaggactaatatccagtatctacaatgaattcaaacaaataacaatcccatcaaaaagtggcctaaggacatgaatagacaattctcaaaaaaaaaaaaaaaaaaaagatatacaaatggccagcaaacatatgaaaatgctcaacatcactaatgatcagggaaatgcaaatcaaaactgcaatgcgataccactttactcctgcaacaatggctataatcaaaaaataaaaaaatagtagatgttggtgtggatgcagtgaacagggaacgcttctatactgctggtgggaatgtaaaccactatggaaaacagtatggagattacttaaataactaaaagtagaactaccatttgatccagcaatcccactactggatatcgatccattggaaaataagtcattatacgaaaaagatacttgcacatgcatatttgtagcagcacaatttgcaattgtaaaaccatggaaccaacccaaaccaaatacccatcaatcaatgagtggataaagaaactgtgatatatatatatatataatgagatactactcagctataagaagagtgaattaatggcattcacagcaacctggatgagattggagattattattcaaagtgaagtaacttaggaatggaaaaccaaacatcgtatgttctcacttataagtgagagctaagctatgaggatgctaaggcataagaatgacactcctctctccctctcccctctcccctccccctccccttccctttccccctctccctctccctctctcccctttgcacagtctccctctgatgccaagccgaggctggactgtactgctgccatctccactcactgcaacctccctgcctgattctcctgcctcagcctgcccagtgcctgggattgcaggcacgtgctgccacgcctgactggttttcgtattttttggtggagacggggttttgccgtgttggccgggctggtctccagctcctgaccacgagtgatctaccagcctcggcctcccgaggtgccgggattgcagacagagtctagctcactcagtgctcaatgttgcccaggctggagtgcagtggcgtgctctcggctcgctacaacctccacctccgagccgcctgccttggcctcccaaagtgccgagattgcagcctctgccctgccactaccccgtctaggaagtgaggagcgtctctgcctggccgcccatcgtctgggatgtgaggagcccctctgcccgccacccagtctgggaagtgaggagcacctcttcccggccgtcatcccgtctaggaagtgaggagcgtctctgcccggctgcccatcgtctgggatgtggggagcacctctgccccgccgccccgtctgagatgtgaagagcgcctctgccaggccgcgaccccgtctgggaactgagtagcgtctctaccccgccgccaccccgtctgggaggtgagcagcgtctctgaccggccgccccgtctgagaagtgaggagcccctccgcccggcagctgccccgtctgggaagtgaggagcgtctccgcccggcagccgccccgtccggccagccgccccgttggggaggtggggggcagcccccaccccggccagccgccccatctgggaagtggggagcccctctgcccggccgccaccctgtctgggaggtgtacgcaacagctcattgagaacgggccatgatgacgatggcggttttgtcgaatagaaaagggggaaatgtggggaaaagagagatcagattgttactctgtctgtgtagaaagaagtagacataggagactccattttgttctgtactaagaaaaattcttctgccttgggatgctgttaatccataaccttacccccaaccccatgctctctgaaacatgtgctgtgtccactaagggttaaatggattaagggcagtgcaaggtgtgctttgttaaacagatgcttgaaggcagcatactcgttaagagtcgtcaccactccctaatctcaagtacccagggacacaaacactgcggaaggcggtggggccctctgcctaggaaaaccagagacctttgttcacatgtttatctgctgaccttccctccagtattgtcctatgaccctgccaaatccccgtctccgagaaacacccaagaatgatcaataaatactaaaaaaaaaaaaaaaaagaatgacacaatggactttggggactcagggggaaagggtgggaagtgggtgagagataaaagactagtaatagggtgcagtgtatatggctcaggtgatggttgcaccaaaatctcagagatcaccactgaagaacttactcatgtaaccaaacaccacccgttccccaataacctatggaaataaattttaaaaaaaacaaaaaacactaattgagggggctcttgagcagccacttgctcaagcctgctcccactctgtgaattgtcttcaataaatctgtgcctactctggcaaaaataaataaataaataaataataaaaataaataaataaataaaatcaatgattagaagccaacgccatttatgaggaagaaccatgaatactatgttagaaaactgaatgcaatagcataatcaaaaagtaattcaccaaaatcaagtgtttttcacccctaggaattcaagaatgagtcaataagatattggctaatagaacacatgagatttggagttctaaagaagcaaagaaaaaagttataaaatcagcttcacagatgctggagagaatttaacaaaatcaacaactcttttttttttaagtcttcattaagagaggaaaagatgaaaactgcctttacatgataaattatatatgtcaaaaatctagtatcaagtttaatggaacaatgtcgcagcctgatgggttcttctttcccactgccctgaaaaaagactaatgagaccagcaggagttgcaacaaagaatgtaataatcacaggcctgctgagcaaggagaacagggagaaagttctcaaacctgtctcccccagaatttggaggctggggttttgtaaaagtactttttaaaaagtactttcccagcagggttctgggaaactggaacagatgattggctgaacaattgggatgaaatcacaggagcatcccaaactgtctttgtgcagctgagttagttccttggcagggatgtgagggggtagtcttagaactagatggtgtctcttggtctactgaaacgttaaatccaaaaaatatctcaaaatcagatctttaggtttcacaatagtgatgttatttacaggagtagttgggaaagttacacattttgcaaccctcagttacgtgactctggggcaatagacaacctatagaaacacaaactaagcaatggcaggttatggtttaatgcctactcattagcaaagtcctaacccctatcataattttaaccttgccttatgaatgtggctttaatcttcagacatggagggtgccagtttcctttgcctccaagtataatgataaacctaatccttctcatagttatcttggcctctgcattacagtaagcaagaaaaatatttagtctgtgaagttagaagcaagatggagtcagtcatgctagatcactcttattacttataattctacaaaagcagttcaaaaacactggaaggatcttgagaccgacatgcccatcatcatcaatctcatttaacactgttctggcagtatcagccattgtaattaaacaagagaaagaaactggagaggtcaaattggaaatgagaggttgataatcaccattcataattaatatgtttacatagctgaaaaacactgaagaatacacttcaagataactataaacaacatgagaattcagtgaaagagaagaggacctaaaatcaacagccaatagcagcagcttttctatataccaatgacaaccagtttggggacaaaatggaaaaaaaaagggaaaaaatatcccttttataatacaatagtgcaaaaaataaaatatcatacaagaaacaggtaaattctacataaagaaatgttcaggccgggtgcagtggttcatgcctataatcccaacactttgggaggctgaggctgtaggaacacttgaggccaggagttcgagaccagcctggtcaatatagtgagactcctgtctctattaaaacagaaaagaaaagaaaaaacagaaatgtttaaaatacttttaaagaaagatgcacggaaaaaatggacaggaacagggcagttcatgcagtgggagactcgtaaatataaagactctacataaattaatttatatattaaacatttgtaaatgaaaaataaaattctaagctctccaacctactgaatggacccctccttttggccaagggcattccaaagttaacctgaaaaatgagttcaggccataatgggaagggagggtcagacatgccccacgataccctcctcccattggaattgaggcacaactgaccagcattaacatttaaacagaggccttaagaatgacaaaacagactttttgtagcaataagataccaacatgacagatagcaggccctgaaagaaatcaaagtattttaccccaaaatatatttgacactttgaaattgtcctacgaaaagaggagacccaaaatgaacagcaaatagcagcagcttttctatataccaatgacaaccagtttggggacaaaatgggaaaaaatatcccttttataataaatagtgcaaaaaataaaatatcatacaagcaacatgtaaattccatatgaagaaatgttcaggctgggcgcagtggttcatgcctgtaatcccaacactttgggaggctgaggctgtaggatcacttgaggccaggagttcagggaaaaatttatgttctgtagagaattcccttccctttccagatcttttcctgatccaggacagaattaactgagtctggcaccttttaaaggctgataagaaacatttacaatctcttctctctgaaggctgctacctggaggctttgtctgcatgataaaatctttggtcttcaccaccacttattttcacccagacactcccttctattgattccaggtctttaggtaataacttaactctttcaaccaattgccaatcagaaaatctttgtatctacctatgacctgaaagcctccctgacccccatctttgagttgtcccacctttctgcgcagaaccaatgtacattttagatgtattgattgatatcttacgtctccctaaaatgtataaaaccaagctgtagcatgaccaccttgggcacaagttcttaggacctcctggagctgtgcctcagaccatggtcactcatatttggctcagaataaatctattcaaaaattttacttagtttgattcttttcatcaacacatgatttaaataaaaataccaataagatatttttatactagtcagtgtgagtctaaagttcatgtggaaaaaggaacaagcaaaaatggcaagaataacactagagaagatgagtgacaagggaagccagcaaatcacctgagggcagagaggaaaccagcattggtagaggcagcacaccccatcattgtggcaaccgaattccagcatatgatgctgagccaaatggatggccatgctagagaagatgagtgaacaagggatgccagcaaacggcctgagggcagagaggaagccagcataggtagagagagcacgccccatcagtgtggcaatggaatcttccagcaaatgacactgagccaaatgggtggccattcaggaaacagtcaaatggaatctataatgcaggctttatgccaggatatatattcaaatgcattcaatatttaaatgagaaaacagaataacagaaactctaggagaaaccatgagagaattgttccataaactcagagtaaggaaaaaatttctaactatgacataaaactcagaaaccatgaaaaaaaggttgataaagtatacttaataaaagttaaaaattcctacatgaaaagaaaaaaaaactataagtaaaaccaaaacacaaataacaaattgaaaaaaaaagtactaaaaagacaaattttcttttttttttgagatggagtcttgccctgtcgcccaggcaggaatgcagtggtgcgatctcagcttactgcaacctccacctcccgggttcaagcaattctcctgccccagcctcctaagtagggcgcgccaccacgcccagctaatttttgtatttttagtagagatggggtttcactatgttggtcaggctggtctcgaactcttgacctcgtgatccacccgcctcggtctcccaaagcactagtattacaggcgtgagccaccacatccagccgacaaattttcttaataacaaaagagctcattgaaaccccatattagatggaactgtgaaagtgctcagcttggttgaatatggtcatacactggcagttgacaaggatgaacctaataaaatgtaaattttaaaacttcagaaagatactgtttttacctatcatattgatctctacatcgttcacaggaatgtaaataggacaagagtcctaattaaaagcaatttagcattaactatcaattacagatgcacatagcatttgaggcaataatcttggctttccattaaatgacatacacatgtaattattcactgcaatgttgtttgcaatgctgaaagatcagaaacaatttcaatgttcagcaataaaaagaaagagctgaatagatttggtccattaaattaatggactactcagcaaccacaccaaaagccagggaagctctttctgtgtagacagggaagcccgtctagatatggatatgcatttaagtgggcaaggagtgggatactgtgtgtggtatacttccatttgtggaaaggaggggaaacaacacttatacttgtttatacacataaaagatataagaagtagaaggcagtagttgactgtgggtcaatagaaaaggactttttactatataactttctagaatgtgggagtttacaccatgagaatgtatatgttcaaaaagtaactttaaaaacaaaaggccgggggggaaggtgcagtggctcacacctgtaatcccagcactttgggaggcccaggcaggcagatcacttgaggtcaggagtttgggaccagctaggccaacatagtgaaaccccatgtctactaaaaatacaaaaaattagctgggcatggtggtgcacacctgtaatcccagctacttgggaggctgaggcgggaggatcccttgaaccttggaggtggaggttgcagtgagccgagattgcgccactgcactccagcctgggcaacagaacaagattctgtctcagaaaaaaggaagaaagaacgaaagaaaaaaagaaagaaaaaattaaatcctatccgtaagtggaaaagtatcagaactctccactcaccctccacccccaatcatcatctctaggggtttagtagttgtctgagtagaatgggtccaacgctggaatgtaaagaattttttcttacttttgttgagactacaaaatgttggaaattttagtgcaaaagaattcatatagaacattgtgtgtgtgcatatgtgtgtgcatgagcttgaaggacaatttaagtaatttttcaatagttattatttttagaattctgcttctgtgtaggatgaagcgccagtacattacctttgggacctcagggcaagtccccagcctcaccacatctacctcacaaggcaagtggaaagattaaatgcaatgaagtatgtagagttggtcacagtgcaaaacacagtgcacaaacccacctacgtccgcagtgtgccactgagctactattcttggagccaggaaggttggctgagtccagagaaacggaatgcagtttcttttcttttcccaacactgcctcttgggtcccctagctcaggacctccttcccaggctcctgataaggacaccatgcaccttaccttttgagtactggtggtaggcagtcaccgccattgcctcagacatgttgtgtagcctcatttcaaccccagaactgtccccgaaatccatcatcagacagagagcctctccagaagccatatgaacacggaatcccagatttggaggtgcccgagcttccacttccagggagcaattaagaacagggttcatgaagttatcagaatttcgagctaggatggccacaggaggatgctgagtagggggatagaggatctcagaaccagactgcgatgccgtgaagctgggggtgcgaggaatgccaggcggaaggccgtgggagctgtgggagagagggagaggcttcagatttcatgacagtggaccactggggtgggagggcagaagccaagcagcctggcctgggtccagccagctagaagccaagtctgagaaacctgatgaaaggcttcacttccactggttctcagagtggggtcccagggccagcagcatcagcatcacctgggcgcttgtgagacatgcaaattcttgacccacccctgacccactgggtcagaaactggggtggggccagcaagcccccaggtgaatctgaggtcagcaaaaatttgggagtcactgctctagctacattagtaacagtaaaaggtagagtttctctcatcactgatttaatagacacgaaagatggtatctcccacaagtcactacttcctgtgtttttgcgaaaagctccccgtgagggtgggtgccaccctttctacatttctccctagctccttgtgctgcaaattggttggggagttggaaatagtctaggatactcaagtctcagcttccaatcacacaggactttcaagatcatttatgtgttaaaagctggtcttgagtaaagcatatggtgttggtaccattacgtggcataaacgaaagattaaagaaagcaggaaaaggaagatcatggaggtagaaatggcttaagtatcttaatggccaattctcatgctcccatgtttttttttttttcctcttccagtgtgctgtgcatgtcccgttaaaaaacacaggcagacagatcacggggtcaggagatcgagaccattctggctaacacggtgaaacccggtctctactaaaaatccaaaaaattagccgggcatggtggcaggtgactgtagtcccagctacttgggaggctgaggcaagagaatggcataaactcaggaggcagagcttgcagtgacccaagatcgcgccactgcactccagcctgggtgacagagcaagactccctctcgaaaaaaaaataaaataaaatacacacagtcggccgggtgcagtggctcatgcctgaatcccagcactttgggaggccgaggcgggtggatcacgaggtcaagagatcaagaccagtctggccaacatggtgaaaccctatctctactaaaaatacaaaaattatcccagtgtgatggcgcatgcctgtagtcccagctactcaggaggctgaggcagaagaatcgcttgaacccgggaggcggaggttgcagtgagccgagatcacgccactgcactccagcttgggtgacagagcgagactctgtcaaaaaaacaaacaaacaaacaacaacaacaaaatatacacagtcagacaaagctttagtctcagtatgtgattgatgggaaacataaaggcaaccaagtggcatgggtccctgatggcaaacagtggccaattatgtctacagcattgtaacttgaaagtcactggactcaactgcaactataattaaagcaaacaacgaagatactaaaatcactaacggattgggcatggatggttccagactggggattggagaagtggtgctggcctccatacctccttcaccgtaccttctgggagaagtgggaaaatgtgaaatcggccacaggggcactcgctgggagctggtctgagtgggtctggccaccttggtgggggtctccatcgtgacagtcccaggaagcagccccgtggccacatcctccgcacagcacagcagtctcaggacacagcaggaagcctccatcttcaggctgcagggagctgctgcagaagtggtgccctggagcttaaaagtttaagaacagttcagggtttattgaatggcctcgtctggcatcagtagctgatgtccgccatgctcaaaaagccaatttaacaaacagccccactgctactgaggtctctgctatttgggtgggtgaccacaaattggccccgtgcattggcgctatgttgtgagtggtaggattcacactttccagcatactagccaagacagcgcccagctggcaccagctagaactatgaggcatgtttgatcaggaatttcagggttgcttagtattagaagttcatgttaccccttcagctaagccaatagaaaattagcaattgcataaggtcatctataactctataaggttgtcagctgggagatggcgctcttacagacagcaaaaatgctcttacagaaagcaaaaatattttcccttactgtggtgacaaattttagagatgccttcaaactgcctgagcagtgtccaaatgacttagaaatgcaaaatatggttcactgacaaactctgaggccgcctacatacgggtgagtctcccccatatgcatcagatgctcaccagcagctttctgatgaaattcaattgcaggggttagataccaacctggagaagagcagagaatgtgctgtctgcggtcccagtagcacacagccgcctgtgatggaacctggggccaccactgctccaggcccttgcgattataatgaaaggtttgtggggaattctgtatgggaaggaaagtgcagaaagaaaaggaaacccggtcatgtttcagtcacatatctggcttatttgattacaaatcatgcccttcaccaggctttgctggaaattcccttgctgtgattgcaggctcattcctgggagtcaggcccaggctgaccatggggatatgatgtggttagaagccaaaccagcggggctgctgcaggcactcgagggagaagtcttaggtagagtagagcttattaaacgattgactaaaatccatggccactgcttcagacagttcacccaaaggggcgagtcacatacaaaacatgctctgtcttccctgtggggcctggacttgactggaacatactgtggtgcagtgactgagggggcaccgcggaaggcctggtggtaactacttgcttattccgagtgcagtcaaacctggcagggaggcagggcttgggaatgggactcaaggaccgtgcctctggccagcagggacgagggtcagttagccggtcatcttcgtgtcccccatcataggaccctgttttcagctgttatcaccacctcaccctgctgatgagccccagcgagccctgcaggagtgggtgaggcacagcaggttcctttctcggcggcggctccaggccccacctctggcaagaccagccttactctcagcctccctcctcccacatggctccaatgaggtgagtgtctctgtctcaggctgtggcaaggccaggccagcattataatcatgcatgagaaaaatccaagacaagtatttccaatgcctgcagccaactggctctgggcttgctctgctctgcagaagaggtggtggaggcacgttggaggacacaggcccagggtcagaggctctggagctcagtccccacctatacaagagtcatcattctagtgcctcagctgaggctcactgtccgtgtctgttagcatggagctcagagaatagacctgccccggtgcagagtaaactattagatgatgagaaagaaaaagaaacattttatctgaggaatgcgagtccctttaaatgatcaggcccagagatgcattaaaatatgacagcagtcgtgtctcactccacttgagctaaacaatgacctcttgaagccacttgctatgtgggttctaaactgactgacgccaagtagccaaaaaatgccattcaccttatagttcaacaatgtatagccaatcactgaccaatgttatttctgtaaaccaacgagaattcctgaggaacaacttctgtaattgcccccttcctgagtcgtcattttttctttaaaacttgagcctctcatttgttttccaaagcacttcccagtgtgcagtgtgcacttccccattctgcggtgctcaaccttggcccaaataaactccctgtttattaactttgcctcggtttctttctttaggtcaacaatgtggactgcacttaacctcaaatccaacgcaacgtcctggccctgggatgttcacagtgaccaccatgccactgcctgggccgccctgtttgtccccaaccctctcttcaccatgatcagccttcgtgtatggtgtacccatgacataactaactccatcttagaaaaagcctccatttcttttcatagagcactctgccaacaaggagaagatattttgttgaataaataaataaataaataaaggctgcatccaaccagataaggacacgcgcacactcttccactattggttctcaccagagggccctgtgaccatacaagattaggcctgaacagctccaaatggccgtcttaactgccactttattgcagtcactcgtgatgagagcttgacatctgccgccagaagctctgctaccttcaagattttcttgtaagactgatgaatccttcggtccagactgggactccttttgtcttcttggcttcccctggactggttcattaaccctttctcctatctctttttcttcttgatgttaaatgttactttgtttgctgtggaatgtttaccttacaccatttataggttaggtatactattatgtatggtttgcaatactgactgacttatggagtggcatcagcctgtgtgcccgcagctctggctgcaaagtaatgggaaatactacggaaaattgcctccttaggagctccatgtagctcatggcttttgtgattgaatcacaatcaataaaagcctgacactgtggaaaaacacaaacatgcgtggacctagttatctctaaccttgcactactcatgacacttcggctctggggcttgtggtgcaggggttcacatgctgtccactctgtcagatgaagcccacttccaggtacttccaacggcatgtcaacccggatcttctgtcctcccagagggacatctgaagtcacttcagctgttcctaatgtgacatatttttagtccattcatcatcctagtcacttgcttcctatttttccttttatatccctttagttcttaatgtagtgattttctttaggaaaacaacaacaacaaacctgcatgtcttagctgagtcctggggaaaaagaaaagggcacccgtgtctgtccagattaaagtccgtgcatgtttgtgtctttccacaatgtcaggcttttattgattgtgattcaatcacaaaagtaaagggcctcagaacagggactggcttgggggtggggggattgcgctcaggcctcaggagacagacacaagagtacccccaccaggcttaactctgctcacagctaagaaggtcttctgttgctaggaaggaagaccctttccttctaaccaagcacacaggccagaggtttgctcacccaagcacttcggatttgtaaccagtgagggcccaagacagactgtggcagctaagcaggaggtgggaggtggagtcaatgagctcccgcagagggagaccccactctgctcttgtttctcgtgtgtattcacaggccctgcctgcattgccaggcctcagcagagagacaagaatgacattcccgtggcggcacccagggagtgctgattccacttgaagatttcttgctaattgaacagttacttacaccttagctaagtcttgaaataatttctcaaaaataagctgcgaaattcttcattggttgaccctagcattggagaaaattgttctgctcaagcagcaaagaatgagttttcttaactggggctccaggggatgtgccaatctacccagtagaatccaaaagaagtaagaatttcacacagagatgctctgccctgaaatggatgctacacagggcctcagcgatcagatttccgggggacagacagacaaatccggccataaaaggtaggcatattgttagcaaaatggagtccgaaaaacaacagacctgggcccacgcatccaagtgtctgggtcacaaaccatctgaagggtccaattctccccaatactgctgtcagcaaagactcggagactgcaatgggggggaacacagtcaggtgtgcagcgtggcctgccctcacaggtggctgtcacggattcttcttttcctaaatttccacctaggggctgaatcatgtgcgtccattggcacaggttggacttggcccgtggtctcccagggcatggtgccagccacatgctctgccctgccccctgtcctgtcaggtttgaggattttacaaataaataaaaggagcaatattatagcagcaaatcaagagtaaagatcaggtggattggaggtatatcagaaagaactgtgatcagtttagctgttcttggcaacattgatgggccactaccagtcactgcctttgaacaataacatgaaaggaaaagtcgcatcggtgaaaacagtggaactgaataataacgaggaaaacaaacatctacatttacccatgtttttcctttaagaaagaaaagttacatttgttctttatatgcttaaatgtttaatttccattagaaggagtaaaaccatcaatttcaggtacagggtgacattagagaaggccaactattttttaaaattatgtctactttaaattttgtattgcctggtgctattgtgtttttttaaattgtggtaaaacaataacataacatttaccatctgaaccatttgaaggcacagttcagtggtgttaagtgtatgcacatgtatatggttgtgcagtacatttttaggacttacccatcctacaaaactgaagctctgtgcccattacacaaccctccgttcctcctccccacagcccctggcaaccaccccactctcctttcagtgtctatgaatgtgactactctagggacctcgcataagtagaattataaaggatgtgtctttttgtgactggcttatctcacaaagcataatgtcttcaaggttcatcgaatgctgttttaaagtctgtatgttatgcaccatgaaataaccaattaccatcatgttgagtgcttgtacccagaaggctcaccatattccttcccagatttcaaaatagagatgatgatgattcttgtatgacatcaccttctacggctcccagcattcgggggtttgtcatactacctgttctactcctgcaaattaacttcagaacaccattcttttttccatcaatttaagagctgcatttgctaacccaccctcgggccatgtaggaacaagcatcgactttcacatctgagcaattctttgtaagttccatgtcatttgcatgttcagaaaagcaatatttcgccatggtacattgacatacctatcagcactgttatcacaatccagaggcgcctgtgttttttcattaacaacagcctgtgttttttcattaacaacacttaacgctgcttcactagttgttttccaaatgttctgtaagaaaaaataataaaataatgtgagagagctgcttatgaaaacccagtacatttgggaaagtaatattacttcattaacaaaatagcagtggacccctgctgtgcgcccagcactgtgctgggcaccagagaagcaacagcgaggaaagcagacagcttcatcctcccagggctcctgttctgccagaggaagccagaaagcaaacatgtagccataacagcatctgctgggggtcgtgctgcggaagaatagagctgcaggagggattcgtgcggggtcgggacggggtgggggtggggggggggggcgcggtgcttttttatacacagggtcagagaaggccgctgtgtgtgacgacatctaagcagagctggaagaggaggaatgcagagctatgccgaaggtggaggcacacctgcttcactgcaggagcagcagaagtctcgtggggctgcagccacaagtgggaaccaagagagcacaggaggtgacctcagagttacgggaggccaagtggggtcagactcaggaagtggagtttcattctgaatgagatggagggttctgagcacaagagtggcacgctccaatgcacagaagcaacagtgtggttgcggtactgaagagagcctggcaggcaggagtggcagcaggggatccactcagagggctatgaggatggcaggtcttgattgtggagtgaaggcagagggtgaacacctctgaggctatggggtggccgggctggctgctggactggaagtgagatggagcccaagagagaactcagagacaatgccactgggcttgctcggcctgtgcacactgagagcttaggtggggtgggggcattggagggcaggtgaggggtgctgggagcccatcttggtcatgaggcctctgttgaccttgcattgacctgtgcagctctccttgtgacaaaatctcaatcctggtggcaccaggaaagcagggaggtgcccacggcacaggaggaggggggacacttttggcctacgggaagctggccaccttgtttcctacacaggacgcctgtccagagacaacgccccactgtggacatgattacaaaaagcagccaccatccctcagactgagggcccagggcctcactctggctcttgagagagctgttaccagaagtagttccagccagttaagaagttagtataggttaaccaacggcccagcccctccctgggatgtgcgctccctgtgctgtgggccttttacagatttgtaactacaggacatcaggtgcttcatctttcaggagaacaacacaggaaggtgtcaagaaggccagagtgggagctgaaagatgccagctcgtgcctgagtgcatacgcctggcacctgcccctcttctgtgacgagaacagggaacccctctgtggcctcccagagcaggacctgggtagatcctggcagtttcctgaggatgtgaaacccaggggctgagacagctgcatgtacctacaacccctaaaaggcatggtgctagtgagcagcatgggagacacagggctttgcaagacactatcctataactatgcccaatcagcaaactgcccagcacgtccaggagctggtgtatggccctgtgtgaccttcgcctgagcccactggggctgtagagagcagagcggccagaatgcagcttggaaatgggtctcccagtcaaccaaaaccagagagccccctgattgcacatttcaccaggaccaagccctttgggacatgatggtcaaatcctaaaggcatcgatctatgcccaaagctgaggtcccaggtggctgaaccttggagtcacctgggtggggtggggttgaagcaccatcaccctgagccacgccacagcatgtctgttagaatcttcagaggcagggcttgtgcatggttttgtttggtttctttgacttttaagctccctaggtgattctgcatagcagatctgcaccaagtgttcaagaagcatgaggtctgtttgcccccttgtgtttggaggtgagggcactaaaagcctaaggaagtcactgtatgtggctatttacattgtgtaatgtgagaaacgcaggtaatatcacctcccctctaaaacacctctccccaacctcctgttctcagaaccatcagacgctcatcttactaaatatccttccttgggaacctaaaaatgcctccttgaactttcgctgacaaaagtgatggcagagcagagaaaagctcccaaacacaaacactgtgggttgagatcaaattcatttcaatataaactcagatggatgtgctacggagggggtggtttaataacgctgctctgcatgaggaatactgaaaaatgaactgcaggagagtctttgccaaggacagcagaggttctgggagcttcaaagagaactggcttctttaaatttgaactagaaacgcacaactctgggctgtctgtgcatgtccctttggaaccaatgcttattctgggtgaaaagcatgtctcactcagaagttttcactcttctctcggaccccacccacagatgtgagagtcactcctctcacgcttctcctccatctccagggcattgcccaggccttcagacccaagccctgttagctactctgataaacagatgcaagggaattcacaaacatccaggtagcccagtcttaattaataggggtcttcaacgagctccccacactgcgcaagttaagcagggtttcagtgctttggctgctggaagccttgtctgtgctggagccatctcggggcagctcccactccccacctgggggacagcacccactccccaccccggggatagcccccactccccgcttgaggggcagcccccactccccacctgagggctaccctcctacttcccacctgggaggcagcccctactccccacctgcagggcagcccccactccccacctgagggctacccctcactccccatctgagggctatcccctactcctctgggctgggctagccctgcctgcacttcttatatgtggaactatgctctggagctgaattaaggctttataagtcacacttgcttcattggcacaaacacacatgataggaaaacaatccctgatgaattcctgatgaaacatggaggtgctttttagctgtactgtacatgtactgtattcaggaagaaaagcctaatttccccagatccaggaataccttctgcctggaagctgatgaggatgggctctgtgattcccggtcttctgcctttccattcagagcacaccaaggacagccacacttcccatcactcataagaagcacatgattagcatagacctctagagaaaaaaaaaaaagcaaacattctgaagactgcaatgtgctgggaaggtgagaacataaagctggagaagccctaagttatacataaggtcaaagccacctgggcctaacaacgggctgatcatgaagatgcgtgtccttgggctgccgtgtcctgctgtgtgtgttttctttctatttccttgcttaaacaatgtcttaggtgtagcccacactaagcaatatgaggaaacgcacaaccaccagccacgctgataatgaatgcctgttccagaaacacccagtggtctggtcataaaataatgagggtcaaaggtcctgctcaggggtgtgtagtagagggggcaacaccacagtcggaaggagtggttggggagctgttggacaaacaggaagaccattaaagacactccaaagtttataagcaggatgttcccacccaggcaatctggccctgatggtagcacggacctggctgacgttcactcctcccatctctgagggctgaaggccgggcagtgagcggagccagtgtccacccggctgggaggctgagggccctgccacatcccatgtctgtgagagcatctggaataggatctgcgcacagctgacaactgttgccagcgatgacaggtccttgagtgtttgtgatgccattctctctactcatgcagatgtttgaaaatgtccataataaaagttaaaagaaaatatttctgctagacctggccctgcacagagccactctcagcaagaagccaggcgactgccttgggtgcaagagctgctttccctgaagcccccacccctctcatccccaggtaggaggggaaggaagtgggggtggcgggtgaagaggggactggagcaccctgctgcttttctgtcagacccgagtccctgtaaggaaacctgtttctgcctgggctctcttaaccccagtctgttattctggccagctttgctcaggctaaaaggaacccaaaggcctgcaggccgccgagagcagcaggttctccaggagctccaggccagggctgggccatcctcacaggggatgtggcttccaatccctgcaccccagcagtggtgctggcagtcagcttgcccctagcctcccaggacactctcaagtttagcctaggacaatatcaaatccagttttaacattgtgagtcaaagtcactatttactgtcaagagtccagtgtattaatatcttgtgataacaaaagctgaggaaaaatcaaaggccgtgttcctggcctaatatgtgacgtgctacaaatgccatcgagtgccattgagcacccatgcaggctggatgcaccaactgaggtatgaagtaatttcctgaactggacacatccgagaggaagaaatatttagaaaatgtttcggaataagctagaatagtcaagtgactcatatttctctgaaaccaattagtcatcaaagtcactgtgctcaaattatctggaaaaaaaagtggatatacccctgaacagaaagaaataaataaaaaatcataaaaagtacataaaattgcaaaattgaataaagtatgtcacaaaaggagaaataaactaagtgagtgaaactaatcctgaaattggcttaattgtcccacagaagtgatatttataggttttttgaataaacatggaaactgactctcctagtcttaaaacctgaaacttaacatccatctcatctgagttcttccctcaggaaaccaacccaggaaagggacccaccagatccctgcatccagccaggcccctcattcctcagattgcttcctcacccctctctaattttgttttctcgtcttccctgctatataaacccccaagttttagtcagatggggagatatatttgagactttatctcccttctcctcatctgcagcacctgataaagctttcttccctggcaatcctcgcagtcttcatgatgattatgctctgtacgtaagcagcagcagcaggatgtcaggcaaacccctggcatttaggtaacaattccacatgatcttaacataagaattgcaaaagaattggcgttgcattgtttcaacattgatgccaggcacacacccgcctcctgccccgcgcccccgcccccccactccatttaaatccgtctctttagaaattaaaaaaatttttttaaatttaattttaaaaatccgtttctcaggtctaccaaatgtgtagcctaagttgaaaactcaaaaattccttctacttaaaggaatcctggcaattacgtttcaggcaacactttagaattttcattttaaaaattaaaaacagagatactctctgtgttaaggacgaggaggaaaaccccacacctgtggccatgcagacacctcctgtaacctaagtattcccttcattgggctctgggaggccccacttacagtcttggttgttctcgaagtgtggcccccagatctcagcctcaccccagacctcctaaagcagaaagtcaggggtggggcccagtgaaggagttaaaaatataccatcctggccaggcgccgtggctcatgcctgtaatcccagcactttggaaggccgaggtgggcagatcacgaggtcaggagatggagaccatcctggctaacacggtgaaaccctgtctctaccaaaaatacaaaaaattagctgggcgtggtggcggacgcctgtagtcccagctactcaggaggctgaggcaggagaatggcgtgaacccaggaggcagagcttgcagtgagccaagatcatgccactgcactccagcctgggtgacagagtgagactccgtctcaaaaaaaaaaaaaaaaaaatatatatatatatatatatatatatatatatatgtgtgtgtaccatcctggcatgtggactatttaagttagaggcacttgcaaaacagcaggtttaagatcactctgaccttccttctgtttcttaaaagcagaaaatgaaattcccatgtggaagatgtcctgtttataccagggaaataaagcaacattcttatcatggtggccatgcctccttccccaaggccttaccgacccacaatccacctccaggagggctacagctgcacagatgaagaccccagctcttgtcagtgctcacagacagctcaccaccaaaggaaaggcagcaggcagcctggagacacctaagggaaagaaaataaccagaggaaaattaaattaagtacaatcgtttaatcacagacatcctgtgaccactcttccatccatatccatatttctgccacaaaagtattaagtacaaaattggctgccatatgaacaaaaagactcgcatctatggttcttttcacttcatatttcccaaactcagggtctgttttagaagattaactgaaatatagttcccatctgactactaaaacagcctccgaacagatccatctctcttcctgctgcctccagggcttcctgcccagatgcacagagctgaccttccagggcaaggtctggcagcttccagggctcctcttcctcctcctctcttcctgcctcatcatccccattcctgctgctcactcacagccctaagagcacattcttccagcccatggggatctggcatgctgcagaaaagaacagcatggaacccatgaccctggggagagatgccagcgcagacacagagtaggcactgcatggcatcctccctgtttatttccacaacagacttgagaggttccgtgcagttactttttcagatgctggtatcattttggtatttgtccctgtgcaaatctcatgttgaattgtaatccccagtgctagaggtgaggcctggtgggaggtgtttggatcacgggggcagatctctcatggcttggtgctgtctttgtgagttctccgagatctggtcatttaaaagtgtgtggtatctcctcccctcctcttgctcctgctgtcgccatgtgatgcacctgctcccccttcaccttccaccatgattgtaagcttcctgaggcctccccagtagcagacgccagcattatgcttcctgtactggctgcagaaccgtgagccaattaaacttcctttctcagtctcaggtatttctttatagcaatgcaagaatagcctaatgcagatgggatcatgaaggcccagcaaaacaaattaactcagcgaagctcacaccatcagtgagaggcagagccaacgtttaaacctggttctcagcacacccaaagccgatgccaattctatggcaccttccttcaaagctctctacaggtgtgcctccagagctcaagctgcagctgaagtcagccccaaagctctgccccttggcacagctggtgactttccctctggactccctaggccttgacagctgtctgctgctctcatgtttgtcagcagagatcatcgtgggtcatcatctggtccctggtcattccctttcagcctgtagctccttgggtcctgaggtatctgtgtctggcaccaatcgacttgagaaagatcaagtgcagcgagtgaaatagtcctgaactaaggtgcgggtttcctgggttctggtcttgattcagccagaaatggatggtgtgatttgggtttctcctccatgcccattcccagcgacagggcaatgggaaccgttgccaagttcccagctccatataggctgctgtgctaaggagaagggcaggctctacatccacttcttctagacacaggcagtcaccttgcctctctgtgtcagtctccttctctgtttgagaggaacgacacagacctacttcacggggctgctgccaggactgtcattctagaaagggccgccctgtattagctaaatgcttggtaaccagctgctaaaggtgttcgcctttgttctttcccctgaaaaatgcattcagctctttagaattctcttttttacctgtcttggatgtctataaagtctagaggatatctactttatcttaagcaaggtttctacaaagataaaactggatagtttcacccaatttttacaagcctggttcttgatgcccaagaagccgccaccagagggcagacgaggacaatatttatagttgaggaaagtgtgcagggaggtgaaaagctgttattttgaagatgaagatggtcactaggtcaaaggcctcaaactgttgaataattccaaggatttccttgcctactctcaactatgcttgtcttccaaaggccagagaaatgaaaaaataaaaaataacaataatagaaaaggggacaactttggaatcatacagaccagaccagatcagacttagaggatttctgcaatgatctagcgggcaaataaaattaaggaaaggacgaacctaacctctgtccaccacgtgcgccccacagtccacagctgtgagactgcccaccactctgggcccacacaaggttagatagccctggcacccaccaagttccgagaccctcccagacacccccacaacaggataacttccaagtgctacacacagaaaacaccagccctggttcctgggacatagttggcccttgagaagtaattttctgtctcagaaggtgagaaacacatccccaacaggtgtgtcctccactcacagaggcgccaaggatagtgctgcaaagctaattttccttgagatttcagaggtcttttcaaataaaaaaaatggaagggggagataatttaaatacaagggaggctctttttcctggtgttgtgaggaggcaggtccccaggccctggcacagaatcagcaccattttcacagaggtacctggcttcctcttagttaactgtgactgtcggggaacaggatgatactgatggctcaaacacagtctctgaggcatcatgtgcctcaagggaactagtcgagccatttgtttgaattacatgacagatctcttagaatcccttaagagtgagtgtttttcggggcctgtcaggggctggggggcaaggggagggagagcattaggacaaatacctaccacacaaacacacaccacacactcacaccacaccacactcacaccacacaaacacaccacacagcatcacacacaatatacacacaccacacagcacatacccacccaccacacacacatcgcacacaccacacaccacgcaccacacaaacacaccatacacacaaacaccacacacacaccaacacattacacacacatcacacagcacacaccatgtatcacacacacaccataccccactcataccataccacacatacaccacacactacacacagaccacacaccacaccacccacacacatgtcctataccacacacacacacacagacactacaggcctaactccatgaaatgagggctacaggagagtcaagaaacctcttctgtttctatgaacaagatcagtcactgtcttgctttaggtgactcaggaaaccccaaaaggctatgacttcagaaatggggcctcgacaccaattacaatggctagtgcgtgcatgaactagttggtctgcaagtacaagatgtataaatatacaggggaaaaaacatcaagtcagcgacttccgctcctcagcttttctttcctttctaagggcaaaggggtaattccttgcaattccctgactgataagagtgaaggtcaaattgggccaacatcaaggctctgggagtctgcaggagcatgggcatttggaataaaagaaacatgaggtaaccagaaaaaataagggaaaaaattgtagccaaaatcagacaatgcttggcagcagtgagtgacataaggcaaagaaatttccaagcatgaatgtgaccaaccccgtcaacacgtgcagcctcattttctcatcctggtttgctttgggtttctttgataaaatgatggtgatggcacaaagacagtaagctaacaaaggcagaaatgctgacagcaagcattcatcaaggatactgatttttataacgaccctctggagtttacagatgtgacaacaggggtactcagattttcaggatgagaaatctgggggtgaggaggtaaagtgacctgcagtggcggggtaccccactgggcaagatctgcaggcacaggctcccatcatgccaggccaggggacagcggtgacccacctgggtccttaccacatcccacaggcaggtcaccttgctggcctcacgcccaggaaagggggcatggaggtttgcaccatgtcacactgccatgagacagtcaacagcagagcacacaggctgcccagcctcaacaacacatgggtgctggcgcgcacagagcatggggaagagggtttagaaataagacccatggaggctgggtgcggtggcttatgcctgtaatcccagtactttgggaggccaaggcgggcagatcacaaggtcaggagatcgagaccatcctggctaacacagtgaaaccccgtctctactaaaaatacaaaaaattagtcgggcgtggtggtgggcgcctgtggtcccagctacttgggaggctgaggcaggataaatggcatgaacccaggaggcagagcttgcagtgagccaagatcgcacctctgcactcgagcctgggcaacagagagagactccgtctcaaaaaaaaagaaataagacccctgggccaagaccccatgatctcttcctgtgccaggtttctcctggtctccatgcaagggacctagcagacaagcagatagcttaactttgtctactaccaggcagcagaaagtcctcgaacttggaaggtatcctgcatttgcaggaagagcaatcagcacttctcatggctgaaggcatccgcttggaggagtcttctcaaaagccttcaggaaaaaactccattctcaacaccaactccaacctctgaactgaccccgccggccaaatgcaccctcctggtacagggcctccactcgtgccagagtgagcccacatcctagaggtgatgacttttgaaagaaaatttctgaatgcatactttaaaatcaagcttaccaaaccctctgagaacagtgataactcacctttcctggtcatcagaaatgttctgggctgcctcctcggccatgtcctgtgcaagctggtcacaagtatgacagtca

SEQ ID NO: 2151 - DNA, 16339 bp, Homo sapiens
cttgaatctcaactaaggtttctttagccacattctacacaaagataaaatcttaagccattcattaaaatcttcaaaattatatgtatttgataataaacatcacatagagcaaatggttaagtcactaacacattctctttaacagcaatttcagttttataaaactactttcagatattgtttcattttgtatcatgatttttaagttttctcactgcagctggaattaatttcgttacaatgagaggaggaagggtttaaaaattaaaacggtgtcttctaattttaaaatgttaatttaacaaaatattccatcctatttcaacattattaaacataggccaggcgtggtggctcacgcctgtaatcccagcactttgagaggccaaggtgggtgatcacgaggtcgagatcgagaccatcctggccaacacagtgaaactccgtctctactaaaaatacaaaaattagccgggcgtggtggcatgcgcctgtagtcccagctactcgggaggctgaggcaggagaatcgcttgaacttgggaagtggaggctgcagtaagccaagatcgcgccactagcactccagactggcgacagagtgagactccgtctcaaaaaaaaaaaccaaaaaacaaacaaaaaaccattactaaacatcaaaagaatcattcaaatacactggttttatcaaaaaacatgaaaaagccaaaatataaattttcatgttagctagtcttccaatttcattttatcctaagcaacttaggtctcagttttgtaatgtgacattaatataatgtttatggatgggtgtgatggctgatgcctgtaatcccagcactttgggaggcccaggtgggcgggtggcttgagcccaggagttcaagaccagcctggacaacacagtgagaccctgtctctatgaaaaattgaaaattagctgggtgtggtggtgcacaccagtagtcccagctagtcaggaagctgaggtgggaggatgccttgagccaaggaggtcaatgcggtgagccatgattgtggcactgcactccagtctgggtgacagaatgagaccgtctcaaacaaaacaaaacaagaaaacaaaagataatgtttatcatgtccacctccacaggacaatgagatgtaattataataggaaatatgatgggtatgtttcagggagaatgagcacatctaccagtactgaatcagctttgatgttcagaaacatcaaagaaatatggtctcatcacttaacacagatgataccttagaagtttcgtttgtttctactctaaatagaagggtcttctttccagaacgacagatccgatacactgtggaagaaagaaatataaggaattacaacctaaacccaaaactggccccaggaagaaactagttggaatggcagaaggagctcccagctaagagctgtgttggctgggccagctctctaggcatcaagaggggagtggactcaggtgggcttgagtcctcagcaagagagagactccaaatgctgcagctgtgacaccccacagtgctctgagtaaccaaggcagtggcggcggggtgacagaggctgttctttctgtcactgggctccaaggggcaggagcagcggggtgaacacactgaaatgcaagactgactgtgcgctacaggccgtgctgagctagagcctctgcctggagggaaagtaccaagctcccaggcaacagctttacgaattctggctactacaccaagtctaaatacatgacgattttcacaacatcaatgagaaattgttctttaaagtctgaataaataaattctagcttttcttttcagtgtcttaaaaacaaagcaaaacagacatgagcaacatgaagtgatatgtttatccaactgtgtgttgttgaatcaacttttagttaaaatgttagagagggacaaataagtacagtgtgtcgatgtgcggtgctgtgagggcacagaccagtgatcagaacacaacacctgcggcctctcccatcctgacaaagtctctgcatgccaactccagcgacagggtgctaggacagcgcagggatgaaatactgaagggacacgtcttcatgaagcagatcaaaatgcaccatcttgttattcacaatatctgggaagagaaaagccatgattttagagacctagtgcagcacacacattttgatctctactttttcagaacagccttcccagcctgcacctcctgttttaggcatctgtcttccctgaggcagctgcagagaccacagtctctcactctcactgccacagctgaggctacatcacggccccagcactggcggctccctgtgcgaggagaggaaaagtgaagcggcccaagcccttggcaaaacacccagcaggctggcttcctggcaaaccacattcacccacatgagcatccttctgcagcgaagagcagctcctcaccagtgagtggaggaactgtgctgagaagagccaagagccaggatcccccaacacctggggcaggctgtgtcacacactgctacatgggatggatccctgcatctcaacggtcctgccaatcccgtgagggccatgggtgatggctaaaatccaaggcatcaggcatgcaaccaagcagggaagtaaagagcacatgagggtgggcaggagcacacagtgtgacaaccaccgagagctcggggagctgcagcacagcagccgaggaaagctctccagcagatatgagtgagtgacaagaaaccatgtgtgagcaggctgcagagaggccaatcccaggagatgggaggttggggaaaggaccagaaaggacaagcaggagacaaacattctttaggagaggtggtgcaagggcacaggagaggcagagactgagggtggcaggacctagctagaggaggggacaattgagccgacacctgaaggagactaacagagacagaaaaggggctttgggaagttaagaaggtatgagaagttcaacccacggtgttttaaaaaaaatttttgctacatcacaatttgctggtcttcctttctctgctacacgtggagacaccaaagtgaatgttgggaagacacttggcttagtcaaccacctttgataagaactcttccatgttcctcaacagccttggattcagaaagtccccaaaataccaagttcaaagactgatgttgtgcagcgcaggggccccccacaccctgtgtttccacactctgcagacaggaggggtatttcactctctcaccattcacactgtgcttgtcaggaccaagggtctgggcattgtacaggagcttgggagaagtgcagccatgaggcccagcccaaactatgaataaggagtccctttacatgaccttcaggcgatctccatgcacatcgaggttctcagaagcacctttaaggaccctgcactgccacacagctcccactatgctcagccctagaaatatgacatcgtccatgtcaaagttccttaaaatgcagcacaggtacctcaccccaaaactccccatgatctggcctagtctagcttctccatctctaccctcagagctgcttctctggcgatatctccttctgtgcccatcactccaactgtgtgacaccttccccaattcccaaacacccattgcccctcccatggtctcttctgattctcttcatgtctctcattcaaaagggctggtccttgacattgccacctagaatcttctgttccttctctacagcacactgcagatctgaaggggatgaggtgcagtgttggctcaacctccctctcagctcagcctgggagctatgctacaaaacgtggaacttcaaatccaggatgcagtcgcttttaggttgctgtgatttcagtagtaaggtgacaaaaatgccttgaaaagctcttggcaggtaatgcctttctcatgtgtggtcagtagatgaagagtgctggagcaggtgtgtgacctcacaagatggggcccagccagaatcaagaggcaactgttaacaaccagcagccaagggacagatatggggcagcgaatgcaggccagcatagccacagaaaggaaacaagacatcacaagggaaaacttaaatccaagccaaaccgtgtctggcactctgagcaggtcaaattagatgaccatggagaaggtgggatgatctgcacccattctcccgatggcatctccaggtgtgctggccaactgaggcagcacacaacccacctaccaaccagtgtggctgcaggtttcaggccctaacagagtgcccaggggttgtttctctgctgccaccttaggtacttctgaatctaggaaaatttaaaaaaccccactgttctaggaagttaaagtccacataattgagcttttttttttttttttggatttatgagactatatgcaatctgttagactagagttgactgcagtatttagaatatgaaagaatatgaaaaacaaaacagagaagcacactcactgcataaggcctttgtgggatttacttgttgtccagcaagaaactgtaggagcttcctaatatctatgtgcacttcagccatgtgttccacgtttctgtcctcatgggtgctttcagaggctaaaatgataggaatgcatttaaatacaacatcttcccacgtaacaggaaacctggagatactcaatgcattttacttaaataaatgattcactttagcactgattttagcatcctgaagaaatattgcaacttgtaaatgttgtcattcattaagcattaggtcctaactatttaaaatactatgataatttccaaggcatctttatttacaggggacttgaaatataactcaatctccctcttcaggtcaaagaaaattttatttatttgtacttactatgtattttaagagtgaaaatatatacattaactaatacaaggcctgtcattctggagtggaattaaaaaaaaaaagaaaacatcctttctacctctgagaaagtaccaaagataagtcccaccttatgtttattaaaagaaacaaaatgagtgacatcagaatgaatcgctttacacaatattatcaaaggcataaccgtatggatttcactctgctggagcaggatgctcttaactagaaagtaaaaattccttccaactctatgctaaaatctgtgtttatattcaagcagactcgtagtaacttaaatgtgactagggccgattttattggttctggcacacttatgtatcataaaatgattttctcatcatccccaggtgtttctcccctggtcctttacctgctttcctgctcaggcagcccctgctactgtgcagctgccactttccagccatgattctaaccccctcttggcttataactcaccaaactgtccaaccgtcccctctctccccacttgctgaactgactctatcgtcccttattaccttgtatgagataagaaatgtgatcaagtgaaacagttttgcatctgctacactaatttcatacatatggaagtaactgaaggaggagaatataagaacaaatgtatctacctttctgaatccatgccaggtgagaaatagaaatctttaggagtaggacaggaattgaatagctggaagggatcttggaggttatgtaacttgatccgaattctacagaggatggagaccctgcacagatctgtcagctacttggtggcacagcttctccccctggtggctaactgccccactacaccacagggatacatagtccagtctcaattcctttgttcttcacccaagcatgaaacaaagtcaactgaatttcaacctttttacatgaagagacctcaacaggtaggttatctgaaacaattaacttatccaaagcaaaatataacccactagaaaacttacctaatggaggatttccaagatctttaaaatgagttgtaacacatactaattcagtttctattttcaaattcaattctccatctaggtttgcttcaataacctgcaaattgagtattttacatagtcttagaaaaggaagccaaaaggaaaaaaactccatgggcaacagctttcacacaaccagatgacaaagtaccctacaaaacctcaaaacacctcagagcacactgagacccccgtgctatcagggaaagtgagaagataaggcccaagagccaagaactcagaaatctcccaaaaatctcaaaggggaagtccccctgcctgcctcccggaatgaagaactcagtgaagatgtgaaaacaggtggaactccgagaggacttgccaggagactacagcagcacaagggcagggctctagggagggctgggtggagctgatgagaactccctcacagcaggagagagtcctgcactgagaaggaaccacgggaagtaagagcctcaactaagcagaatgggcaccttgggcaaaaaaaagggaatgaaactttaaatgaaggaaaaagagggacagatctcagaaagtcctggggatgtggtgaggatgcatgttttaatattttgtggttacaaagaatagagaattctagagtcattaaattagaaaactattttggtccactttcactcctacaatgaaacttcctcctaaaagaaccagaaaaaccagccgggcgcggtggctctcgcttgtaatcccagcactttgggaggccgaggcgggcggatcacgaggtcaggagatcaagaccatcctggctaacacggtgaaaccccgtctctactaaaaatacaaaaaattagccgggcgtggtggcgggcgcctgtagtcccagctactcgggaggctgaggcaggagaatggcatgaacccgggaggcggaacttgcagtgagccgagattgcgccactgcactccagcctgggtgaaagagcgagactctgtctcaaaaaaaaaaaaaaaaaaaaaagagaaatgaacaataatagacgctatgacacaacaacataaatcagaattagggaagctcagacatgagatgaccagagagcacgcacataaaacacagctgacagcacaggaagtaattagaaacataaggaaaaatttcagaaacagaaactagtttagaaggaagactagagcaaataggcaccacagagagaatagtaagagaaactgggatggaaaggagaaagataaaatttaccaaacagaaacaaagagttaaaaggatctgacagaaaataataaagacagtggagaagatccaagccctctgagtcccagaagaaaaacaaagcactggaaaagaaatgctatcaactacagctcaaaactttcctgaagtgaatgaagagttcggcccacatattgaaaggacacaccacacacctgggaaaactgaccccggatggtcaagacaattggattgaaagaaaaatgggaaaaatccccagggtatttagtccccactttcaaatgaataaatccaagctgtgaaacaaaatcagaatggagtcattctttttgatagcaataatatacaccagcagacaatgcagtgcagtgagccaaactgacattataaacacatgataaccaatgaaatcctattcctgtgagtccttcttgagtgatatgctagagaataggcttttaataaccaaaaaaatcattggagaagttacagcataaacagtgtgagccttattttgacctttagaaccaaaactaaacaacaggaatgaagaggacagaataacgtgtagtaataaaattttatgctctgatgatgtagacataatataaccattacaaaacaggaagggggaaaatgagaagaatgtggaaatcagtgtcttatttttataaaatataaatcaaccatttgtcataaacacacatttaatatgactataaggccttcagaatctcatgagaacatagccatttatttagaaaataaactcacatgttggaaaatgaaatgtccaaatccagaagggtctggggctgctgttgggttaccaggactgaggatggctgagccaaactccacacgcccaggctaccagacttctgccatcccctcatataccatcgggcacccctcttctactcctgctcttgctgcccggggactgtctccacaggtcacaagggactcctttcctttgaagctcctctacccaccccaacaaccaatcagttcttttaattggatggaacctagaagtgaagcatatgccacagtatggtttgaggttttgctaacctatcctggtccactcccgcacctacaatgaaatttcctcctaaaagaaccagtacctgttatttctctttttgatgttgatatctgcccaatgttaaagcctaggaggtctctggaaagccagtgtgtagtctgctggatagcattttgccatctagtactagaaaagtgccacctagcaactggtcttatttagggccattccatcctcacagtgtcacagaaagaaaacagagaaggcactctgtctgcacggctctgtatcagtgttcatgtttactgaatacaatttagtgttccttgttcttattccttaaaattggtgaactctgaatagttttcattccagaaacaaagtttttctaatttgggtgagctcttatttctgagcttttcacattaatagaaaaatagtgccccaaacttacctgttgtataatctactttgaatgagaaatactcattttcaacccttttctttcattaatccaaaaaaatatattgttatatttcctaacccgttttcctacaatctggaacaatagttgactgaaataaaatatataaaacaatctttgtgaatatgctagactgcttagtggggctaaggctaacacatgaccttagctcatttgttccaaacaaccacacacccaagatctgtaaattcccattgttttgaaaagcaatggttttagatataaataaataaatacttacttaaaaatgcaacttgcaatgggcctagatgcacttcaggcttaaatgttctcttgtgttttcttcaaattcctaagaatctcagtaacagaacattagattccaactccctcctaaccattaacacctggtgcctagcacatggtggccttaagtcaatacttactgaagaaactaacaaacaactaattctctgaacactggtcactcatgtctattttaagattcagttatttgggatattatacacaacaacacacttgatttcttaagtatcagggtaagatctttcaatgatttccttaaaatagtcaactattgtttatagaatgctgactatactgggcacctagtaaaaattatctctaaatttttaaaaactgacgaagcccctgtcatagctgcactgttatccccatttggggtagtatccagcactagggtactcactgcacagcgcagcctggagctgaacccaggtatgtggctccaatgactcccctcttccatatcatgactcctaaacatagactctggtttctatcattaggtgaccctgcagagccgtttctcagataacatttgaagtacaatatagtatggcaatgatgtggtttgttttggctcagcaaccccacccaaatctcatctcgaattgtaatccccaagtgctgagaaggggcctggtggtaggtgactggatcatgggggcagcttttcccatgctgttctcttgatagtgagggagttctcatgagatctgatggttttaaaaatggcagtttttcctgtgttcttctctctccagctgccatgttaagacgtgccttgcttcccctttgccttctgtcatgactgtaagtttcctgaggcctcctcagctatacaggactgtgagtcaattaaacctcttttgtttataaattacctggtctcaggtaatatctttttagcagcgtgaaaacggagtaatacaggcacacatcacaaagtactgctacatgatgtggtctgaagacaggcagcatcgacatctcccaggagctggtcagaaacagagcctcaggctccagctcagacctcccaaatcagaacctgcactttaaccagattccaggggattcacacgcatggtagaacttagaagcaatgtcttagaacatgatgtcaattccctccagttcttgcttctttttctgctcctgcatgagtcacatacaacccaccccatcagtcacacctcgcatttaatgaaaggaagtaactgggcatctctaatgggaaggtgggcatttttagtgtgttaagtctacccattttccttaattctactgcctgtaatattcagatacagaattctggatacccaggaagacctcattatgtactttgctacagtaacttgataactttccatttagtaattccagatcgtagtagcctctccacaatatttctatgtttttttaaactccaaaaaagagaaaacaaaacacctctgatgattctaagctacccttctacctctctaccttgctgactcattttcattgaacagaaagaacaaacaaatgccatccttcaattaacagccctgtcttttctctcctgggcctctctgaatttctctggaagtccccagggtatccccagatgaagccagcctgacaactggatcagcatcactgcagtcacaggtgacaccaacgtcagcacagtgcacactgcttcatggaaaacagattttatagattaagttatgaaggaaaagctttgagttacccaggtccaatgacagcattgctcttagtgtgcagaactctagaaaaaaacagtcaaatgtacattttctaggcttcaaaatacttttgtgatttcaaagacctcttgaagctaaattttgttccagatccatgcaacacttattgctgcctactgagtggcaatcccacactgggcagctgggacacaaagatgattaagatggggtttcctttatcaagaagctggtggttcacgagaccttcagagatcttagcaggtgatttaccatgtacactggacagctcagctccatggaggagcttccagaggggtggtggggaaaggtctgtgatgaagcatgagaatggctaagtgccttccagggagatggagagaagaagccatgtgtcaaatggcaaagaaactgaacaaaaaagaagaggcattgtgggggaataccagaacccagcctcgttctgcagggagggtgtggcaatacaacagagatgtggctataaaggtggcctggtacactgtcaagatcaaaagtttatgcttcatcaggtggacagtggtttttagaagattcagggacataaccaagggtgttttttggagcaggataggagggagcagggggaggagggaggggcagtgagtgaaggaagaattcacaataaccccaggtatgaatgaggataacctacacatttcccaccactgtcacacactgtaacatttcgagccatgtggccataggagacttccacaaaataaacagaaaataaacagaaatataaaagtgccccctagcttggtgtgaggtgtgcttggaataaaggctgctatggtgtggcatatctttgtccctggctcactgaaagacacttggcacgcagacaggaaactccaaactcactgtcagtcatatcagtgactcacagaaaaatacgggcacgttagcaggtaaaagatacaatgttccagccgggcgcggtggctcacgcctgtaatcccagtactttgggaggcctaggcgggcggaccacgaggtcaggagatcgagaccatcctggctaacacggtgaaaccccgtctgtactaaaaatacgaaacaaaaaattagccaggcatggtggcaggcgcctgtagtcccagctactcgggaggctgaggtgggagaatggcatgaacccgggaggcggagcttacagtgaggtgagatggcgccattgcactccagcctgggcgacagagtgagactctgtctcaaaaaaaaaaaaaaaaaagaaagatacaatgtttcatacaaaatataagaggaaaaacaggcagattaaaggcaaatataaaagctttcctcaaagaattagagttgaaaagtattggaataggtttctaaatccaactagcaatctgcaggttctcagcaccaggccaggtcctcataagtgggaactcggttaggaggtgcccacctgcatggactgctgcagggtgagctggagaacccacgccgtcccaccaaatacttcagagttcttttctaaagaagttgtgacttacaaggtgattgctgatgtttttcattttttccacaacactcttcatagtcttcaagactggtaaataaatactaacctacaaaaccaatgagaaaaaagcacaagtattaaaaatattaatatactctagtaatgacaagggccccataactaactctagaacacatgcatgctcaaaaactatgggatactattttacaattttctgaataaagttcttttaaaaatataaaaagaaaaccaattctatttcactaactcaaggatgctcaagcaaaattaaagaatggaatgcctgcctctggttacctcagcaaccatgtccctgtgggcattcttttggctcaagaaggaatagggtacttcagctgagatgcccctatattggtccagggggaatataactcaggcaatcagcaggaggccctcctctaagggacatttacacctatgattcaagggccttttccatgctctgtacaaaaacatggcagacagtcactgcatcacatctgagactgttaccaagagtgctctataaaacacaggctttttcaaaatcagtgtaggtgccatctagtaaaagtcaagtaattattttacccagcatatttctgtactttcttcttaaacaaattgtgagcaagaggaaatgggccctttggcatcatctttactttcaggagctctagggttaaccatcggcatgaccgttaccccatgttagccctaagccatgaaattcttctcttcttggctttcgtgcacatccagatatcgctcctgaccggctgaggaaaagatcaagtcctgtgaaacccaaattggtgtctaaggccaagaatactaataaatactaattgtcctccaaaagtatcatttgtgttttaagtgatgttactgagcgagacattttctacatataggatggcatgacatttctatcatatgcaacatttttaagatgctttatgtaaataacaaaaggcaaataatctaatgttttcgttaagtatcctttaaaaataaaatatactgcaagactacaactaaaactagagaattcaagtcatgccatttaatgtggggtgtacagcaggactgcaggcatcacctacatcaggatctgggaccaccggttcttgtaagtccttccacaatttcctaggaatcacctttatggggatgtcatgggtcacaatgcggctactgcttgacatagataactgccaagaaaagaatttaaaaatatttttatgttgttaatattaagcaacaacaaaacaaacccgaagacccgggacaaaaaagttgaaataccaaatctaagtggaatgctgtcagtttattcactcaaaagccattcgaccaatattgatggtgccaatatttatggaacagactctgggtacttccaggaactgggaagtgtggtgataagacaaaaaggtccttagtgttccagtggaacaaacagatcaataaaaatgcaaacaaatgaaactgtatgaaatgctcattatagccgtgagaaagcactccacagagaccagggtgagtgtgggggagtttccttagactgaggaggtgacatttcagataccaccaaaagcaggagaagcagcagccatgggaagacaagaacaaggggacagggtttcaggctggggaaacagcacatgtaaagccgtgaggcagaaagaagcaagcctgctatgttgacgcaaccaagagaaggccattctttgggcataggacactcagagtgctgcagtttctaacagttaaaaggcaaactatatttatttctaggggctcctatgagactcacagaccaaaatatcttgcacttttggacaaaaagtattatacgttactatcttgcttttccttaagcaatagaaaaaacataccaaacttatactgtgacatgaaatgccctaattagctctgagaactgcctgactgcaaagagttgagagttatgaagaaaagctgggctgggcgccgtggctcatgcctacaatcgcagcactttgggaggccgaggtaggtggatcacttgacgtcaggagttcgagaccagcctggccaatatggtgataccccgactctactaaaaaaatacaaaaattagctgggtgtggtggtgggtgcctgtaattccagctactcaggaggctgaggcatgagaatcgcttgaacccgggagatggaggttgcagtgagccgagatcgcgccactgcactccagcctgggtgatagagagactccgtctcaaaaaaaaggaaatacgaacctcattctatgagtaggaagagcaactctggattgtatgtatgcgcatgagtttgtgtatttgtgtgtttggaggacagctgtgcactaaattcatctggcagtagcatataaaacatacgtgtactgaagaacgaggggccatttaaaggttattatagcagatgaggcagggtgggagtggggagaaaacatgtcaaaggtgaaaatggatagagaaaccatgatttctagacaaggtgacaataccactacaagaaacagagaggctggaagtttcacggcttggaaaaagcagcattctagctgaatgcatatgataacaacacaattttaaaatgaggaggaactgactctaatgcaaaatatagttatggaccagatctttaaatttaaataaaccaaacagctttcaacagtatttattgttaaaaaggctaggctaactatgtctattccttcgaggccaagacttctgtgttagaaaccctgactctcctactcaccagctccacggagaccgtgaggcagggaaagtgtttattagtcagtttgattttcaaagccctggcattctgggcagtcttcaaggctcgagataagttttccgatgttagctctaaataaatctcattgttttctgcagagacaccctccatttgaaattcgttgaagaagttctcctaagggaaaaaaaatgagggatgagggagggtatatgtgatctttccagtgacaatctgcagagtgtgcaggcctctcagaagcttttgctcacctgttccagctcacaccacatgctcactcctccattagccagcttgtcacaaaggatgaagttaagcttatcagggctgatgcggagggtgcaggttttggcaagcttggctatcatgttactgattcctaaagcaggggttaaaataaggaattactaaaatgcacattatgtatcctagagaccaacttattttgcagaatttcttgttcatcaacttctcggtggaaaaataaccacttaacgttggtatcacactggaaagtactttaatacccctgatgtcacgcaattctcccaacaaactaggggagatgtacagcacacatcatcagtgttcaaataagaaaacaggcacctaccagtcattcattcattcaacatggatttattgactactaggtactgcaatacacagttaaatgcaaggttaggcactgtcagggtggagggacgaatggggccttgaaggtatgtcaatgcctgataaagccgtctatgggagcagtggccgcttttttttaaagccacgtgatcggaatcaagtttcagaaacgtcccttgaaagccgccttcatccccacaagtgccctccgacccgccccgcgccctcccggccccaccctcccgcggcctacaccagcacccccatcccggccccatcctcccgcggccccttccggcgcccatccccgttctgatcctcctgcgcggtccccaccgcgcgctcactgcttccttccgttcctccctcgctcctctccggcctccctgctcacgtgtgaagtggttcagacaggccccgtccacgatcttggcccgaaacttcatggccgcggatggcgcagccgcggcgggcctctgtgggtaacagaaaagcgtcgcgccctgagtgtccccgcccggaaacacggcagcgcgaacagtggttccgccc

SEQ ID NO: 2152 - DNA, 19977 bp, Homo sapiens
ccaccgggccagggctggttccacgctgtcatttctctccgctggccccagccgcggggccaccgccagacagacagaccggggatcctgcctggcggcgtgaccttgggttagtcctagagccgcttctagcccggtttcctccgccccaggttaggaccacgtgggtaagaagatttcctctgtagtaggggctgtttaatgagtaacagaactggctgctggttctttacaattgcccagctgctctgcagaggcgagaagcaattgcgggctgagcctcccgggaccttcgcgggagggtggagaggaggaaggcgggggaggcggggccagaggggcagaggaaggtgggggcgggcggggcttgtctgcgggatggcccaggatgcggtcagctgagttcgccggcccagggcaggcggggcccgagcctagcggtaacccccgggcagggcggggccgctcgcagactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctctgcgcaggccgagtggtgagtcgcccgcggcccggctcccgccgttctctcttcccaggggtctagcccgtcccctgccttggccacgtgcccatttacctgtaggggcggtgacggaggctctggtgcaccttggctgtgagctgcagaggagcagagagcggcccggcgcggctgcgcggggaggcgggcgcgcggccgggaggttctggggctggtgtgtgcggagcgaggtgggcgtgggggaagcgcgcgggcgggatgtgcttcctcgggtccaccccgtgcctacctctcccacgtcccggcgacggagcgcgcggggctctgggcggggagcccaccgggccgaggcgcagcgagggtgaagccagagccggcagggtcaggtcccgcagggcgcaggcgggcgcttctcgcagcccaaacccgggcggggagtgcgggaacccctagaactatgctgggagccccagataagaggaaggagatggtgacttaagtgacgaagtgatgttttgtccccaccgccttttaaagggagaagggggtaaaatttcatttggaggatgattgttacgcgagctttcagagttcagatggcgtcaagtggccatcgagtcaacatttaacaaaatgttaccgcataaaatattgtcatcgagttatctggcagctccgcagagaaacttcacaggcatatgcgttatatgacataatttgcatggggaagggggtcccttcacgattcttttatatggcaacctgttcttggacctggcagggcccagagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacggtcagtttcaaagaaacacagtctgggatccggagtagaaagaggccgtttcccgtgaaggccatagaggcagtttccaggcgcctgggtgacctgtctctgcacttccctctctgcttctccatccctgtttcctttccccactgtcccctgcctggcctttctttggctcattttctgccttcctggggtcttctggttaaaaagaccattggttccattcattggctgtaaccgcgggtctttaaaaaactttgtgacttccttgaatagaaagaatgtcttactctggatttctacaagcgctgctgagccattcccagggcaggcctttgtctctcccgcctttcagtttgtttgcccatctgcattttggcccaagctttccccatttctcagctgctcttacattatttcttttttcagaggctaccctgaccttctagtcctctgcattaaacctcatcaccgcagaccgttttaattcagcacaggtgtatcgagcacaaattatattcttggttccaatactttcagcactggtgggcattcatgtttcatttaagaaggataaattagtgtttctttacatgggctttttgtcaaagtggaattttgttgactttactgatcttaaaattaacgcaaacttattgtaaaaacaaacaaacaaaaaaacccaaaaaccaaaaatcaaatatataacagaaaatgaaacttctaggttttcctcttccctaaagataaacaacaaacattcttcttccttctcctctctctctcacacacatttgcttttgaaatatgttcattcaaaaaagtattttaaatgtttacaagctaagttatttatgcaagtaacttaccaatctgatttgagtttaacgggttaaaactaaaaaaaaaaatcaaaaacatcttcagtttttttttttttttaagtaagatggatctggctggtaataggtagagagccccaggtgatcaccgaaaagactcttccttggggagccaaatcctaagccaggtttaggatttccctgggaggtagaatttgcagcccaggtaaaaccagcaaaactctcctgttatgtggggaggggagcgaagagcatggctttctagagaggtgagagaagacttgttgagaaactgaatttcatttccttacggaagttggagaacattgtggtacaatgttaggagaaaggttttctaaaatcagtgcagtctgacatcttcaacaccagggtcttttccactggagcactgcagacatctgcaactttctctgcctacgtgggtgtggttaaatagaccctccctgagtgcagggctgaaaagtggagagaagttagttcttgggacactcacacccaggaggggggatcctgcaggtactaagattgcaaagggaaagagagagtgaggctggtcctggagcccactaggaaggagccagcggaaagcagtgactggacaagggaactgatttctctgctgatgtggccttggtttctctggttcagagtaaagaaaagcaaccaaacctagagagaaacatccttactctacaaggccagacgggaagttctgtctttggcttggtttccttttctacaaacggggttggattctctctggagagctttccgggggccactcagcagtctctgattcagtgggatgttctcagctgctggcccaagggagctcacctcttagctcttcccctgcctggttcactggggggctgctccctcccattagctccctacccctaaagacaaaaatagcagcctggagggggcagagttttaggggaggttgtaagagggcacattcttcagaggagccactcttacgggggaatgttcctgccccacagaaactggccctggggatcaggactctgcctgaccctaaaccctacttcttccctcagtcggtaggtctgcttaatggatcctgaagaaggcctgaaatcatgaccagacccctacgccccgggatcctcctgtagtgccttttgataagaagcactgccctggcttctctctcctccttccacatgtgtagggagaggtagctctgcctattcatgaagcttcatccctacactgtccttcatttggcccctggtgaaccgggggccaaggtgtgatacctcttttaaaactcattcccttcacactggtgttgtgactcatgcctgtaattccagctacttggaggctgaggtgggaggatcacgtgagcccagtaatttgaggcggcagtgagctgtgattgcaccactccactccagcctgggtaacagagtgagaccctgtttgtttcttttttttttttttttgagacagagtcttgctctttcacccaggctggagtgcagtggcatgatctcgactcactacaaccttcatctcctgggttccagcgattctcctgcctcagcctcccgagtagctgggattccaggcatgcgccaccacacccagctacttttttgcatttttagtagagatggagtttcaccatgttggccaggctggtcttgaactcctgacctcaagtgatctggcctcctcggcctcccaaagtgctgagattaggggcgtgggccactgtgcatggccccctgtttctaaaaaaatgaagaataaagtgttgaattaaaaaaaaaatcaacaacaccacaccttattccccttcttagctctccttagctggactgcagtaggctgggatttccaaagaagtgttgtgtaaatgctaagggagaatgaaagcctggtggagagatttaaggcagcaattggagggaacatttttctccacacctaacaactgtagttttccctggcattcaaaatttgctggaaatgatcactatattatggtaataataaatcccattctccaaaaagggaccttttgggttttagcttggtgacaagagactgctgagttacgaaggtgagaaccgtgtggtggaaacaactggcttgacctcaggaaagcagcttcacttcacagactcctactgatgtctttatgagccttggatcatcctgtagacccagtgcttcactctcttcctctcagcatgaatcctgcccactctgcaaggctttccagggagttgggggcctggccattacagggcatttggggatttgtttctttattaactgagttcaaaacgtgagtctcaccctccttcaaagagctctggcaaaaccctgcccttctccacacagagaagtggtcttgggggtttctgactactgagccctagtagaataacttcaggtacgccacgtttttccttcatgggactttgcagtggagacggggccgtgggctgactcaggtcagcctcagtccctctccctcctatggtggtcccctgtccccgctgctccccctggagctgataacttttacccatctttgacccaattcttcctggggagaagagcatctgagattctagaaaagtgaggcagaggccaggcgcagtggctcacacctgtaatcccagcactttgggaggccgaggctggtggatcacctggggtcagcagttcgagaacagcctgcccaacatggtgaaaccctgtctctactaaaaatacaaaaattagctgaacatggtggcgtgtgtctgtagtctcagctactcgggaggctgaggcagaagaattgcctgaacctgggaggcggaggttgcagtgagccgagatggcaccactgcactccagcctgggtgacagagcgagactgtctctattaaaaaaagggaggcagagaggtgtggtgtgttgggtcagtgagtcttgacttgctgagctgggaaattgggaataagggacaggtttttgttttgttttgttttgttttttgagacggagtgtcgctctgcaacctctgcctcccaggttcaagcgattgtcctccctcagcctcctgagagtagctgggattacaggcgcctgccaccacacctggctaatttttgtatttttagtagagatggtgtttcactgtattggacaggcttgtcttgaactcatgatctccacccaccttggcctcccaaagtgctgggtttacaggcataaaggggacaggttctctggaggtgtgaggtgcctgtccacttaggcttttggcacattttcagcacctcctctctgaaactagcaatgctataaacacacatacacactctcctctctctctgtttctatttctcacacaattcacacacttacatcaggtgtgtaaggaattccacttcattgcactgactttctacatattagtggggctctgcacgatcttggtttctactgagtggattcactccattctgtgattttttttccttagggtcctgcctcagttggcggaatggcggccacgggagccaatgcagagaaagctgaaagtcacaagtaaggctccatttcattccaggttgggttgggtggggttgggttgtttatagagcatatgttgtgccacacatttttctaaggacttgacatatattaacacatttgatgcttgtgaaagagactgaggcctggagggattaatgactcaggaggttcgtacattagatggttaaagacctccggggtcgggtgctggggcctcagctcttgattcttaggacatgttgtttcagaaaaccagacaagtccctgctcaaatctctgtctagtaggtttttcctctatgtgccaatttcttaaacaaaatcccctgcttatcactcagctctgccttggttctgaattttaaatgccttcttatttctttgcagtttgtcatacttctggtatgcttggcatgacaccacttgtgtttaggcattgctagaaaagcaagaatttcttgtcttcattctgattcctatgtgaactttaatccgctgattattcttattttctcacccccccagttgtctcccacctctgctggggttacctgggcaggccttctgtcctgccgccatggcctctccccagtcttggtggcctctgaccttggcaccacccagggttgtggtgacctctggccccccttgctctggactcctggtcctttgttcctctgtaacttccctgagacctctctgaagtctcacatgtgacagctgcatacccaggtcataattccatatggacaatgctcttctcctcctccattccccagaagtcctggtgtccattttggagtttctggtgcctgtggacattccctgcagtgattttttttttttgagatggagttttgctcttgtcgcccaggctggagtgcagtgagtggcgcaatctcagcttgctgcaacctctgcttcccagtttcaagcaattctggtgcctcggcctcccaggtagctgggattacaggtgcaagccagcacacttggctaattttgtatttttagtagagatggggtttcaccatgttggccaggctggtctcaaactcctgacctcaagtgatccacccgcctcagtctcccaaagtgctgggattacgggcgtgagccactgtggcctgcctcagtgattattttttaattgaactaatagtattcctggtattttcagtcattgacagccaaaaatgccttgtccccagtttctggagctcccctccttcctcctcctgccatggcttgaggttgaggcctagtaggaggctggtgggggtggaggggagtggtagaaatgaaggctggagaaaacagggccggcacaccaagtgccaagcaactcagtgagggtttcctccccttccctctcttcagtaattattttaccctcccttgttttatcctcagctatctgctaatcatgttccacttgctgaaaggcagtcaggtgtagagctcaggagtacagcctcttaggaaggatgtgaccttggactttgaatggggttactgatggtacttagtttatactgagagtattaaatgaattgatatgtgctagctattaataacttcatttctaccccaagtcgaaagccttccatgagtggaactggatcttactcatctttatgttcagtacacccagcacaggatgcttggctgttgcgagatgcagccagcattttctggagccctcccacttccccttccccagtacctcaggcccctgtgtctcacccatctcattttcttcttgtctccacatgtgctggtcctaagctatttgggcaagtttatataaaggttgatactgctttctcttccctgctgataaactcctggaatcagaagccagttttcattgctttcttttttttcctttttgtcttttattgagacagggtttcgcccttttacctaggctggagtgccgaggtgtgatctcagctcactgcaacctctgcctcctgggctcaagtgatcctctcacttcagcctcctgagtagctgggactacaggcatgcaccaccacacccagctaatttttgtatttttcacagagacagggtttcactgtgttgtccaagctgatctcaaactcctgggctcaagtgatctgcccgcctcagcctcccaaattgctgggattacaggcatgagccaccgcgcccagacagttttcatttcatttcatatatttcttttacatggtagatgctcaatgaatatttgctagatgaataaagtggtagaataaagcagaataaagtcacttgaaattatgtgtagactagagaaatatttttttccaggtagtatgtctctgacttgttattttaaaatccttcaaaaaataaattggggcatctactggttcattatggtacatgttaaatttactttttaaattttactttattttttatttttagacagtcttactctgttacctaggctggagtgcagtggtgtgatcagggctcactgcagcctcaacctcctgggctcaggtgatcctcccacatcagcctcccagggaggtgggactataggtgcatgccaccatgcctggctaatttttacattttctgtagagtcagggtttcaccatgttgccctggctagtctcgaattcctgggctcaagtgatccacctgcgttggcctcctaaagtactgggattacaggagtgagccactgtacccggccaaattttcatgttttaaaataattgcctgtcttcacggttacaccctacttccttcttcttcatttctcagaatcaaggagaaaagacaagtattttattttgaaatatgtgacaaagttgtcttaatcacatcctgttttgttattttgaagcatgactcttagcccttctatgttgtactctgtgtatttctaacatcctgaaggaggagaatggaaatgttacttacatgaaaaatagttgtcactaaaggatcctaaaatactgtggggtgtgcagatcgtcagaatttcagattggcctagagatcaaaaaggttttctgagaaaagttcaaggatggtccttaccacacgtgattctggatttggtcgcttgaaaaatggccttgccccacatcccagagtagaatgaaccctgattctggagatccccccaatagcttgtcaggaagaggtgggcttaggggcaggcgggtgtggctctgtgcttcaggcaggctgctgtgccttcctgagcagggttttcagcagattcactagtgcagtcagcagagtccctgcctgcccatacaggagacagtcacctagccccctgtccccttatacaaagatctccctgtctctgtgtataaccctttgtacttatgttttctatatcagcctttctgaaatgttcaggtgtgagctcacctgggccccactctaggggaattgatgggaaggaacatttgacagtcatgaaaggaggaagcagtcaggtataggccatctgtgtgtttggagcctgggtgtctgctgttgatgagtgccagatagaaatagggatttgataaaatgatagataaaataggatgggaccatctcaaccttgtttttcttgtctgtggtgtgttacgtgggattcagagatatataagacgtggtcatggcctccagaaatttttgttctggaggtaaagttattacattaattatgtataccagtgttaaaatatagataaggtgtaacaagcatcgtgtggggagagaatggacaatgtctgtgaggggggtgcatcccttatttaacagttatttccaaatccgtggcagctgagaccttgcctctcttgtgtctttttcttttctcatgagttagaatgaggaggagacatgaccacggggttcagggcagaaagtcagactcagaaggaagaaaaagaagtccccaattgctctgacatcagcatcccatgtctgcctctgtttcctgtaagggagcccacccatctctaggactcagaaggcatacattgttgaaggagctacgtttgaggctggctctaagggacttcgacaggcttgagggactcatctagacctggggcatttgttttgtaaggaaggttttattggaacacagacacactcactcatttgtgtgctatctgtagttgctttcacatgtctacggtggacttgagaagtagcagaaatcatgcagcctgcaaaaccacatgtatttattatctggccttttatgaagaaaagtttgctgatgcttgctctagaccagcatgtgccacgagcacattttctagcagataaacagatgtcttatcttgtcactcctattggatatcgtgctggagaagtggtagctagtgtaacaaaaacaaaaacaaattgaaggtatgcagattggaaaggttatctctgggaggtaggattagaggttgtttttccttctatttctgttcatatttcctatggtaaacatagtagttttaaaataaattcaagtttatacatcgaatgaacttgattagaggagcaactggctatactccctactccttgtatgggtagatcaaacatttccatctgtgtactttcgtgtgctcttctgatttcatccctgttgccctccaaacagagccatgggagcaacaggggttaagagggaggagaagggggaagaacagaggggaggcaagtgcggaccttggcaatgttggggttgtcttatctccgggatctggccctgtctttctcccaccatgagcctcgtgtctgacataggccacttctgtgataatgtcggctgtcgggcactgatgttctataagccttccactttcttgttttttaacagtgattgccccgtcagacttttaaatccaaacatagcaaaaatgaaagaagatattctctatcatttcaatctcaccactagcagacacaatttcccagccttgtttggagatgtgaaggtaagaggccaggtgttgacaccttggaatttgccttaagatcaacctccccctatattatacaggtagaccaacccacaaatgcttgagagaccacagctgacaggtttatgaagacataatgtttaccaaatttttgcaagtttttaactttcaagtatgtgaactagcaagtaaaactatcctaagtagtgccaaattgttccctaattcatcttttgcaaatttagtgcagtcatgcattgtttaactctggaaatacggtccgagaaatgcagccttaggtatttcatcattgtgtggacaacatagagcgtaaccacacaaacctaggtggtagagcctactacttgcctgggccatatgcctctaggctacaaacctctatagcatgtgagtgtcctgaatactgtaggcagttgtaacacagtggtaagcatttgtgtatctatacatatctaaacatagaaaagctacagtaaaatcatggtattatataattttctgggaccgctgttgtgtatatgtgattccttgcttaccaaaacatcgttacatggggcatgactatgcatttgaaactatatataaaataaacttcctaatgcttcattgagagaagagaaagatgtaaaaatttcctagggaagcaaaggatagtaaataaaggtcattgtattttgtttgtaatataagatacatattgatattctgtttagttaattgcctttaatgtcttattttgcttcatgcagcttccagttaactttttctacaaagtcttaagtcccttagttctgatttatcttaacgtaggactttgaaatgtctaatgggtaaagatgaactgacatgtagaattaaaaatcaaaatataccaggacgctagaatccagtgctgctacatgggatcataattaaacaatagtgttatgtcttatcaatcatcctgttctttgatagtgttggtttcaaatggtggacaacttcccatgtgcttttaattcattaaaatttcattcatcctattaagttaatccgtagtgatttttattccaggctatggaattttcttttttatgtttagagaataattaataattcttttcttttatcttcagacttttttttttaaattttttgacctggagtctcactgcccaggctggattacagtggtgtgatctcagctcactgcaacctccctgtcctgggttcaagcgattctcttgcctcagcctcctgagtagctgggattgtaggcacctgccaccatgcccagctaatttttgtattttttagtagagatggggttttaccatgttggacaggctggtctggaacgcctgacctcaggtgatctgcctgcccactcccaaagtgctgggattacaggtgtgagccactgtgcccagccatcttcaaactctttaaaaacttactcacttaaaaaaattttttttttcaaaaccaacattttcttacatgatgttctgcaaattaaagtttttacttctctgagagagacccatccagaatagctatcacttcctgagcctcctctaggcttcggctggctcttctcaagcattggctatttggcactcaagtaaccaggcgagagagcggtcagtagcccattttgtggggccctggtaacacagagggacagtgaggagttgctccctctgtttcaaacccaggctgtctccacaggccgccttctacatgacggagggaggccgagggtgcacaggacctggaattacctcctcagagagagcaagggtctggattcctgcgtttgtggagctgactgccttttgatgcttggccgcccaccctgaccactcaccagggggccttgttaaagcagattcctgggccccttagattcagcaggtcctggtgaggccagtgaacttatatttttagcaagttcattggtaatactgatgttgctggtctaggggccccacttgaggacctctgctatagacagtgcactaatgggggtctctcttctctggctgcagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtgtgagtacctgccttcccttgtgctcagtctctaggctctgcaaccccctgtgccccacccctctgcacacacagacagctggtcccctaacacctgcttactgtaaatggctgggagcagggtgagcccacagtagctgggattcagagattattgaactcaggctatcgtccttgaggctcagtctccaggggcgactaagtacacaaatgcatatacaccgctgtctgtctacacagtgtgagggtggcaggtgcagggagttagagtgcttggggtgtagaggaaggacagtagggggcgccctgcctggagcaggatggaaggagagcctcaaagtaccaggcctctaatcccctctaccacctcacagtgagttacttcaaaacacattttgatttagcaaggagcatggtgaacacagaaatctccagattctaccatagaagtcttttcatttttcagttttgattttgtcaggagcaatataaatgaacagctgcagagtaaggaaagggaaccccttttgttgagatgtgcacccctacctctccagtcagctgaggacactagctatgtcaaccaactagaacatatcagggagccaagacatgactaggttactgataatctgcgcaagcctttcctgtgtgtaaggctccgtgaccgattctagcagggatgcctccactgtatggctctgccacaggaacagcccctggaaagtgctgagttcatccggggagaggcatcacagaagttgtgacactagggggggtgctctgaagaggagagcaggagaaggaggtatgcagagaccccaaagagaggaaaaggcacaggcagacaagatcagcaaagcatcctgtgtccagtgggctgaggaaccagctgattacttagtttgtctgaagcagagggtgtagggagaaaagagaaaggagataaaactttaacctgtggtggggtgtgggagaatagggtgggtatttatgcagggcttcaaatgctagaaggagctgtttgttacctggcaatagcagactgctgcttccctgctgagcccctgggtccgcagctgttacctatttgacaaattgtgtcgatcaaatggggttttgtctttgacagctttgcatacactttaaagtttcccaaagtgttactagttcttaaatttatatttaaaaagtttatctttcatcactatgtcaatgggcatgttagattgaattacatcacatgaaacatcagccagaacattgacaaagtcacaaccttggcttaacatgggtgtttctccctggttccagcatggtatgggcattccttctatctcaatcatgttgcatgagctcataaagctgctgtactatgcccggtgctccaacgtcactatcatccgcattggcacttctggtgggataggtaaggtctgcagaggggcctcttgccctgtgaatggatgagggactggggcatgccaaggcagcttctacatggtgtggcattagagacaaagagttcctttcttggctttgttcaagggaagcttgttaacaggaggtgtgaaaagaagcttgttttgttgtttttgtccaacctgttctcccaacccgcaccccagagctaggcagtagaagggcaccacaccatgcatatgggggaaactcatccttttggggttacacaatttgtgccttcttgtctgcttgattctgtcttattctttctaatcccccttcttctccattctctcctttcctttgcttacttttcctcctccctaatcctgcagggattttgaagcaccttaggagaaaagacacaggaaaatcaaaggggggaagagagaggcgcagtacaaaactcagataagtgtccttaaattagcttaaaatgtccctatcctcaacagggacattttttttttgtttaaaaaacaaagatggttggccgggcgcggtggctcacacctgtaatcccagcacattgggaggccgaggcgggcggatcacaagatcgggagatcgagaccatcctggccaacatggtgaaaccccgtctctactaaaatacaaaagattagctgggcgtggtggtgcacgtctgtagtcccagctgctggtgaggctgaggcaggagaatcgcttgaacccgggaggcggaggttgcagtgagccaacatcgcgccactgcacttcagcctggcaacagagcgagactccatctcaacaacaacaacaacaaacaaacaaacaaaaacccccacaaacatggcaaagaaagaatgagatttaatgagaaagcaaaagctaacaaattgttgaattgtaagccaaagtctgttaggcagatttgttttaaatacgtggtcttgctctctggggttccaactctgtgccattctttctgctaaaaactgggttctagtgattcctgctcccaccgaggtgttcagagctcagggaagaagcctgcatgtgccctagagaaagttgagctttgccgctgctggccaggcctgtgtgtacttgttccaggctgtctagggcctggactatctaggatttatagcaattctagaatttaagtgtcctgaccttgaaaggggacttgctttagacccaaatattttgaatatgttatcttgtctcttttctttttgttatatagagagattgatgcataaaatctgtgtttgtatgactgtaattccaagtttagcgaaattgtccctaggacaacacaccaacggccatgagctgtctcggtcctgcaagcttagtctccgatgctgcccacctgacacagctgtgcatagcatgctggcctctgccaggaactctagtgaatggttcttgagttcttgctctggagtgatttttaaaacaatgatcagataattctggagggagtagtatagattttgaattttcctcaattgctctgtaaaaatggaaagagcaactagggagcaaaaccaaaaaccactggacacagttgataataaaaggtgatgtgctatcctcacaaaccccaaagtatgaatgggtggagacaaaaagcctcaggatctggttgtgttggcagctgctcagggggaagctcaaggcgatggacagacctgagaacaagagtcccaggcactcctaggaaggtgcagggggacatggtgaagatggcagctgacactggagggggcctgtgcgtcccaatgtgagtgatgctggaattccaaggggcttgaccactccaggccctgtgggttcaccaaggcatcagccaagctctcctctagctccagccccagtgctgggagaagctgctgaaatgagactctgaattgcccagaacagccgcaggagtagcaatggaaagaggagttcagatacatgtggggagcgaagcaaaggtctttgcaatcggccatgttttttaatgtttcatgaaaacaactgacttgggagctctggaaaagatctgacttcttgttccctcccacatgtttaggaaaaccaattttgcattaaaataagtatcagaaatggatcatagttatcttagtccctgcaggttgatagacaagatgccattgactgagtggcttataaacaataggaatttatcgcgtagtctggaggctgcgaagtccaaggtcaaggagtcagcaaacttggtgtctggtgagggctaactttcggattcatagagctctgttttctccctgtgtgctcacatggcagaaggggcaggcagctctccggggtccctcttataagggcactaatcccactcatgcaggctccaccctcatgacctaatcacctcccaaaggccctgctgcctgaaaccatcacatttagggttaggatttcagcctatgaattttgagggggaaaccagcattcagtccaggtccataacaatggtcaaatcccatctaaaattattataacacaaagaataaggggcagagtaatgtccctacaaacaggaaactactccaggaaggcacgcccagaacatagaaactggaccctaataatgcatcaatctgagaggaaggccaggtaggtcaggagttggtcatagctcacctgggtttagggtgtgggacttcattatactgttctagtctgccttttgctggtttacttttcaagtatttgcctgaaatcttaaatattaacaaggtatgaaacagggatcaatgaaacacatcatggtatatggttcagtgacagacaacagtgggaaatcgccgtgaatggaagcaagaaatatgggacaaagtacttgaaggttcctggccatttttattttattcttttttttttctttcgaaatggagtttgctctttttgcccatgctggagtgcagtggcgtgatcttggctcactgcaacctctgcctcctgggttcaagtgattctcccgcctcagtctcccaagtagctgggattacagacacccggcacaatgcctggctaatttttgtatttttagtagagatggggtctcaccatgttggccaggctggtcttgaactcctgacctcaggtgatctgctcgtcttggcctcccaaagtgcttgggattacaggcgtgggccactgcacccagccctctactttgttttttgtgcctttctcttccatagtgtccataatgatcatgcattaattactttcatagcttaaaaaaaagttgaatgggaaaaatgggtcactgtgtatttgagaacagtactggatgcttcgtgtttggatgtgtgggtggatctgcttctttcttccatatgctctgctgtgtgctccctggctgccctgctttaattttattttgttttacaccctgcatatcttgatgtctgcttttttcctcaggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaaggtgaggcagcggatacgaggaggcatctttcagccagggaaccctggtccgtcccctgagcctgccttctcgctgtggactggcgtttccacttgccaggctgctgtctcagttacacttcgcccagagtggttataatgacccgtttgagtggtcattataggcaggacctggatgggtcttgcttgtccctgtgtccttctgggcatcagtggcgctgatgtgttgtaggagcttctcacatgcatgtggttctcatgtctccatgtgtgcctcagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaaggtaagcggcacttgatgggcctcggcgtcccctcctcccttcacttctgctctcctggagcccctcgctggggcccctcctcctggggcaccccgatacccatttctggtttctgtttccgctgcccccaagtcactttctgacatatgtgttgtcaccacaatgctgttcaatgtctgactgtcacaccctgacaaaatgcaggattctcagtgaccttgtgcaggaaaaatgacaaaaaagcttttgctgccccatgaggctgccaccaggtctataaaaaactcggctttcaaagcgctttggctttctgaattgtggttcatctaccctcaaggtactagccacccttgaaggccagctcacagctctgcagaattcccttatcacctcggccaaaacgtgcctttcaaggtggtgcttgcagccctgagctggtcctggaatggtgaattccttttggaagcaggcacgagaataagggagggacagggcagggtggtgtcagagagggaggagtcttccgagcccctggaccagcgcctttccctcccgcactccatcctccggccccgcctgactgcatgggcagcctggtttcctgaggaggcagagaggctgctcctcagagctcgtgggttcttcatcccgtccctgtgaaatgttagacccccggcaccttgccttgatgtggtctttgtcctttgcagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatcccctgttgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcagactttaaaattctaatggtagtcagatttcatgtcactaaacaagaaatctgacaatagtgccaggaaactaatttcctgatacattaaaaaaattccatgca

SEQ ID NO: 2153 - DNA, 16339 bp, Homo sapiens; identical to SEQ ID NO: 2151

SEQ ID NO: 2154 - DNA, 25788 bp, Homo sapiens
cgatgttgtggttccgcggcgcgctgggagtttgggtttggttggctgcagccagccagccgtgtaaaaactccaacgccgggcgccgcgggcagcacccacggagacccgcggggagctggtgagcctgagcgggctggaggacaatgggggcgcccactgtggtcccgggccttgtccactgtgcggagctcgcagtgcgggcagtgcgcgccggggctggagggaggggaccaccttgtcgccgggttgggatgagcacagggcgggatctccaagcctgcccaagtcccgcggccccttggttacctgttgcttatcctctctgtacttgctgtgtccctggcgtggacgtgcctgtactggatacccggcgtgacgtgccccctctgtgtgccccgcacgcacgtgtctctgctgaataccccgcgtgaatgtgcccctgctgtgtacccggagtgcgtacgtccctgctgtgtaccctgtgtggacgtgccctgctgtctacccggcgtgcgtgtgttcctgctgtataccggcgtgatgtgctcccttctgtttacctggcgtggacatgccccctgctgtataccctgcatggaagtgccagcgctaggcgatcgtaaggcgcctgcaggcgtgtcagggcgaggcgtacagaccgacccagagcgggcgcgcggattttgcttttgcagctgcagctcctggcaactggtcaagcaggcagcgtccagcgcacccgcgaacaccaggtccggcagcatctgtcttttcccgcagcgtgcagcgcctgaccatgaggaacacaagcaaggaacttcagggcgccacgcaccgctacgctccctgcggtgagtgcgccctgagcgcgtcccggccagaaagagctgggtgcgtgcactctgcttgctagacacgctgtggacccaacgtcctctatgtgggctggaggggggtgtgaacgatggaggaccaagtgataaaactaacaagtcaaagaaagccacaaactgctcctgtgcctgagtgtgaaatcaagacttaaatatgagtggggggagtcttgtttttctttattttcaacaagagagaaccaaggctacctatcttggttcaatctggagcaacaggatcccttggaaattttctttgtcatagttcaaccctatacaattctcacaactgcgttcctgaatgttgacctgggaagtttcttctctagcagaatcccctaggaatttcactgaatccctagcccttgctcctactttagaccccaagcaagttaaatatacattctgggtttagtgtctggatacaggaaaaggaattcagtgaggttcatgtcttcttatgtgccagggtttgaagtggaggagaggggaaggaagaagaagtcttgagatgctgtcttctgggttttttttttttccttttgctattgcttttttatttgtgaaaggctgtaggagggtagagaagagggtcctggggatcagctgggacagctgagttgcagctggtcggcaccctggagccagcacatttgctcagaagtgaaccaaatgtgacccttcttcatactctaaacatgctgctagcccagagctctaccttgtgaccactattgaagatagtgtggccatgctggggattggaaaggggacagcacagaaggcctggctgatttgccttttcccagtaggctctggagcctttatgtgacttctgggtgccttctagtgaccttgtctgtatgaacagcagtaaggaacactaacaactgccaggcactgttctaagtgctttgtattaatatacactaactcatttaacctcataacaatgctacaaggtaacattacccccattttatagagtttggagtaatttgcccaaggtcacacacttcgtaagtggctccacagctgttctgtgaggccacagcagcctaaagcaggagcctgtgcccctgcgggtatgtgaacatataacacactgccttgtgccttagagaccagaagagctgggggatcttcagttcatctcatagactgtcacagactgtgtttcctcactgattaaataagagtactaatatatggcaaatgagaaggcagggaaggctatatatatatataaaaaatctataggatagtaaatgactgatattgtacaagtgccaacaattttttgcatgataaaagctgagataactcttagtccctttaaccctctgtgtgtgtgtgtgtgtgtgcgcgcgcgtgcgtgtgtgtgaggtggtcacaaatggttcttactgatccaggccctcattctctgagtgcctcctttgtatgcatttacaaatggccaaccagattcgagttcagtgcctgtccacagcttccagtaatgagaagaaggtagaagacacactgttctctgtggattaattagtaatcaaaacacagagcggaaaaataatgcaacaatcaaacgccttctctcaaatagaaaatatttgaactgaatatgatcggagtatgaagctgctaaattctcttattcattcttaaattgattctctgtgatcttttgtgcaattctttaaatcttttccaatttttttctttccttttcgaaaccatatagtgttgattcagctatttaatgtcttttacatacttaaaagattgtctgtattaaataccatccattaaaaattcaatgtctaagcttttagctttaaaggatggttacttctcatttctctgtgcttacataaatcaatttattcagtactattttcctgtgcatctactgtaatagtcagcattctccaaaccaaaataaccaacagcatatccatgtctatctttctatatacatatagatagatagatagatagatagatagatagatagaaagggagagagagatttgttttaaggaattggctcacgtaattgtggagtctggaaggttcgaaatttgcagtgcagaccagcaggctggagacccagggaagagctgatgttgcagtttgagtttcagagtggtctggaggaagaatttcctctttctgggggatctcattcttttctcttaagactttcaattaactgcccacaaaaagagtcaaactctgtaaaatatttaaagaggtttattctaagccaaatatgagtgaccaaggcctgtgacacagccccaggagttcttgagaatatgtgcccaagatggttgagtcacagcatgattttatacattttggggggacagaagttataggaagacatcaatcaatacatgtaaggtatacattgattcagtttgaaaaggtgggataactccaagtatgtgtgtgtatgtgggtggggggtggttccaggtcataggtggatttaaaggttttctgattggtaattggttgcaagttattatccaaagacacggaatcgatagaaaggagtgactgggttaagataaggggttgtggagactaaggtttttgtcatgcagatgaagtctccaggtagccaacttcagagagagtagatgtgaacatctcttatcagacctaaaaaagtgtcagactcagttaattctctcctggatcaggaaaagagctggaaaaggaaggggattctctacagaatgtagattttccccacaagagacagctttgtaggaccatttcgaactatgtcaaagaagtctatattggggtaaaatatttcaatttctttcaggacctgctatctgtcatgtgatgctatactagagtcaggttgcaatttggtctctgactgccacagagagtctgttttttcagtcttaagatctctgttttaatgataatgctggtctgctgtgcctgaattccaaaggaaggagggtataaggaggcacgtccagctttccttcccattatggcctgaactaatttttcaggtttactttggaatgctcttggctgagtggggggattcattcagtcagctggcgggtggtggggggcttagaagtttatttttggtttactctgataggaggaagcccacccacattatagaggacagtctacttcactcaaattctaccgtttttaatgttattttcatctaaaaaacttcatagacacagctaaaataatgctttaccaatatctgagtaccatggtccagccaagttgacacataaaattagacattatacctacccaagaagaggatattgtgttagactctgaacatactgcccctgtgacagtacgttctgataagtggtattgaatagaaggggatattgtgttagactctgaacatactgcccctgtgacagtacgttctgataagtggtattgaatacacccagtcacttgtgtcacattaattgcatcttttgtatctgacattcttcctgggttttgtttctaaagttttcaatcaggtgtggttttttttttcttacatttgggcatctggttaatcaatttcagattcaaatagttacctagaacctcagttgtctgagtgccccagatctcttctctctgtgggggtcatcaataaacactgataactccaggtccctgggattttgccaactcacttgacagaaactcccagtaggactccagggagtctcctgggtggtcccaagccagcctgcagggcctgtcctggataccctcagctcaaggccttagggagcctcatggcttcaccaggcccatgttcagctcctctgtccacagcacctttctgcatgggctccaatcaagaagggaggatggacagagaaccgctctcttcctccactcgattgtgcctggcttcttcgtgggacctttttcaatagaaatcacacaatctacactcactgtgtttcaacttgatctttctcaagggagccacacccagtcacctcaggaatctctgaatttccagctgagatgtttttccataacacataagtcacctgtttccgccacttttcaggaaccatctagacctctggccacctttcacagccctctttggcctcaggcatgagcaaagccattatgattgaaaacagtaattacatattaataataatgaaagggacaaggagagagggagagggagagtgataaggtgagatgaattctcatgtggggagtctgggtggagagaatgggggaactcacactgtactcgctcatatggagagaggctgccgagctgattcgagtgccattgctcggtggacaggcctctttgaccactccccagtcctacctcttctcactcttgtgttattggtaaatgtgttcaaacaggctgttatttctgtgacagaacttagatttcagtatttttaacatactaaatttagcaaatcttggtcaacatttagtcatgtattccacaggcttacccataacgttttaagtgatttgggatttttcaggaatgtatattccccaacataaccagaaatactgttgtcttatttttatggaggattaggagagagagacagagacatcatggggcttgggtacctccctgggaagcgaaagcacccatgaaagaggctgagccctagcagctttccccttgattggtgccagtggtggcatcttggtgggcagtagagactggattgcatagctggtgttatgactcacgtcagtaacccaaaagagggcattttcttccttgctaatgggctctgtggcttgcactgccccacctgatggtgttgtctgcatagagatactctggtagaggcctagaggccaccccgacacacagcaacagtgtggccctccgcctctctcctctatagattggtattaccacgtcccagtgaagcgctctgagaaggccgtggatgccccaccagcgtcccagatcccaggtctcagcaatttgggagactcacacagcgagaacctgcctgggactcggagatactggataaaagaaacagattcggaatatgtgaagctcgcgaaacaaggtggcaggcccggtgagccccctcctgccctgttcagtgtggcagcctcgcgggcggtgaggggggcgtttgttcctaatttcttccatataaaaatattactacagagtctgtatgtttagcttagggccttgggaaagctaggttaattaggtgtagggatgagcatgatctccagggatgagctaatttttatgatgctagaataaataggccaaattcacagaatttcctgtgtaggatatttcttctgagtaatgcctttgcgatgattcaacccttccctcacccactttatattctaattacaaagagaatctcaggaagttgcctccaagagagaatctgtctttgcatgctaccaattcttgtctaattgtgaaaaggttttgttgtttattctcattgcggcttgtcctttgtatgaaaacgttttagaaaatgaagaccatagaggagtttcagtgtgatactgacgaggaccaaattttgatacatgatttaattgagaaagtactgcttaactatgctaaaaactaagttatttgagctcaatagaaattactgatcagagtctaaaatgtctcagagccagccttgtggtcagtgacttggagagacactaaccttttttcccctttagctgccattacccctgtggggattgtcagagagaaaatgggaagcaaaatggcaacatctttgctttaatattaaaaagcctggaccaaacaatttgatggactaggtgtgatgctcagagaacaagacctagacattttttcttagattcacctcctcctgctgttggttaaaagaacattaaggggacaaactctgaatgtctgtaaatcagataaaagaattgcatcaatagtagtttcctgagtgtgatcattgtgccatgattatgtcaggaatgtcttttggcagcatctgctgaggtatagggggaggactgggcattgtgtctgcaacgcgctgcccagtgattctgaaaacaataacgacaataaaaataataatgagagagagggacagacaaagagagaaaacataaagcaaatgtggtagaatattgtttggggagcctaggtcagggtataggggaactcatactattcttgcaatgtttctgtaagtctgaaacatttaacaatgaaaagtgctttaaaagtaaaaaaaaaaaaagaaaagttaaaattttcttactgatagtaataggtcaaccaaagttgtctgctactgccacaggcactgctatcattttgctgtccttatgatcaagaaagtcagttcttcccactccccgccttttgaaaccgggggagggaagtgtggggagctagaaagcaagtgggtgagtccggagctggcctgggcctctgagaaggagcctgtgctctctgtgcctctcagggttggctccaaggtgactgtgaaatctcccaggtacctttcaggggcttgtatcctacttcccatctggaaacctggaggtgtggcttctcctggaaatggtaggggtggggttagggacagctccacagtggcagaggacagtcagaccgtcctatgctaggagaacggtgtgggggtagctgaggatgagggagccagcatgtgcagcccctggagacctgagcagtggagggatgggccccctccaggagctggtagatgctggcctgcatagatgcagctcaagaccaggagctctgtccagatctgcaaagagtgagatgtggggaggcatacaggatgtccctgcctgagcacaaagcaggacgcccacctgtcagcctgtgcacagacaggtgaggatcagggatgctctgttagtccctggatcccagaggcaactacagggagacctacagttcgccttgtaaattgagcctatcactggcaatgctgtgcgtctgtgtaggggcggcggggtgtctcacagccatgtcattttctcttttgagatttgttgaagcactttgcccctggaaccaggaaaggctctccagtggcctactccctgccagactggtatatccaccacagcaagccaccgacagccagccagcaagagtaagtaccttaaagcactcacatttttgtttatctttacaggaaaaaaatagcccaattttaattttaaaaatacaaatgtctaatagtggtagcaagcatgtgatatgacaacttcaggttctcttttacaatagcctgctctttgagggatgtagcctaagttgtcagaaaaccagagttctggaaacctgtggcattttgtgccaccctagagtcttgtgtctttgggctccttctcggtaaattgcactgtagtgttaccggcgggtcttcgttcttagagcttctaagatggtggcgggctgcttccaagatggtggtgggctgctctcaagatggtggcaagccttttgttctctgacctggggttcttggcctcacggattccaaggaatggaaccttgggccatgcatgagtgttatagctctatgagaagctgtgggtcacggaagagaaccgtggaacccagcgactagtgttcggctccattaggacgaacccgggcacttagctgcgcaggaacaatggcgagcctctagcccgatggggagcgtcagtgggtgcctccctggatcagaagtgcagcggacactctgccggatccggagaggtggaaattagcggcgggtctgcaacggaggcaatcagcagtggtggactgtgagtgaaagctcagctcaagccggaacaaacacagaccagaagagtgtgcagttgcgagatttaatagagtgaaaacagagctcccatacaatgggaggggacccaaaggggtttgccactgccggctcaaatgcctgggtttatatgccgatcattgtccctccccctttgctctcaggcaatagatgattgactatttctttacctcccgcttttagcctaattggtattttagtgaacgctctttactacctgattggtcgggtgtgagctgagttacaagccccatgtttaaaggtgggtgcggtcgccttccccacctaggcttaggaattcttagctggcctaggaaatccagctagtcctgtctctcagtaggactgaccacatcctcctgatgtagaaatagcagcctatcccaaagggttctcattaaagacaaaaggcactaggtaaagctagaaatacatgaaatcctaaatttctatgttcaatattgagatatggggagccatcgttcccataatatttgaaatgtctaagaaatttctatttgtggacatgcaaactttatctccagaaccacctgtcgtggattgagaggtaaaatgaaaaatcatttcaggccatttccccatttttttggcttgaaaataggactaccacaaatatatttccaagtggttatccggtgttacttgaatgttctgcacactgccacatggactttttcttcccttccttctgctttttttcttccagactgttggtacccctgtccctttgctgtctcctcccaccccatatgtccttaccaattgtccaagccttctaggatgatctacttctggggccttcagtgttttccgtcctcctgggaccttgtcctcctctggaccgcagaccacctgctccaggtcctgggacaggcagaggatgaagagtgggaagctcaggagaaatccttccttcactgaaaatctgggaacccaggagctataacttaacatgctttttgtttttaattgtccctccctttgttgttttcaatgctcatctgtttctgtgggctttttcctgccgagaccacatcagaagtgggaggcctggggagaggtgccgcttttcacacctgtgctccctgagcagctcagccacactcatggcttctcttactgggtatctgcgtccaccttccaagcctgcatttccagcctctgaccgctgctctctggcctcttcactcgctctctcggaggcccccagccacctccttcaggtgctttgctgcagtggtgcccagtaccccacgcctcgaccttgcccttggtgcccactttgcagctggggccttttttcagcatcctggagccctgaacaagtacaaatgaggagcaggacatgggggcatccctgcagcccctcagacactgcatggggggtttgtgttgccgtgtcaaacttgaatccagtgttcttccctgttcaaacctggttatgtgtacagatggtaccttcagggatctgaaggctgaagcattctagtgcctttggatgcccctcctgtgtgcgctgcctatatgggaagactggttgctagtttaaatactcacattaaaaatgaccatccaacaggaaacagagcatgttattattattttaaatgaacatgttaaatggtaaatgtttaggggtgtttagctattttaaggggtcaaagtggtagatgctatcctaaaagaaataattattttataaggtacgttttataaattcatattttagtatatctcgttttactaacgttgagaccttgtgatttctaagtgggcctcctgatcctgggacgcagggcctggaggggttggtgtgttgtttagcaggcacaggagggaagggcccgtctgtgttttcaaggagaatgggtagtgctgatgtcaagagagacggaagagaagagaataagggagggagagaaagagaaagagagggaaagaagaggaagaggaaaagagagaaagagagagagcaggagagggagagagagggagagagagaggagaaaggaaaggagggagacagtgagagaaggagggagacagaaggagggagggaaagggagagccagcgatggagatggaaggaagggagggagtggaaatggctctgagcaccaggctgtaactggtgtctgtccttgcagagtgcgggctgtctccatgccggattacatggttcatgaagaatttaaccccgatcaagccaatggtagctatgcatccagaagagggcccttcgacttcgacatgaaaacagtttggcaaagagaggctgaggaacttgaaaaggagaaaaaaaaggtgacgggagcccataaatagacggcatccgcatccgctttgcttctgtggtctcgagtaattaagtgctgtgatgttagctgctggtggcgtcttatgttgctcgtggcatcggccacgtgctctgtattttaagtttggatctactaaaaggcaagcaggcaccatactatggtctttctttttctttttatgaataatgactttaagaggtaagatttctttttgctaaatgatttatagatagttaatgcttatctagaggaaaactggcatagcacttcttatcaggccaatatagaaaaggaattttatatttagtcatcccatttctgaatattttcatttatttaagtattaagagttttctgggacactctttgttgataataaaggaagagaagatgaattctcttctgtatgaagtcctggtggtgtatttgatcacaaaggagtgactggctgtgcagtgaagccttctcagaggatgtgtattttaagaatgcaatggagaaagttggaagcaatcttgaattgccagctctgttgttgggaagtcttgacaggaggaccttctatcccctttccttggtgctggaaggaacaagagccaggccttcagctccaccaagggctcagtgttgcccggggcatcagcaccaggtctcagattagtctcagttcttgcaacttcagggtttgtgagtgaaacggtgaagttcatattacaaataacaatagtgtttgatactgagaataagagtgaacaccgttgtcacctgatgggtgatcattttgaacaatgaagagactggatgtgtctcagcgtacgtggaagttgttgtgaactatttatgcctgattcctaggctgttgccttagcatcttggtttgaagggaaacccctcagtttattttggggacttgagtagctgaacaccaagtggaatgtcaactggctgcaatgggccacatgctttttctttaagatctccatgtccggctgtgattcagattttgggttgtttccatgatccgtgcaaaggcattagaccttttattgttgtttttttgtttttgttttttattttatttttttaattagagagaagttctcgctctgtcacccaggctggagtgcagcggcattatcatagttcactacaccctcgaactcctgggctcaagggctcctcctgccacagcctcccgagtagctaggtctacaggtgcatactaccgtagacactcagccaaaatggaccatgttaagaattagatttatctcttagtgttgcacaagtgaccaattacactgagctacaacctctagtgataaatgaacctttggatattaaccgtggctacagctcatttctacagaaatcttaaaatgctaaatgctgtatcactctcaaatcaagtggggtttttaagttagtacccatttacaaaaggtgtgctaggggctacacaaagttcctgaagccagcccttcactatggggaaggagataggatgacaaggggtggtggttaaagacacacatgctgagtatttaacaggtagagggacatggtgtcgggtaaggtgcaggggatgagcaccgcatcgggatgggctctgatttccctaataagacaacaccatcaccgctttggtatgaaggtcacctatgagtgatgatcacatcatgggcgtgggccagctgacaaagcgcttcctcagctgtgccctggcctcacacgggacacatggtggacacctgacaagacttagggcacatgtattgcctgttggttaccagcattcatgggggtcttgctcacctacagggtgatcgggggatcttgtttcttttttttgaaaagccatcttttcttcctataattgttagcaatacctccgtggattttgtttgcttcgttttgttttttcccgttttcccatagcatgtatttctatttcttttaataagaaacaatttaggtagagcgaaacccaccttttatagagaactgctccccaggttttgactaaggcgtcccttgtgtaccaccacagctgtcaaggaacatatagcagttctgttgcccccagcatttctacccctctttatagtcagcctctcccctgccccttgcaagccctgatctgttttcagtctttatagttcttctggacagtgcaggaacatcgccatcttggacaagcctctcattctaaaagttcaccttaaaaaaaaccgcctaaatccaaggggcatcagcctaatggctaaggtcaacacgaccatgaaccataggtaacatctccaaccagaaacattccaaactcctccctgaccagagacatggtagcccctaaataagctctctccagccaggaagatgccaggcccgagttaacccccctccgggctgaaagatgtctgcaccaagataacctcccctcctcccagagagattccaacccagccatgaacttctccacacacataaacattccaagcttctgataagccccctcaccccaaaactgatatatacttttagtctgtaagagaaagtgctcctgaccacaatcagccaggagtgcctctcaggttttaactaaagaaaacctgtctttgactgccacgccgcatttcgtgtttctttcctctttctttaattcttacacttccttttccagaatgtgaaatcaatggaatcatacggcatggcgtctttcctgcttggcttctcccatgtggtgtaatgcatttacattatgcatctacattacatacgcatggccatgctgttctgagtgtcagtagttcatttgtttctgttgctgagtttcattggctgatcatgatacaatttgtttatccattcgtttgttggtggacatctgggttgtttccagttctgggtgattattacaaaagcgtacaggtgcttttgtgaacatatgttttcatctgggtgtgggaagttccttcaggacgaggctcttagttcattgtttttcctcctgagcagatggcatctttactcaaatatagcaactgcttttgagttagtgatagtcccttttacataactattttgttgaatgagattattgctgaattatattttattgtgagcatttacaatgaccacattgaaagtccagcctataagctttgtatctttgctaccattagtgagttttcttctctagctgttgaatgctttccactaactcaaggttttgtgtgtttcctcacacagctgaggctaccggccattgactcaaagtatctgagcaaagcaggcaccccacttggccctaagaatcctgcaggaagtagactctccttcccccccgtgtaagtgcttgagctacgccctcactgtctggactgggtttgggtttggccttccgtctttcatccggtgatgactgcgctagtgacagcatccacacaacttcccgaagccctgtctgtggcctggcctggctgtgcctgtcgcctcctcactgtggtttctgttccttcctaatgtcattttgcccctgttgaacacatctgcccttccaggtcatgcttgctgcaggttggcagtgtggaggctctgcttctccatcaggctgtgccctgcctgaagcactccccctccaagataccaccctcaccacagttcacggggactgcttgtcctgcatgtaggggccaccaggtcctgacgtttctgtgtccaaggcctgaactgaggtgtccgcgccttgtaagcgtgctggctctgtttccagttggaagatatagcagacacactgacatttgctgatcctccagctgcagagtgaaatccctgaggccttaggtgtcttcttactctcccagaatccaagtttaatgctaggataaatgttattaattacctgactaattcttcaaacagcttcttgtccaatggggaaaaaacaatcagatacattgcattgtgacaaatgccatgagagcaccaagctcagagggaaatatacatgtattcatatgtgtttatatatatgtaagtatatatgtatacctagacatgtatttatagatgtacgagagagaaaataaagcattaggagtggccttgataacaaagtgattgaacccctcctgggcgcaagaaatcctcccacctcagcctcccaagtagctggggctatatgcatgcaccaccacacccagctaattttttattttttgtagagacaagatctcactatgttgcccaggctggtatcaaactcctgtgctcaaaaaatcctcctgcctctgtctctcaaagtgctgagatggaggcttagagagaacaggtggtgggctgctactgctcgagctgaaagctcacactacctctaccgtgtcaaactgccctgtcactcttcagtgtgggtcaggataagatatttgaagatgcagtagatggtgaaaggctaagctaacatcaagaaatgactggagacaaacctgtgtaagagagtaaaatagcagcagataatcattgataaggacaagaaagaaccaataagaaagtaatcattacactttttttgagatggagtcttgctctgttgcccaggctggagtgcagcggtacgaactcagctcacagcagcctccacctctcaggttcaagtgattctcctgcctcagcctcccaagtagcgggactataggtgcctgccaccacagctggctaattttttttttttttttttttggagacagagtctcactctgtcccccaggctggagtgcagcggcgcaatcttggctcactgcaagctctgcctcccgggttcatgccattctcctgcctcagcctcctgagtagctgggactactgtgtgggctaattttttgtatttttagtagagatggtttttcaccatgttggccagagtgctctcgaattcctgacctcaagtgatctgcccgcctcggcctcccaaagtgctgggattacaggtatgagctactgtgcccacctccctccctcccttcctcccttcctttcttcctttcttccttccttccttccctttctttctttctctctctctctcctttctttctttctctttttcttttctttctttttcttttctttctttctttctttctttctttctttctttctttctttctttccttccttccttttctcttctctttctttctttctttctttctttctttctttctttctttctttctttctttctctttctctttctttctttccttccttccttccttttcttttctcttctctttctttctttctctcctctttttttctttcttttttttttctctctctcttctttcttttcttttttttgagacagagtctcgctctgttgcccaggctggagtgcagtggcacgatcttggctcactgcaacctccgcctcccaagttcaagcaattctcctgcctcagcctcctgagtagctgggactacaggtgcgtgccaccatgcccagctaatttttgtatttttcgtggagacggggtttcaccaggttgaccaggatggcctcgatctcttgacctcatggctgcctgccttggcctcccaaagtgctaggattataggcgtgagccacggcacccagcagtttgttgttgttttttgttttgtttttaaaggtagttctgagcaatccattactatgagggaagggcatggtgttttcttaggaaggcttccctgtgaaatactagaattattactaattcttaattgactatcacaaagaaagattttggaagctgaactaaacatgctctcatccctgtacaagggatgctttgacatgcacttgctatgcttaaaaatggagacagtgagacagagaagcagagggagagacaaaggggcagagagagatagagggagaaagagagagggaaagacagagagagagaggtttgttaggtttaaagggacagtgacacctcctatttggtgtgttcacggaatactgcttctgctttatcattaacccttgtacttaagtttcacattacttttactctttttaaggcctggtcaaaaaaacagttcacctaccaatttttccaaactcattagcaatggttataaggatgagtggttgcagcagcagcagcgagctgactcagacaagaggaccccgaagacctccagggcatcagtgttatctcagtccccacgagacctggaaggtccccaggatgcagccaggctccaggatgcagaggcttctgaaggtcctgaggacaccccaggtgaggcacaagcagccatctgcatttattggaggcttggttaattgtgatgcagcagctgacgttcttatcacatgatgcgtctcgtaatgagaaatgagtaacccaaaaaccatgtgaaaacgcccacagaagtactaaggttacagataagcaagagagtaatacatgttttgctctttcctctttattcaaatgaatagcggaagtcatgacttttggggtttcacattttcttttatttgtcaaaaattttgatagtccatttgatataacaaacaaataatataccaaatagtatcaacttttaatcttccagatccaaacaatgttgaccctaaaaggacttttgcataagcagccggtactttttgagatcacttcttaaaaagctttgaaaataagtcaaaattcaaacttaaaattactccattattggcatgtcttaagctttgaataatttagaactttctccacaattagatgttcaaagtactatattagtttttatttattataatattttattttatttatttattttttgagacagagtcttactctgttgtcctggctggagtgaagtggcacaatcacagatcactgtagcctcaacctcctgggctcaagcgatcctcccatctaagtctcccaagtagctgggactatagacatgcaccattacacccagctatttttttatttttcataaagacaaggcctcactatattgccccggctggtctcaaactcctgggctcaaacaattcttttgcctctgccttgcaaagtactgagattacaggtgtgagtcactgtgcacagccattcatttttatttttaatagtacagaaagaattcatcttattttttcaacacatccatcttaaagcctattgacattgtgttcagtatccatagctctattaattattgaccatttgcttctgggaaacctgtttttactcttgaggcttgagctctttgattaagaggaaagatggcgtgttatacctcttcagacatttgaagtgtttggtgtggtgtggttatttgtaagtgaggtcaccgtttgccattctacaccctgttccttactgtatttgttgaacaagatctgccacttattggccaactctctcctttattatcctggaagatgagatggtgacaagttcatactcagtgttgttaaaaagcaccctattggctgagcatggtggctcacgcctgtaatcccagcacttcgggaggccgaggcaggcagattacctgaggtcaggagttcgagaccagcctgaccaacatggagaaaccccgtctctactaaaaatacaaaattatctgggagtggtggcacatgcctgtaatcccagctactcgggaggctgaggcaggagaatcacttgaacccaggaggcggaggttgcggtgagccgagatcgtgccactgcactccagcctgggcaacaagagggaaactctctcaaaaaaaaaaaaaaaaaaaaaggtttgttgccctattgaactttacaatgtcaagagtgttttatgacttattgttgttttaagtaatacagaattttcattaaatctttaagtaattatgacttcttttaatacttgatctgtttcattaacctgaacaacgaatgtactttttattacagagtcttctcaaagtgagtacttataaagtaaccagcaccaaaacacaaaaagtcttacacaaagaaattgatggacatagtcctgcattctgagactacagcctctaggcagcctggaatgtccttctccaaactgcatgcattctgactacaaagcttgtgccatgtatgctttaaaaaaatcagagttccagaaacttaacttagggagagcaaaaagaggatcgcttacacaattacaacaggatgaagatgatgatgatgatgatgatgattattattattattattattttttttgagatggagtctcgctctgtcgcccaggctggagtgcagtggcgcgatctccgctcactgcaagctccgcctcccgggttcacgccattctcccgcctcagcctcccgagtaactgggactacaggcgcccgccacaacgcccagctaattttttgtatttttagtagaggcggggtttcaccgtgttagccaggatggtctcgatctcctgacctcgtgatccacctgcctcggcctccgaaagtgctgagattacaggcgtgagctaccgcgcctggcctattattcttttattcatgttacacaagcaaaaacatactttagttcatggacacacattgtattactcgtcatgtgagagtcatactggaaaacataagtaaaaagccatcggagactccaatttattttttagtttactttttattttattttaaatcgacagataataattgtatacaactatggggtgcaatgcgatgttttgatatatgtatacattgtggcatcattaaatcaaggtaactaaaatatccattacctcaaatacttaccctttttttgtggtgatcacacttaaaatctgttcttttaatgattttgaaatatacaatatattattattaactttattcaccttgctgtgaaatagataattaaaacttaactcctcctgtctaagggaaacttggcaccctttgaccaacttctcctcttaccccatcaactactgccccatccccagcacctggtaacacattctattctacttctatgagttcaatttttttagattccatatatggctgcaattatacagtatctgtctttctgtacctggcttattttacttagactaatgtactccaggttcatccatgttgtcacaaatgacagaatttacttcttttttaaaggctgaatagtgttccatcatgtatataccacattttttttccttattcatctgttcatggccagtgaggttgattccatagcttggctattgtgaataatgctgcagaaaatttgggagcgcagatgtagctttgtgacatactgattccatttcctttgatatatgcccagcagtgggattgctatatcatacgagaattcgatttttagttttttaaggaaactccataatgttttccattatggctattctaatttacatttcaccttcagtatgtaagggatcccttttctccacattatcatcaacacttgcttttcatctttttgataatagccattttgacaggtgtgagatgatatctcattgtggttttcatttgcatttccctgatgatagtgattttgagcttttttgtatatacctgttggccatttgcatgtcttcttttgagaaatgtctatgtaagtcctttgcccatttttaaattggattatttgtttttttgctactgagttgagttccttatacattttggatattaaccccttatcagatgtatggtttccagatatttttcctgctctgtggcttgtcttttgttgtttgtttcttttgcttgcagaaactttttaatgtagtcccacttatttttccttttgttacttgggcttttggtgttctgtccaaaaaatcattgcccagaccaatgctggggaggtttttccctatattttttctataggtttagcatcccaaatctgaaaatctgaaatcaaaggaaatgctcattggaacatttcggattttggatttttggatttgggatgctcaaccagtaagtatgcaaatatttcaaaatttaaaaataattgaaatcccaaacacttctggtcccaaggatttcagataaaggatactcaacctatagcagttttacagtttctggtcttttgtttaagtcttcatctattttgagttgattttagtatattaaatgagatgaagatccaattttctttctctgcatgtggatattcagtttacccagcatcatttattgaagaaactgtcctttccctcattgtgtgttcttggcacctttgttgaaaattaattgactgttaatgtgtgggtttatttcttggttctatccactgatctatacttccatttttatgccagtaccatgctgttttgcttactctagctttgtaatatattttgaaatcagatgatgccatatatctgtttttttttttttctgtttgctcaagattggtttggctattcagagccttttgtggttccctacaaattctaggatttattttctatttctgtgaaaaatgtcattggaattttggtagggattgcattgaatctgtagattgttttgggtagtatggacattttgacaatattaattattctgatccatgtatgtaggctatgtttccatttatctgtgtcttcttcaatttatttcatccatgttttatagttttcagtgtacaggtctttcacctccttggctaaatttactcccaagtattttttaatgctgttgagagtgggattgtttccttactttctttttcagatcatttgttgttagtatatagaatgctaccaatttttgtctgctgattttgtagcctgcaactttactgaatttgtttaccagttttcacagttttttggtggagtctttagggctttctatatataagatcacattgtcatcaaacagaatatttcacttgtctctttataatctgaatgatttctatttatttttcatgcctaattgctctggctaagacttcaggtactaagtcaaatagaagtggtgatagtgagcacccttgtatttctcctgatcttagaaaaaaagctttcagctttcattggtgaatatcatattagctgtgggcttctcatgtatggtctttattgtgttgaggtacatttcctctatgcttaatttgttgagagttttttttatcataaaaggatgttgaactttgtcaagcacttttcctacatctattaaggtgatcatatggtttttgtccttcattctattatgtagtatatcacattctattaatgtagtatatcacatttaatgatatattatgtagtatattaacattctattaatgtagtatatcacatttaatgatttgcatatgttgaaccatccttgcttaccagggataaattccacatgatcatggtttatgatctttttaatgtgctgttgaatttggtttgctagtattttgctgtgaatttttgcatctatgtttatcagggaaattggcctgtaattttcttttcttatagtgtccttgtctgactttggtatcagggtaatgctggcctcataaaatgagtttggaagtgttccttccttttcaatttttttgggacagcttgagaagggttagtatgatttcttcctttacatgtttggtagaattcaccagtgaagccattatgtcctgggcttttctgtgatgggagagttgttttttttttaactgattcaatctccatactcattcttagacagttcaaattttctatttcttcatgattcagctttggtggattgtatgattctaggaatgtatccatttcctctagactatccaattcgttggtgtataatccttcacagttgtcctttgtggtcctttgtgttttgcagtatcagttgcaatgtctcctctttcttttcttatttttttcagtcttttcttttttcctctcttagtctagctaaatatttgtcaattttgtttataataaaaatactactctaacattttttatctcttctatcttttcttctgctaaccttgggcttagattattctttaggacctcaagttgaaaatacaaatacagcaggtacagaagatcaccttcataagatatgataagggttttattattctgcattgtcttaagaagatagaatttacttcaccattgacaaagtattacatattatctgatcaagggacgatcatttggcattcatataaatgtataaactttatattgcaggtgttatgtaatctttgtgtttatattatcagcaagatctgttcaattttgaagaaaccttttaacgtttcaaattaatgaaggcctaaataagcagcaaagcccctaagagctggaagaatcgtcatgtggagaagaggatctgctctgcttagtttctggatagctgaggcgggggtcactatgaaatgcctgctcccacctctcagtatctctgatgccaaggctagtgctagagcttttgacaaccacactctctccactgtcagtctgaccactattttccttcctgtatttcatttcctcttctgttttcctatttcccctgctgtccctcatggttttaactttataagcaataggcaatttagaaagtgccttttttccttccaactagacatctctccacttagagtgtgttgctataactttctggagactaatcttgtcaaggcttcttattttatttttttgagacagggtcttgctctgttgccgggcctggagtgtagcggtgccatcatggctcactacagccttgacctcctgggctcaagtgatccttctgcctcagcctcctgagcagctgggactacgggtgcatgccaccatgcctggctaatttttgtattttttgtagggacgaggtttcgccatgtggcccaggctggtcttgaactcctaagctgaagcaatccacccacttcagcctcccacagtgttgggtttataggcgtgagccaccacacccagcctaaggcttcttcttaatgtttctttccctccatgagacacaagattattattatttctttattgcaatttttttcagctgtcctagatgttttgacgtgccctaaagctgggcattaggaaactggtacactactgtactttgagagggtcaacattaatgaagattgcaacaggcttgggagcagggacacgtgccatgccgaggctgacagacagcctgagttgcccctcttctctactcgccttgcccaggctgtgctcatactatttatttaataattcttatcggtgtgcttatgtcagcagaaactttccaccatacacaggcaaaactcatgaattgaactgtttccaatggggcattctcttctggtctaccagtgcaaaagttgtaatcttgtgtttccaatgtattatttatgccaggatcataagctcaatttttatgtagacttcagaaataatccttattaataggtacaaaactatgtgttttcttatatttaaaattaatgttttttaatttatagaaaatgtcatctttgtctactcatttatttactttgtgttgcaggcccagaagaatctgtatctgcatcaacaccagcagagctcaaataaatcctgatgcaatatgtatttaggataatttttaaatggctaaatatgacatgactgtattatagctatatttctgaggctttttttgtattttattaatatagactctcattgaataatttaccttgcagcagatttgacattgctgcatagaaggggcaggtgttggtttttgtttcttgcatttctctgggatgtgaaacacttggctaacaaacacaactaaggcctctggtaccctctgccctgctggcctggtgatgtcccagtgtctcagaactgatcacttgctcctcctattgtgtgaaccactcttagcaggcattgctactggattcttaactagagaaaacttacagaacaggtgttaagccttttccaatatttagtattgtagtcttcatagaaatcatttctagttacagaaaaatttaactccagaatatggtgatacagtttatgttaagaaacatattttaatttattatgccatgaatttataaacatttaatataaaacattataacatttgctgttttaaaatttttgctattttttcacaaactgatattcaaaatattaaacatttgttattttgtataaacctttaagtaaaaatatgctgttttaatatttaatttagtagaattaacaaaaactttttaatagtcaaactgaattaccttgttttataaatgttaaattgtttatatttaagtaattagcttaaaaatatagttttatgttttgtacattaattgattaataaaataataattttatgtgagaatgttttcaaaaagccaaataaagtcacagatattttagcttctttcccagaataaacttatcatgcatttgcttacctaaaatttaagtttcaaattagttctctatatgagatacttaatcgagcatatatatttatattcattgatcaaactgatatgctacaggagaatgtatgcaatgtgtaaaaaatgcaaatggctgtatgcattgaataaaaataatatacaattaga

SEQ ID NO: 2155 - DNA, 25788 bp, Homo sapiens; identical to SEQ ID NO: 2154

SEQ ID NO: 2156 - DNA, 25788 bp, Homo sapiens; identical to SEQ ID NO: 2154

SEQ ID NO: 2157 - DNA, 41972 bp, Homo sapiens
tttaatttacttccatatttttttattagtaaaatgcatttactttttacaggcaagtatgaaccactttgaggttttcttcccactcccaattctcaattcctatgggtgcggtatcatctaagagaataagcattcttgaatattctggacatgtggcatggccttctgtaccaactcttctagatgtgcttgcctggtgtgccatggaccctgaatcgatataaacaagtatacttcgggtgtccccagttgctaaagatattaagtttcacacataataaatattcagaaactgcatgctgaaaataaagaaaagaaaatcaatgccttataacgaaattcatctcaaagaatcccaatgaatactgatataattttaaattatatactttttttttttcgagataggatctggctctgtcacacaggctggaatgcagtggcatgatcatggctcattgccacctctacctcctgggctcaagtcatcctcccagctcagacccccgagtagctggaactacaggcacacgccaccgcacctagctaatttattaattttttgtagagacagggttttgccatgttgcccaggctggtcttgaactccagggctcaaatgatttacctgcctaggcctccaaaagtgatgggattacaggtgtaagccaccacgcctggcctatatactttttcttttctaacataactattttcaaatatcagtctaatgaatgagaaaataagctactggaataaagagcttatgaaaagataagtagagggagaggaggataatatggcggccaagtgacctctctattccgctgtttcccccctctacactccttgctggctgtgccgaggagcaggggcaagagggcttgttgtctaaaaaccagaactatgaagccaactataagaacagataatatgagcccaaatgcatatgaatacataatcaaatatgaagctctacaaatatgctcatttctaacatatatgtattgttttacctttattttctcactatttggccaaaaagtgtcataaaacacttgtttttacatgatataaaatgtcttctacatctcttcagttactccctgtggctaatttaaaaaatgaggatatatttcatttgccttggtgagtttcaggggatttataagctaacagttgatattttctcccactgggttaggagttttacttgtattatctgatattaaatctttatcctctattcctttgagcttctctctgcctctgtccacttcatattgtaccatcatcttcctcccctatactcaagcaaggtgaggtagtaactattacacttaatagtattcagggaatggaatagttaagaaagaaccaagaaattaaatatatatattataaaaaagtgatagcagatgaggaagaatttgacttagaaactgcttttgcatttgtctgtcttttgcattaaaatcctcgtaagcacttcgagctcagaattgaagatcagataagccttgtgtaactcacgcttttgtcataattattctcatacgtcactttacatgaagcaatcccaacaaatttctcccagtgatagagctactcatatcatttcccagagcatacattacctggagttcaaatgtttgaacggtggttcctgttttgttatatataaactgacctaggaaaatttcttctccttcacatttttttgtgatgccctataaagaaagcaacagatatagagattgtaatgaatggatgcagttgtgttttcaaaaagaaccaacaattcaccaaatatctctgtgtgtccaccaggggcacagtgctgtgatcatgccagtactaacctatacacccagaggatatttaacaaggggtcaatgaggcccaaggctgatcacgggactgactaaaaggatagaagatggatggacacacagacagatagatagatagatagagagctagatagatagatccatagatagatagttagaagatagatgattgacaaacagctgatagatggaagacagatacatacatatagagcaaatcccaacattaactttgacctgataactatatttgcaataagcatactttgaataaaataaaaatgcgtcgccatactgaactgatgtttaccaaaatgagataaacataagcccattgccagattttgatcacacaaataatttcctctgaaaagtaagctcccgttgactgacaaaaacactgatttttttctttgtatgcaatttctcttgtgctttttgttcttctctacccttcaaattgaagatttgtgagaggataacgcactggtgcaaactaatttattttgtgaatctgaagtttattgttaggttccttaaattgtaacacagcaaaataaacagtacattcattaaatcattttataataaaaatattaatatcaaactataacatttttattaaaagagttggatacatcatggttacataatgtactcacaattatatatgtatgtggggaaaagagagatcagactgttactgtctctacgtagaaagaagtaggcataagagactccattttgttctgtactaagaaaaattcttctaccttgagatgctgttaatttgtaaccctaccccaaccctgtgctggctgaaacatgtgctgtgtcaactcaaggttaaatggattaagggctgtgcaggatgtgctttgtcaaacaaatgcttgaaggcagcatgcttgttaagtcatcaccactccctactctcaagtacccagggacacaaaacactgcggaaggccgcagggacctctgtctaggaaagccaggtattgtccaaggtttctccccatgtgatagtctgaaatatggcctcacgggaagggaaagacctgaccatcccccagcccgacacccgtaaagggtctgtgctgaggaggatcagtaaaagaggaaggcctctttgcagctgagatcagaggaaggcatctgtctcctgctcgtccctgggcaatggaatgtctcggtgtaaaacccgattgaatatcccatctcctgagataggagaaaaccgccttagggctggaggtaagacatgctggcagcaatattgctctttaaggcattgagatgtttatgtatatgcacatcaaaagcacagcacttttttctttaccttatgatgcagagacatttgttcacatgttttcctgctgaccctctctccactattaccctattgtcctgccacatcccccctctccgagaaacaccccataatgatcaataaatactaagggaactcagagactggtgccggcgcgggtcctccgtatgctgagcgctggtcccctgggcccactcttctttctctatactttgtctctttgtctctttcttttctcaagtctctcgttccacctgacgagaaacgcccacaggtggggaggggcaggccaccccttcatatgtacacatgactcaagcctcatatattctctttagcttaagacaggagtgctagttttatttctacctcctttatcaccttgttgggtttttttaagaaacaggatctgatggaatactatgcagccataaaaaagaacaagatcgtgtcctttgcagggacatggatggagctggaggccgttatccacagcaaactaacacaggaacagaaaaacaaatactctatgttctcacttgtaagtgggagctaaataatgagaacacatgaacacaaagcggagcaacagacactgagatctacttgagggtggggggtgggaggagggagaggagcagagaaatacctgttgggtattactacttaccgcctgtataacaaacctgcacatatacctctgaacctaaaataaaagttaaaataaaaaacaaataaacaacaaaacaaaacaaaccaaaaaaacggggtctggccatgctgcccaggctggcctcgaattcctgggctccagtgatcctcctgctttagccttttaaggagctgggatcacaggagcagatactgcgcccagtccttttatcaccttgttttaattttacttggttcataaattctttaatgtagaagaaaatgatgagaagcagtttttattactaaaggattcctgcctttgggattcacccataatttgtctaaataatgaacgtgttcacctttctgagatggaacttagctgctcaaactcaacttttcagagacaccacttgcaggtggtgtgggcttctatgaaaggacagcagccctttgttttgaaactccagatatggaatgtagaggcatttgggtgacatataaggcaggctgtttaacccagggccctcctccagatgggaagatcataattgaaggcataaacctatataaggcaaaagtgggagtagacagtaaaaccaaaaaacaaaacaaaacaaaacaaaacaaaccccaaaacaaacaaacagaaaaaccaaaaagtgaagatggccaaatggcgcctggagagaaagaacacaaactactcgggctgtacgtggacccagcagcgcaggacttaagcggcaggttcccaggaaggccggaggagggtgtccatgtggggagcgtgtgggtgaaagcgtgagggggagtgtgggggaaaggagcccaaatctgcggcttagctaacagtcatttcaaaaagcagttacaacgcctccacgcccctccagccccgcctggcccagcagagggctctcttcttcctcccatctctaagaccactgccggcgccgccccagaaccgcccacaagagcatggcctctgcacaaagtggtgaccccgcggccctcctctccccagcagctcatggtgtggtgggccaggctggcacctcctgtgcactgcaggagtcctctcagggtcagctctcctgatagcacacttgtgactcccgacgaaatggcccgaccagatgattcccgctgcaaactcacgacggatgagccccaccgtgcgcgcaaagcttcctgccggctttgcaccgcctagcaattcatgtgacaagcatcacagacatgggagaaaagtgttgtacaggaaacagagagacgctacccgcaagggggaaaagtggggctaggaaatccagacccggaagcgagcagaagaaaatgagacaagcctacagttaatatattcagaagcataagagaaggtactgccttcataaaagaaaaaaatataggctctaaaaaagggaatatgtatagaaacaagaagtctcagaaagtataatcatgacagcaggaatgaaaatttccgtagaggggttaaaatgtgaattgatatgatcttccagaaggtggaacaaaaagcagaaaagggaaagaagaaacactttttaaaaataataaattagacagtaagttgaatcctcaggatgcatgagtgaaatcccacgacaacagttgtgcatcaggcctacctaacaaggctggagcaaaatgctgagggcgccagagggatatcttgggaaaaaaaaaagaaaataaatgaaaagaaagtgaaggaaggaataaagaaaggaagaaatttataagttatctgatgtgaatcaacataatgggggaatatttgtacttctgaagaagaatttgggaaagttttagtaataggaatgcagaaaactaagcaaattaaagaaaaataggctgggcaccagtggctcacgtctgtaatcccagcactgtgggaggccaaggcgggaggatcctgagccctggagtttgagaccagcctgggcaacataataagacccttatctctactaaaaaatttaaaaaacaatcccacgagtttgaagttgcagtgagctgtgattgttctccaacctgggcaacagagctgagaccctgtctcaagaaaaaaaaaatgtaaagcaattattacactcagaaacatttaaaaaaatggaagaaagtagtatttaagtacactaaatagctcaactgagagctgttttgttcacatagtcactgtgaaaacattgagtattgcttgaacaaaaagataatacagtcttctagcagtgcctcaaatgttaaacctacatttaccatgctatctaggaattccagtcttaggtatacacccaaggaaaacaaaaactcatgtccacacaaaaacttgtacatgaatgtttgttgaagcattatacataatgaccaaaaaaatgaaaataattcaaatgtccatcaactgatgaatagataaataaaatgtcatatatccatacaatgaaatgttattcagcaataaaaaataaatgaaatattgagacatactacatcataaatgaaccttgaaaacagtatgcaaagttaaagaagccattcacaaaagatcacacattataaatgattcaatttatatgaaatgtatagaataggtaaatttattgagacaaagtagaccagtggttgccaggggctggaggagtacactaggggaataggaggtgacggctaaggggtatggggtttctttttagggtaagaaaaatgttctaaaattgattatggtgatggatacacaactctgtgaatacactaaaagccactgaagggtgtactttaaatgggtgaattaattgttatgggaattacatctccagaaacctgttttgttttttaaattaagacataaatattttgggaagatggaagtgccatggaaaagagttaatcttcattttcaatgagaggatgtcataatcaaaactgaaaaatcaggaaataatggcaaaagccaacatggaggcaagtacccaaataaacatctaaaattgttgcaagtagaagctttgggataatgagaattggagatgtggagaagtgggacaaggaattactgtttctttacaaactttatggaaatatttgatttttacttatacatgtataactttgataaaagtaaaaataataatataaatcatttggtccaactctctctctttgtaggtgagaaagcagaagtccaggaaataagtgacacaactagttatctgtcctagttcagaggacagcccctaattcctagccaaccaccttctatcaggccaatctgaatgacaaatttagatagcttcttacatagacagaaaattccttgggtgcactggagatgtttcctgacggagacaccttctctgagatgtgctccatggtaacagcagttggtatgatctttgtagcaagcttgattagggtatgaccctgggaacctggaaaagcccagcactttccagggtagacatccggctggaaagaaaacactgaattaatctcttaactagttatgtgaatccattcccacaatactggtcagctaatcactattgactgcagatctctcttatgcctatcaaataggaaaactcccaaggcacctctagtgtggttgttcttccagagcactgtatgcttatatcaatcagagccctttatcatatgagcatgttttctttcattgctctaactagactgtaagctgttataaggcagctagagggcatgagtggtggtgctggtaaggctagtgatggtggtagtgaggatgatgatggtgaccattgtgatcattgtggtgatgatggtggtaataatggtggcagtggaggtgacagtgatggtggtggtggtagtggtgatggtgattgcaatggtggtcatggcaatggtatcacctaaaaaggtggtggtagaggtaatggtgatggtagtaatggtagtggtggttgtagtgatggtgataattgaagtggtagtggtgatggtgattgcaatagtggtcatggcaatggtatcacctaaaaaggtggtggtagaggtaatggtgatggtagtaatggtagtggtggtgatagtgatggtgataattgaagtggtagtggtgatggtggtgatgaaggtagtggtggtggtggcagtgatggtggtggtggtggtgacagtgatagtggtggtggtgatgatgatggacatgggggtggtgatgaagaaagatggtgaggtggtggtggtggtggcagtgatggtggctgtggtggcagtgatggtggtggcggtgatggtgatggacatggaggttgtgatgaagaaagatggtgctggtggtggtgatgaagatgagggttttgatggagatgggggtggtggtggtggttatggtggtagagaagaaaaatgaggtctactactttgtagatataaactacagcctggaataagatcagtgggttttacccctgaaagttctaaatttgcaactaacttcaggtgtatggatcaaagttgagaggtgctctgctgtctattgatggctactgcctttagactgtaactgaaaagtttggtggggatcttacttggagatttctcctgttataattagacttaagaacatgtggtctgaatagcacttaacatagtacagtactggcacttaggagacaagtactttcaacaaatgtttgttgaatgactgaagttttcaatggaaaaggatggtcacagaatcaacttacagaaaagacatggaatgtatatgttttacttgaaaataaaataatctagtttactaatcttaaaatgataaataagtaaataattaatcatagtttactgaccataaaataagacataattcatgcagtgtactgactataaaaatataatgagatgatttcagattctgtgacaagttcagacactcttatattgcctccatttttaaaattaacattttcatgataaataataagaacaaaattctaaaatagaaataagtgattcttaatttagctttacctgaagaataatatctggaggcatttcatgatttaggaaacctatcccatgccagtacaattttgctttattatttttataactttctgaggtcccagcttcaatgatggaggctcctaaaattataaagtaagttgtaaaataaagaaacaacatacacaattcaaaacacatcatttgaattttaacaatgtctctagaaaattattactgggcaaattataagcgaggtaaaattcatactcaggaattgataggaaaagtatgacagttttcactaccactgaaattttgtcattttgaagaaaactagtttgttctgtttagtttcacaaaatgtatgattaaaaaaattgaattttgaggcaagtaaattagagatgagaatattatatggattctgtatcacctaaaaacgtatatagatctttatattttaacagctcatgtgataaatgagacttcctgtcattcccattcactcaataacaaaaaaagcagaaaaccaacaatgctccaaatgtccttcaagttacatttgtagcaattatgcagattcattgaactctattttaatcaaagaaatatgaaatatactcatcaaacattatcccttcaggttacttcattttagaagcaaaatgtattttatacagaataaataaagaaaatgcaaattgcttttacaaattgcatttgcataacacaccacaacactaaaaatacatgtgcctcatcaaatatctgattatccttactttttctttccttcttttttttttttttttttgagacggtgtctcactctgtcgccaggctggagtgcagtggtggaatcttggctcactgcaacctccgctgcctgggttcaagtgattctcctgcctcagcctcccaagtagctgggactacaggcgcccgccaccacgccggctaagtttttgtatttttagtagagacagggtttcaccatgttggccaggatggtctcgatctcttgacctagtgatgtacccacctcggcctcccaaagtgctgggattacaggcgtgagccaccgcgcccagctgattatctatacttttcctaagatgacacactttttgaaatagtaattgagttcctagagttgccagatttggcaaataaaaataaaagacagccatttaaatttgaatttcaggtaaacaaagaataatttttttagtagtagtcatgtcccatacaatatttgggatatatttatactaaaagattatttgctatttgtctgaaatttaaatttaactgggctcccttcattttatctggaaaccctatgtgtacttcgtttttgaaggctaattctgactgcccgctcactattcctactcgaccaactggctggacagaatctacactttcacctgctaatgtggggactgaataccccatccccataatcctttccagaaaaaaattaaaattttagtgtggtggaattttgaaaataattcatatttattcattttctcattcattaaaagatttaaatcagctttattaagatataattcacatcctatacaattcactcatttacagtgtatgattcagggttttgtattatattcttagagttgcacggccaccacaatcaattttagaacatttagtcaaccccaaaaggaacccatagtggttagctgtcattccccatttccctcaacctctctccccaagccttggcaattattaatctattttctgtccctgtagattacctattctggacatttcttttgctgctcccttgtagtcagtcacagtatgtagccttttcactaaggctactttcatttagccaatgcatttgagatttatgaatgttggaatgagtatcagaagttccttccttttattgactgcaggttgatattccactgtatgaatgcatccgttagtctttgttgatggacatggggttattctcaattttggtgatgatgaatacagttgctatagacattcttggcaagttttgatgtgaacatgtttcaatttatcttagataaatgtatagaagtgggattgctaggtcaataaggtgttatattgaacttcataagaaattgtcaaactttgccagagtggctgtgccatgttacattctcacccacagtgtatgagaggtccattttgttcatgcggttgccagcacttagtatggtcggttttgttttgtttggcattctaatcggtgtgtaatgatataacattgaggttttgacatttcactaatgaataattaatgtaaggcattttttcatatacttttttgacatgcatttatcttctttaatgaagtgtcttccaaaccttttgcctattttttatctggttgtctgtttgcttaattgaagcttgacagttttttataaattctggattcaagaatgtgtgtggtttccaaatattctcccctagcctgtaacttgtcttttcattctcgtaactgtttttttggcagagtagaaattaattttgttgaagcccatattatccattattttccttttacaatcatagtttttgatgttgtgtttaagaaaactttttctaactctaaaaaatttcgcttatttttttttctagctttaagctttatatttaagactgtgacccatttggggttaatttttatagattgtgggttttgggccaaggcttttttttatttttgcatatgaatgtccacctgttccagcaccactgacttgccttttttcctttttcaaaaatctattcaccacaggtgtgaactacttctagactttttgtattgttccattgatttcacgagtaccacatgctcttgattactgtaaacttatagtaagccttaaaattaggtagtgtgagttctccaactttgtctctttttttcccaaaacaaatttgactcttctagttccttcaccattccacatacattttgaaaatggttgtcaatttctacaaataatcctgctgggattttaattaggattatattaaatccatagaaaagttggacagtattgtcatcttaatggtattgagtcttctaatccataaacatggtatacttgtccatttatttaaatcttttttatttatttcattattgttttttagtttttagctctcagttcccacattttgttagtcttacacctaagtattttatgttttttactgcatttatgaatagagctgcttttaaatagtctctaattttctattattagtatatagaaattgtatatatacccttgaacttgtaaacctcacttactctggtagatttttttggtggtttttctacataagcaatcatgttgtctctgaatagagccatttttttcctttctaatttgcatgccttttcccctatcctctgcctttcgtactctctttctctcccagtttttcttcatttccctttcctgcctttttttaaatattagttgaaattttttatttattttttatttcttttgaaactgagtcttgctctggggcccaggctggagtgcaatgacgcaatctcagctcactgcaatttccgcctcgccttgcaggttcaagcgattctcctgcctcagcctcctgagtagcaggattacaggcgtgcgccaccgcgcctggctgttttgtatttttagtacagccggggtttcaccaggttggccaggctggtctcgaactcctgacctcaattgatccgcctgccttggcctcccaaagtgccaggattataggcgtgagccactgtgcctggcctccattttgatttctccattagcttttggatatctctgtatttttaagtaattgttctcatgattacaacgcacgtacctagcagctcatagtttatttgagttaactttttatcattcatataaaatctttacatttatagatgtccattaaatctcacccactgacttttcctttatggttgtcatagaattaaatctacatatattagccctccacgcccagacaatgccatacattttttcctttcaacagccatacatattttaaagtacttaaagaaagaaaattacctcatcttttgttgttgttgttgttttgagatggagtttcgctctcgtcacccaggctggagagcagtggcgtgatctccgctcactgcaacctccgcatcctgggttgaagctattctcctgcctcagcctccggagtagctggaattacaggcatgcgccaccacgccccgctaatgtttctatttttagtagagacaggatttcaccatgttggccaggctagtctggaactcctgacctcaggtgatccacccgcctcggcctcccaaagtgctggaattacaaggcatgagccactgtgccgggccacctcatctttactcacagatgaggctgttgctctttcttcattctttaagtcccgagtttctttttggtgtcatttctattgagctgaagaacttcctttagcagattcagtggcagataattttcttagtttttctccatctaaatgtcttcattttgccttcattcctgaaagatattttcactggatctacaattctgcattgctagatcctttccttcagcactttaaacatgtcgtttccttctcttctggtctctttaacttctggtaagaaatctgtaataatgtgtagtttttttttagcttctttcaagtattttcatctttgattttgagcaatttaactatgatgtgtctggatgtcattttccttgaatttatcttctttctgatttgccatgctttttgagtctgtaaatttatggttttttttttttaaatcgagtttgagatgtttttagctattacgtctttagatacattggtctcttcttcatctccctctgagactacaaggataagaatattatacctttttatagtgtcctataggtttctgaagttctgtttgcatttttttcaaacattttttcattctttgaattgcataatttcttttgatctatcttcaacttcactacttctttatttttaatttttaagttcggggtacatgtgcaggtttgttacacagaaaaacttgtgtcatggggatttgttgtacagattattttgtcacccaggtgttaagcctagtatccattagttatttttcctgatcctctcccttctctcaccctccatcctccaataggccccagtgtgtgttgttcccctctatgtgtttatgtgttctcatcatttagctcccacttataagtgagaacatgtgtttttggttttctattcctgtgttagtttgctaaggataatggcctccagctccatccatgtccctgcaaaggacatgatcttgttcttttttgtggctgcatagtattccatagtgtatatgtatgacattttctttatccagtctatcattgatcagcatttaggttggttccatgtcttttctgttttttttgttttttttttttttttttttgagacagagtctcgctctgttgcccaggctggagtgcagtgatgcaatcttggctcactgcaagctccgcctcccaggttcacaccattctcctgcctcagcctcctgagtagctgggactacaggtgcccgccaccacgcccagctaatttttctttgtatttttagtagagacagggtttcaccgcgttagccaggatggtctcgatctcctgaccttgtgatctgcccgcctcggcctcccaaagtgctgggattacaggcgtgagccaccgtgcctggccagttccatgtcttttctattgtgaatagtgctgcagtgaacacatgcatgcatatatctttataacacaacaatttacattcctctggatatcccagtaatgggtttgctggttcaaatggtatttttgtctttaggtctttgaggaatcactgtctttcacagtggttgaaataatttacactgccaccaacagtgtataaccattcctttttctccacaaccttgcctgtatctgttagtttttgactttttgataatagccattctgaatggtgtgagatggtatctcattgtggttttgatttgcatttctcttttttttttttttttttttttttttgagacggagtctcgctctgtcgcccaggctggagtgcagtggcgcgatctcggctcactgcaagctccgcctcccgggttcacgctattctcctgcctcagcctcccgagtagctgggaccacaggcgcccgcaccacgcccggctaattttttgtatttttagtagagatggggtttcaccgttttagccaggatggtctcgatctcctgacctcgtgatccacccgcctcggcctcccaaagtgctgggattacaggcgtgagccaccgcgcccggccttgatttgcatttctctaatgatcagtgacgtcgagatttttttcaaatgattcttggccacatgtgggtcttctttttaagtgtctgttcatgtcctttgcccactttttaatggggttgttttgttttcttgtaaatttgtgtaagttccttataaatgctggatattagaccattgttggttgcagagtttgcaaaaattcccttccattctgtaggttgtctgtttactccattgatagtttctttttctgtgcagcagctctttagtttaattagatcccgtttgccaattcttacttttgttgcaattgcttttgatgtctttgtcgtgatatctttgcccatgcctatgtcctgaatggtacatacaactttcaggctgagactatggggttttctaaatataggattatgttgtctgcaaacagggatagtttgacttcctctcttcctatttggatgcgctttatttctttcttttgcctaattgccctggccagaacttctaatactgtgttgaataggagtgacttcataggcaatacctaggttgtcttccagggttttctttttttttttgtagttttggcttttacatttaagtctatattccatttcaagttaatttttgtatatggtatatggaaggggtccaatttcagtcttctgcatatggctagccagttattccagcaccatttattgaataggaatactttctgcaatgtttgtttttgttagattggtagaagattagatagttgtaagtgtgtggccttatttctgggttctctattctgttccattggtctatgtgcctgtttttgtaccagtaccatgctgttttggttactgtagccctgtagtatagtttgaagttgggtaacatgatgcctccagctttgttctttttgcttaggattgcccttgctatttttggtttcatatgaattttaaaatagttttatctagttctgtgaagaaggtcaatggtagtttaataagaatagcattggatctataaattactttaggcagtatgggcattttagtgatattgattctttctatccatgagcatgagatgtttttccatttgtttatgtcatctctgatttctttaagcaatggtttatagttctttttgtagagatctttcacctccaaaattagctgtattcgtaggtattttattctttttgtggcaattgtgaatgggagttcgttactgatttggctcttggcttgacttttgttggtgtatagaatgctagtgatttttgcacattgattttgcatcctgagactttgctgaagttgtttatcagcttaagaagctttcgggctgagactatggggttttctagatataggattatgttgtctgcaaacagggatagtttgacttcctctcttcctatttggatgccctttatttatttctcttgcctgattgccctggagaggacttctaatactgtgttgaatatgagtgacttcactcctttttttctctgtttttgtttttctatcattaagcatatatagtcaatatttattttagatatcgtatttttcagttctaaaattccatctggttctttttattctcttggctgagaactggtatcttttcattcatttcaagtgtacttactttcacctcataaagcataattatgctagctgcttcaagtctttgtgtgacaattccaacatctgtgtcatgacggggttggcatctgttgtcttttcccttgggagttggtcttatttccgtaggagtttgcatgccaagtaattgtgatttgtaccctagacatactgaatattatactgtaagactctgagccctattactgtccactagggaatgcttttatttgcttcatcaatcaaccaagaaatgtcagtcctccttccttttatgagtggtggttccaatctcaattcagtcctcaaaacctttactacaggcctgtcatgtccatgtaccactcaggggttagtccaagacttgagccacagtttacatcattgccaaattctcaaagcctccactttgctgttttgggtctgttcccatgaatgggcagctgagaggtgaggccagaagctggccgcaaacagacaggggagcaggcgtcttctctgcagctttgccttccaggctttctgcccacactctctggcccacaggactactttattctgcgattttggctagaaaaattgggcttctttcacagatttagctgcctaccttgctgccacgtttgcagctctgtaattgctgcctgcctcagcctaggctgcaagagaaaagaaaagaaaaaaggaaactcccacaaggctcacatctgcagtttttggttcccctctaccaactgcctgctttgtttactttttagcccactcacgtagttgctttttgaattttgtccggattttttctcattgtaatcagttggaagagacttaacaggctttctctatcttggccaaaccagagctgacatttgtttccacatctatggctacagagaagcccgagcatttccttcttttcctcactctgcatgtgctactcttgcacctacattcgtcatcataggcttttcaaaatggaagttgtaaatacatcaattgatataaatgcatcaatacaaaaaagaaagcattaaaaaagtgtatcagaatgccaagaccaaaacaaacaaacaaccaaaaaatcccaactatggttcgtctcccatcttgtccccaacactcatgctttagggaatcaggtttgggaaagttctgccctctaactcactctctgaaaaacacatgctcacaagactgagtaatcatgctgttccaaatgctctccagttcatgcaagctggaaatttatttccctggcgtaaatttgactatcaattgattaaaattagcattactatgtgttttatatttccattctccttctgtccctttcttctttcctcccacattgttcactgaacacatattgtccatagactattataggcagggcatggtagataagattaaggttaatgattcatagccttaacccttaataattaattttaattggaagatattaggaacattatatataacctttaaacactgtcatttaatccctaataatgcatttagattggtgatcataagtaattttagtatataataatacaaaatgtcctaatattttgtgccttccacaacttcactgtggcatcttggctttcttggtggttcttttagatgcatgttaatgaagttgcacaggcttttttccctggaacatttgcactcagcaatcagtagtgacaactatttctactctcttctttattatctaaattgattaatttcccccccccaagttaccagataaatatgttttcctcataaacaaatgtagagaatagggacattcctgaagcattcttttttttttaatgttcctcttttcactttttctgtactcaccggccgacttcagggcataatcagccatctcgacttggtcttctctcaactttttaagtacataattgaccaagtttgacacttcctgtagaaattttataaacagttttctgttaacaatctttgccaactgcttgagttttgaccattcattttattgatttggacctaatttgcaaaattagaatagcagtgagcccctatcagctgcactctgagccaggccctgttcatggatctggactgacaccttcacagctcttgggagtgtcattttcaggaatacggtgtaaataaagccaaggtgtgttcagggactcccacaaggtcacacagcaccgtggacctagggtctcttctgaagccctaaccactggcatcacagtgctctcccggtgaggtgctgtgacctactgtgttctgtccctcattagtgtcctgtggttagcagtaaagacttgaacattctagagttatttgggaatcaaggcagtttacacagactacatgattgcttatattagacatttttcacccagtctaattaatattggattctgaaggctgctctcattctaaaaaacgaacaaacaaacaaaaccaaaagcaccctaagcaggcgtaacagttcaagttcaagctgcctaaacgtaacaccttcacagtgacaaggatgaaatggggtctggagggcggcaggtggtccatgtcagattgctgcgcatttcaaaaagtagacattagggaagaaaaagaaggtagtaatgacagcggaagagaaagaagcaaaatagagcttgtggtttccaacacagttttgcctgaatctgatgctgtctagactaactacattagctatgaagatgatgaatgcaaatcttttgctatttaaggtatttgtgtatagagctcagagactgttatttctttctttctttctttcttttactggaaaatagaacagttatttattttggtgtgaagtaagtcatatgcaatagaatgtcttctctgtgacacagcatttatgaaacactgggtttctgtacacaaaccaaatatcagtcaacactggacttcccactgggagaagaagcagatgtgacatcggaaggacatactcactccccgtcaccctggacatccgcgctaaccaccaccccaccctgcccaacccgcctagcctcatccaggacctctgtgtggtccgggtcctccacagggtctccatgggtgttccagttgtgattattgtccataccatccttcatatctcttagcaatgccttcaggacatctatttgttcgatcaaaaatagaatttgacgaaaattgttttccagattctggctttccttcctgtaaagggaaaatctcagcatgagaggaagaaagtgtaaagctcctgttatcagctgttgctgggctccacccgccatgtgatgaggtgctttatattgttgaagatatacattcttgagtgagggaagagcagagcatgcccatttctctaaagcatcacgcttcactaaaaaaaaaacaaggacatccaggggtcacatggctgagggtgtcctactgcttgaccgggctctgcatggggcaggcaaggctcaatcaatcttgctggtcccccagctgggtaacgtcacacaggtgaatcctaaatcccactgttacctttccaattgggaacaccttgcatttccggtgtagtacagagcagtggctttcgaattgtagcctgagttcagtggaagtgccttgggcaaggggtgctggtggatccagccagtgggcagtgactggttaccagtttgacagcctgagcatgcaagattttacttcccaagaatgttttttttttttttttgagatggagtctcactctgtcccccaggctggagtgcagtggcgtgatctcggctcactgcaacctccgcctcccgggttcaagtgattctcttgcctcagcctccccagcagctaggataacaggcacatgccaccgcgctcggctaatttttgtatttttagtagagacaaggtttcaccatgttgaccagactggtctcaaactcctgacctcaagtgatccacccgcctcggccacccaaagtgctgggattacaggcgtgagccaccacgcccggccaagaatgggttttctatgtttacagtttgaaaattactagtagagagaaaaagaaaatgtcaagcgaataggtatttctttatgctgaaaaagtataagcactacttatctggtatttttccccatttgtaaatcaatacatgtttgaattcgggaaaaaaccaagcatttagaagaaataaacactgttaaattttaatgactttctaccagtttttattccatgcaaaaaattggtaagaaaatagaaataatatttataattttgtgtctccactacacttccaaatcattaaaaactattttaaaattatttaaatggctttataattcttcatttcatgaatatattccaatgtatttaaccattggcctaattttcttatagggttattttccatttttagttatcataaatgacatggaaagcacacctcagtgtgtattttgtcaaggaatgctccatagaagtagaaatatgtaaaaggacaagtaattttctaaagtactacaaatgttactgtttggtgtttaaaattttaaattatgtatatgcacaagtgagaggaggcaatttttattttgttgtttccttcttttgataaatccaagtaacaataaatgtactatttttaatactaaatacagcatgggtagattaagtcacctctaaccctttaatcttttctatctcctttttttctttttcttcctcctttctttccatctgcatatatacatagagaaatgctaggaatgatatcattaaatattaataatagttatttctgggagtgaaattttgagttatttcagggagtaacttttctttcttatacttttctgtacgaaaacatttcagtatttgaaaccacaccaaaaagaggcatatagcaaaagatcgcactcactttaaaagttccagttgctctttaggcatacgaagtctggcctgaaaacaacagaaaaagataaatcattctgaattctgcttattcaaatagagtcttttttttttctcagaaaagggaaataaatagcacattgactcctgatatacagatgtgctggctggaactcaggagcgtcctctgagaggcccgcctctttcctagcctcacctgtacatcatgaatgtatttgaaggagatgaggtaatgcaaatctatttaatgagtgacattcaacaggagctcttggatgggcacatcatttcctatttcttaagactgtaaaggcctgaacacagtctgagagggaggttggaagaggaaaaaatagagggaagaggaagagagggaagggaagacaagcgggagaggcgcccctggtggatgtggaaaaacctaaggagcacatggcgacgttagaggaccatgctgagctctttgggcttgtccctgaataaggagggggactcccacttacaaataagaaagggatgtgattacttttgggctagattggcaatcacaatcagaaaattgcagaaatttatctaacactggtgtcatgtctggtatagatagtctctggtatggacggtcttggtggtgcccaaaccaagacaagaaaccaggaaaaggtaaagttactgtttggacacaacatgtggcttcagaggactttctgctatggaggtggtcagtgaaaacataaacactgggaagatagagcatgctggagtgcaggcagcactctggtctgcagtaccgggctactgtgctgcctgttcctcacctggaatgggggaatggcctagctgcatcctcctgtcactgagaagaacttgggtctgggtggccagcacctctatgtcccttagctcatcctgctgtgtgtcttccgggccctgccacagatgacggtggttgggtgctcacatttcaaatgccctacaagtcattagcctgggagcctccaaagccctgcactctcttcccgtctgtctttacccagcatgagacacacacacacaaacacacacactccacatacacatgcttatacacacgtatgcacatgctcataggcacacatgcatactcacatatgcacacatgcacagcccctattccaacatgggatggttggagaaggtcaataatattaccaacagagaaaggagggcaaaagagagcaccttggggcaccaatcttgaagggctcagaagccaacaactgagtggacaagctggtaagaaggggaggacaagtgtgaaagggtgatctcttccccagaggattccaggaaaaatagtcaacaatgcccatcgagggatggctcctgacatcctttctttacatctggaactcccctaccctgacatgttttactcaagtggtttatcaattaagaggcagtatctttgactatgtgccaagaaaataatgtagatcagagtggaggaatgatcaagtgtgaaaacgaaggccgacccaagcaatcaattcccttgggtttaaacttaaatcttggaggattcccgcagcagtctccagaaatttgtctcatccacatactctccctgccaggttgggaagcagacacctctgcctttaaggatcactttcttgtagcaacaaagctcacacttcaggcacccaacagagaactcaaagggaccctatgagtttcctggggctcttgacacacatgaccacaaacggggtggtttgaaacaatggaaatttattctgtcgctgttctggaggtcaaaagtgtaaggtcaacgtgtccacatgtttacactcctctgaaggtcctcagggagattctgtttcttgccttttctaacttctggtggctctgggcattcctaggcttgtggctgcatcactccagtctctgcctctgcctttacgtggtctcttcttctcctctctgtgtctctctcctctgtaagtctcctaaagagatccctgtcattgtatttaggacccatctgagtaatctaggacgatttgatctcaagaaacttaattacatctgcaaatacctttttcccaaataaaggtcacattcacagtttcttggggtcaggaggtagacatatctttttgggaatcacctttcaacctcctacagtgaccatcaatgtgctatctgggaaatagtgctccatctttacccagtaattagcttgcttttctgttacaaagactggctttttatcagttagctctgcccaaaatagtgctatactataaatgtgttgtgtcttgtgcgatgttattctgtcatgtgtgataatgatgtcagaatggaatgtagtgtggcacatagaaaaatattgccttgcttttgttctgaacaattacacttcttatacgttctcctcaacatttttattttgacaaggatgtgaatttgggagcttatcattggtagatagagattctcacttctagtttttcacattctgtttgagcaacttccctgtcagtaggagcagtgttttcaatttgtttcttttttctgttctagccttaaaataacatacagaaaatactcctcaattaatttgctgataaatgaacttgagagttccatgaaaaataaaatatttcacaattttaaaaacatttttattttgcttcattcccaaaagcatttcaggcaagttctactataggaacttgtatagtataagaacatgtaggacaaaacagtaagtaaggaagtgaaagtgaagataaaataaagattggaaaagtaagataatgcgagaaggatgaagttggaacctactcgtgcctgaaattcttgaaagttattagctgtgggctataaatttgtttcagagcatcacagcaaccaaatgggtgggagagggggcaggccaatggccaaaatttaccacatccacaatgtggaaaaagaaaatcaaaagtgttataaaggctgctttgtgtatagttgattatctttctgaaacatttctggcaatgagatgggggttcagtgtcctaggaaccttcctaaaacatccctccctgtaggctgttggcctcatgacaaagcctatgtcagggaaagcctcatcagatgtgaaaatgtccagagcactcgttaagaggacacagcctccagggatattgttttcagcaacaaagtccctgtgcctcatcctaaccatggattaaggtagggtttgtctgcatgtgctgtcaatttacagcctcctgagacacgaaggcgtcaggtagaggctggcaaagaaatagccatgggcaaagcccagttttacttgttttttgtttagtttttttttttttttcttcagataatgttgactgagacccaaagctttatgccttggaacatggctctagtaatttgaaccaagataaattcaatgatgtgttaacacatttctgacatggtcattaaaattttttttctcaatgaggtcccataagatatctaactttaaaccatataacttcaaggtgaatcctacaaactatagtgattgcagactgtgccctgggtaaataactaagcttgctgcttaatatagctttaagatagaaaccaattaaatattggagtaagtaatttgaagtcattggtcttgaactcacaactgtgatcactgtggcttgaatatctatgtttcttccaaaatttatgttgaaacttaatccccattgtggtggtgttaagaggtagggtcttttggggagtgattaagtcatgaaggtaccacccacgtgaataggattagtgcttttaataaaaagctcgaaggaagtagtttaggcccttttcgccctttgacctcctaccacgtgaagacacaagaaagctctcattaaacatagaatgcacatgccttgatcttggacttcacagcctccagaactgtgagaaagacatttctgttctttataagctacctagtctatggcattttgttatagcagcataaatggattaagactgtgctggtgatttgaaagtggcatgtgacaataaaattttgttctcagtgtagcagtgagcaaagtcttagtctgaatggcaggcccagtctcaacaaaatctggatcctcagggaggatcatttcagctctggaatatgcagtggtgtgaccacaggctgccttccttcattgtgctgatccattgtgctgatccagcttcctaatctataaatggatttagtaatactcttactgaaaagtcatttcgaggataaagtgtaatatatatttagtgttcttaggatctcttctgatgcataactattaccattatcctgttctccatggtggaatatgaggcgatatatccagctttttgaaaagtaatatcaaatcattgggattcaatatgacaacaaggtcacctaaaaattataaatattctttacttatttttcttttaagagtttatcctaagtaatcaaggagaggcaaattgattaagccataggatgtttgtgtttataatatttaaaaaattagagacaatccaattgtttagaaataagtattcattgaaaatattattcattggaatattttatcatccattacatgtcattataaaataatatctaaaggcaagggagcatatttaaaatctattactggctgagtgcagcgtttcatgcctgtaatcgcttgagctcaggagattgagaaacagcaactacttcatgtagcttgggatttataaagaactcacgtagaaataagttaaaatcagtctccagtggtttctgacagtgctcttgtctgtgtgaaaaccaggttaacactggtcaaaaattaaatgatcataggtcaacctcaacctcatgaaaaatactgtccttagaaacacggccatagtcattttattttatattttgagacagagtcttgctttatcactcaggctggagtgcagtggcacaagcacagctgactgcagcctcaacctcccaggctcaagtgatcctgccacctcagcctccagagtagctggtactacaggcatattccaccatgtctggctaattttttgatgttcaggctggtcttgaactcctggagccaagcgatctgcccacttcacctgcccaaagtgctgggattacaggaatgagccaccgtgttgggctggctagacatttttaaagggttgaatttgctgttgagtatgctggttagtctaaaatcggaaggtagaagggaaggatgccttttaaaaatgtgattagtctcagataacttatttatttattcattaatgtgcatatttattaagcctccatttacctggggactcttctaggctctagacaagctccttgatcattacattttagttaaaagggaagaaggcaagaagagagctggtaaagaaatcgatgagtgtctaaaataaagcaggggtaaaaactaggatgcacctacacctggatattgtcacaggtggtttgtgtggtcacagaagcctgtctaatgaggagacatttggactagctggaatttcagaaagaaaccaatcctgcaaagatctgcagcagaagactgtgggcaaaggggcacccaatattcaggcactaacagaacctgccagataaacttacaagtgtattagtcagggttctctagagaaatggaaccaagccaatgtatatatagagagagatttattttgaggaattggcttaaatgattgcaggggctaagtctgaagttttcagggcaggctggcaggctggagaaccagggaagggttgatgttacagctcgagtctgaaggctatttggagacaaaatttcttctttcttggggaatctcattctttattcttaagactttaaaatgcctgtgagaccaacccacattgtagagggtagtcttctgtatttagtctatagatttagatgttaatcacatctaaaaaataccttcactgcaatatctagactggtgcttgaccaaacatctgggcgccatggcctagccaaagtgacacacaaaattaaccatcacaacgaagcttaggcacaaattggcaatagttggagccaccatgaccactctgcgtgctcatctctgcttttctggttatgacctaactatccagcttcagctcccatgggcttggtcttagtctttgatgtgagaacctcgtggagtaggagctatctgaggctgaccctctctgtggggtttccaggtagctgtgcttttgtctaagactggggtctcacagattctcagcatatgcagactgagtagcgcctctgagatgggagttatcctgggcatcaacctatgaacctccagggaggcttcctcactggactggaatgctgtgggcatcatacatgtgcagtctcccctctcttttgggacttcacatggcaagacacattggaatgaggcagttactggaggaactaggaagtagaagatttcagaggccctgagcaaaaagggtatgaagtaggaatctgatcagtcaggcctaaggccactgactgggtcactgaagtcactatgggttaaaagatcagcatactggtggagacaggccaatatgtctgtccatcttcccccagagcagcagtaacctggtcatagctcctgctgaaaccacctttgcaaaaatgaaaactaagggaagtatgacggtgaaagagacaagacctatccgactccatcatgcttctaacttttaagctgtccttgttcattcctgggagtaggccaaactaactttgggaaggaattcagttcatggtttgactctgaaacaaaattgataacagtcctttcctgaaaagacccccttcttgcttggggaccaatctgcctttttaggactaacaaattagctacaagattagaaattacagtttaggggtcacgcagaccctggctccaagagtctgaacctccccaaattgttcctggggataacatcactattgtaagacctaagatcagtgcttgagatgttttgcagaccctgcactagatggatcagctgataccacccaggccagtaatctgactcaaccagttctgccagcccacccaggaacagaagacagcaagaaaacctcactttgactctctacgattccatctccaacctgaccaatcagcactccccacttcccaagcccctacctgccaaactatctttaaaaactctgatcctcaaatgctcagggacactaatttgagtaataataaaactccagtatcccacacatccggctctgcgtgaattattctttctccgttgcaattcccctgtcttgataaattggctctgtcaaggcaatgggcaaggtgaaccctttggatggttacactgccaccctcctccctccaatcttctgagtttctgagcatagaatggacaaggcttattctggaatgctgggggtggggtggatcagaaagaggacattcagtgactagcctcagtctaagcccacctagatctaactagcttcaggacaaagggaagtgccatactcctgtccagtgtcaggcagtgtcaggcagaagttggtgataaaggtttatttgccattttatttgtgcttgagattctcttggggaagtgtggagaatttttaggacctcatagctataaaactattgtcttagtctgttttctgttgctataacagaataccacagcctgggtaatttataaacaacagaagtttgtttggctcacagttctggatgcttggaaatctgagagcatggcactgccatgtgatgagggttctaccatggcagaagggtgaaagggcacaggaacatgtgagacagagagagaaatggggccaaactcatccttttattaggagcccactcttcaggtgactatcccactccaatgataatggcattaattcagagctcttatgacccaatcactttttaaaggtcttacctctgaacactgttacaatggcaattaaatttcagcatgaggtttggtggtcacattcaaaccacagaaaccacttaatagaattccatttcctacattaattttattagatattctcatataaaacaaagataacatattgaaagttgaactagccttgtagcatattaaactttaaatgagtgatatacaaaattacttaacaaaatatcacctgatatttataaagccttgaaccatattctgcaattatggcatataattgtctggatttctgaggaacatctgtttctttaagccactgatgatttaggagtcctgttaaagaaaagacaaactttgattaaagagtttctctggaaacataaaatattttacatgtattcataagaatttccctaaacatgaagaatatgtatactcttaagaatatcagatccttgggtgacatcatggaaaatggtggaatagtacacacaaaaaatcaggcctccatgtaaacaatatagctagtaaagattgacagaatcaattttttttggaactctggaatctaatccaaaacctacagcagccagataactaaggatagggtggctagtttctagaaacagagcatgtggcatttttctttacctgactaccatcttccatttctcaacctggtggtggcagctatagggacagcatttcacattcctttaatatagactttgttcttaaaataccatggtaatgttttttgactcatctagtggttccctgaggggctggcacagaagctgacctgtgtttattccacgcctatagctttctaggaagtggcaatatctattgaaagacttcaaagacatactgccgaagcccaactgggacaaaggacagtagatgatggaagtggcagacagacccaacagcccatgaataaagaggcagtctctttctggaaaaagggctcagaaggactgctgcatcatatactaggaagcagagaacgtaatgtgcatttctaggactggacgcatgttcataaatgaccccaagaagatactgggttgcacctctggtggatctgtagattgtgtataagcaggagatgaagactaaggcagagttttaggtggcctggcttagtcttgaaggagtgtcccagcttagagccaagctgcaaagactgagagagtaatctctgtctctgtctctgtttctgtctctctctcactctctctctggatccaggaattcaaggaaatatgtgagaaatcagtggctaaccactgagatagtggaatagcaaacatatacgacaagaaatacagtcttccaaaatagttttgggaggccgaggtgggtggatcacaaggtcaagagatcgagaccattctggccaacatggtgaaaccccgtctctactaaaagtacaaaaattagctgggcgtggtggtgctcacctgtggtcccagctactcgggaggctgaggcaggagaaatgcttgaacccaggaggtggaggttgcagtgagccaagatcgcaccactgcactccagcctggcgacagagtgagattccatcccaaaaaaaaaaaaaaagtttgaaaatgttactaaacaaacaagtgattgcagccctcaacatgcaacagcaggcaaaccctggggaagagggaaatctgaattctagagttattacattataatattaaaatgctcaatttgcaaaatcacatggcatacgatgaaacaggaaagtatggcacattcaaaaagagaaaatggcagaaaccatccctgaggaatctgacattggaattacgagacaaaaactttatatcagctgttctacatatgttcaaaaactaaaggaaaccatggacaaagaactacaggaaaccaggaagattatgtatggataaaatgagaatattgattaaaataaattatgaaagaaaccaaatataaactctgaagctgaaagaggaataactaaaatgaagaacttactagaagggctcaacagttgatttaagcaggcagatgaaagaatcagttaacttaaagatagagctatgaaattattgagtctgtgaacagaaagagaaaagtgaaaaagtgaacagagcccaagacacccatcagacaccatgaagtggatcaacatatgcattgtggcagtctcagaaagaggagagagagagaaaggggcagaaagaaatgaagaaataaataaaacctatgggatacagcaaaagcagtactaagagggaagattatagttgtaagtgcctatattgaaaaagaggaaaaacatcctataaatgatgtaatgatgtaccttaaagaaatagaaaagcaagagcaaaccaaccccaaaatgagtagaagaaaagaaataataaagatcagagaagaaataaataaaatggaaatgaagtaaacaatacaaaagatcaatggaacaaaggtttttagaaaaattaaatgaaactgacaaacctttagccagattaacaaaaaagagaagatacaaatgaaattagaaataataaagaagacatcaaaactggtactgcacaaatttaaaggatcattactagctactatgaacaactgtatgccaataaattggaaaatctagaagaaatggacaaattactagacacatacaacctaccaagactgaaccagaaagaaattcaaaacctgaacagaccaataaaaagtaatgagatcgaagccataataaaaaatctcccagtaaagaacagcccgggaccccatggcttcactgctgaattctatcacacatttaaagaagagctaataccaaccttatgcaaactattctgaaaaagagaggaggagggaatacttctaaactcattctacaaggccagtattaccttgatatgaaaaccagacaaagacacatcaaaaaaaaaaaaaaaaaaaaaaaagaaagaaagaaaactacaggccaatatctctaatgaatattgatgcaaaagcccttaacaaaataccagcaaactgaattccatgatacattagaaagatcattcatcatgactgagtgggatttatccctgggatgcaaggatggttcaacatatgcaaatcaatcaatgtgatacaccatatcaatagaatgaaagataaaaaccatgtaatggttttcaactgatgctgaaaaggcatttggataaaattcaacatctctccatgataaaaaccctaaaaaaaactgggtatagaaggaacatacctcaacgtaataaaagccatgaatgacagacagatccacagctggtatcacactgaatgggaacaaactgaaagcctttcctcaaagacctggaacacgacaaggttgctcactttcaccactgctattcaacatagtactggaagtcctagctagagcaaccagacaagagaaagaaataaaaggcatccaaactgcaatgaaagaagttaaattatccttgcttgctgataatatgattttatattaggaaaaaaactattagaactgataaattcagcagtgttgcaggatacaaagtcaatgtacaaaaatcagtagcatttctatatacaaacagtgaacaatctgaaaaattaataaagtaatctcatttacaatagccacaaacaaaatcaaatacctaggaattaaccaaagaagtgaaagatctctacaacgaaaactataaaacattgatgaaagaaattgaaggagaaacaaaaagtagatagctcatgttcatgaattagaagatcaatattgctaaatgtccatactacccaaagcaatctacatattcaatgcaatccctatcaaaataccaatgacattcttcacagaaatagaaaaaaacaaccctaaaatttatatggaaccacaaaagaccccaaatagtcaaagctattctaagcaaaaagaagaaaattggaggaatcacattacctgacttcaaattatactacagagcttagtaaccaaaacagcagggtactggcataaaaagtgagagataggctgatgaaacagaatagagaacccctacagagaactcattttcaacaaatgtgccaagaacatacgctggggaaatcatagtctcttcaataaatggtgctgggaaaactagatattcatatgcagaagaatgaaactagacccctatctcctgccatatacaaaaatcaaatcaaaatggattaaaggcttaaatctaagactttagactatgaaacaactataagaaaacattgggggacaatctccaggtcattggtctgggcaaaaatttcttgagcagcaccccacaagcacaggcaacaaaagtaaaaatggacaaatgggatcacagctaaaaagcttctgacagcaaaggatacaatcaacaaagtgaagagacaacccacagaatgggagaaaatatttacaaactacccatctgacaagggattaataagaagaatatataaggagctcaaacaactctacagagaaaaaaaaaaaaaacaaacctaaataatctgataaaaaaatgggccaaagattcaaataaacatctctcaaaagaagacacacaaatggcaaacaggcatatgaaaaggtgccagtttcattgattgtcagagaaatgaaaatcaacactacaatgatatgttatctcacctaagttaaaatggcttatacccaaaagataggcaataacaaatgctggagaggatgtggagagaggagaactctcatacactgttggtgggaatgtaaattagtacaaccactctgcaggatagtttggagaatcttcaaaaaatgataaacacagctgatatatgatccagcagtcctactgttgggcatatacccaagataaaggacatcagtatatcaaagagatatctgcgctcccatttgttgcagcattgttcacaatagctaagatttggaagcaacctaagtgtccatcagcagataaatggataaagaaaatgtacatattcacaatggtgtactatgcggccataaaaaagaatgagataatgtcatttgcaacaacatggatggaattggagatcattatgttcagtgaaataagccattcatagaaagacaaatatcacatgttctcaattatttgtgggagctaaaaattaaaagaattaaactaatgaacatagagagtaaaatgatgattaccagaagcaggtgagggtagtgtcgaagatggaggaggtgaggatggttaataggtacaaaaaatagaaagaataaataagacgtactatttgacaacacaatgggtgactacagtaaaaaattacttaattgtacattttaaaataactaaaagattgtatttggattgtttgcaacacaaaggataaatgcttgaggggatggataccccatccttcatgatatgattatttcacattgcatgcctgtatcaaaacatctcaggtaccccataagtatatatactatgtacccacaaaaaattaaaaaattttaaattttaaataagaaaaagaacatttgaagaaataatggctgaaaaagttccaaagttgataaaaagccatgaatctacacatccaagaaactcaacaaacttcaagtaagacaaacttaaaaagactcatgctgaaacctattataatcaaactgttgaaagacaaaaacacagagataatcttgaaagcagaaagagagcaatgccttgttatatagaagaaagtctttgttggattatcacctgatttttttcttcagaaactatagaggccagaagacagtgggatgacatatttaaagcgttgaaagaaaaaaaattctatatatgagaaaacgattctcccaactgcagaaaaaattaacatattctaagataaagaaaagctcatggtgtctctatgactagaccagcccttcaggaagtgctaaagggattccttcaggctgcagtgaaaggacattagagagtaactcaatgccgcatgaagcaatcaaaatctccagtaaaggtaacagagaggtaaatatgaaaccagtattattgttttgggtttgtaactccttcttttatttctttcataatttaaaagacaaatttataaagcataattataaatctatgtttatgggtacccaatgtgtaaagatgtaatttttgacaacataaagaggagtaaatcccagtgaatacagatcataaggaggaaaaaaaagaggagcagagctgaataggagcagagtatttgcattctattaaagttaatttggtataaatttaaactatattgttataaatgtagggtctcagttgaaatccccatggtaaccactaagaaaatatctaaaaaacgtatacaaaatgaaacagatcagaatcaaaagagtgcactacaacaaagcaattaaacacaaaagaaggcagtaaagaaggaaatgaagaacaaaaaaggtataagatatagattttctaaaaaatagaaaaatggcagaagtaagtcattccttagtagtaattaatgtaaatgaaaatggattaaactttccaatcaaaaggcagaggctggcagaatgaatttaaaaacatgattcaactatatgctgcttacaagagatttactttagaatcaaaactgaaatttataaaacatggctgaaagaaattaaagaagacctaaataaatggaaggacaacttgtgttcatgaattggaagatttactactgctaagatggcaacactacctaaagctgtccacagattcaaagtaatctttatcaaaatccaaacagcatgatactggataatgatagacatatagactaatgggctagaatatccagaaataaacccattcaactatagccaattcagtttttggaacagaggacaagacattcaaagattcctatagggaaagagtaatatttttagcaaatattactttggctttccacatgccaaaaaatgaagttggatcccttgcatcatatacaaaaatgaactcaaaatgggtcaattacctaaatattataagagctaaaaccagaaaactcttttaaaaaggtttggcaatggatgcttcaatatgacaccctcaaaattacaaaccttcgtgtatcaaagaaagtgcaaagacaacctagaatgaaagacaacctagaatgaaagaaatgttttcaagtgatatatctgagaaggatttggtatctagaatatattaaaaaactcttccaactcaacaacaaaaggacaaacaacctaatcaaaaatgagcaaaagactttaatggacatgtctccaaggaacacatacaaacggtcaataagcacataaaaagatgcttgacatcattagtcattagagaaatcaaaccatgatgaaacatgacttttcatccatcaggtggctgtaatttaaaaaaaaaggaaaaaaatgatagtggaaatgtagagaaattggacttcttgttttaatccatttgtgttgctgtaaaggaatatctgaggttgggtaatttataaagaaaagaggtttatttggctcacagttctataggctgtacaagaagcatggcaccagcatctacaactggtgagggtctccagctgcttccgctcatggtggaaggcaaaggaggagccagcatgtgcagagatcacatggtgagagagggagcaagagagagctgggagaagtcaggttctttttaacaattagctcccacaggaactaatagagtgacaactcattactgtaaggatggaaccaagtgattcatgaggaatctgtcctcatgacccaaatgccttccattaggcccccacctgcaacactggggttcaaatttcaacatgaggtttgggaggacagatatccaaactatagcagtcctcctacactgcttgtgggaatgtaaaatagtgcagccattgaggaaaacagtctggtggttcctccccagaaatctcattcctatgtatatacttgaaagaattgagaacaggtgttcaaataagcacacatacacacttatgcacagcatcactattcacaatagcctaaagataaaagcactctaaatgtccatgaatagataaatggataaacaaaatgaggtatatacatacaatgaaatattatttagctacaaaaaggaatgaggaactgacacatgataggatatggatgaaccttaaaaacattatgctaagtgaaagaaggcagataagaaagatcacatgctatatgatcttttttgtaacaataactgggttgaaacttttattttaatgggagatacatgccttaagttgtgaatatattaaagaacaattttccagtgtgctaggggtggtggatggtgatatttcccgatacgaaactacaaactgcacattctgcagtaatttatttgggaactgtgtgatgagcaagagtctctggttgtcaaaacctcccaagtggagtcacctaaatttagaaaaggtaaaatgtatgtttgcaataaatatattagaaattcttaactttaaagcaacatctatgactaaaaaatttgcaaaaagcaaaccacaattctaaaagaaaaatctcctttctaaattttctattaaaaagccagtattactcttacaatcagaaataaaaaacaaacgaaaaagctttgagaatgtgcaggtcacctccagcactttccgtggcatttatttacaaatatgagtcattccgttgagatctctctcaccaggcagacataacctgtggaatggttttaaggatcattacttaggaagacttacctacaagaagaaaagtcagtgtaagcattgtacttagaataatcttccatgatcgagttaccctaaaagaataaaaacaatgattagaaaaagaatttaacaacatcatgcatttaacttggactttagccactacactcacgtcaacaaacttacttattttcattcttgcttaatctaggttgagtctatgaattactttaatttccaatccactattttttaaattgagagaagatcgttttagtgatgatacacactcaccagcatatatgagtgcgcatacatagagtcatgcctcttactttcacatatgcaatgcttatgctagtatatgtctatttatattcttaaaatacttataagaaaaaaacaaaggcagttttctggaggtctcaaatgtagaactagctacaaaaaaagaaaaaaaagaaaaatcaggttctgattttatggaaattttgtactaagctaaagaactatgacagttaagaaatatctgataaaattctttaaagccaccatgaccttttttcctactctgtgttgaagtacagtatgctatacaaatacgatttgtgctcttttctgtataattgtacagaccagtgatgcctcacagaatgaacacatccatgaaacctcacccaggactggaaattgagcatactcagttctgtggactgaattgcaccccaccccccaacacacacacacacacacacacacacacacattcatttgttgaagccctaccatcattgttactgtatttagagatagggtctttaattgctaattaagggtaaaagaggttatgagtgggactctaaactagcaggattgttgtccttagaagaggtggaagagagaccagaactttttctctctttgtgcagtcagaagaaaggtcacatggggacacagtgagaaggcaatccaggaagagagccctcgctagagaccaaatcagctggaaccttggacttcccagcctccaaaactgttaaaaaaagtaaatttctgttgtttcagccacccagtctgtggtatttattattgcagcccgagcagatgaatataccaagcccatcagaagcccatcttatgcccttatcaaccctatacctcccacctccaaaggtacctgctctcctgagctctatccccattaagtaggtttgtctgggtttgaaccatctataaatggacccatgtgggtatgggctctatctgtctgcctcctgttcccagtcttaagtctgtgagagtcaactgtgctgttgtgtatagttgtggttcattcattcttataactgtgtagtatttcattgtgtgaatatatcatgtgggtatccatcctaacattgatgggtgtttggggctatgataaacaatgcagttataaatattactacaagcaatgcagctatgaacattcttgtacatggtttctgatgaagacaagtatgtatttcatttaagtgtattttcaagagagacattgatgggtcataggatacatgcataatccgttgcagtagattttgctcagtgttacaaagtggttgtaatgacaaccttttcacatctaaccttttaaaaagccctaaagggtggatggggagggaagctaaaatgatcacattaatctaacgtgaaggctataaacttccggataaagtattacaagttggcaaactaaaaatttctacttaaaacataagaaaaatcacattaagatggaccattcattaactgtattcactagagtgggccgcctaattctcccagtacagaatctttaagtagcttatctaccctacataaagcagtcatacctattagccatccaagagtgtgacagtgtggaaaccaactaagaagagaattttcttaactctcttcccctccagggaagtgtattctggaacctcttccttttaactattattggagatgtggagagtggtagggggtccactgtattaaaaaagttgttcataggtcagttatggtctacaagagctcttttggtgggctgcattaagtgaaaattatcacattaccatatttaccaaagattaactccagtgtttttcgttttttgtttttcactagaaaactggctgccaggctctgcattgcaaaattccttcggtgccttcacccagccagtgggattctgccatttggggcaagcatattttgttattactgtgattttgaaatgctgctctacttgtactaataactttgtagcattccttttatttttattgacagttttgttctgtgcaagtgcttcattgttaccaataggaaggttatttcattacttgtagtttttgttttcccagcaggcagcacatgggcagggcgtttgtaaataggtttagggtatttggattccctgctataataatccccacatatgttctcactagaggaaacagggtgattcactcaaaatgtgcatcccctaccagagtctttagtcaattatcacccaagaatgtaataaatgccactctgtgcccagagtcctgagcccggtgctaagctctgcataccaccaagactatacaagctagcccaatgacaaaaaaaaaaaaaaaaaaaaaaaaaaaaagtgaattatctggaagcttttaagttcctgctgctgtggctcattcttttaaagagggtggctctcctttcttaatccttctcccaagtctgctgttattaatccagataccgttgacatagaagtattgtgatcaagtgtaagactgtgatgaagagaaaccttcaaaggaaactattgaaaatgattttctctataaagggagaaaatactgtcgggtaacaggtaacagatgaacagacacaagtgacagatgtaacacataaaacctacaatttcaggcacaccgttctgccatgtttacctacccattcgcatcaggattttcgtcctctgataacaaagcattgccactggcgctaccgctggcgtcttcagagcaacgtctaaaaaacatggcagcccttcttgcctttgtttttccactcatgatcccctaccaaagaacaaacagctggtaggatgaagagcaacatttgtcctcattcctattttatgaaaaacatgaagctatacatacagtttctaaatttgttttgtataatgtcttcttcctccacgggtgtttcttcttgaagacggaattttgaaaagcttctgattcttctgtt

SEQ ID NO: 2158 - DNA, 41972 bp, Homo sapiens; identical to SEQ ID NO: 2157

SEQ ID NO: 2159 - DNA, 2894 bp, Homo sapiens
cctgactggccgcggcggcctccaggaagcggaaaagcaaggggcggtcgagctgggccgccgcgccccactgctcgccgcgctgctctttgacctcgcagggtgtgaagaagatgcgcagctccacgctgcaggacccgcgccgccgggacccccaggacgacgtgtacgtggacatcaccgatcgccttcgttttgccattctctacagcagaccaaagagtgcatcaaatgtacattatttcagcatagataatgaactcgaatatgagaacttctccgaagactttggaccactcaatctggcaatggtttacagatattgttgcaagataaataagaaattaaagtccattacaatgttaaggaagaaaattgttcattttactggctctgatcagagaaaacaagcaaatgctgccttccttgttggatgctacatggttatatacttggggagaaccccagaagcagcatatagaatattaatctttggagatacaccctatattcctttcagagatgctgcctatggaagctgcaatttctacattacacttcttgactgttttcatgcagtaaagaaggcaatgcagtatggcttccttaatttcaactcatttaaccttgatgaatatgaacactatgaaaaagcagaaaacggagatttaaattggataataccagaccgatttattgccttctgtggacctcattcaagagccagacttgaaagtggttaccaccaacattctcccgagacttatattcaatattttaagaatcacaatgttactaccattattcgtctgaataaaaggatgtatgatgccaaacgctttacggatgctggcttcgatcaccatgatcttttctttgcggatggcagcacccctactgatgccattgtcaaaagatttctggatatctgtgaaaatgctgagggtgccattgcagtacattgtaaagctggccttggtcgcacaggcactctgatagcctgctacatcatgaagcattacaggatgacagcagccgagaccattgcgtgggtaaggatctgcagacctggcttggtgatcgggcctcagcagcagtttttggtgatgaagcaaacaagcctctggctggaaggggactattttcgtcagaggttaaaggggcaggagaatggacaacacagagcagccttctccaaacttctctctggtgttgatgacatttccataaatggggtcgagaatcaagaccagcaagaacccaaaccttacagtgatgacgacgaaatcaatggagtgacacaaggtgatagaagtcgggccctgaaaaggcgaagacaatcaaaaacaaacgatattcttctcccatctcccctggctgtgctgacctttacactgtgtagtgttgtcatctggtggattgtttgtgactacattcttcccatcctgctattctgactcaaagatttcagaacatagtagccatcaggaccccctgacagatagctgcttctctccatttcaaggactaaaatggttttgcattaagtaaaaacctgtgaccagaactgaaggaagactctaggaactgaaaactgcaacagaaattagcacaatttgaaaacaaaacaaaattgcaaaagacttagttgctttccacctaagaagctaatcaatggggaaaatgtccacggggtttcagtaatgaacttttgagtttgggtgcaagcaaatgtaccaagaccagctcagtcagggagaccctaccccagtggtgctagaggaattaaagacacacacacagaaatacagaggtgtaaagtgggaaatcaggggtctcacagccttcagagctgagagccccgaacagagatttacccacatattgattaacagcaaacaagtcattagcattgtttctatagatattaaattaactaaaagtatcccttatgggaaacgaagggatgggcctaattaaaggcataggttgggctagttaactgcggcaggagcacgtccttaaggcacagatggctcatgctattgtttgtggcttaagaatgcctttaagcagttttccactctgggctgggtgggccaggtgttccttgccctcattccggtaaacccacacccttccagcgtgggcattagggccattatgaacatgttacagtgctgcagagattttatttatggccagttttggggccagtttatggctggattttggggggcttgctcccaaaaagaatgactcaaagaaaggcccagctctcaagctgaatgacaaaaatgctgttgtaaatttagtctcaggtgtaaatacccaagccctctggtactcagggagctggctggtctgtggtgcatgtgtgtccttgtgatggcaagcattgtagttgatggccttcagaagaattgaggatctgatggaggttttttaatgtatttattttctgttcagcttgtgaccctgtgtcaaaatttgtaaagatacaaaaggcattactgaaatggtactttctgtaatttgatactatttggctttaccatcttcacttgactgtttgtaatactgtagtaatattaactctgataagtacccaagctgcttgtcttctaccaaagagtgctttattaacaagaatctgtgaaaaccacattttaaacactgttgcatgttgtaataccaggtgataccttggtaacctaaaacttgcaagagaatattagtggtagctttagaagactcaggaggagaaactgacttcagagctggaagatgttgcaagtcattcctttttctgtcctttagggactgaagaactgggaggttgcccattgtttggttgccagtcatacaaattaaaatcatatttccttccatgc

SEQ ID NO: 2160 - DNA, 90882 bp, Homo sapiens
acacagtaaatattttattttaataatagcatagaattcttctgaagaaaattgttatacattatagctattattttacagtaacagagagaaaataaaattagagatacaaatattaaaggccaattatcaaaatgaaattaacacagattattattcatatgaacaatgtaaacagaatcatctatttgatttaacatcaaatatatttttggcatataattatttttacaatgagaattattaattattcaaccaattcaaatatactcattcagccaaaagaacaaaataagcctcttagaaattcaagatttatagattgatattaaacattttctcaatacatagaatattctgatctccattgagttaaactgtacaaacactcatatctattgttttatagcttataattaggtatagcttgtcaccagaactccttgtccaaaatatcactattaattgtacgaggcaaagtcctataataaaattactgtaataatggccacatcttttcaaaaacagaatatggaagtttccattttcatgactatgaatctggttttccaaaattgggttcccaaatccagtttctaaatgtttcaacagaggtgagaaagtaaaggaaataaatgatttaatggaactctggaaaaaaaactatcatagatcttagtttgaaaaatacatcaaacatgagatataccatgaatgactcagaattatataataatgcctatatcaaactttattagttagctaaagggcaaagagtaagaggcaagttaaaggtaatacttgcttttaacaaagcagactaagtaatatgttaagtgttagggtgggataggaaagaactcaggcatggcaaaaatctcctcttgggctttctatataaacatctattttagttttggactgttcaccgagaggagctctccctatccatgaaatgcttcccagaccaacaggtcttggtctagcagctgtaggaaggcagcagtatgaaaatgtaggaaatggaagccaatttgtgtccaaagttagtccaccctaactggactctttttaaactgggttattcaaatgccagcaaaaagtacaggctctagctaaagaacatgaatagacatctgtcttaaaaatgcctggaagaggtcatgattattggccttatgttctcccagaataagaacttacaaagtcctggaaatcctcagctctctccagccacctttccaaataaaatcttaatgaatatattttaaatcctttattgggctctgtaatcccttcaaccaaatagccaagctgcaatcgttttatgtaacatctgtttcactggaaaatgtgggaagttattttgatattgtctagcaagatcaataagtaaacactgatcaccccaagccaaatgatattgcccttcagggagcttttagaaagaaaataaactgataaaccaagaaagcagattgtatgcatagcaaagcccttcagcacagtgcaaacatgttctttatgaggaggtgcaaacccacttggtaatttcaagtgagaggcaacagaagtctttcttaatccaaagtcagaagtttccgaagaacttcaagcacaatatcgtaacaaaagtgatactgctcctatatacatatatataaaaaacaacagaatgttaagtaattgaataacagaatccactttcagaaaacacatttgtaattttcagccacactggaaagttcctaaaaagagcaaacatttaactataaacacttaagaactttacgtgaatacatttttaaaactatgaggaagataaatgatcaaaatatagctcttggcctagaactagttaccttaaggcttaacataactgttttttttatcattatccatattctattaatctaccctcccaatgactactaacaaatctgtgacataaatgatgtctttttatgacgtcctgataaccttgacagtttagtggcaagtaaatatctcaaactgctatccagaaatgttttaaaaataactttagatgttacttaaatagcacggcattatggacaaggcatgtgtttggacacgaggagacctcaacttcaggcttggctcctccccttctatctgagtgaccccatggagcaggctttattgctctgaatttgaagtacttggtcaggaataccagagaatcagagcaaaactaatgtctacctcaaacagtaggaattcaatgagattatgtcaataaaagagcttttaagtggtaaaatgttatgcaatgttaatctttatattcattattcttattattatgtatgtggtgaaagcttaccttcgtttgaaccatgccagaacgttgttctctcatttgggccactatatccatgatgttgaactgtaataagatgacagtaattttgtatgatccacatgggggaaaaacacaaattcacagattgccaaaaagggtgaaagagatgtcaagatttaatcagaaagatctcattttcactcacaagaaaatgtgctatttttaacttagcccaatggataaggaagactattttaataggttttcaggagaaagcaggaagcaatcattcataataagaaatgctctccaaaataagtaataaatttgcccttgtgtgtccctgtttgttatccaaaggcagaacttaaagcagcactgtaattctggaaaggcacagaagactttctctggccccaacaatagcatatctgtttcttatatgaagatccctgtcaactcacacggaaactgggagcaacagtcgacccaacactagattccagactgtgtgtggacaccagtacagctgggtgtggtcattgagttggtgcaggcctacaaaggtctgttgctggtccacaatgagtcaagaaactgggagtaagtgctcagaaactcttatggcaatttgacactggcacagcactgagaagtgtgctcaactgaacaggatatagaccagctcaggtgttgctgaacttgcctggagagtcacatgtgggacaagctgagaatgagtcgtttcagcaagacattgtggacacatgtaaatgttgtcaactgtaaccccaaagcatataaaaatagaaaacaataagcattcctttattttcatagcttatcatttttataattaaaatttttaattaaccctttgaaaaaactttttgttttttagagacagggtcttgctctgttgtctcagctgctggagtacagcggtgtcatcatatttcactgcaatctcaaactacaatcctccctcctcaacctcctgagtagcaagaactataggtgcgttccaccatgcccagctaacttttttatttttatttttgtagagatggggtctccctatgttacccaggctggtttcaaactcctggcctaaagtgatcctcagccttggcctcctaaggtctgggattataggcgtcagccaccatatctgccataaaaaacattttattttataatacagatatacaggaagttgtacagggtggccctgtgtatctttcacccagtttcccagatggtgtcatcttgtttaacaagatataatatcaaaaccaggaaactgacattgggacaatccacaaagcttaattcagatttcaccagttttacatgcaactgttagtgagtgtgtgagagtgtgtatgtgtgcatgtgtgcatgcacagagctccatgcaattatatcatatgtgaagattcatgtaactataaccacagtccagatacagagctgttccaccacaagacttcctcctgctatccctatagagtcacactcatccaccccaatctctaacccttggaaaatagtaatctgttctccttctctatgcttttgctatttcaagaagaaatagcaaaattcactatatgaataaaattgcacaatagctaaccttttgtgattgacttttttcccacccagaataacttggagatccatccaagttgttggtgtaacaatagtttgcttccttttattgctaaataatattccatgatgtggatatgtgccactttatttaaccatcaatttgttgaaggacatctgggttgttctggtttttggctactgtgaatataatctgctatgaacatttacatacaggtttctgtatgaacataaattttgattaatctgggataaatgccccaagagtgctattgctgggttatatgtcaactttagttagttttgtttttgttttctttccaagaaactgctcaattgttttccgcagtggctggtaccagtctacattcccaatgtctcatacatatgggtaatgtatgagcaatacagtttctccaaatcttcacataattctccaaatcctcaccagcatttccaaatcttcatcagcatggggtgctgtcactatttttacataagcctttctgataggtgtgtaatgctactccatcctggttttaattagcatttccccaagggctaatgaagctgagcatcttttcacgtgcttgtcatctgtatgttctctttggtgaactgtctgttcatgtcttttacccatttctgtttttcttttttttttaactattgatttttgagggttccttataaattctagatccaaggcctttgttggatatgtgccctgcatatagttactctctagcttgtttttttttttttatcctcttcattgggtctttcacaaaacataaaattttagtttgctttccctctgagatcagtgatggcaacaacgcctgctctcaccactcttattcaatatagcacttgacattttagtacagcaataagaccagaaaataagtaggatgtatacagattgtatacagatcaaaaaggaagagacaaatctatatgcacatggcatgactgtctatgtagaacacactaaagaatctaaaaaaaaaaaaacctacaaaacctctaagagctaataagtaatttcaacaagatcacagggtacaagatcaacaaatgaaaatcaattaaatttctacgtactagcaatgaatatgtggaaactgaaagtacaaacacaataccatttacaattgctccaaagaaaatgaatagggtaaatttaacaaaacatatacaagatctatacactgaaaatgacaaaatgctgatgcaagaattcaaagaagacctaaataaatacacttaccatgttcatggattggaagattcaatacagtaaagatatcagctctctccaattaaactacagatttaaagtaatttccatccaaatcccagcaagttttgtgtagatgtagccaaactaattctaaaatttattagagaaagcacagaccctaggatagctcaaacaattttgaaaaaggagaataacgtgggaggaatcattctatctgatgttaaagcttactatatcactacaataatccaaagggtggtaccggcagaaggatagacacactaatcaatagaacagaatacggaaccagaaataggcccatacaaatatgcccaataatttttgacaaaggtacaacaataattcaatagaggaataacagaattttcaataaatgatattgaaacaactagccatcaataggccaaaaaatgaatcttcacctaaatttaataatttattaactcaaaatggactatggacttaaatgtcaaatatgaacttacagaattttcataaaagaacacaaaaaaattattcaggccctcagctaagtgatgagctgttagacttgatatcaaaacatgatccataaaaggaaaaactaataaaatacaatctcatcagaattaaaaactgtaacttctttaaaagcatttttttaattataatttaagattaggcaaattatggaaatacatttgaattactaatttttaatcagtttactgactataaaacaagcatgactggactgttcagttaagaaaagacacagctttccaaatgtggctgtagtggttaaccaaataatgaagatggaagtgactgcaatgaaatgaagacaaagagttatataattttcacttggagttatgattcctcatatattgagttttatagtcattattgattgtgaagctctaaaactacacttgtgttatttccaaagatgtactggttaacaaagcaaaggaaccattaagacttatttgtaatttacataaaaaataattaattcaaagataaaataattatcttaaagagaattagattaaaaagacaagagaggacttctggttccaaaataacagtgtagaagcaagctggcttcacttctttacaaagaaaaccaaaaccaaatatacagcactgaaattatcaccaacaatatcccagaaatcaaatacgaggagaagacagttcctggatccacagagatgggaaaaaaactctaagtaggcagtaagagaattgggtttccacatctgcaatgcccattcctccaatttgcccagcaccaagagtgcaaaaaatctccacctgattcatgatttctataccagaaaaggtgacatccaggtttcccaccatctgggttacctggcaggaaacctgtccctacctcaacccacaggaagcactacatgtgcctgaagaaagaaatatcctgagaacagtcagaaacaaacaggtgaggtgggactaccatccccagccctggaaactctggtctgtaactcagctaaaggagatgccaaaccagagtggttgtttagtagcaccacattgcagaagatacattgcacaggacccctgggcatgaatctctagccacctttcccacactgccatgatatctcctttgagactttccctaattggaatgagcagctctcttattgtttactggagccaaggcaaacttggtcgtaaggtgacatctagtgccaaaaagaaggcagcaacttagcccctcaccaaaaaaaaaaaaaaaaaaaaagaaaaaaaaaattcgacaggtaaattacatagaatctataaccaaatacattcaataaaaaacaaaaataagccagacagagaacactggaataaataactaatccttcattcaaagacatcaatacaagatatatatttcttgcacatccagaagaaactgcagtcaacacaaaaccatgacctccccaaatggataaagcaaggaaccagtgactgaccctcatgagatagccatataagagctccctgatcaaaaattcaaactagtattaatagctttgaggaaactcagagatctccaaggtaacagaacaccaattcaaaaatttattagacaaacttaacaaagagattgaaataatttaaaaatcaaatagaaatcttggagctgagaaatatattagctgaactgaaaaattcattacagcctcacaatagcagaatgaatcaagcagaggaaagaatcagtgagcttgaaaaccggctacttgaaaatgcagtcataggtggaaaaagaataaaaaagaatgaagatcatcaccaaatatagacaattacctcaaaagaccaaatccaaaaattactggtgttcaagagggagttgaacaagagcaaggggtaggaagcttattcaaagaaataataacaaaactttccaaaatgcaacagatataaatattcaggtataagagcatcagggccgggcgcggtggctcacgcttgtaatcccagcactttgggaggccgaggcgggcggatcacgaggtcaggagatcgagaccatcctggctaacacggtgaaaccccgtctctactaaaaaaatacaaaaaaattagccgggcgtgatggcgggcgcctgtagtcccagctacttgggaggctgaggcaggagaatggcgtgaacctgggaggcggcggagcttgcagtgagccgagattgcgccactgcactcccgcctgggccacagagcgagactccgtctcaaaaaaaaaaaaaaaaaaaaaaaaaagagcatcagagaacaccaaacatattcaacccaaataaggctacaccaaagcataaaataataaaactctcaaagctcaaggatagaggatcctaaaaagtagcaggagaaaagaagtaattaacatataaaagagctccaattcatctgacaattgactctcaacagaaatcatataggccaggaggaagtgggataaattttcaaagtgttgaaagaaaaaaaaaacctgttatccaagaacactatattcagcaaaggtacttttaaatatgaaggagtgataaagtatttttcagataaacaaaatctgaggattcaacagcagcagacctgacttacaagaaatgctaaagcgagttcttcagaaggaaaataaaaaaatacaaaaaaccacatacacattcaaaaagaaaacttttcaaggcataaaatccactggtaacattaacaacatggacaaaaccagaatactctattattgtaatgatggtgtgcaatccatgcctaactctggtatgaagctgaaagataaactcataaaaagccgtaatagctacagcaacctattaagagaaaggtaatataaaaatacacaaatttagataataagcagttgaaatgtggtggggatggagttaaagcatagagtatttttttaaaattttttctttgtttctattctttactttgtgatctaagataagttgtcacttctttaaaatagcttattgagatccactcaaggcaaaaagaactgggaagtccccacagctgtctgctgggcagaaaaccctaggctatgggtgccacatcagccatacacccacggcaacaccgccctgcctggagatctcacacccttgacctactgcatcaacaaaccatctgtaggtctactgcacaattagctctgactcccaagcacagaggatcagcaggcctccagtgtgctgtggatctcctggtgacctaatctttggctcgagctgccccaagggaggagagagcacaggctgccagggttccccttggggttaaagagatgtgggcatggtgccagtgactggagggggctcccctaaggcctggaaatggacctggcaggggatcatcgctaccccttcccaccacccccactgctgcaaatgtgctggaatacaaaagagccatgtgactgagagtctatttgccggccattattctcaagcaccatctactggattgaagcctaaattacaacaccccaaactcttccagtatacactgcctgtgaaatccagtgccagaatctagccacaagtattaataaatatcccatacagagtgttggccctctgaaagcacccagaaataaagccaactgactatactcagcttatgctacagtcaaacccacaagggatacaaagaatataaaaacaaaaagcctcatcgaaatgatagcaaattcaacaagataaaagaacacgtgccctctcagaagagaaagatttaatgcaagaactttggcaattcaaaaagtcagtgcctccttatctccaaacaattgtactagctcgccagaaattgttcttaactaaattgagatggctgaaatgacaaacatagaactcagaatctgggtggtaaggaagcttaatgagattcaggagacagctgaaacctaatccaaggaatttggtaaaatgatccaagagttaaaaagttgacaaagccattttaagaaacaaacaaactgaccttctggaattgaaaaattcactacagaaaatttcataatacagttggaagcattaacaacggaatagaccaagatgaggaaagaatctcagagctcaaagattggtccttcaaatcaattcagtcagacaaaaataaagaaaaaagaatttcgggccaggggtggtggctcatgcctatgatcccagcactttgggaggctgaggtgggaggatctcttggggccaggagtttgagacctgcctggccaacatggtgaaaccccatctctactaaaaatacaaaaactagtgaggcttggtggcacgcgcttgtagtcccagttactcaggaggctgaggcatgaaaattgcttgaacctgagaggtggaggatgtagtgagctgagatcacgccactgcactccagcctgggcgacagaccaagactctgtctcaaaaaaaaaaaaaaaaaaattgaaaatgaacaaaacctccaagaaataagagattatgtaaagagaccaaacctatgactcactggcatttctgaaagagaagaagagtaaacaacttggaaaacatatttgaaaatatagtgcgcaaaacttttcccaatctcactagagaagtcaataggcaaatttaagaaattcagcaaagtcctgtgagataccatacaagatgaccatcctcaagacatatagttaacagattcaccaaggtcaatgcaaaagaaaaaatcttaaaggcagctagagagaaaggtcagcttacttacaaaggaaatcccatcaggctaggagtagacctctcagcagaaacttgaaacttacaagtgagaagaaactgtggacctattttcagcattattaaataaaataaactccaaacaataatttgatattcttccaaagaaagcttcataagcaaaggagaaataaaatccttttcagacaatcaaagctaaggaaattcatgagcactagaccagtcttacaagaagtccttaaggaagtgctaaatgtggaaatgaaagaacagtacctggcaccacaaaaacacaagtacatggcccacagacaccataaaggagatacacaatcaaatctacaaagcaaccagccaacaatgtgatgacagcatcaaaatctcacatattgatataaaccttgaaggcaaatggtctaaatacccaacttaaaaggcttaggatggcaaaatggattaaaaaaataaggcccaaccatattctgtcttcaagagacccatctcacatgtaagaacacccacaggctcaaagtaaagggatggagaaagatctatcatgcaaatggaaaacaaaacgaaagcaggggtcactattcttatatcagataaaacagactttaaaccaacaatgatctaaaaggacaaagtagggcattacacagtgacaaagggaaaaattcaaaaagaagagttaactatcttaaatatacacacagctaacattggagcacccggattcataaaacaagttcttctggacctatgaaaagacttagtcacacaataatattgggagccttcaacacccaactggcaggattagagagatcatcaaagcgaaaaattaattaataaagaaattctggtcttaaattcaacacttgaccaattggactcaataaatatctacagactagtccactccaaaaccataggatatacagtcttcttatctgcacatggaatatactctaagatcgactatatgctcagccataaagcaaatctgaaaaagattaaaaacactgaaatcatctcaagcatactctcagaccacagtacaataaaaacagaaattactaccaagaagatctcccaaaactacacaattacttggaaattaaacaacttgctcctaaatgacttttgggtaaacaaatgaattcagaaatcaaaaaaattctttgaaattaatgaaaacagagacaaaacaaatcaaaatctttgggatgcagctaaagcagtgctaagagtatagtttatagtgctaaatgcctacatcaaagaagttaggaagatcttaaatgaacaacctgatgtctcacctagagaaactagaaaaaaagaacgaatcaatcccaaactagcagaagaaaacaaataaccaaaatcagagcagaactgaatgaaattaagatggaaaaatgcatacgaaagatcaacaaacaattttttttttttgagatggagtctcgctctgtctcccaggctggagtgcagtgacacaatctcagctcactgcaacctctgcctcttgggttcaagcaattctcctgtctcagcttcccaagtagctgggactgcaggtgcatgccatcacacctggctaatttttgtatttttagtagagacggggtttcgccatattgatcaggctggtctcgaactcctgacctcaggtgatccacccgcctcggcttcccaaagtgctgggatcacaggcatgagccaccgcgcctggtctgttttttgaaagaataaacaaaattgatagactgctagctaaacaacaaaaaaaggaaaatctaagcccaatcagaaatgacaaagatgacattacaactaatcccacagaaatataaaagatcttcagagattattataaatatctatgcacacgaaaaatagaaaatctagaggaaatgagtaaattcctgaaaactcccaagattcaaccaggaagaaattcctgttcaagaaaacctgaacagaccaataatgaattccaaaagtgaatcagtaataaaaatcctaccaaccaaaaaaagccctggaccagacggattcacagctaaagtctaccacatgtacaaagaagaactgctaccaatcctactgaaaccattccaaaaaattcaaggaggagggactcctctctaactcattctatgaagccattatcaacttgataccaaaatctgacagagacacaatgaaaaaaaagttcaagccaatatccccgatgaacatagaggcaaaaaaaaaaaaaatcctcaacaaaatactagcaaaacaaatgtaacaacacatcaaaaagataatgcactatgaccaagtgggatttatccccagaatgcaagtataatttgacatatgcaaatcaataaatgtgatatatcaacagaatgaatgacaaaaaccatatgagaatcttaatagatgtggaagaagcatttgataaaattcaacatgctttcatgataaaaaaaaaaactctaaacaaatgaggcatagaaggaacatatctaaacacaataaagacgatatatgacaaacacacagctaagatcatactgaatggggaaaagctcaaagcctttcttctaagaactggaaaacaggtcaagaatgcccacttttaccactcttattcagtataatgttggatgtcctagccattgcaattagtcaagagaaagaaataaggggcatccaaattggaaaaaaaggaaattaaattgtccttctttgcatgtaacatgactatatattcatatattcatatatatatgtatatatatatatatcccccaaaactaatgactctaccaaaacactctaagaactaataaactaattcagtacagttgcaggatacaaagtcgacatacaaaaatcagtgatatttctagactccaataacaaactagctgaaaggaaataaagaaggtgatcttatttacaatagctattaaaaaaaaaaaacacctaggataaatttaaccaaaaaagtaaaagacttctatgaggaaaactataaaacactgatgaaagaaacgaagaggacagaaacaaatggaaataatcctatgctaatgaattggaaaatggaatactatgcagccataaaaaaagagtgacatcctgtcattcacagcaatatggacaagtctggagaacattgcattaagcaaaacaaggcaggcacagaaagataaatactgcatgttctcatttatatatgagagctaaaaaatcaaactcatggaagtcaagagtagaactgtgggtattaaagatgataaggaaaggttggctaacaaatacaaaattaagctagataggaggaatgagctctggtgttctgcatcactgtagggcaaatatggttaattataatttattgtatatatttaaagagctaggagagaagatttttgatgttcacaacacaaagaaatgacaaatgtttgaggtgatgcatatgttaactaccttgatctgatcactacacattgtatacatatatctaaatatcactctctgtaccccacaaatatgtacaattattacatgtcaactaaaaataaaaggaaaaacaacatagatggaatcattttaacagataaaacttgagaataaaaataatcataaaggaaatattgtaatcatcacatctgattcctgtgtctatctcttagctggttccaaattaaaaacaaaagtaaaggattgtgaattattgactcaaactcaattatattattatgtttattttgcaaatgagaaaactagatttgagagaggatgagcaatttacccaaagtcaccaaaatctaaagtatgtggcaaaacaggcagtcaaacagggacccctcattaactcagaagtctacattttttctcacattcttatgtgcttgtcacttatattcattaaaaacaggcacattccatcaacattctctagtaagagtctaaacaccccgtgtaagatacagggaaggaaaaggaaatggaactcacattttctgtgtatctattatgttccagacactgtcctaagccattatttacaatacatactttaatcctcacaaacacccccaggaacctgcagcaagttcggtgagaatcaggtatccaaagctcatgtgcttttgatttactaagttgcttttgaagaccaaatattagtcttccaaatgatcaggctattaaatgtagtgtgtaaacaccaacagcatcagtgtatctgcttgattcacacacttactgaacagttctttacgatggcacagaacacgacatccacacataggaacacccctgtccggcctatgccggcactgcagtgaacaaccatgggtcctgtaaggtggctcttccttgcataacgaatatattttatgaagctatctgctgaggcaggagtgccatggtctggccacttggtgaactgcaactgttttacagagtgactagttcccgtctgttagagaaagaaacagagcgagaaagacatttattgatttcttatattagagacctcacgccaacttctaatattcaaatgataataataatggctatatggtattaccttggtattatatagaactttcaaaaagtactcaaacctctttttgatgtttataagaattctggaagttgctaggaatagaggttttctccattttacaaaggagagcacagtaacaacaataaaaataccagtattaacaggcaacaaaaattaagcacttgctatgtggcagttactatgctaggggcttcacatgaattctctcctttaatcttcacatcaaccatgtgagataggcaccattttatctccattttacagatgaaaatttaaggatgagggggacgagagatgtatgctaggtcagaaggttcacacgtttagagctggaactgtaatgtaggtgtcttgaattctaatctaccatcattcttctgtaccatgaggctacaggaaaaccaagatttcaaaatgcttagagtgagagatggactgtcatgttaggaataagaccaaaaggcaaagtatcttagtttagaaatgacatatgaaatttaattaagacatataggtgtctgacaagagaggcaccgatctcttccagcgatgaagacagggtagtcaatgaccatgagagtagattgtgggtcccactattgtgctgagcccccttgaagtggagtcatgaaactcttcccagcattgtcagataaagcactttgaatttacctatatctcatccaaagggatcatgaccctttcctcagtgtggggcccttattttatcacacatgggaacctaatggaagaactcaaaatgagtttctcacttctcctatgcttctcccgaatgcacctctttttcctaagctttctgaataaagatgctagtgctcagagctctattctaatccacagtgtcgactgaaatttgtgatagttaattttatctgtcaacttggctgagccctggtatccagatactaggccaaatattattttgtgcctctgtgaaggtattttttaggtgagattaacatttaaattggtagaatttgagtaaagcaggttattctccataaagtgggttggcttcatctaatcagctgaaggccttaagagaacaaaaactgacctcccatgagcaagaaggaattctaccagcagattgcttttggactcaaactccaattcttccctgggtcttcagcctactttcccaccctgcagatttgccaaccctccacaatcacttgaaccaactccttaaaattaatctctctctctggatcagtcccataacctgtattcagggatctcaatgttatactgctagaaaaatacacataatcacatattttgttgctactacaaatgtatgggtcaaacctcagcatcactcagcaacccttttcctggtgattgtgctccaatcaacttctttggtgatgactccaaaactcaccattctctgcaagtttcctgttcaactcctattcccttcactcttgttaacacatgtatcacctacctgccaactgaatccactagagcaatctaactcattgctttctcctataaaccattccttttctgttttctaagtctattagaccaaggaatccatgaattattctagaccaatgcttctcaacagaacttcctatactgaagcaaatgtcttaaatagtggcaatatagtagccactatcaacatgccactcataagccctaaaatgtggctacttgcaggtgaggaactcaatttgttattttacataaatttaaataacttaaatttaaacttaaatatccacatgtggttactgtattgaatatattttcaacccctcctctgtcacttataaatcataagtcataagtcacatatgtctcccaattttatctgcaaaacacttgcgtctgtgctttccacccccatgccaacagccgtagttgatcatgtcacttactaaaattcttcaatgtctcccaattatcttcataataaagttcatgctacttagctgaaatttaagacatttcacattctagctggcccctgcttacttttgagaacctcatctcatcttttattactccctggcactgaacttttacatttcagaaacacataactacttatatttgtctctacacacaccttatgctattttatattttgatcatctactttctccctccatctttttcatttgcataattctcaaaacaaatgccacctcctccagtaaacctgtctcaaaaccccaagtaaagccaagtgtttaccttctgagccccaaagtgcccaagacatatctcaacattatcactgaacacggtaagttaggtatctatcagtgagtgtaaccaacctctccactattcggtaagtactgatagtgcctggcccagtgattagcatactttaaggactcaatacgtatctgctacatttggcagaggcaggtataacccagaatcagacaacttcaacagtcactctccctgccccacctctcttttccaattttttcttctccacagaatctggttgaggagaagtagaagtggtggtggcttctggtaccagggacaagtaaaaagttacttaagaagtatcatcgatcgattttccatcctactcctaacttctagttctaagacatctgcttatgtggtgaaacatatatctaatactgatgtttaaaaacttacggacttctccacaacttgaaacattcgaatgatgaaatattgaagtatctggtagttctccaggaatacacggaagtgtttcaattccaatggcttcttcagagaaatgggccagtaatggtagcatttgataattccaccttctatctctctggttatcatggcaataacatttgaattattttccaacaccatttgccaaaagtcatctatggtgctcagcagtggtccttgagtagcgatataaaaatactcttctccacaattgactattctaatataactagcattgatgtagtccttgctttttccaagaggaacgcgtgttgaatcatctattacagaaacagaaacatctggtagataaaggtgggagatacatcacacccagacttcacgaaaggatttcacacatgtaaatccatatatctctttgaccaatagagaagatggcctaggagtttcttttcaaaatggttgagtccatgagtttaaattatttcctccctgaaaactattggcatgacctaagaaatatacaattatgggatgtttatttttcaaatcagtttttaataaatgcagaatgatatcattagcatccaggtacttttggaaatttctgctagaagtggcatgggcaaggttaagtcaagggaagtatcctatagtttgcaactgaacacaacagaggagaaactctttgtgggagtaaatgagtgatattatcctgcaaatctgaaacctgcaaacccagagcagcaggagccaggggaaaaaaaaaatctgatagttgactgcagacaaattctaggattaatggaattccaccactgtccccaaactagacagccatattttatgtccattctcagccttcatctggtgataggacatgttattcaaagcaaagatattgtggcaaaaggatgctaccaaggggaattgctccaagtaatatgggactcatctaacatggactgttataacaaatacgagagggaaaaccagctatttggcctactaaccttcactgctccaggagttccttcttcacctgacacagacatctgaagctctggttccaccaccatccccacagtgagagcagaaacacacacagcaaaggaggcccttctctgccatgcagctctctcaccaataacctctccttactactcagaatcacatggaccacttatctagtaaatatgctgacaagacctgaacaggcatttatataatatctggcagaactcttctcaaattttaacatagcacacagaaactttcccttgtaaatatgaatgaacagaaaaaatcagccaggcgcggtggctcacatctataatcccagttactcaggagactgaggcaggagaatcgcttgaaccagggaggcggaggctgcagtgatctgagaccgcgccactgtacttcagcctgggtgacagaatgagtgagactccatctcaaacaaaaaaaaaaaaaaaaaaaagctagatatataaagatacccggtatttcaaaaagggagaccattctaaaaaatcacaacaaatattctcctttctataaaagatgataacaccttaaaaactcctatttgtatattaaataaaattcaagagagcattaattatttaaaacaatactttatacctatgtttactaacaaatatgttatattactaaattataaaggtgataacaatggctttgtagggagatctttcatcatatttatgtagatatatgatgatatatgtcatataataataataagcctggcaagtgttcatcacaatgttagcagtagttattacagtatctaaaccatataaattacttcatagtaaaaaaagcattttttaaattttgaaatgagattaaatatgtgaaaattaaataatctaaaataataaaagcttgatttcatataaaagtcacaatcattcaactcaaactcctaaagcaggaattgaacagaaaaacaaatttatgtttagaaaatcagcttaaaaaattttcccagaactcagaaaaaaaagattaaaaaaacctacaataatgattaaaatggtaaaagacacagcgcatacaaggggaatgtaaaaaacgaatttcagaagcaaactgtggaattcactgcagaaaagaaataattcaagtgatcataggaaagctccctaaacagaagcaggagtactaacagaatgcagtgaaacatgcataccaggttcaagcagcatgatacgctacatgtatcaccttgtcaactccaaaacaaacctttgagggaggtgctattatattcatacttttcaaataaagaatctgtacaaagtaacttgttccatattatgcagcaatcttctagactccacagactaggtaaatctagactctggtccaaaaataattccatgctctgttgtccatcaaggaagactcaagtttgcagacagaaaggcctaagtgtcagacaacattaatgaagagagccactaagacccctagaccagcagagcataaggccacaggaacaggaacaggaagcaaaaattatgctaatggatgactaggggtaatggcaactggtgccactcccatttccaccccttgattcttgaatcttggctatggtagaaacagcatcatatattggatgctgacatggggcatgtataatctcctgaagaacattaccccagccctgcaaggtactgccacctagctttcactgtaattgagtcttcaaaaggccattcatccattctgtcaagccagccgctttgagaggataaggaatatggtaacatagtggcaatgaggccattgccacaaggtatttgccacaaagtgagttctttgattacagcaatgctgtatggaataccatgatggtggataaggcattctgtaggtccacagatggtaaattggtgggagcactgtgtgcagggaaggcaaatccatacccagagttactgtctattctagtaagaaaaaagcactgctccatgcattatggaagtggtcccagtgtaatcaacctgccatcagctagctggctgatcatcccatggaatagtgcccatcaggtactcaatgttggtctctgttgctggcagattggacactcagtagcagctgtagccaggtcagccttggtgagtggaagtccatgttgctgagctcatacataacttccatccctgccattatggccactttgttcatgagacctatgggcaatgacacaatgacaggggtgactgggggtatagtctagctgatattcatagagcatgtcactctattcacctgattattaaagtctgcccctgctgagatcaacctttggtgagcattcacatgggatacaaatatctttgtgtttgtgcctatctagcaagatctattcacgtgcctcttccccagaccttattgtcaccaatttttccaaccatgttccttcaaattccctgaccatccagctaagccattaaacatagcccatgaatcagtacacatttatacgtctggccatttctccaagcaaaaaacaaaaaaacaaaaagcaccaagtgcactacccaatgttctgcccactgggagttatttctcttcaccactgtccttcagagatgtctcaaaaaaggggctgtagtgctatagctgtcctcttctggctggtacctttatatcacgcagaaccttctgtagaccaggtccaagtcttctcttcttctgtcagctgatcataggcaactcctcatgagacaacaggtgctggctgaagagagcaggtaatgtagcaggggtgggaacagtgagcatttgggcagcttcttcgtgtaacttatttgtgccttcaggatctgctcaagcccaatgttgtatctaccactttcatttgatggtggagtgctgctgtgtatgcccaactttatggcttggtggcccatagttaagcattctctacttagttctctatgaagcagtctctaccaaggcccagtagcaggccaaaagctgtttctcaaaaagagagtccagagagggtggcaggaatttgctctaaaatcctacgtgcctgcactgtgattcatctaaaggggtctgccaaaggtccaaacagcatccttatctgccaatgacacttcaagcaccactggatctgctagatcatacagcccacgtggcagagaggcttgcatggcagactgatcctgtttcagagccttctcttgttttgggccccactcaaaactagcagcttttcacatcacttagtaaatggaccagagtagcacatcaaaataaggaatgtttcctccaaaacgccctggttcactagccattgtgcctcttttttgcttgtaggaagagccagatacaatttatccttcaccttatgattatctccacatgtcccacaacactggacctctagaaatttcactgaagtagaaggccactgaatttttgttggatatatctcctaccctctgacagacaaataagactaaagcatttgctacttcttgttcactagatccaatcagcacaatgtcatcaatgtaataaacctctgtaatatcctgtggaagggaaaggtgactgagatccctgagaactaaactacaacatagggctgaagagttaatacacccctgaggtaggacagtgagggtgtgttgttggccctgccagctgaaagtaaactacttttggtgttcttgattaataggtatagagaaaaaagcatttcccagatcaatagctacatagcaggtatgaagagatgtgctgattttctaaggcaatgaaactatatctggtatagcagctgcaactagagtcaccatctgaggaagcttacaataatccactgtcattctccaaattccatctcttttttgtgtaggtcaaataggtgagttgaatgggatgtgatagatatcaacatcacttcatccttaaagtccttgatggaggcattaatatcagcaatctcttcaggaatgtagtattgcttttgcttttttactattttcctaggtagaatcagttctactggcttccactggccctttcctgccataatattcctcactccacaggtcagagaagcaatgtggggattctaccagtttctgagtatgtttattccaattattcattccagggcttggaaaataatcacaagatggttttagggacctactgagtccactgtgaaatgaacttgaactaaagctccattgactatctgacctccataagcccctgctttgatttgtagaccacagtgatgttttgggtctcctggaattggtgtcagttcagagccagtgtccagtagtttctgaaagttctgactattttctttttccaaatgtacagtcaccctggcaaaaggctatagatccctttggagaaggctgaaagattaacagtatacatttttagcagtgtgccagggtcctccctttcattcaaggtgttctctgtgtgtaaactggctcaagtctgggaagttattgactggttgtgattctctgttcctatggttcaggttagaattttgctcacttgacctagaactcttctgcttacacctatcaaggaagaatttagtagacgtcccatctagttcacttctaggaacaccatgatcaactaatcaacaccacaggtctctacaggtcagactgttctgattgctgctttgactctgctattaccataccatgctcaccttgcctttggctatcaagtgccaccacctggcccttatctctctgggatccaattatacccactgcattcaggtttcccaactcagtggcagcaatttccactgcaatatctgaactacagagaagaacaatcacagtattcttcaaggattctgggactcgcctcacaaatatatttctcacagttatgagaaaagtacatcctctggacctcctggggtgggttggcaggtcttaaatgataaacctaatctaatattccaatctccctaatcctttggatcacagtatatagtatatcgaggcagttctggcattttatcttcatttagactgggccaccttttggtccatttaatacaaccaaccaaataaactgtaagagctctttctaactccctaatccacatattaagtccagaatctcttctttgtggtcccatttcaataaattcagcctgatcaaacactaagttccttccaccattgtcccacacccttaaaatccctccccacaaatatttcccagatttctgtcagtataaattggaaaaatcatgtagctcttttgtagcgtaacatacctccccatgggtcacactttgtaccttacctttaagggcctgctgggacttgagtctagttataggtctagaagcaatgaaggatggtagctgtgagtcttgagaagaatcagcaatgtcttgcaaggcaacaaactcaggggaggtaataaaagtttcctcaggtaaagtagcatcaatctcctcagatgggggtggcatggctgcttttactggcaaggaagactcatcagggtcaaggggttcgatacacccagctttataaggctcttcacatatgtctgcactccagttttcaagatcccattccttctcagttaatgccctcattttaacagcagacaccctaaaagggtggggattcaatttgcactgtaattcagccattttcaggatgagattttgggtttggttttcaataatctcagctttgttgttataaaatataagagtttctttcagggcagaaagagaaacttttgggttattcatgcggcacttgagctgggaaatttaatccctaagatcatcctttccttctctacattaggagtaactagccaatctcattgttctcatgagaactcaaaaatgttctaaggtatcaaatacagatgcccagaaccttgcttcttgtaaatgtctgaataggattacctaatggcaatactttgcatatctctactgtcacattacactatgaattattaatactctattcactactgaaaagtcattaatgcctttacatcttatcagattagggaagtaattcataaaactcatccttaaaattctgttcctctagaattgctctcagtaccaaattctgttactctagattctctagataaatagaatcaataggctgtatatatacagtgagaaagatttattttaaagaactgactcatgattgtggggactggcaagtcaatatctgcagggcaggccagcaggttagaccccagggaaaagttgacattgtagtcttgagtgcaaaggcagtctggaggtagaattccttcttcctctggaaattttagcgtttttttcttaatgacttcaactgactgaataaggcccactctcgttatggaggctaatcagctttactcaaagtctgctaatctaaatgttaattacatcttttaaaaaataccttcacaccaacatctagactaatatttgaccaaatagctgagtatcatagcctagcctagttgacacatgaaattaaccattaaacaagctaaaaattttagtagatgatttgaaggaggaaattttttaaaaacttatattagtttcctataaaaccaagtgaaagaaaaaaataagaataaaaatgagagagagagagagatagagaaagtacttgcaaaactacagaggtaaaagaagtaacgagaaaaggttttataagatagaaccaagaggcaaccctaaaattcatagaaactaaaaaaaaaaaaaaaaaagacaagagtagactgaagagtagaaattacaactaaaggaagatcaattaaagggtttatttgtctaggtaagaatgatggaaatgaagcatacctggtaacattatttaattccaggaaaatagttaaagattttgaaataaaagagcatatttctcatgaagaaaaggagtcagatggccattacagttctcatctaaaacactggaaggaagaggacagtgaagtaacactcagggaaaaaaaatgagaaaaaaaagaactaaaacccaagattcctaaaaccaacaaggatattcgtttatcaggataaaaaaaaaaaaaaaaaaaagtagagcttgagactgcatcaactacttatacccatctccaatcaaacaattaattcatcagaacagtgatttcaaattaagggaaaagggaaagaaaatgaagtaatagcaacaaatactacaaaacatagtttcatatctataagaagaatgacgagagccaggcattccagctacttgggaggctgagacagaaggatcacttgaagccaagagtttgagaccagcctaagcaaaagcgtgagtccctgtttctaaaaaaaaaataaatgaataaaaaattagctgggtatggtggcacatgcccatccccatagtcccaactacttgggaagctgaggtgggaggattgcttgagctcaggagtttgaggtttcggtgagctatgattatgctactgcactccaagtagactctgattcttaaagaaacaaaacagctctgtgcggtggctcatgcttataatcccagcactttgggaggccgaggtgggtggatcacctgaggtcaggagttcgagaccagcctgaccaacatggagaaaacccatctctactaaaaatacaaaattagccaggtgtggtggcacatgcctgtaatcccagctactcaggaggctgaggcaggaaaatcgcttgaacccaggaggcaaagggtgcggtgagctgagactatgccactgcactccagcctgggcgacagcgagactccatctcaaaaggagaaaaaaaaaaaggtttcttgaaataggaaagaaaacaatgtacaataaatacagtggtggttaggcctgggtttgaatcccagatctctctcctatttgcagtgtgaaagtgagaaaattacttatctcttttagcctttctgtaaacaaggacactaacatactgacaccttagaggtaggttgttgtggggattaaacattactacctataacagacttaaattagtaataagcaatagtaataaacatattagtgttactactactattattattagtgggtggtagtagcagaaacaaacatagagcaacctcaagaagtacagaaagaagcttgttaaatctctgccttgaagagcttgttttcccatctatctatattataatgctgaagtgtatgaaaattttttaaaagtgtaatataccttttgcactcacaaaccacctttttaacagtttatggaggtaaaactgtcatacatgtgcacccatgagaccaccaccacaataaagataattaaacatctccatcagtgcaaaactatcctcatgcctctttataatctatccttcttgctctcatcttgccccaaggcaaccactgagacgttctgtcaatacaaattagtttaaattttctaacattttatatatgtggaagcatacagtatattagttttctaggtttgaaatttattttcacattctggaggctggaagtccagtattgttatggtttggatgtttgtcctctccaaaccttatgttgaaaactgatccccaacattggaagtggggcctaatgggaggttttgagtcatggagacaaatcactcatgaatagattgatgcccttcctcagggttgagtgagttctcactctattcactgctgcaaaaaccgattattaaaaaggaccaggcacctctctctctccctcttgtgtcctctttcaccatgtaatctctgcacatgctgattccacttcaccttctaccatgagtggaagtagcctgaagccctcactagaggcccaatcttgaaccttccagccagcagaactgggaattaaataaacctcttttatttataaattaaccagccccaagtattcctttatagcaatacaaaatggaataagacagaaaattggtactgagaattggggtgttgctataaagatacctgaaaatgtggaagcagttttggaactgggcgatgagtggaggttggaagtgtgtggaaggctcagaaaaagacaataatatgagagagtgtctggaaaaagtgcccaaaggcacttcagaaatatttggggccaccccttccctaataggccccaaggccttctggggacagacctggagcaccactgcccttggccacctcaggatgctgctccccacatcctggctgctctggctccagcagtgggtcaaatggccccaggtagggtttgggccactgctcctgaggggctaagtggtaagccttggtggcattcatgtggtgttaagtctgcaggcatccagaatgcaagggacatggaggcttggcagctttaacctaaatttcagagaatatattaaaaagcctgggaaagcaggcagatgcctattgcaggagtggagccaccaaagagagcccctaccaaggcaatctttagtggaaatgttgggttggagtttccttagagtccccaccagggcaactcttagtggacccacaaaggtgctggaaccccacaatagtagagctatccacagcattccacctcagcctgaaaaagctgcagcattattacaacccatggaagcagccagtggtctacgcccagcaaagctatgggggaagggctactcaaggccttgggagcccaccccacacaccactgtgaccaatatgtaggagatagagtcaaaggagattattttggagctttaagatttaaagtgtgccctgctgtgttttggacttgcatggggcctattatccctttcttttgaccaatttttcctttttggaatggaaacatttacccagtgcctgtaccaccattgtaccttggaggtaaataatctcttttttgattttacaggcttacaactggaaagaacttactttgagtctcagatgtgactttgaacttttaagttggtgctgaaacaagttgacttttagggactattgggaaggaataattgtattttgcaatgtggtaagaacataagttttaaagggccgggggcaaaatgctatgatttagatgtttggcccttctaaacctcatgttgaaacttgattcccaatgttggaagtggagcctaatgggaggtgtttgagtcacaagggcacatccctcattaatagattaatggcaggagtgagctctcactctattcgttctgcaagagcctggtacctccccatttctctcctgcttcctctctcaccatgtgatctctgcatatgctggttttacttcactttccaccatgagtggaagcagcccatagccctcaccagatgcccactcttgaaccttccggtctgcagaactatgagctaactaaatccctttccttcataaattattcctctatagcaacacaaagaaactaagacaaagatcaaggtggcagcaggcttggtttttcctgaggcctctctccttggcctgccaatggctgccttcttgctgtgtcttcacatggacctttctctgtgcctttgaatccctgatgtctcttgtgtgtcccaatttcttctttatataaggacatctgatggattggattgggcacactctaagaacctcattttatattaattactactttaaaggccctatctccaaatcaggtcacattctgaggtacaaagggttggaacttcaacatacaaattttgggagaatttaatttggctcataacacacagtatatactcttttgactggcttatttcactgagtaaaattattttaagattcattcatgttgttcaatgcattgttagtcattttttattgcctagttgcattctattatgtagacataccacaatttgtttattcactcttccgttgatgggcatttgcactgtttccagtttttggctattataagtaaatctgatatgaacattagtatataagtctttatgcagacatatgctttaatttctcttaggtaaaacatatgaatagaactgctaaatcatatggtaggtacatgtttaactttattagaaacaaattccatttcattgcagtgagtgtaaaatggtatctcattatggttttaatttgcattttcctaatgatttacaatggtgaatatcatttcatgcatttatttgccatccttatatcttccctgagaagtgtctgctcaaattttttgctcatttagtgttgggttatttgtcctcttcttgatttgtagtaattatagattataaatataagtttttgtgagataaatgttttgcctgtatttttcttctagcctgttgctttcctttttggttttataataatatgctttgaagagcagggttttttttttaatttgatgaagtccaatttattttttttcttttacaatttgagggttttgtgtcctatttaggaaaaatttgccaaagccaagggcagtaacgttttctcctagggtttctttcagaagttttatgtttttaactctaatgataggtctataatctattttgagttaatttttatataagttgtgaggtaagaatcaaagttcatttttggtacatgaatatgcaactgtccagatgatttgttgaaagattatcccttccttattgtcttgcattaaatttagatattatcatcttctctgttcttctcacatgatcatacagaacactcaatgagaaatatataagcatgctctgaaaagtgagaagctaacagaaacctaagtcactaccttgattagttctgaataggtccctgatagataagtaacagaaaaaatattaggccaggagttggggaacctctgtgactcgctcttttattagccttcaaactgctttgtaagttgtgaaatggtaaagaaatggaagatattgtctttatacctaaaaattcctatactacataataaaggccattcttgcttggcatgatggtacagggccataaatatgaccatgcaagttgaaaccatgcgaaaggacctttgttgttgttgttgttgttgagacggagtcttgctctgtcgcccggggctggagtgcagtggcgctatctcagctcggctcactgcaagctccgcctcctgagttcacgccattctcctgcctcagcctcctgagtagctgggactacaggggcctccaccacgcccagctaatttttttgtatttttagtagagacagggtttcaccgtgttagccaggatggtcttgatctcctgacctcctgatctgcccgcctcagcctcccaaagtgctgggattacaggcatgagccaccgcgcccagtcacaaaaggatcttagtaattaataggaaatattattcttgtttcatggctcttaacattttttgtgaaatcattaaaaactcacttattgctggctatacatatatagagaagcaaaaaatagcaagactaatatttatttagaacattgtaatttaaaacattagaaatattgggaattaaagcatttaatttgttaaaaaaaaaaacaaaaaaacaaaacttacccagagtagtttgaacagtgtttgcctcttctttttgttgtataacttacaatacagagtgagcattttttctatgtctaggctaacttccaagtctggatcagtttccaccttttatccttggcacttatattgttgtgaaatagctccaaagtttctttaatgtcaagttttctaccatcattgcttcccctaggttgcctttatccttttcctcacaagcactttggtcattcatgtcggtaagttccccttccacaggtgccttaggctgcagctctagggtcttttgagcagtagcagtgtcagcatgtccctggtcagctagttcttctataactccattcaaatttcatttccaacattatcactttttatccctttattgcagtttcatctctctcagccaaatctctctcttgattatacattttggtaaaaggtcataggggtttaccattgagagacaaggagacaatacaatcacatgctttgctgtgtgtgaactgaataagaggctcacagttacctatcactgacatattttgaaagaagtaacatttattagtcactggtcatgatgcacatctgttatttacatagggacttgtggactaaagtgccagcaaagatgcttactactttaggcaattacttgcagtgaatatattgtggtaactaaaatgtgaattgtactgtgggactggtgttatttagctaaacacagtaactgatatttgagcatattggggccatgcaaagtgaaggttccctatatttgcagtgttcaaaggtgtgtgaattcatctatttagtgttctcagcatttgaagacgacaaataaattacttctttagctttcttaatatgagtcttcaggaaccttttctataaagtcaagaaatgtgtgattaaaaaaaccacagagctttctatgatggccacttaagttggctgagtttcagattagattacactgcgttatgaggtagatataccaatgggcctttaaaaagaatatggttgaattatagtttcttttcttttatgaaaagccaaaagttttacataacttcccttactttaatgatttaacattatttttattatctttgaatttcttagttgtaactcttttgatatccagaataaaaacttcaagtcagatcaaatattatgtgtaccttctattgtaaaatgagcttcttacaatcccgagaggctaatttttaaggcatgtttgcttttagtctccttgagggcaaactgcacatgcagaaatagaaattataaaatttggacctttgacattttggagaagcaacaaattattagtattatttattaaaatgtctaatcatggttcattattctgatttcagaagtattcatcaatgcacttctccacactctccccacagaagataacagaatagcttattttaaccatgttggatatgtacttgttttttatcatcataaagttagtttcaattctaataaaccaactaaacatgaaggtatttatctagtgaccgcagtcactgtgttccactctggtttttataataactatctcaagtctagtaggagaaacaaaagtgaaaataattaaaatatggtttggtagaaggggagagtggttacaagatgctgtgagactactggaaaaacaccaaacctagctttgaggaaaataagaaaagcctattggagctggttaagaaagatagcaggaactgcctcagcaaagaagggatgagtagttctttcaagaactgcaggttaagaggcataaaaaccaacaaataagaaaagaattatgaattctagataccaaaagaagttttgtgggagagctaaggctagagaggcaaacaggtgaaattcttaggccatgttaaacaactgtaccatgatagtaacaaagagccaagaaagagctttaaaagaagagctacatgttctgacttgcattttaagaaaatctcagtagcttttgtgaatgatcagaaagggaggcagtaaagaagaacgtaaccagctgagaggtaaaatgggctcagtctaagtcagcagcagtgggaactgagagatgggggaggaccccagaggtattatggaggtagaatcaactgactccctgttttctggtttgaacttggtgattacataagatatagaatataagaagagggtcaagttggaggaagtaaaatagtaaatttagttttgaaaaactttgactttgaaaggaatgtgagttatggaatgagatatcctgcctaagattaaaattgcattgctgtgttttgattctgctctttgaatggcctgagatggataactcctaagagtaactgagtgaggaggacagaaggtgccactaccctcccatccaacacagggaagcaacgttaaggctctgtggagacaatcaaaaggcagcctcctgttggagagcagattagcagctttattgtccaggatgaaggatgcaaatagctcttttttcgcgtgtctaaacaaaatagccagagaaggtggttaaggcttcgggtaccaaaagtggtgtatgactcagactattggattttatgttttggaaggctcatgctctgagaagcagcaatatatgagaacaaggctgaaggactgctgtaaaggaccctgtaacagtggctgaaggatgtaccagaaaacagaggacctgactctctcatatctagcacatatcttagaatatgcccagatcacccagtgctatgtaccagaaccctttatcatggtcacaggccaaaatgtctcatacaaaaagccatacagtgccctttgcactttttctaaatataaacaggaaaataatcaaaactatttttagcttacatggaagaatatctcggtatctgtttttttctctgttgcttggttgattcccagagttgaactcaccaggcagattcttaagttctaaagcctttaaaaggttaaaaatgaataaataaataaataataaattgtgtatttactataaccaataaaaaagaaaaaaatatgcctttgtttagtgctcatgatccttaaatccctatatgacatgacctgctatttaatgtgttgtatgataagtgaagctagatcctcatttaaaaagtgctatataaaatatctcaagtttcacatgccaatcaatgagttggttaataagaaaatgttaaactttctggagatactttccacttgaacttcattttcttcttctttcataaaaaaggaaatacaagctattcatttctcagaacctacccacagatctatcattttataaataaaaataacaacataacaacaacaaaaacatataaacaaaaaatatatacaaacagtctcacaatttacccttcccctttgaagaaattatagttaggaccctaagaatccttcctttcaaaaaatttctttaccaagtgtgaattcaacaaacacttattacacatttagtaggtacctggccctgtttcagacactggaatacagggatgaattggataatggcctcatccttaaggagtgaagagagtagttagaggacatgtaatcaaataccatgtgaccaatgtacggagacagtagtataaatgacagcactagattgcacctaaaagtcaagaagaaaagctcctcaaagggaaatagcccttgaactgggccttagtgagtcactggaagttagcatatgaaaaacagtgtgtatttagaaggaaagaggagagaaggtgaaggggtggaaataatggaggcatacatgtccctttgggaaactgtgactaatatggtaataagagcacaaagcacatgatctagtccaacaacagactaaaactataaaatatcttgtttcatatataaatgaaattaggaggtagctagtcatactttattagaatatttgtggagaaagcctgaaaatctatacattttcaaagctcttgggtaactcttgtgtagccaacctagcaaccgctgccatggggaacaaggagcctgtgaaggttttaagtagtacaataaaatgatcaagtctttctgaaaatcaattttaaaattaatctggaaaaaattctgtaggaagaatgagaaaaaattcatttatgaatgaataatgatggcagatgagtctcattagatgttaaaagataatatgaagctatgctaattaacagaacaataccaataaaggaataagaaaatcagtagaaaaagtccaagaataaattaaaatatatgtaaggctctagtatatgataaaagtggcattttacctcactcaagagaaattccaggagagtcttgggacaactggatagttatataatgctgagtccctatcaaacatcttataccaaattaaattctagctgcatcaaagatttaaatgcttaaaaatcataaaggtactagaaaaaaacatgaagtaattattacaatcctagagtaaaagaagcattcctaaagagcacagaaagccccaaacccagaagccccaaaagcaaagattgccatatttgaccactaaaaatcagctatttcttcacggtaaataggcatgtgtgtgcacatgcatgtgcacctgtgtgtaacacaaacaacagcagaaaaaatactacgtgtaagacacacaaaggcataattttttccttaaagagttagtaatcggccaggcgcggtggctcacgcctgtaatcccagcactttgggaggccaaggtgggctgatcaccttaggtcaggagtttgagagcagccctggccaacatggtgaaaccctgtctctactaaaaatacaaaaattagccaggtatggtggcaggcacctgtaatcccagctactcgggaggctgaggcaggagaatcgcttgaacctgggaggcggaggttgcagtgagccaagatcgcaccactgcactccagcctgggggacaagagcaagactcatctaaaaaaaaaaaaagagtaaccaataagaaaaaaaaaaaaaaggaaaatggggcaaagaattgaaactagcagttcactgaaaatataaaaggcttaaaaacatatggaaagatattcttttgttctcaaataaataccaattaagtaatcaataagaaataatttgtcatttaagagatgagaaaagatccaaaaaattgatagcccaaaatattaatattgtctttctaggaatttgttcaaaaaatatttaaatatatgcatacagtatatgaagagagatgaccgctgttcataatagcaaagactagaacaacctaaatgtccaaatgttccatggtagttaattatatggataagtaccctaatttcagaaattaaatattaaataaattaaggtacttatccatataattaccatgcaacacttaaaaaaatgagatactgctatacatgctgataatatacttggaaattgtatctaggaggaaaacaaatttaaggatgtaaagtgcattccgacaaatttttttaaaagtttgcatgacaaaatgacaaaatgaatagtgtaaaggggccctagaaagtcttgagagaaagagagagactttctattttatatccttttatgctatttggctttttttttaaccacgtacatctattactttaaaatatatataatatttaaaagtaaaaacaatgtactagaaccaaataaagaaagaaaagaaaagaaaccctctggcaatgatataaaaaaagaaatcacatatagactttcgttaagaaaatatttaccataaattcctgcatgatatcatacgctgctgttttttcctcaaggattttcaaacaatccttgatggctgtctgctcatgaaaattgaatattaatggccgaatctgagccaactgatctagttctccttcagaaacaattttgcgcgtatctaaggaagagaaaaattcacatatgtaagttactggtatatatgtgaagggagattttatttttgtttctgtttctcttaaagacacagccatttaagggtaaacagaagtttatttttccacgggtgaagagtctactactttgaaagaggcttcctttggaaaaatcatggctatttacaccttgaaattatacaaaatccactgcccttggagaaaactgttcagtgccataaacataacgaatgctgtggattgagaagtgttcagttttataatgtgaattgggtatatggattgaaaattatgccaaggcaagaacgtccaaggcttggattaggaaagagaacttttgccctccctgggaccaagtgtttggaagttcctagagtctgagatgtggtgacgtggagagttcacgtcctgtttcattactctgaaacagattgaacatgaacgcacacacgtgcacacacaccaaggatggagaggatctatgcaatataattaataagatggaataatggatacgtatggacacttgcaaccaataattggggagaacattctattaatatttaatagcacacatacaatctttttatttttaattatgatcttttaggtaatgttgacagtcaaggttccaaacatctgaaattttatacattatgtccactggccaaaatgcaataaatctagaagtcaacagtaaaagagtattttaaaagcttcaaaattttgaggtaagatgttcaagtaaaacaagttctcataatctctttgcaaagccaaataatgtgaacaataatcaagttaataccagcaaaaagatatatacaaaacaatatagcaaaagaaagaggtggaaatttctaagaatctgcacattcctgggaagcacatcttatcttggtactccactatatccagaggctctttgtagggttggaagtgagggctcttggttgggatagacaggcacagaaatcctaaaatttctcacaaatatccctaaccttagtatgagaggaggtctaagcaggctggaaggggagataaaattcccacaagcgtagaagccattttgatcatctttgatgcccaacagaaaaacccttagatcttcccattgtgttccacctttgctagtacaaaagctgggagaatgaagagagaaaaaaatgaaaatgtagaatgactgtaacaaacactggtgttgactccccaacactgattctacccctctggttagttaaagccatttgtgatcattccatagtaagatccttccagtgaataattcagaaataggtaggagatttgcgccaaccatagaaataggctggtcttgtaaaaaagagaagcaaacctctcttctaccctcatccctctgtacagacataaacaaagaagtataaggacctaattatcatagtctgccctcttatggccataaaaggaaagcgtatagcaaatgtgaaaaacataaagaaactatgttcttgatgacattagcaactgatcatattgaacctggaatccttcctatctctgggcttccattatggtagaaaatatatatatctttatcattaacatcattctgaatttggtctctttttcttgtagcctggtccaagaattccaatcaaagtataaaggtgaggtttcagctgtagatcctgggaatcatttcagccagtttacagaaagggatttgatctagctatttggtgttgtatcaccattgtgtgggcttgaagaacagatgcctctctcattatgatccaagaacaacactgcataatggtctgccaagaaaagttctgtctttgccacaattaggaaactgaggaagttggagaccattttttctagccactggctcctagatgacaccacttcagcaacaatggagaaataagaaagtcactaccacaactgttggctctagtaacacatcaccttacctataatgaggaccaggaacgccaagcctgctatgatgcatagcaataaaatggatgcctctctacacatttacatcttggctaagtgcatatgatcggcaaagcccaaataagctaccaggaagtcttgaaaatgtaatttttcatttttctgcctgggccatacaggaaggtacactaggagaagggtgtgactgatattgagtaagggcatctgtgatatctgcttaacatttcagccacaccatgccctttgagtatcctgctccttggcccctatcccttcagcacacttatcattgtcctcgggcaaaataaacaatgcagccctccaaaatacagtttacaagggaagatgatgagatccaaataaaaatggaaatcaggaagaattcattcctgctcaatcaacaaaaccgaagagacagaaaaagctatacatgttcataacaaaatggaataaaatgtgaaacacagaaaaaataataatataatatagcatgcagaataatttttaaaatctattctaaaatggaagataagcttaaaaaggaaaatgaactgtgtatgcaacatctgtcgaaagaaaaagaaaaattattttaaataagagttcacaaggagataagaaaacaatagaatgaggtttaaaaaaattagtttataaacctaagaaaataaaggtaaaactcaaaagtacataattacagcaataatttataattaaatcgaattctgcaagaaacaaagcaggcagttgaaaatcaacttattgccataggacaaaggcatgtatacatacagtaatgaagacaagaaaggtttaaaaacacagtgaaaagataatgcatgtgaggacctcatcagaggctcaggagaaaagctgcagacagggtgaggaacttgagaaatcctccttcgtggggcaagcttgggaaggggaaaaacagcatccacaggaatggcacaaagcatgcccaaaatgcttttccctatttccctaatggaccaaaagcataagaacctgagaaaacgcatgaaactctgtcatcctcaaggcacaaatgaagactcattaacattgggggtagggaagagagaagagcatcctggacccaggccataagatattccctacacctgcagaatggacaaaataataaaggaggtaccgcctgaggccttcctaagactgagactgaacaaggacagcagagaatgtcaccccaaccaggttggcaagcaaggtaatcataagtaagagctctctactgctgggaattagagaagatcatggagaagaccttctctgaggtgcatgtacaatgggaagagctaaagcagagggtggagtaaacactgaggcaaatcctctacatgtaaggtaacactggaggaatttgaagctggtggtgcactaagggtaaccatagcaacatcaaacccaagccctgctgcattactgagtaaattgatgcaactcctcacactgaaggcctaccaacaaaagagtcatgtccatccctatttacctcagcgtctagaacttagctaagaaatactacaatagctcccccttatctgcaggggatatgttccaagacccccagtggatgcatgaaactctggatagtattgaacctgatcgtcatcaactgaaacatatttttgttcatgtcttccacccataaatttaatgccttttccatcttaagtaagcatgtatcatgcactgtggccataactttggcactctgatgtgcaacagcaaaacttggatagaagattcattcttaccataggtctacgcaactttagcatatgatttttttctttccttattaagtcaagaactttcaccttttcatgtaaagaaagcactttacagcttccctttggcatatccaaattgccagcatcactactctttggggccattactaagtaaaataagggttacttgaacacaagcactgtgaggccaaaacagtagatctgataaccaagatgactactagttgactaagagacaggtagcacatagggcatgaatatgctggacaaaggaatgattcactcccaggcaggacagagcaggacagtgtgaggtttcatcacactactcagaacagtgtgcaatttaaaacttattgtttatatctggaattgtccacttaacatttttagtctgtggttgactgcaggtaactgaaactatgaagagtgaaaccatggataagacatttttacttctatctctagactatacaatattcagttttcaaccaaaaaattatagagtacacacagaagtaagaaaaagagaaaaaagttgccaagagacaaagcaatcaacagaaccagacagagatataacatatgttaaaactgtcaagtgatgaatttaaaatagtgataatcaatgtgtgaaaaggcagtgggaaaagtagacaatatacatgaacaaatggagaatttcaatggagagatggaagccataaaaataataaagtggaaatgcttaaagtaaaaaaaatattgtaagaaattaagcatgttattgataagctcatcagtagatttcacagaggcaagaaaagaattcatgaattacaaaatagatcaagaggaattatccgaattagaacacagagaaaaaaggtagatgaggggcagaggcagagaagaagagaccatccaagaactacaaaccaatatcaaacagactaatatattatacctgtaaatggaatcccaaaatagaagagaaggagaattgggcagaagaaatatttgaaaagataataactgagaattttttccaaaatgaatgaaagacaccaagcctcagatccaaaagctcatcaaaaacaatataagccagaagacaattgagtgacaactttaatgtaatcaaagaaaaaatcaaaataaagaaattaagatttcagtaaatacatgactaattataaaagctagtattcttgtaacaataatgtgtaacttcactttttcttttctacatgatttaagagatgactttttcctaaatttattagcctaaaaataaaaaaattatcataactttagattgtaaatcaacattttgttttctacatgagaaactaaagcattaaaaacattattttatgttttggaacacataatatataaaaatgtaattttgtgacaacaaatgaaagagatggggtcaaaactgtcaaaggtccacagtttttttttttttgtattttactgaattaggctggcataaattcaaattagagtgataagtttaggatgttaaatataatgcccatggtaaccacaaagaaaatagctaaaaacaatacataaaggaaattttttaagaatttaaatatttcattacaaaaggcaactaaatacaaaaggagacagtaaggcaaaaaaaaatgaggaacaaaaaagctacaagaaatatttttttaaaatagcaaaatgacagaagtctctccttatcagcaattactttagatataaatgaattaaactcaccaattgaaagaaagattggcagaatggattaaaaaataaaaacatgatccaactatacactgtctacaaaggactcactttagatccaaagacacgaataggttaaaagtaaaagaaatattccatgcaaacaggaaccaaaacagagcatgaatagctatattaatatcagataaaatcgattttaattttaaaaagttaaaaatgacaaagaaggacattatatatcataaaaggttcaatacagcaagaacatataacagttataaacatttacacgcctagtaacaatcaaaatacacaaagcaaaaattggcagaaatgaagagagaaacagttttacaataataattgaagatttcaatatcccattttcattagtggatagaacaattagacagaagtaagaaaagggaggacttgaacaatataataaacaaagtatatctaacagatacatacagaatcctctgtgcaacaacagaccacatatttaagaacacatggaatattttgcatgtgttaggctataaactaagtatcagtcaattttaaaacactggtatcacaaagagtatcttctcaaaatacaagagataaagttagaaatcaaatataagaaaaactgataaacttacagatttgtgaaaattgaacgacataattttaaaacaccaatggatcaaagaaggaattacaagggaaattagaaacatttagaaatgagtgaaaacataacacaacatatcaaaactatgggacacagcaaaagcagggttaaggggaaatttatagctataaatgcttacatgaaagaaacaaggcctcgaataaacaaactagctttacaacgtaaggaattacaaaaagaagaacaaactaaacctaaagctaacaaaaggaagaaaatagtaaagattagagcagagatcaaaatataaaatataaaaaagagaaaaatcaatgaaaccaaaagcaagttcttcaaaaatatcaacaaaatgatgtgatgaacctttaattagataaactaagataaaaagagaaaagactcaaactactaaaatcagaaataaaaatgaggacattactaccaattctaaagaaataaaaaagattataagggagtactatgagcaattgtatgcagaaaaactggataacctcaatgaaatagacaaatttatagaaacacaaaacctaccaaaaccaaaccacaaagaaacagaaaatctgaacagacctatgactagtaaggtgattgaataagttatcaaaactatcccaaaaaagtaagccctggatccaatgccttcactgttaaattctatcaaacatttaaaggagaactaacaccaatacttgtcaaactgtttaaaaaaattaaagagtagggaacactccctaacttaatctatgaggccagcattatcccaatatcaaagccagacaattatcctacatgaaaagaaaactaaaggccaatatccatcttaaacattgatgtaaaaatcctcaacaaaatagtagcaaagcaaatatttagcggcatattaaaaagatcatacaccatgactatgtgggatttattactggaatgcaaagatgacttaacatacaaaaatcaaggtaatacaatacgctaacagaaaaaaaggcatgcttatctcagttgatgcagagagagtatttgacaaaattcaacatcctttcaagaatatattctttttgagacagagtttcactgttgcgcaggctgaagtacagtggtgtgatcccagatcactgcaacctctgcctcctgggttcaagtgactctcctgctctgcctcagcctcagcctcccaagtagctgggattacaggcaactgctaccacgtctggctaatttttgtactttttctttagtagagacatgttgcctagggtggtcgtgaactccccaacctcaggtgatctgcctgccttggcctcccaaagtgctgagattactggcatgagccaccatgcctggcctatttgtttgtagaaaaaaaattcaacaaactaggaacataagaaaaatacataaacataataaaagttatgtatggaaaacccacagcaaatatactcaatgttgaaagagtaaaagcttttcccctaagatcagaaacaaggcacggatgccacttttgccacttctatttgacataatattggaagtcctagtcagagaaattaggaaaaaaaagaaataaaagccatccaaactggggaaagcaaaaagtaaacatctctgtttgccaatgatatgatattatatgtagaaaatcctaaagattactggattttacacacacatattcacacacacacagagttaaaaaaaataaattcagtaaagtagcaggatacaaagtcacacacaaaaatcagttgcatttatatacactcagatgaacaatctgaaaatgaaattaagaaaacaatttcatttacaataatatataaaaagaaataaaatactttgaaattaacttagccaagaaggggaagggaaagatttgtacaaagagacctataaaacattgctgaaaaaagaattaaacaaatatatctcatgttcatggtttggaagatttaatatcattaagatatcagtactacccaaaacgatctacagattcaatgtaatccttatcaaaatcccaatgactccttctgcagaaatagaaaaactcatcctaaaattcatatggaatttcaaaggaccccaaatagctaaaacaatcctgaaaaatatggggaaaaaagactcacacttcttgatttcaaaacttactacaatactacagtaatcaaaacagtctggtacaggcatagacagacatataggccaaaggaatagaagaaagagtccagaaataaaacccaaattattttcaaaaaagttatcaaggccatttaatgggaaaaacacagtctttacaacaaatggtgctgggaagctggatatccacatgcaaaataataaaattggatctttaccgaacgccatatacaaaaattaacttgaaatggatccattacctaaatgtaaaagctaaaactataaaactcttacaagaaagcatggcaataacttcaagacattggatctggcaatgattccaaaggtacaaacaaattttaaaaaatataattaataatactgaaatatacacttaaaatggataagatagtaaatgttatgttatgtaagatttacaacaataaaaataatttggagaaaatacctctaagtaacccacagatcaaaggggaagtcataagagaaatagggagacattttgttaaaaatgtgtagattgtattttttagaaaagttttacatgaaaaaaaaatgagcacttagaattcccatatatcccctgccaaagtttcacttattattaatgttttacatttggatggtacattcattagtattgaaccaatattgatacatttttgttaactaaagtccatcctgtattttggttttcttagatttccttaatatctttttactgtttcaggagcccatctaggataaaacattacatttagttgtcaagtctccttgggcaacttttggctatgatggcttctcagattttccttgtttttgatgaccttgataggtttgaagagtactggccaggtgtattcttcaatgccttactattgaaatttgtctaattttttctcatgattaagactggggttatgggttttcaggaataagatcacagaggtagagtgccatatttatccatagtatcaagggtatattatatcaacatgatgtatgacagttgatggtgaccttgatcacatggctgcagtagtgtttattaggtttctctactatgcagttattctttgtactcctctggccatactgtactctttgaaagaaagtcaatatgtgcaacccacacttaagaggtgggaaattatgatccacttcctttaaaattgaatattaacgtaatttatcaggaattcttctgcatgggagatttgtctcttcttccccatttattaacatatttaatcatttatttatatcagtatgaactcatggatgatgattttatacttcatactataatccactgctacattagattgttgttcaaattgttccaccttttgctacttagaatgagaaaacattataaattgaatgaaaataaaaacacctcaaaatgtgtgggatgcaactaaagcagtacttacaggaagatttgttgtattaaatacttgtactactgttgtccctctgtatttgcaaggaattggttccaggacctcccacagataccaaaatcctcagatgctcaagtcctttacacaaaatagcatagtatttgcatataatctaagcacaccctctctctcaaatactttaaatcatatctagattacttataatacctaatacaacataaatgccatgtaaatagttgttatatttttaaaatttgtaattttttgttgttgtattgttatctttgttcctaaaatatctttgatccatagttggttgaatttgtagatgcagaatctacagataaggagggccagttgtatttatgaaaaagaaatatatcaataatctaagtttccaccttaataaattaagaaaagataaaataaaatccaaagcaagaaggaaaaaggaaataataaagagcagaaatcaatgaaattgaaatcaatgagaaagtaagggaaactaaaagctagttcttggaaaatatcaatagaattgatacagtctctagccaaactgatcaagaaacacagaacaaagacacattttatgaaattgaaaaaaaagagaggtgatcagttaagataagacatcaaaaagttaatgagggaatattacaaacaactctagtcccataagttagacaatttacatgaatgggacaaattcactgaaaaatacaaactgccaaagctcattaaaaaaaagagagacacctaaatagtcctatatcaattaaataaattgaatattgttatgggctgaattgtggcccatatgtggccgtatttggagacagggtttataaagaggtgattaagttaaaatgaagtcattagaatagcccttaacgtaatataactgatatccttataagaagagattaagacacagatatacacagtgggaagaccatgtgaagacacagaggaaagacggccatctgcaagtcaaggagagaggcctcagaagaaatcaactttgctgacatcttgatgtttgactgctagcccacagaactgtaagatccattcttggatattttgttataaaagcacccccccaaaaaaaaaaaaaactaaaaactaaaaactaacacaaatatgtatttagaaacctcacaaattctgggtccagttggcctcactggtgaattttagcaaacatttaaggaagcaatactaccaattttatacaaacttttccagaatattgaagaggagaaaacacttcccaaataattttataagggaagcattactctgatactaaaaccggaaaaagatatcacaaaaaaagaaaattacagatgaatatctgtcatgaacataaacacaaaaaaagtcttcaggaaaatactagcaaatcaaatcgtaaaacataaaaacaatattacaccatcacaaagttgggcttatcccaggaatgcaaagcaggtgagatatttggaaatcaaccaaagtaactcatggtatatcaacaggcaaaaaaaagaaaaactatatgatgatctgaatagatgcagaaaaagcatttaacaaaagtaagagtccattcataataactccgggaaactaggataataggaaggctcccttaatctgataaatggcattcacaaaaatactacagcgaacattatactttatgatgaaaaacagaatgctttctccctaaaatggagaatctggaaaggatgtccactccctttcctcttattcaacattgaaccaaaagtcctagcgaatgcaataagttagtaagtcaaaaaaaaaaagaaagaaagaaagaaagaaaagaaatgaaaggcatatacattggaaaggtagaaaaataaaactgtgtttattcaccaacatgagtatctacttaaaaaaattccaaaaaatatatttaaaaggccctagaattaatgagcatttaggaaggttgaaggacacattggtaatatacaaaaatcaatcatatttctatctactatcaatgaacaatagaagttaaaatatttttcataagtctcatttacaatagcaccaaaacatgtgaaatattagatataaatctaacaaaacatatatacaatctatatgttaagactgcaaaacaaacaaacactgatgaaagaaatcaatgcagacctaaacagagtgaggaatgcttccgtcaggagaaacaacaacaaatccgttaaagtggaatttgagaacgccaccaggacattttgggttcctcatatgctactgaatcatcagggaaagggggattactacactgcctagtgtgctggattccaagtattaaggggaaactgggctgctgctttccaatggagtaacgaggaatacgtctgcaatgcaggtgatcctctagggtgtgtcaaggtgattaagtaaacagaaaactagaaccacccaatttaggcagaactactaatgacttagatcttgaggaatgaatgtgtgggtcaccctatcagacaaggaaccacaaccaaatgggatgtttgctgagctgaaagagaataccagacaggtgtaagacggcagtgatcaaaaccagatacaaccatgtgaccagctgcataaacagggataaaatattgtgaatttttctttcttttttgatatgcatattttatacatatatatatatcatatttttgttttcttttaaaaatattaaagggaatgtgaatcagttggaaaagaaagaatatcactcaagacaaaaaagagacacttttggagaaggggagagaatgttttcagttgtacacagattagttttatcactgtagatgcaagcataaggttgtccttatttggatattaagtaacatttaaaagggtgtatataggtgccaggctgatacagggtgaactgtgatagctttataatatgttgacatggctaggctggaccacttttcccagaattctgttctctgaatgtttccagctaaaacagggcacaagcgaggttctcatgtcagatctggaaggtgaacatggggcagcagctattctgtgctcagatgcactatggatgatctcctgactcccctcattctatatgtggaaggaagaacttaaaatcacaacagtgccaatcctacctgaatgaatataactggcatgtcattctatctaaatttcaaacaagtttacacaggaatgaacaaaataatttaaaatcaccgatgcagcaaaaacttgcccaaatagctacaaaaatgtattttttaaaaaattagagggaggattttcctttccagatatatttagaataagtagaatcaaaacagaataatataatatgtccacaggaacaaacaagtcagttagtgaaaaaaaatttagagaatacaaaaggatcaaacatttttggaaacttaatatgtgataaaagtatatataaattcatttgggaaatgtggtttacttagtgaatagtgctggtataactgtccagtcatatgaaagaaaatatagttttctatacccctataatatttagcaataaactgcagatagattcgtgatctaagcaaaataagtgaataaaaattctgaagaaaatttaggagaatatttgcatgtttttcctgtaaagaagacctttttaaacattttagaagttaagaatgttcatgaaagtctcccttcttaaggtatagaattgagggttacaatttatagcacatttgtcagacagacaacatgttaagatttccaacatgtgaagagttcctacaaattaataagaaaaacaatgaacaaagtttataaatatgcaaatccaagaagaagttaataaacatatattaagatacttgatcctagctgggcacagtggctcacgcctgtaatcccagcactttgggagaccaagacgggtagatcacaatgtcaggagttcgagaccagcctgaccaacatggggaaacctggactctattaaaaatacaaaaattagccgggcatggtggctaagcttttggaaaggaatctggtattgcccattaaaatataaaacgaacataaactttgacttaactatcttactttagggaatctaaccaaaatcaaagtaccagtacttaggaaatacgtgtaaatatatatattgcagaaaaagtcaactggagaatgggtgaatatattatggtatttccatacaatgaaatattagacaactattaatcctatgtcagaatatgtcttaacctatataataatatagtttaaattttaaaaactatggttgcagggtaattgtagagttgcagagcacacatcaatttttatttaaactttaaacagaaaatctgtttttatatctttgtgtattcttagataaactattatattggttgcctctgaaccaggattcaggatgatgggaggaaattattaactttttctctatatcattctatattgattttcactaaaatattagcatacattaactttataatttaattttttaaaattttggcttttaaaatattttattaaatgttaaataggtacaaaataataattaagtaaaatatctttaagaacaatacatacccaatttaaaacagaacattagcccctgatgctcctgtgtccccttcccagacctcattccttgtcctcctccctcagggaataatcactattctgaattgtactatcattccttttgtttgttttgtttaccctttatgctgttttgcatatttcacaaatttatatagattacattattttgttttaaatcttgacttttttgctaagactgcatctgggtttattcatcttcacattaaacaaaatacaatatctaattcatacatgctggtgttgacagatatctgagttgtttacagttgaagtctattaaaaacaagcctagtatggacattcttgcatatgtcttctggtagaaaaaggaaagagtttctctaagctaaataaccaggaaggaaattgctaggacatatggcatgtgcacactaaaaaaataccaaattattttccaaaatggtttccatcaagccacatactcaccaatatcaactattatcacatttttaaaaatggaaacaatctagtcagtgtaaattattatttcactatgatttaattttcacttccctgattcgaaattaggttggaccactttttcatattttctcttctgtgaaatgtttgttaatgtgttttgcccatttttctatttggttatcttttacttactaatatgcagtttcttatattttctaggcattaatcctttgtgagcatagacctcagtaacagaccctaggaggagcctaaccatagtcctaaactgaaactgaaaaggagggtactaagaaagaaaaaagcagtgtctatctacttttccctaggaactggccttactctaacagctaagaaatggtatttcctgtttgcaaagtaatgtgttcttatttttattttaaaaatatatttatattcaaaattccacttctgcctaaatatagaaagctagtatgagcatcactcctaccctaacaatatacataagttgaaaaaaaaacactaaatcaaaattttattgaacccattagagagctgaggttgcagggcaaccaagtagtctgcaatctaaggaaagacagactctcctaaggagtgacaggacatgaacactggctccctgtggcagttcaagggagaaagagataccaggcactatacaaatgggaaagaagtattcagacataaaatgtaatgcactgctgatagctggatgtgggccagtgtgacagtacagaacagcgtaaagccacagacacaaaaagaacttgcacacattcacagactcaagttcacagacctccaacaggtgctcataagaaagactgagagcagagcaggaaacgggaagaaccattccctcagaagggtaggcttggaggaggggagccactgtcatggtcgaaaatgcgtaaagccccacttagacctatttctcccagaacaaaagccttacactgcaggaggaggagcagcaatccctgctttgtataagtgtatacccactgcagttggaaacagagcaaacaaaatccatctattcctggagaaggtgcagaaaacagtcctaagcccaggatttaatgccattattattacaaaactcctaccactacactaagtgaaggggaggaaaccttctccactgtagacttgccaaaggtgtcaggcagagtctggatgccatgagaaggggtagtatcactaaccaagcctgtcactgaggaccagggacagaggacctgcccaaggctgagaatggaataggacaacaaagaatgacttggccctccctccccaggcacgcaagcaccagtctactgctggaagataggcaggagaaggaaagaaagcccttctaaagcacaggcacacaggggaggcctaaagctgaggacgaaacaggaagagaccaaaaataaaaactccttagcaccccagctgacaccctgcgcacaagctaaatcctaaggaattctaagccaatggttcaccataggtaatgagagcaacacaaaaccaaaacccagctcatgtcctaaatggcctaccagaggaataggcatgactatttctaggcataaattctatttactttagtctctttttttctacacccagtaccaacactcaatcagatatatagacacataatgaagctgcagcagctgcaacaacagaagccagtgtcaaaaagcaaagcaatcacagaaaaaaatatcagcaacaacccatctgtcagagttatccaccagggaattttaaataactatcattaacatgttaagctctatgaaaaatgcaaacaaaacgcattaacaacagagacggaatctgtaagaaggtgtcaaatggaaatgttgtacataaaaaacactgtgtgctttcaatgggttcattagtagacttgacacaaccaagaaaggaatcagtaaacttgaagaaaggttgacagaaattacctaactgaaatacaaagagtaagaagagtaggagaaaagaaaagtaaaaagcaacaaataatgttagtacagcttctttggaatacagtttgtctgttatacacttatgacccagcaatcccactcctagatatttaccttaaagtaatggaaacttatgtttacacaaagtttgtgaatatctgtagtacttttatccataattgccaaaatctggaaacaacccagtgtccttcaactggtgaatggaatactattcaataaaaaagaaattaaatactgataaatgcaatgacacagatgaatatcaaaagaattatgctaagtgaaagaagttggactcaaaaggctacatatttatgattccatttatacaataccttgaaaaagacaaaagtaaagagaatgaaaatagattactggttgctaggcaccggtggtagggtaaagggttaactataaaaaaatacaagagaaatttggggggagatagaaatgtactataccttgattgtgatggtaaaccttggtcaaacctcatagaactgtatgctaaaagggtgaattttactgtatgcctcagtttaattaagcatgttttaattaattaaaaattatgtctcgttttataaaagcatattcttataaactatttttgtaggagatctgcattttaataattgcataaggtgatattttcttaactggatttgacatttttcaaataaagtcattagagaagatgtttccaacatttgatgggatgttggttatggatgacctctaagatcctctccaactccaaggtttttgaggtgtgcatgtgatcccccaagtttacaaacacaaattttataaatatatatatatatatatacacatacacatatatgttaagtatatattcatagttctaattacatttatattatatatacatgtaaatacgtatacacaaaaagttctgaaatattcttcagtattataatttattatatatttgttattttctttttttccactataaacatgtgataatttgtaatccaaaaatgttattattttacttacaaagcatatattgtgcaacaaatttttaaaaaggaaataaggaagcaggttatttttcaaatctataaaatacctagctttaaaaaaatggattttactaaactgacatatttaatactttaaaatacttgaagaaaggacaggaattagccattgtgaatatggggtgtggagcatttttttaattgcatttttttatttttaaaagaaaatcctagaaaaccatattttcccatttttgaagttttccctagctctttctttcatttgtattagaaatatctttgtgcatatctctaaaatagagcctcaacttgctactacaaataggatgatgtcataccagaaagtagaggggagagagcctgtgatggccctgcagcctcctcatcctcactgctccacctgtctcttctgaaggggcctctggctgtccacatgctgggatcactgccactagaaaagaaatgtatatatttgcccatggtttcaaagaatatatacatttgagaaatactttctaatcatcttcattgattatttaattgacattcatttccatttcaattcagccacccactcccattgtcatcacctgaaactggcccacttgtgaaataattcccaaatcccaatatctgatcacaaactccatctcctcctactacttttaccttgcaaactagtcgcctcagatccatccacttatttaccttctcccctcctttacctagactgtgggagggaagtactcgggtcactgggctttctaatatcggcagagagccgtttggaaaataccagcatgtccctggttggtttcctgtaccactcttccatggcagcaaattccaagccaccatcttgttatagtccttattttaatactctctctgacttagtaaaaatgtaacttcttctagaaaatgcaagccagaaaatagaaattctttcaatttattatcttttaaaacatttacttagatgcatcaatgtctttcttattccttgctttctgcctgttcaaaattcctccttccgtgttcttaaccagattccttctgcctcctctaaggtatttttctataacttatttttttttaacatatcgtgaatttctccctatctacaaattctttcatatcataagaatacacaattttctgtatcttaaaaataggaaatgctttaaactctgtctagctactaattgttaacagatttttcaaatcctagcccatacccactttgtttcctttgcaacgtctccatactcaactgactcgctaatgctattaacttggctcttgttgcactttcatttgcaaccctacctagcaaaatcctcctaatttgacttctgcatctaaccttcaatgtttagagaaaattcttcctaaaatacaaacttaattacacctgcccaccaatatcaggataaatcaaggccccttatcagacacaaaagtttaggatattggccaggtggcctctgtctatttttccatcaccatctccactgatttcctacatgcactgtatgctttaaccttagcaaaataagtgcctttttcttttacttctgtaagaaaattcgggtttcttactcttttctccttctaatttttttcttggattactgtaaacatttaattaatctccactgactgccacttccagctatcctcaccttgccaccagcattcctccttctggatggataaatagatagttgcatgaataaaacaaaaagaccctccgtatgcatccttttgattttaacagactgaataaaatgtatactcagcttcacatatatggcattacttccctctccagcccacactgtattttgggctccacctctcatcttctgcagcttcctagcattccacctcacatacaccctacgactcttggcacctaatatttctccccattacccctaagatattttcacaactccttaccctcgctcaaacttctccctcttgcctgaaatgttcttctctttttcacctgctaggtttctatttaattaaatcctaaattcaaccaaaatatcttttcttcaaagaagcttgtgggaaacctccctcatgcatagtcaatcttctgtacccacaatctttggatttttactctaaaataatatttactatgttgtacatcaatttgtcttttatatgtctgtttccctaattaaactgtgaactaaagagcaaaaaatatatagtagtttgtatttgtgtacagtgcttagtgtatcacagaatctcaaaatgtctttggaattactattatttgtttaatgcacttctgaaaattgtacatataaatttcatacaatacgcatacaaaaacacataatataaagaatatacacattcttatacagtgctattccagtgagggtagctaatattactgataaatctctaagaaaatatggcttaacaaaatgtttcctcatttgatgtttttgcttataacacctaaatttgaacattttataagcatgaaaacttgtttctttgttttcctaatggaaatttactgttcttcaggtactttaaattttttaaatatatactaccagaaattcaccatactaataaacctgttgtttataccatataattttctttctgaaaacagattacatttctaataacatttagtgctgtaccgtgagcttcatgctacctcaagtacactgaccacttcaaaagctccaagcatatttgcaaaagctttgacgccatgtaactattgagaggatagagaaatcgaatccttcaagaatacttttcccttatgttaattaccatatttttgagatcataaacatatttctaagaaagctaaatcaagtttataaaaagctatatcttgaaaaattaaacatttcagggccattattcactgtctccatgcagagggctagctatgaatataagtagcataaacagaaaacccactaaataagcatattagttatacctttctgaaggctcttcaaaaacatcctcataatcattatgtgggaaattccgaagagaaagttttaccttctctgaattaactttattttcaaaaacctacagacataagaaaggaaacaaattatagcactggttttagaaaaatatggtttaaaacgtgatttctatagctacttaagaagagcaaaaagatctgcaataatggaattataaccacaatcacatagtataatgtctgctcctagaaaatcacttaattgtatatctccctattaaatatcttccaatctgtcaaaacagtgtagagtactatgtaaacagaagttatttatattgaattgctcaagtgatttttcaaaactaaatttttaaaaagcttcatttgagaaaaaatagatttattacttcagcccagaagagattttcttataagtgtttaccatgttttgtttactgtgaatataaaattcctgccactaaatttatctttactttagtacttgcaccatctaatctactaattctaagtatttctccacattccactgcccaattttgcaccgggcagtggacttcagtcttgataactcgcagtgccagtgccccagccaccacatacacgtttccttccttccttgtctaatactgtcttgccatacttggccttctattttctcaagaacatcttttgaatcagctgatcaaatctcattcacacacagaaataactttgggactattattgaaattaagtaatatgaattttttaatttaaattggaaataagtgatgtatttatatattaagtatcattatccactaatatgatatagctatccagcaaaaagattataaaatattctcaataaagacaatgtataccttttcttagatttactcctaaacaccttaagtggcacaattgtaaatgtaatgtcatagagcagaccttttatttgatacacactgctcaatccacaaaccacatgtttttacatctagtatttttgtgtacattccattctaaatactttaaacttccattatgatttcttctttgactaatgagtttgttagtgtttgcttggtgtatgtttaatttttactttaaaatcacaggaaaatgtccacctaagattccttctcattaaactatgtagctacaatacacgaaatgaaatgagcttcacagaattgaactagttttgaaatcagcactgattggcaaatccctaaaaattaatttcaggataattaaaattgaaatgtagaaagtgtggctccagtgggatggaggaaaagaagtgggacacatgctattacacaacatgatcccacttccctcttacgagacatgcttaaaagtcatttgagtacaattcatttacttagaaaaagtgatatctggaagtcctaacacaatttaaacctgagacatctttcagctcatggttcaaaatcaaatggattatatttattttttaaagaagcagactgttccagatggctgcaattcaaatttaaggctgactaacatatgtctgattgagtgaaaagtgattttgctaacaataccaagaactaacaaggagaaatataataaattatcaagatggcaggacttttggagattgctcacggaatcaaattaatatcaaattttttaaatgttagaaaatgttttctgaggagcctaagttagcttttctgtagtccatgcagcaaggatttatgaggacaaagtgaaaacagtaacacagataggagcctggtttctagtctgtgactcaagagttatatgatcatagacaaatcgcttcagctttcacctctaaaatgagtgctggcataaaaatgtctttaacaggccaggtgtagtggcttatgcctataatcccagcactttgggaggccaagacgggtggatcacctgaggccaggagctcaagaccagcctggccaacgtggtgaaaccccgtctctaccaaaaatccaaaaaataaattagcctgtctcaaaaaaaaaatttctttatgctccaaatctaaccaacttcaagtctatgagtctagacaatttctaggggacagcatcatatctgaaaggacataaaaatggctacagtatcaaattgtttcatgaaacataagaaaagcaagttctaataaaatcaggtaattttcccaacactataaaaaccatccaggaatgttctaagatccttttttatgaaaggaaactttaaagcatatcagaattcaccctagataggccaagctataacttagcaaaaaaacaaacaaacaagcaaaaaaaaacccaaagtaaaaatataaacaaaatcacaaaatgtgctcagttctagaagaagtcaaataagactataagactatataaaggatatacttgggccattctgtgaaggtgctccctttcaaatcgtctctgcttcaaagagaaaaccattctgatcagagaaaagaatcaagagtgagcggagagcccaacacggcactaacagccagagattcccagccaaagatgtgatggtagccttgatgtggccaacttaagtatagcagagaatggacaggagataataatcaagttacaacactgttcttaaaagctgcactcctgcccacctggggtggaggtggcaattgaacaggggaagtggtaggagcagtttttggtctatgtactgactttatctctattactcctgtaacttacaggaaatgaacacaaggccagcatcatcatcgcagttccaaagctccagttgactaggtaagagaaaaaaaaatgcaaagcacccaccagactaaaatgcatttccctttttttgtgctctaaccctagcactatctccacaaatggggtaatgtgttgaagtaagaggttttgtcacagacttttcacagccctctacttttccatagttcggagacacccaatcatgctgtctcaaacaatgaaaaagtccacaatcaatacatctaaaggtgcttcatacttcatgtgacatttattttgtatcttcattagtaacacaaaactagtgcctgtaaaatttccagagtagcattagaaaatgcaattcattagaaactttgcaaaaaattccactctttcaaatccccattttggtcactgtcaacactacagtgacaaaaaattaagaaatcattttggtgagaaccaaatagatacccatttcccagagagcacagtcagcaatttaggtattagccaaaattagtagagatccctctccttttagtcttacctttgatctaggtgtgttttcctgacttgatgaaggcaaagtctccctgaaattcaagtcttctgcttcagagtcatttccctcataatcgtttactgaacaaaggcggggggaaaaactgatcaaatagaaaacactatacagaaggaaaaatggagccttaatgagaaaaaacaagctacatgaggggcattttcatctacttttcctgttttccaaacaccccatctttatctcctatggtaatcatctctttctcccctgctttgaaaaaatcaacatagcaaagctgatccttcttctaggattatcctcagggagttgacttttgagcggttcccttgttcctcattgccatattattcaagaaagtactcttcaagtaaatcctagatatttacaacctgcagaacctatgcattgggatctacagaatacagtcttctgtgtttcagagtctatttcttgaataaagaatactgtgttacaaatgtcgcactgtaacttcttgtattatttataattcataagttagtaatatgttaaattatacagaaaattgttttcggctttgttgaataatgtaatatgaatcatcccaaggaaactctgggtttcttatatgattattcctaattactgtgttaattttactgcacagactctttcagataagaagccaagagaaaattttctctgatctcagtactgagcactcagagtactgtttctcataccatgggagccttaaatattatgatttagaaattctatggcatggcatattaccaaatcaataaaaatatagtaaacaagtactatggaaatgaaaaagtgtgttcctgaatgtgtgttaaaaaggaaatctaatagaaattatgaacctttataacacatgaattaattttataaattaaaacattaagaaatatcaatgaagggacaacatatcaaaactaatgtgaagtagctaaatgagtatttagatagagggaaaatgtataggtttaaatgtgtttacaaaaaaggcagaaaaaaaaagctgctataaatgagttttgtattcaatcatagaagccaaagaaaaactgaggaaacccagagaaactacaaaggagaaaatcataaagaaaaatataataacagaaaataagcctaaagaataatcagcaaaatccaataaactagttctttgaaaaaaaaaacttaaaaatacgcaaccctctttcactacaaatcaatggagagtaagtgcacaaataacattaaaaatgaaaaaggatcgcttctcggccttttggctaagatcaagtgtaaaaatgagaaagggcacagctacagatgcaactctcatttttaaaggtaataagcaaatattatgagaaactttagggaaatctgatgaaatggaaacttttataagagaattataagttatgcaaatttactccagaagatgtagaaagcctaaatagtgtaataaccatttaaaaagtcaaaccaataatcaaaaatatcactcccaagaggaaaaagcatctgggcccaaacaggtttccagatgggattttatcagactttcaatgaaaaaaatctctcatgcaaacggttctgaaaataggaaattccgcaaacctaggaaggagcttcaagtgctagaaaaaaaattaacaggaaaaaaaagtctatgagaattgtaaacaagcaactcatagaaggcgacttacaggccaataatatattcagaaaaagtccagcctcacctgacaaacaaaaaatgaaaagtaaaacaacctacaattgactttcatttatgcttatgagagatttactgtaataggacttaaccacaaccaaccagaaaataggacaaaatatataaaacaataattttcagaccttaaacaacagactgtgatcccagagagaagggggtgagccttctggttgctccagattatggcctccagaagtttgcaggctatagctcaggaaaggaatcaacgagtccagtgattcaatgagttgagaagaaaaagatcaaagttaggagaggctgaggcagccagaatttgtagggcagagtaccagggaggagggagctatacagaacaagagaagtctaagtagctgcaaagaaaccctctcatgtcctttgcagaatatggatatgcttatatgaaggaggacaatctctgacactcaggaaggaccaccggaaagtagcaagccacacaattcctaggaacagttcataggagccagaatgaggagaccctgtaatacagggggcgttgaggatagtgcacagaagagatacctcttagtactaaaactatccttggaacagaagctccttagggccacctataaaaaaggtgaagagcaagcctcagacaggatcaggttaaacttcaagtaacataactacaaggcagaaaaacccaacattctttaaagaaaaatcaaggccgggtgtggtggctcacgcctgtaatcccagcactttgggaggctgaagagggtggatcacgaggtcaggagttcgagatcagcctgacaaacatggtgaaaccccatctctactaaaaatacaaaaattagctgggcatggtggtgcgcacctgcaatcccagctactcaggaggctgaggcaggagaatcacttgaacccaggaggcagaaggttgcagtgagccaagattgcaccactgcactccagcctatgagacagagtgagactctgtctaagaaaaaaaaaaaaaaaagaaaagaaaaagaaaaaagaagaaaaaaagaaaagaaaaagaaaaaatccagcaccaaaatcatataattcacaatgtgtagtaaacaattaacaggtatgccaaggaatagaaaagtataacccacagccaaatcaatcaatcaatagaaatgtacttagaaatgacagatgataaaatttagaaaaaagaacttttaactattataaatttttaaaaggtgctcaaggaaataaagaaaaacatgatacaataaaaagagatataaatcatgtaaaaataagacctactgaaatttctagagacaatgtatgaactaaaataaattaacagcagataaggcagaaggaaaaaaaatcagtgtctgtcaacatacagcaagagtatatccaaaatgaagcgcacagtagcgaaaaaaagagactgaacagactcagcaaactgggacaacatcaagtgaactaaaattcctgtaactggaatgccaaaacaaatatgaagaaataatagctgaagtgttaccaaactagatgaaaactataaaccaacagaccaaagaaggtcaataaaatacaaatgtaatatatgagcttatagaaaaatcacattcatgtatgtcatattcaaattactgaaaagaaaaaatgccagagaaaacagacacattaaatatagaaaaacaaagataagaatgatggatttctcatcagaaatcatgcatgctagaagataatggtgagacattttaaagtattgaaagaacatagaattcttatagaatgtcaatatagaattctataccctgaaaatatatatttcaaaaaataagacttctgtagaccaataaaaactaagattatatccagcctgcactaaacaacaacaacaaaagttaaaggaagtttttcaggcacaaggaaaaggataaaatatgaaaatgtagaactatccaaaggaatgaagagtggcaaaactggaaaatacatgagcacataaaacatactctttcacatgttctaatttctttaaaagataactcaattataaggaaaaataataatctattgtagggtatacaacactcacaataaaattggtatcaataatagcatgaaaggcaaatgggaggaaatggaagtatcttatgttcctacaactatatgtgaaatggtaaagcagttcccgcttacccacagggaatgcctagttccaagacccccagtggatgccgaaaacttaggatagtacttcctgcactgaagtcttaaatccctcaaagtcatccatgagggttaaaatcagtttttcccaaactcccattaatgttgacattttgacctcctcccataaaccacaaatgttcttaatggcgtctagaatggggagttatttccaaaaggttttcaatttactttgcccagagccatcagaagaatcactatctatggcagctacagccttacaaaatgtttcttaaataatgagacatgaaactcaaaattactcattgatttctaggctatggaatagatactaaatcaggaactaactcagtaatttaaaaaaacctaccaatcagaaagagcccgggccagaaggattcacagtcaaattctaccagatgtataaacaagaggtggtaccaatcctactgaaactatttcaaataattaggaagagggactcctccctatctcattccataaggccagcatcgttctgataccaaaacctggcagaacacatggtctaatatccagaacttataatgaacttataaatgaacaagcaagaatcaaacaaccccgttaaaaaatgggcaaaggacatgaacagacacttttcaaaaggagacatacacatagccaagaagcatatgaaaaaatgctcaatatcactaatcatcagagaaatgcaaatgaaaaccacaatgagataccatcttacacaagccagaaaggctattattaaaaagtaaaaattaaaaaaaaaatgtttgtgaggttacagagaaaagggaacacttatacactgctgatgggaatttaagttcaaccactgtggaatgtggtttggagatttctcaatgaacataaaacagaactaccatttgattcagcaatcacatcactggctatatgaagggatataaattgttccgtcataaagacatatgcacatgtatgttcatcacagaacttttcacaatagcaaagacatggaatcaacctacatgcctgtcaacagtggaatggataaagaaaatgtggtgcaaaaacaccatggactattacacaaccataaaaagaatgaaatcatggctgggtgcggcggctcatgcctgtaatcccagcagtttgggaggccaaggcggatgaattacctgaggtcaggagtttgagaccagcctggccaacatgatgaaaccctgtctctactaaaaatacaaaaattagccgggcatggtggcacacgcctgtaatcccagctactcgggaggctgaggcagaagaattgcttgagcctgggagatggaggttgcagtgagccgagatcgtgccactgcactccacctggctgacagagcgagactctgtctcaaacaaaaacaacaacaacaacaataaaaaaaaaaaacaaaaaacagaatgaaatcatgtcctttgctgcaacatggatgtagctggaggccattatcttaagtgaatcactacctgggtgatgagatcatttgttcaccaaaccacagcaacaagcaatttgcccatgtaacaaaccttcctatgtacccccaagcctaaaataaaagttggaaagaactagtctacaaaaaagtttgggtagctttccatgtttttgcatattctagcttaactgatttatcattaaaattagctttttcataaaagtttgcaactgttaaaggatagtttccagaaaaagaaaatcacagctctcatacagacatataaatgcacatgttactttattatattcattaatcagtgagggaatcaggcagatgttatttttaaatttttttttaaaaaacccataatactgtgtgttagtctgttagcatcactacgtaggaatgtctaaggctgggtaatttataaagaaaagaggtttgttctggctcgtggttctgcaggctgtacaggaagcatggtgctggtatctgcttctagtatctaacctcaggaggcttatagtcatggcaaaaagtgaatgaggagccagcaaatcacatggtgagagacaaagcaagagagaaggggaggttccagactcctttgaacaatcagatctcacatgaactgagagagcactcactcatcaccagggggataacaccaagccattcacgaaggatctgcccctatgatccaacatctcccaccaggttggggattacctttcaacatgattagaagagataaacatccaaactataccatacaggaagtccttgccagagcaattaggcaagagaaacaaacaaaaggcatccagattgaaaagaaggaacaattaggcaacagaaacaaataaaaggtagccaaattgaaaaggaggaagtcaaatttgtccctgtttagagatgacatgctcttacaaatgcaaaaacctgaagaatccaccaaaaaactcttagaactgataaacaaattaagtaaagttgcaggatacaaaatcaacatgcaaaaatcagtagcatttctataaaacaataacaaactacctgaaaaagaaatcaagtaagcaatctcatttacaataactacaaaaaataatacctaggaataaatttaaccagagattaaagatctctagaataagaactataaaaaattgatgaaataaattgaggaagacacaaaccaatggaaagacatctcatgttcatggaataaaagaataaatatttttaaaatgacaatataaccaaagaatctgagagctcaatgcaattcctatcaaaataccaatgacattcttcagagaaattttaaaatcataaaattcatatggaagtacaaaaaatactccaaatagccaaagcaattctgagccaagaaaaacaaaaacaaaataaaaacaaacaaacaacaacaacaaaaaaacaagaacaaagcttggggtattacactacctgacttcaaaatacactacaaatctatagtaaccacaaaatcatgatactggtataaaaacagacacatataccagtggaatagaatagagaacccagaaataattccatatgtttatagccaactcttttatgacaaggcacaaagaacatatattggggacaagaaagtctcttctataaatggtcctggaaaaaactggatattcctatgcagaataaacttagactcctatccctcatcttacacataatctgacttacagatggaatccaggctcacaaaagcagatagcagaatggtggtttccaggggatagaggaaggaggaaatggggagttgttggtcagatggtatcaagtaacagttacacaagatgaatacgttctgaagatctgatgtatagcaaaatacatacaatactgtattgtaatgatatttgctaagagggtagatcttatgtttgtaatacacacatacacacaaagaaagaaaatggtaactgtgaggtggtggatatgttagcttaattgtggtaatcatttcacagtatatagacaaatcaaaacatcaagttgcacaccttatgtatacacaatttttgtcaattatacccgataaggattggaaaaacacttctagggagagagcaataataatgacaaggagggcggatagaagagggaatagaagctgggctgaaggtggaaggaatgagaaaaggcataaaagacatactgaaaaatgatggcaagctactaatgttttaagcaagacaatggcaatatgggtcggctgggagacagctgacatttaactaaaacactgcattagtagatgtatcaaaaaccttagaaatgtatatgccctgagttcacagctaacaaaattatggaaacaaacagctttgtggcagattacaggttgtttttattgtcttgttgttttctttgtgttttggtgcttttttgtacttcccaaattcttcacaataaacctatattacatttataatcaggaaaaaaaaatgccatttgaaaagggtaaagtaaaacactagagtttaattgttgttactctaagcgtgatggcttattagaaatgcagagtcttgccccccaccccaccccaccaagacccagaggatcagaatatgcaggataataatccacaggtggtccctatgcaaatctacagtctgagaggcactcctgtagctcctcctgatcccatacccacaaaagtagatgatgcacctaccaggctctgctctaaagtccctaggtgaagacatgttgttcccatcccctaaatgagactggtaaaaggcttcttcagaaaaggagccttagtgtcctgtgagtcaggccaaaggtctagttagtatcctgggggccagcaaacaatttttgttcacctggtaaaacacacaaagccaaagatttttctgttacacaactggagctatcacagctttgacatattattactcatcaattcaaaatatttaaaactgcaattttaattaaagacaaaataaatttcatttgaaattttatcaaataatttcaggatattccttgagaactggagatacgcttatttattcaaataccagagcttaaatatgctataccttgcattccacaaataaatatgtgaatggcccctccactccaatgatgtatctctttatataaacacacacacacacacacacacacacaaattcaatcaatgtcactcaatggaaactcagttatttaaatgccacacctaagctaaattaggtgctgagaattcagtactgaataaataagaattaattacagagaccgtcttcaaggagttcttgttcattcaatctataaaaagttctcacacagaataaatcttttttcttttctaattcttgccataaagggcctgtaaggccatgttacattgctcccattggttaaaaccaagaatacttttatctggagacctttccattaactacctgcaaataaaatggtattactataatctgaatctaaagttaatgtgtgaaacagatttattttaaaaactttgagatataggtgttaaaaaattatttaagactaggtgtagtggctcatgcctacaatcctagcactttgggaggccaaggcaggaggatcgcttgagctcaggagtttgagaccagctggggcaattgggtgaaaccctgtctctacaaaaattagacgggtgtggtggcacacacctgtggtcccagctacttgaaaagctgaggtaggagaatggcttgagcctgggaggaggatacagtgagccaagatcatgccactgcagtctagcctgggcaacagagccagaccctgtggcagaaaaaataaaattaaattaaattaaaatgtgaaagtaaggcaaaagataagtggaatgtcacttcaatgtcataaaataatgacaggccatcccaaagattacttatgtggggaaattgtactttattcagttcattgtttactactgattaaaagtcctagacttaatgcaattacaacgtaacctatagatttttgtccagcagtgatacaaataatttctgtctgataaggtaacactaaagattataatttatttctgtctggcattaaccaggttttcttaatctaatctagcattcttactctaacattggttcaaaacgccagtgaaaaacctagatcctcaaactgttctttgaactacctttgccatcttcctggtttcttcactaattaatacattgagtaaaatgtttaacctggtttcatttcaaatttgtgagtcacatttataatttttaaaaaactctgctttgacaaggggaagaatatcttttttaaataggaggagggctaggcacagtggctcacacccgtaatcccagcactttgggaggccgaggtgggaagatcacttgagctcaagagttcgaggccagcctgagcaacccagtgagacctcatctctaccaaaaattaaaaaaaagaaaaagatagccaggtgtggtggcactcacctgtagtcccagctacttgggcggctaaggcaggaggatcacttgagcccgcaagatggaggctgcaataagctatgattgtgccactgtactccagcctatgcaacagagcaagactctgtctcaattaaaaacaaaaacaaaaggatggcagtgttcttgtgactggcagtgaggtaacagatttcagtaaggagccttccctggaagcagacatgagatcttaaggacctcagaattaactaagaacctctaagaatgacacctaagcttctgcctaccaactatgttattgaaaagatacaaaatagtacaattttaattaaagacaaaataaattttgtttcgaattttatcaagtaatttcaagacactccttgataactggagacactcttactaattcaaatactagggtttaaacatgctataccttgcattccacaaataaatatgtgaatggtcctttaccccaatgacttatcctctttatataaatacacacacatattattaagacctctccagtgcacagatgaatagactaaaattcatatcaaaccataccaatagtcagttgttcaaaccttccatcagaacagctttgatcagaaatgcatgcctaatcctagtattttaataaacaacagtgcagtgagtcacagataaccctacagaagcacaagaattaaactggataaatttccctttcctggcatgttttctagtatatcttaaaatagacaaaacaaagcaatattaaaatcattaacatttaattcaattttgagttgcagctactgtagtaaaccagtaataagatcatacaagtcaacatcaacacatgtgtactgaaattttaggtagcctagaaaagtaaactatatgataaaaacaaaatcttcatttgcagaagaaaacctttcagaaaatatagtgcaagcttttaccatatttcccacctcccctcaagcttggctaagtaagcccctgcaagtgcttcccctataagctccatgttttataatgatttctggactcatctcctcgggttggaccataagcatcttgaggacagaaactgtaacattttcacttttcaatctccagccactagactaacacaatggagacatggcaagaaatgtttgagggactaattagttaaattccataaagaatgtgtatgtatcaccaggtaactaatctgcatgtccacatcaagaactctgagaagtcacagaggtaccacttgagtgataggcactcggtcccttagggaaagattgtgaaagatattgagggaccagtggtcaggttcgtaagataaaggtttccctccaactcctggggaaggtgcaatagtatagaaaatagagaattagccctgataaaagagaaatccttaaaaaagtattacttattctgtgatagagcactgaggaaagaggaacaaaagctccaatatgaaacaaagtgatcccatctaatcataaataaaagaaaaactacaagtgtttggtttgctcaggaaacaaaagcaaaacacctttcctcaggtggcagggtgacataattggagagtcactgaatactgtacatattctcaaattctcagctgggacactattttcagtctatctcaaactctctcaaaactgaagcaggtgctaacaaagactatttcttcacagtggactttgggttgggtgcaagatgccaaaatagacaatgtaaaatgacatgctcagcaccttgggcctctggcaattcttagcaccagggctacttctaattcttgtgaaagttctatcatacactactccctgagacctatactagcctgaagagaagggaatgaaagaagtctcaaatgttcaatagtgacttactcttgccctacctgtaggcaccccagggatatgagttccttcctctgaaatctgtatttcctgtgactaaattctcagtacaagcttcttagactactagtaattatttggcatgttttatgccttttaataatggctcttagttttctataaggaatggtggtattgctttttctgattataaacataaccattaagaaatgtcattccgtggtttcttaatcaatcattccctgtagtgtgtgagtataggactgggggctcagagggaagcagggagaagtgaagtgctaaagtgctacctccagagccactgacagttctgcccaatgcaatcaggcaaaacaagaaaaataaaataaaaggattcatattgggaaggaagaaggaaaaccatctttacttgcaaggttaaaagctttatacataattacacctcaataaagttgacttttaaaaagccacaaaaagataatgtacttaaattaaaataaaatacagaaactctaggataaagataatatcaagttattaatgcaagtttaaacattaaaaaatagttgctacccactcatcacagacatgagcagcaagctcattaaagattactgtgagcattcattggaataatggaagactcaaggttccaaaggcactgagaccctatatcaacaatgcttcacccttgaaacccagggactgatgatgatacagttgccatgagctacattctgagtaaatactttatcaattattagaacggttcaagtaaaagtaatgaatgacttaagacatctttctgaaatgactcttttatctggatgcctctgctattagggtgcaaggcaaacaaccttctactgtttgtttcattcatgatataaattgctttggcatattccctccaacctcctgaacctcaggtcgatctgtttgtccatttgtctgtttacacttcttttcttccctccttcctacgttcctctccctctcttgtggaagtgtatcagtaattataagagggtgctttatttcagaagacacaattcctgtacctccaatcactgttaccaagcaaaagagttcactgttcaatgtgttagaagccaatactatggcactgggtttttgagaaaagaaagacttttttctaggtcaaccaacaaggagacaggagtctagctcaaatctgtcttcctgtactgtttttaaggcagtatttttattagaaaatgtgtagggagtgaatttggggatagtaggagattggtagaaggaaaggggggtctgaaaaggctttgggcatttgcagtatctcttcatgctatctcatgggtcacatatgtaaattcagggggagttagtacgaaacatgcagtggaaatttgggctgtggcgtcagcaagctcattctgtgtagactctagtttgctgtattggttccaactgatttcagccagttttgttatcttaaaagcagagagaatttcagtgtttcagaaagttgtttttgttttttatttttatgaaccaatcctataaattcaagaatttctctttgccactggttaactctttggggcacagtttcattagtagaccttggcctccatactccaaagaactacttatctactgggtgcagctgaaccatttccataactgagatcatgtaagtcaggaatgtatacacattacacatgtgtgcagacaaaagttcatgacttcacctaccaggtccaagacgagtctccttaggaatgcctgcatacaagcctggcccttggctggtgtctgggaacttggctggtaaaatcattgcctacactaatataaattttttctaaatgagaaaagtagctcacttctcctaaaacatctgttttccttctaggtatctggaatttcagtgactgctatcagtcacactgacagtctgtgctcatgactaacccctgataaaaaccctaaactcttaagctcagacgagcttccctgatagacaacacttcacacaagtttccataccttgttattcagaaaattaagtgcatcctatgtgactccacaaggagaatattctggggagtttgtatctgatatcccttgttgattttgctttctaccttttcagtctaccatatcttagccatgaatgtgactacctgctgaaccccatgaatccttctatccaatcgttgaacctgggagagctctgacaaaggctagcatgggaaaatacgttgtcttcctcattaacagacccttcttagttatatctcactttctaagttcctgccttccacttcctaggagagaaaaaactacacagcattacctgaacatcatcccagggtaatcacagagcagccatctccgcaaaagaaggaaaaatgaactgtgtaatgttgcaatatttttaactgcaaataattttgcatacaaggcttacctacaattgaccatttttgcactaaatgcttttttaaagtaacaagctaatatcttcttaatataaaaatatacatgtccaacaaaatttaacttgttctgctatcatgaaaagaggaattccagacaaatgtctcataatgtgcagtcagtgggcttatataaataaggactaaaattacaagctcaataaaagatcatcaaaccagggaaaactccaagtaaaattataatacacagttgtccctcccacctgagactcacctgagactcatactttccttccaacatgcctgttctgcctattccctcaagactcagacttcaaatgagttccctttaagtagataagaacagtttcgcaacggattccagaaaaaccaatatgccacctaaaggacaaggaaggcatctacactaagaaaatgaaaagaagtcagagagagaacttcctgacttactcagattatatacccatgggtccacatatgcctaaaggccaaccttgtccttaatctttagtcactcaatctataaaataaaagatttagaaaagggctatgggcaatatggatcttttgcaggtacaaaattttttaagtccataaactttctctttaaaacactgaagaccattagtgatggttataatattcttgtctgaactgagagctatagtcaggctccttttagaagccctgccatgaacagagaaaaaagaaaaggcatgttcctactcctctatcctctgtagacatcttctccgtgataagttaataatgagaagagaaaaccaaccttctagctttctcatcatttaatggtttgaaccctgagtttctgcagcctggaaaaaaaaaaaaaaaagaggaagcagcagcagcagcagcagcaagttctcctcatctgaaattcttccctctcctagctcaccttccccaccttctcactcctttgtggtcctcacagtcagatatgaggtaataggtggaaaatacttccctgtgataaggcagtgatgcctgagccacccacttctggtaagaaagctgttcctaaagaatagcaaatggtactcatgttttgggggactctatgctacttagaagcgagtggctaaagttgcacggtgactaattcaagaacaaacagaagaaaaggacaaacagaaaaataaacagaaagaggcatgcccttagcctcaatcaggtagttctaagaaagtgattaggatggttcggagaccaccagccccataccttatccagtcaccaaacaacccaggctggggtgtggttgcctggcaaccacaccttccatgtaccgagtatgtcacaaatatgtctttccggtgtgtgatctcttgactgtgaaaagtaaaacgctaaatcaattcagcaggctttgagtgtctacaatgtgctagtcactgtatcagagatgtggatccagggatgatgcaataacttctgcctccaaggagctcatagtttagtggacatctggcaaagtactcactgattcttgacaattcatataatcatatcaatagatgcaaaaaagcatttgacaaaatccaaattccatccttgatttaaaaaaaaaaaattcttagaaaactaggactagaggcaaactttctcaacttgataaaaaatatctacaaaaaaaatctacagggagaatctagaggctttcccctaagataggtaacaaggcaaggatgttctcttttaccactcctattcaacatcttatacaacttctgactaattcagtaagaaaaggcatacagttgaaaaggaaaaaataaaactgccttgcttctcagatgacataaatgtctatataaaatatctcaaagaataaacaaaaacaattagccacttaatctataaaataaaagatttagaaaagggctatgggcaatatggatcttttgcaggtacaaaattttttaagtccataaactttctccttcaaacaccgaagacctggaacttagctgggcgtggtggctcacacctgtaatcccagcaccttgggaggctgaggcatgcggatcacttgaggtcaggagtttgagaccagcctgaccaagatggtgaagtgccatctctactaaaaatacaaaaaattagccaggcatggtgccgtgcacctgtaatctcagctactcgagaggctgaggcaggagattctcttgaacccgggaggcagtggttgcagtgacctgagatcgcgccactgcactccagcctgggcaacagagcgagactccatctcgaaataaatcaataaataaaaactcctggaacttaataagcaattacagcaaggttgcagaatacaaagttaatatgcaaaagtcaattccttttctataaaccagcaattaacaattggaattggaaatataaaacacagtatcatttacattagctgctccccaaaactgaaatatacaggtataaatataacaaaatatatacaggatctatatgagaaactctaccaaactttgacaaaggaaagcaaatatctaaacaaatggagagatatttcatgttcatgtatagaaacactcaatatttttaagacctcaattcttcccaatatggtttataaagccaatgtaattccaacaaaaataccagcaaattgtttcatgggtatcaacaaattcattctgaagtctatatgaaaacgcagaaaacccaaaataatcaacaaaatactaaagaagaacaaagttggaagacagataatacaagatttcaagacaagaccacaaggtactgttgaaagaatagacaaatagatcaatggaacagaatacagtatccatataaatatatccacacaaatgtagtcaactgatctttagtaaagaagcaaagaaaattcagtgaagaaagaatattctttttcaaaaaatgataatggaacagaccttacacctttcacaaaaaaataactcaaaatgaatcacagacctaaatgtaaaacacaaaaactctcaaacttctagaagataactgtattggtgcccaagagctgctataacatggtaccacaaactaggtggcttaaaagaagggaaaacaaatctggaaattagaagccttaaatcaaggtgtcagcagggctgcactctatctgaaggctctaggggagtatacttccttgtctcttcctgtcttttggtggttgccagaaatccctggacagcacgattcaactgtctcacacaatttaaaccacaacagtcttctctccaatcccccaaaagtcatatccttactgtatgcaaaacacattcaccccatttcaacatctccaggacccttgacccattccagcatcaactctaagtcaaaattgcctctaaatatcaactgtaatgtcccaaatctcatctcctaaatcatctaaatcaagtatgtgtgagatcctgggtatggtccagcctggggcaaagtttctctcctatggacactgaaatccacaaaacaagttatctgcttccaaaatacaacaggcataggacagacagtcaccttccaaaagggagaaactggaaggaaaaagtgggtcacaggtctcaaacaagtccaaaacatggcagggaaattttcattaggtttccagggcctgagagggctgtctggatccatgagtcacacaggtaatcttttcagtgaatggttgttcagccacacccttggtcctgtttcgggagtatgtttcctggattggctgagaactttcaaacccatcaagtgctggttcctttgcttaacaattccttcctcaagttatctctttccttttgcatttcactataagcagcaaggaaaaaccatggccccatctttcacgctttacttagaaatctcctcagctcactgcctacaagttctgctttccacccacaggtaaaacacagttcacccaaatttctgccactctgtaataaggatcacttttcctccagtgtctgataatatattcaccacttcctttctaaggcctcacaagaagcacctttaaagttcacatttctagtaacattctgttcatgacaacatatgtattctctaagatgcaaagaatctatgatagatgctttttctaaaattcccctctctactgagccttcaccagaatcacctttaatatctgtatttctacaaatagtcttttcaaagcagtctaggctttttatgttatgcacctaaaaattattccagtctatacacaattccaaagccacttacatgttttttaggtagttattccaacagaaaaagatttccgggtatcaaaatatgtattcatttcctatggctgccataacaaagtgccacaaattggatggcttaaaaatgcagaaatgtattctctcacagttctgggggcagaagtctgagggtggcagcaaggccatgccctctgttaggccccagggaaggatgtttaattgtctcttcctaacttttggtggtttcagtaatccttgatgttccctggttatagacatcccactccaatttcagcctctgctgttacatgaatttctccctctgtgtccaaatttcccttgttttacagggacaccagtcattgcattaggacctcagcttaacttgtttaacatttgcaaagatcctatttctaagtaaggttggactcacaggtatctggggttaggacttcaaaatattctcttggggtataaaattcaaccacacaacaataataaaagagaaaatctatgtgaccttggttttggcaatgagattttaaatacaacaccaaaaggataatccaggaaacaaagttgataagctggactttattaaaattaaaaacttcttttctgcaaaatacactgttaagagactacaaagacaagctacagaccaggagaaaatgtttgagaaagcacatatctgacagaaaatttctaataaaaaataaacaaagaactcttaaagctcaacaatgagaaaacaaacaacctcatttaaaaattggcaaaataggcatgccactgcaaattccgtgaaacaggagaaaaactgtgagttcccaaagtgtaagagggagaaaaccgacctccaaacacacatccctgctgggaatctgaaaatccagatcacaggagaagaatttaaccttacctagagatggaagggatttagagagtcacacaaaatatgaaagtagaagtagcagcaggaagtgccttgtatgcactcccagtctccagctcgagcatagggacgccatccctgactatatctcactggggcccttgtggaagacaaccagcagaactgcggaagtgttgtggggtgaagaaagctcccagatgaaattggtagtggtttcgactgggcacacattttctggagtggagtccgaggaaggagcaggagctgctgcagatacaagcaagtacaggagtacaagaactgccaccaacagagcaggggcaaggtctgggcggggcattgcaggatatgcgggcttgccaactgcatgggagttgagtcaggcctcttgctactggctatccctgacttccctggcaaactatataatacagtagaggcggccaagatcccctatggaacataaccccattggccggagaaccaacccccagcccccacagtggcctcagcaagccccgcccaaggagcttgcctaaccctgctgcctaaccagacctgcctaaccctgctgccacctgacggcatttccctacctgccctggtagcctaacacaaaacatagaaactctggggagcttcatcccctgaaccctgcccccagcaccctctgctctggagggttgtctttaattgtctatggagcatatatatatatactctttccctatggtatataagccctgagtctggggagtaatggtgtgaacatctacctgtcttacacgaacacatttctgcccaagaacacatttctgtccataagtttcccctaaaaatcaccctctgccaataaactagatatgcctgcctcattctttgatttcttggctccttctgtatttggaggttattttgcatatatggccctttcaaggaatatctatctatataaagataaaacaataagctatcaagctataataagatatggagaaagcttaaatcaatgtttctaaagaaaagaagccaatttgaaaggctgcatactatataattccaactatatgacactaggaaaagcaaaacttttgagacagcaaaaagatcagtggtaagcaggggttcaggggttgagctagaataatgaacagaagaagcacagaagacttttagggcaatgaaactattttatatgatactataattgtggatacatgacattatacatttgtcaaaacccatagaaatgtacaatataactagtgaaccttaatgtaaactacagacttcagttaatactaatctatagatattggcttattaactatagcaaatgtaccaaacaaacacaacatattaataacagggaaaaccatggggctgagggggtatagggtaactttctgtactatctactcaattttttaataaatctaaaactgttctaaaagtagtctgtaaaataagatttttaagagcaaacagaacaagaattttaaaagataattgtctgaagcacaaataatgacaattatatggtgcactttataagatatgtagatgtaaaatgtatggcaatcataacacaaagtatgggtgggaaataatggaagcacactgttgtaaggtatatatattatactatatgtgaaatgatatattatttgaaggtagactgtgacaaacttatacagcctagagtaaccactaagaaaagaataaaaagaaggagaagaagcatggaggagaaaaagcagaagcaacataagggcagagtggagataaaatggagtaaaaaattgagtcattaaagaaagcctcatttaagccaaaagggtatgggaaaagaagggactagattaaagaacaggtaaggcaagtgcaaacctggcaagatgatagattaagatctaatcatatcaataattatattaaatgtaaatggtctggccatccaaattaaaagtcagggattgtctgactggattaaaaaagtgagatccaattatatactgtctacaaggaacccaccgtacatataaagacattgataaactaaaaaaatggaaaaaagataacccatgtaaacactaatcaaaagaaggtagaatggccatattaacatcgacaacatagactttaaaaaatgataaacatttccagaaatgaaaaggggcattacataatacataggaattctaaatgtgtgtgtatccaacaacatagcttccaaagtgataaaatgaaaactgaaatgaaaaaaacagaaaaatctacaacaatgttggagacaagtaggcagataataaggacacagaaaacctgaataacattatgaagcaatttggcctaacttttatagggcatcccagccaacaacaaaataagtattaaagtggacacggaacattcacaaggatagtccatattctgggcctaaaaacaaaccataaaacattaaactgaaatacaaaatatgtttttaaaaatggaattaaaatagaaatcaacagaaataaatctttaaaattctcaaatatttggaaattaaacaatatatttctaaataactcccaattcaaagaagtgacaaaggaaattatacaatattctgaattgaatgaaggtaaaaatacaacatcaaaattagtggatgcagctaaaacagtgctgatagagaaatttatagcattaaatatttatattgggaaataatagaggccttaaatgagtaatctaagttcttaccttaagaaattaaaaaagaaattaaatccaaggcaagcaaaaagagggaaataataaagaggaaaaaaaatcaatgaaatggaaaataaaaaaataacagagaaaaatcaatgaaacccaaaacaggtccatgaaaagattttaaaaaaaattgctaacctctagaccctcaatgtccagtagaactttgtataatgatgaaaacattctatatagcagcaccctccaatgtggaagccacttgggactactgatcacttaaaatgtggccagtgtgactgaggaactcaatttttaatgtaattttattgaaattaatttacatttaaatagacacatgtgactagggataactattgaacagtgcagctctagaattgactactgaaagaaaggaaggggtgggaaggaaagaggaagaggaagagataaaggagggagagaaagagggaggcagagaagatgagatacacaaataaccaaaatcggaaatgaaatgaaaaagaggacttcactacagatcctaatgttagtgccattaaaaggataataagaaagtattacaaacaactgtatgccaaagttgataacatagatgaaaaaaactaattccttgaaagacacaaagtactaaagttcactcaaaaagaactgagtagcatatacaatctgaatagccatatatagttttaaaaacttgagtccatggtataaaactaacacaaggaaactctaggcccagatacctccctgttgacctctaccaaacctttaaggacgaataacaatcctatacaaaatgttccagaaaatagaaaagagaacactccaaactaatttatgagaccaccattaaccttgataccaaaatcaagaatattacagaccaatatctttatacaccaatatccctcatgaatgtatatgcaaaaaaaaccttaacaaaatattatcaagtagaatagatttatttctccatttatttggttttctctcttcaatgttttagagtttttagtattcaaatattacagaacatcattagatttatccctcagtttttcatgtttttgataccattgtaaactgtatttctaagttttaatttccaattgttcattgccagtgctaaatacaattgatttttgtatattggcctcacatcctgtgtctttgccaaagtcatgttatttctagttgcttttttgtagattcctcgggctcctacataaacaatcatgttgtctgcaaataaagacaattttatttcttccttttttatctgtgtacatttatatcttttccttcctttatttcactgactaggacctccctataacgaacagaaattgtgaatggaacatccaatgtgatgctggtataagaatagacatatacctcagcaggaaagaacagagagattagaaataattcacacatagcaacaattgatttaggaggggaaaggtgccaagataatataatggggataggatagtgctttcaacaagtgtgtgggaaaatgagacatccacatacagaattatgaacttcaccccatactcatattatgtacaaaaatccactcaaaatagatgacagacctaaatgcaaactctaaacctataaaacttctagcttaaagcttaggggaaagcttttgtgacactggattacacaaagatttcttaagacactaagcacaaaccacaaaagaaataattgataacttgactttgaaaaaatcaaaagcttctgctcttcagaagacagcattaagaaaatgcaaagtcaagtcccagtctgggagaagatatttgcaaaacacacatctgaggaaggacctatatcctaaatatatagacccttataactcaaaaagaggacgacccaattttaaatagtcaaaagatgtgaacagatacttcaccaaagaagaaacatagatggcaaataaatatatgaaaacatgattaagacaactggtcaacataaaaatgcaaaggaaaaccatacgaaatactgctacatacctactagaaatgctaaaatcaagcacacacacacagtccaatacaaagtgattctggtgaggatgtggagcaaatggaatctcatgcattgctgctgggatctctactcatcatcttgctttatttttcccaaaaccactttttattaccttaaagtttgcttacccatgtaagtccatatatatcttctcacatgtttattgtctatcttccccaatataagtactatgaggctggcaacttggtctgtcctgtcatcactgtgtcattctggcaccaagaacagtgtctggcaatctttacatatttattaaaagtgaggaaggggtggaaagaaaagacactaagacatctataagtgaatatatgaaggcaaggaacccagtcacagccatctacagaggagcgttaagagaaaattaatttagaccaccaggaagctgcatgttgtaatgcatgattcccaatttcagctgcacattagaattagctggagagctttgcaaaatcccaattccaggccacaccagaccaacaaaatctgaatctctgagaatggaacaccagcactggtcatttttttttttttttttttttttttagacggagtcttgctctgttgccacgctggagtgcagtggtgccatcttggctcactacaacccccacctcccagattccagtgattctcctgcctcagcctcccaagtaactggaactacaggtgcatgccaccacgcccagctaatttttgtatttttagtagaaatggggcttcaccatgctggccaggatggtcttgatctcttgacttcgtgatccgcccgcctcagcctcccaaagtgctgggattacaggcgtaagccaccacacccagccaagcactggtaattttaaagttcccaggtgatcccagtgtgcactcaaagttgagaatcactgaaaaaatggaacctagaccttggaaatgtacacaactgagtgtgcaagctacttaacctcccttagcctcaaaattctcatctacaacatgggaaatatatgtacctcccagagttgctgaaatattgagattctatataaggctctcaggaaatgtaaattctcatccccaagggaaacttgatcaaatcttcatagcttagggtaagaaatgctaattctaccagcaattcacatttttcattgttagctgattattttattgaacatttacattgaggaaattcagaaatgctcatttttccactttcctggtggtaagatgctgcctgaagctatgtttaaattttcaagagtaaataaactatggcgggaaatctagctgactatgccagtgaatctcaaacctagctgtacattagaatcatctcagaaatttttttaaagaaacacacgtacgtccagaactcaccaggccaaattaaatcagaatccctggggtggctccagaatatcagtatttttttaaaaagctgatagaaaggtaattgtaaaacacagtcagggcttaaaagcactgatttgtactaacgatatgccatgctaactgcacatcacagtcacttggggagctcttaaaaaagttgattgattccagaaccctaccgagacttactgattcagaatctgtggaagtggagcctgtcattgtgcaaatcttcataaaactccccactggtgattctgatgcaaactcactgagaaccactactttgtatcatacatttactctacgtgttgtatatcagaaagatcatttaaaactttcagtggtctcaaatgccaagcctgccagttacttttaatcagtaactgacacaacacatcacagtaactccaatgactttacagatcttttcagaacacttttatgtccagcccactgacccacatcacctaccctatgctgtgccaaatactggctatgtagtccgttggtatttctaaccaaattcctctaaatgggctgctgatctgggaaaagcaacatggaatcacattactccccaagccttattcccctttgctaagtggtatgtaatgccaggattaatgaaatgaactctattggtcaaatgagtctgaatgaaatctgagttgttgtctgctcctggaagcaaactgttatctatttgtttccctcagagagataaactcagaggaaacaggagtgatccctgaggtgggaataatatagtgggctgcaattttaaaactctgcttagacaataacaggacacttggaatcttattttgatagatcaaaccaatcagtatatacagcaccatggtggtactaccaggcaggtgataatagtagcatttaaacaaccaggcactatattaggcatattaaatatattaactcatgtgattctcaactgcgatgataatagccctatcaggcaggtactattattatttccattttgtcaaaaaagaaacaaaggcacacagaagttagatgatttacccaaagtcccatagctactaagtggcagttttctgaaaccaggcaatctggctttggagtccaacatcttaagtactccactgcaatgcagatgagtgatggccaagcagtttaaaaaaaaagaaaaagttattgtctgcagtagaaactggaggtcagggtatgggtaccttgggcaaattacttaacctcttggagcctatttttgcatctgaaaaatcaggataataattgtacctgccttgtagagctgaggtgatgattaaacaagattaggcatgtgatgtgcttagaaaagtacttggcacttttaagagctttctgtcagccattattattatttgtattttaaaacagctcaagtggtcagggagaaatgaaaatctattaaactgaaaattttcctgccaatcttagatttgtagattctgtagattaccagtacatcagatccaatatgaaatgcagtcataaaagattttcacaaaaacttaaggactgtcactgtgacaaaccccagcccaaacagtccaggacaatggctctaaaaagcaaacatcttcaattatcaagctgtgtacatgtaaacacaacaggaaccagacttctgagtagctgcaaactgcagttctctgtgatgggagaacatgccccagaacagcctgtcaagtggtaattgccagccatcctcagtcacatatgtataaacagaaaagaaaaacaaaacgagggctcaaataaaaagcgttaacattcattaaacgcctgacactctattaaatgtttttcatgcattaccttctttaatcctcacaacacccttccaaagttgaacatgaaacaaccacactggtttatatcactttaaatgtaagactacacgtctcaaatgggccctgagcactgcctgggaatccaactctatttctctagtacgctcactttcaccctctctaggactctgtcacatatctctcctccaagttcccacacctttcctctcccccgctgccctccctctaagctgatggatgcctataccaatagactcttttcccaccacccactgtatctgcacctgttatctcagcttcccctctagttacaacagagtaagtgtccctgctcatttcaaaaccaactactcacctgcttagggtcttctcctttctcaggtattcaacaactaccctttacaatgttcccctctttcatctgcagcagtttttcctttctacgagtttaatcacattgccatataaacattctgctttcttctatcttgaaaaaaactctacccaaccttaaggcccctcttccccattaaagttgttcttgtcaaaatgattaaaatcctcctaattaccaaaggcatcttatacggtaacattcaacatggttgaccactacctccctcccttttttggcttcgcctcctcttctttgtgtacactattaaactagatgtcttcaccagtcccatatattttaaatactatgtacagtatatgatgccgattccaaaggttaactctagcccgacatcctccagaacttcagatttaaatttctaaaaagcacatttgatatctcaacccaaatatctactagataatttatgtgtgtatatttcaccatactaaaaaaaactaccaggtgactgataaatggagagaaggtgaataggtaatgtgaaaaatcaaatgtgctaaatattcatggcacctgtaggtggtaggtggtcagagtcctctgcaaaattcttcccagctatgcttatgtcttctattgggaaaaacctactgggcatctcaaacctaacacattcaaaacataagtactgattccacaacttccaaaaatgaaacctaccccatcctacagttttccttgagtcaaggctagcatatgagggccttggcatatgggggcattgcctatcgcgttcatagatattctgagcttctagaacagcatctggcacacaggaggcgttcaaaatagctgctgaatggattgatgaattcatgttctttctttctaggtccctcgacctccacccgcccttgagtcattgggaagttctgggctgtctcagcgcctgatgatggcttcttaccaatcataccacacggctgctcctcagggagttggtggcattcccctaccacagagccacagggttcctgtcccggtcccgtctcgcataggcgccccaacacgcgtcacagtgcagctggcatcacacggccagaatcacgtcctgccctctggctgcagcgacactacttcacagctcaggcccacccgggcagtctcccgggccagggccacaacccacgccttgtgacccctgcacgtcaacggcatcttccttcttcacgcccgccctcccacagcccggcgcagcggcctcccgcacgccccctgcccacctggcccccagccacctttcctcacctgggcctgcggggccgccccaactgtcccgctgcaaccccagcagcctcgccagttgggtcca

SEQ ID NO: 2161 - DNA, 69937 bp, Homo sapiens
acacagtaaatattttattttaataatagcatagaattcttctgaagaaaattgttatacattatagctattattttacagtaacagagagaaaataaaattagagatacaaatattaaaggccaattatcaaaatgaaattaacacagattattattcatatgaacaatgtaaacagaatcatctatttgatttaacatcaaatatatttttggcatataattatttttacaatgagaattattaattattcaaccaattcaaatatactcattcagccaaaagaacaaaataagcctcttagaaattcaagatttatagattgatattaaacattttctcaatacatagaatattctgatctccattgagttaaactgtacaaacactcatatctattgttttatagcttataattaggtatagcttgtcaccagaactccttgtccaaaatatcactattaattgtacgaggcaaagtcctataataaaattactgtaataatggccacatcttttcaaaaacagaatatggaagtttccattttcatgactatgaatctggttttccaaaattgggttcccaaatccagtttctaaatgtttcaacagaggtgagaaagtaaaggaaataaatgatttaatggaactctggaaaaaaaactatcatagatcttagtttgaaaaatacatcaaacatgagatataccatgaatgactcagaattatataataatgcctatatcaaactttattagttagctaaagggcaaagagtaagaggcaagttaaaggtaatacttgcttttaacaaagcagactaagtaatatgttaagtgttagggtgggataggaaagaactcaggcatggcaaaaatctcctcttgggctttctatataaacatctattttagttttggactgttcaccgagaggagctctccctatccatgaaatgcttcccagaccaacaggtcttggtctagcagctgtaggaaggcagcagtatgaaaatgtaggaaatggaagccaatttgtgtccaaagttagtccaccctaactggactctttttaaactgggttattcaaatgccagcaaaaagtacaggctctagctaaagaacatgaatagacatctgtcttaaaaatgcctggaagaggtcatgattattggccttatgttctcccagaataagaacttacaaagtcctggaaatcctcagctctctccagccacctttccaaataaaatcttaatgaatatattttaaatcctttattgggctctgtaatcccttcaaccaaatagccaagctgcaatcgttttatgtaacatctgtttcactggaaaatgtgggaagttattttgatattgtctagcaagatcaataagtaaacactgatcaccccaagccaaatgatattgcccttcagggagcttttagaaagaaaataaactgataaaccaagaaagcagattgtatgcatagcaaagcccttcagcacagtgcaaacatgttctttatgaggaggtgcaaacccacttggtaatttcaagtgagaggcaacagaagtctttcttaatccaaagtcagaagtttccgaagaacttcaagcacaatatcgtaacaaaagtgatactgctcctatatacatatatataaaaaacaacagaatgttaagtaattgaataacagaatccactttcagaaaacacatttgtaattttcagccacactggaaagttcctaaaaagagcaaacatttaactataaacacttaagaactttacgtgaatacatttttaaaactatgaggaagataaatgatcaaaatatagctcttggcctagaactagttaccttaaggcttaacataactgttttttttatcattatccatattctattaatctaccctcccaatgactactaacaaatctgtgacataaatgatgtctttttatgacgtcctgataaccttgacagtttagtggcaagtaaatatctcaaactgctatccagaaatgttttaaaaataactttagatgttacttaaatagcacggcattatggacaaggcatgtgtttggacacgaggagacctcaacttcaggcttggctcctccccttctatctgagtgaccccatggagcaggctttattgctctgaatttgaagtacttggtcaggaataccagagaatcagagcaaaactaatgtctacctcaaacagtaggaattcaatgagattatgtcaataaaagagcttttaagtggtaaaatgttatgcaatgttaatctttatattcattattcttattattatgtatgtggtgaaagcttaccttcgtttgaaccatgccagaacgttgttctctcatttgggccactatatccatgatgttgaactgtaataagatgacagtaattttgtatgatccacatgggggaaaaacacaaattcacagattgccaaaaagggtgaaagagatgtcaagatttaatcagaaagatctcattttcactcacaagaaaatgtgctatttttaacttagcccaatggataaggaagactattttaataggttttcaggagaaagcaggaagcaatcattcataataagaaatgctctccaaaataagtaataaatttgcccttgtgtgtccctgtttgttatccaaaggcagaacttaaagcagcactgtaattctggaaaggcacagaagactttctctggccccaacaatagcatatctgtttcttatatgaagatccctgtcaactcacacggaaactgggagcaacagtcgacccaacactagattccagactgtgtgtggacaccagtacagctgggtgtggtcattgagttggtgcaggcctacaaaggtctgttgctggtccacaatgagtcaagaaactgggagtaagtgctcagaaactcttatggcaatttgacactggcacagcactgagaagtgtgctcaactgaacaggatatagaccagctcaggtgttgctgaacttgcctggagagtcacatgtgggacaagctgagaatgagtcgtttcagcaagacattgtggacacatgtaaatgttgtcaactgtaaccccaaagcatataaaaatagaaaacaataagcattcctttattttcatagcttatcatttttataattaaaatttttaattaaccctttgaaaaaactttttgttttttagagacagggtcttgctctgttgtctcagctgctggagtacagcggtgtcatcatatttcactgcaatctcaaactacaatcctccctcctcaacctcctgagtagcaagaactataggtgcgttccaccatgcccagctaacttttttatttttatttttgtagagatggggtctccctatgttacccaggctggtttcaaactcctggcctaaagtgatcctcagccttggcctcctaaggtctgggattataggcgtcagccaccatatctgccataaaaaacattttattttataatacagatatacaggaagttgtacagggtggccctgtgtatctttcacccagtttcccagatggtgtcatcttgtttaacaagatataatatcaaaaccaggaaactgacattgggacaatccacaaagcttaattcagatttcaccagttttacatgcaactgttagtgagtgtgtgagagtgtgtatgtgtgcatgtgtgcatgcacagagctccatgcaattatatcatatgtgaagattcatgtaactataaccacagtccagatacagagctgttccaccacaagacttcctcctgctatccctatagagtcacactcatccaccccaatctctaacccttggaaaatagtaatctgttctccttctctatgcttttgctatttcaagaagaaatagcaaaattcactatatgaataaaattgcacaatagctaaccttttgtgattgacttttttcccacccagaataacttggagatccatccaagttgttggtgtaacaatagtttgcttccttttattgctaaataatattccatgatgtggatatgtgccactttatttaaccatcaatttgttgaaggacatctgggttgttctggtttttggctactgtgaatataatctgctatgaacatttacatacaggtttctgtatgaacataaattttgattaatctgggataaatgccccaagagtgctattgctgggttatatgtcaactttagttagttttgtttttgttttctttccaagaaactgctcaattgttttccgcagtggctggtaccagtctacattcccaatgtctcatacatatgggtaatgtatgagcaatacagtttctccaaatcttcacataattctccaaatcctcaccagcatttccaaatcttcatcagcatggggtgctgtcactatttttacataagcctttctgataggtgtgtaatgctactccatcctggttttaattagcatttccccaagggctaatgaagctgagcatcttttcacgtgcttgtcatctgtatgttctctttggtgaactgtctgttcatgtcttttacccatttctgtttttcttttttttttaactattgatttttgagggttccttataaattctagatccaaggcctttgttggatatgtgccctgcatatagttactctctagcttgtttttttttttttatcctcttcattgggtctttcacaaaacataaaattttagtttgctttccctctgagatcagtgatggcaacaacgcctgctctcaccactcttattcaatatagcacttgacattttagtacagcaataagaccagaaaataagtaggatgtatacagattgtatacagatcaaaaaggaagagacaaatctatatgcacatggcatgactgtctatgtagaacacactaaagaatctaaaaaaaaaaaaacctacaaaacctctaagagctaataagtaatttcaacaagatcacagggtacaagatcaacaaatgaaaatcaattaaatttctacgtactagcaatgaatatgtggaaactgaaagtacaaacacaataccatttacaattgctccaaagaaaatgaatagggtaaatttaacaaaacatatacaagatctatacactgaaaatgacaaaatgctgatgcaagaattcaaagaagacctaaataaatacacttaccatgttcatggattggaagattcaatacagtaaagatatcagctctctccaattaaactacagatttaaagtaatttccatccaaatcccagcaagttttgtgtagatgtagccaaactaattctaaaatttattagagaaagcacagaccctaggatagctcaaacaattttgaaaaaggagaataacgtgggaggaatcattctatctgatgttaaagcttactatatcactacaataatccaaagggtggtaccggcagaaggatagacacactaatcaatagaacagaatacggaaccagaaataggcccatacaaatatgcccaataatttttgacaaaggtacaacaataattcaatagaggaataacagaattttcaataaatgatattgaaacaactagccatcaataggccaaaaaatgaatcttcacctaaatttaataatttattaactcaaaatggactatggacttaaatgtcaaatatgaacttacagaattttcataaaagaacacaaaaaaattattcaggccctcagctaagtgatgagctgttagacttgatatcaaaacatgatccataaaaggaaaaactaataaaatacaatctcatcagaattaaaaactgtaacttctttaaaagcatttttttaattataatttaagattaggcaaattatggaaatacatttgaattactaatttttaatcagtttactgactataaaacaagcatgactggactgttcagttaagaaaagacacagctttccaaatgtggctgtagtggttaaccaaataatgaagatggaagtgactgcaatgaaatgaagacaaagagttatataattttcacttggagttatgattcctcatatattgagttttatagtcattattgattgtgaagctctaaaactacacttgtgttatttccaaagatgtactggttaacaaagcaaaggaaccattaagacttatttgtaatttacataaaaaataattaattcaaagataaaataattatcttaaagagaattagattaaaaagacaagagaggacttctggttccaaaataacagtgtagaagcaagctggcttcacttctttacaaagaaaaccaaaaccaaatatacagcactgaaattatcaccaacaatatcccagaaatcaaatacgaggagaagacagttcctggatccacagagatgggaaaaaaactctaagtaggcagtaagagaattgggtttccacatctgcaatgcccattcctccaatttgcccagcaccaagagtgcaaaaaatctccacctgattcatgatttctataccagaaaaggtgacatccaggtttcccaccatctgggttacctggcaggaaacctgtccctacctcaacccacaggaagcactacatgtgcctgaagaaagaaatatcctgagaacagtcagaaacaaacaggtgaggtgggactaccatccccagccctggaaactctggtctgtaactcagctaaaggagatgccaaaccagagtggttgtttagtagcaccacattgcagaagatacattgcacaggacccctgggcatgaatctctagccacctttcccacactgccatgatatctcctttgagactttccctaattggaatgagcagctctcttattgtttactggagccaaggcaaacttggtcgtaaggtgacatctagtgccaaaaagaaggcagcaacttagcccctcaccaaaaaaaaaaaaaaaaaaaaagaaaaaaaaaattcgacaggtaaattacatagaatctataaccaaatacattcaataaaaaacaaaaataagccagacagagaacactggaataaataactaatccttcattcaaagacatcaatacaagatatatatttcttgcacatccagaagaaactgcagtcaacacaaaaccatgacctccccaaatggataaagcaaggaaccagtgactgaccctcatgagatagccatataagagctccctgatcaaaaattcaaactagtattaatagctttgaggaaactcagagatctccaaggtaacagaacaccaattcaaaaatttattagacaaacttaacaaagagattgaaataatttaaaaatcaaatagaaatcttggagctgagaaatatattagctgaactgaaaaattcattacagcctcacaatagcagaatgaatcaagcagaggaaagaatcagtgagcttgaaaaccggctacttgaaaatgcagtcataggtggaaaaagaataaaaaagaatgaagatcatcaccaaatatagacaattacctcaaaagaccaaatccaaaaattactggtgttcaagagggagttgaacaagagcaaggggtaggaagcttattcaaagaaataataacaaaactttccaaaatgcaacagatataaatattcaggtataagagcatcagggccgggcgcggtggctcacgcttgtaatcccagcactttgggaggccgaggcgggcggatcacgaggtcaggagatcgagaccatcctggctaacacggtgaaaccccgtctctactaaaaaaatacaaaaaaattagccgggcgtgatggcgggcgcctgtagtcccagctacttgggaggctgaggcaggagaatggcgtgaacctgggaggcggcggagcttgcagtgagccgagattgcgccactgcactcccgcctgggccacagagcgagactccgtctcaaaaaaaaaaaaaaaaaaaaaaaaaagagcatcagagaacaccaaacatattcaacccaaataaggctacaccaaagcataaaataataaaactctcaaagctcaaggatagaggatcctaaaaagtagcaggagaaaagaagtaattaacatataaaagagctccaattcatctgacaattgactctcaacagaaatcatataggccaggaggaagtgggataaattttcaaagtgttgaaagaaaaaaaaaacctgttatccaagaacactatattcagcaaaggtacttttaaatatgaaggagtgataaagtatttttcagataaacaaaatctgaggattcaacagcagcagacctgacttacaagaaatgctaaagcgagttcttcagaaggaaaataaaaaaatacaaaaaaccacatacacattcaaaaagaaaacttttcaaggcataaaatccactggtaacattaacaacatggacaaaaccagaatactctattattgtaatgatggtgtgcaatccatgcctaactctggtatgaagctgaaagataaactcataaaaagccgtaatagctacagcaacctattaagagaaaggtaatataaaaatacacaaatttagataataagcagttgaaatgtggtggggatggagttaaagcatagagtatttttttaaaattttttctttgtttctattctttactttgtgatctaagataagttgtcacttctttaaaatagcttattgagatccactcaaggcaaaaagaactgggaagtccccacagctgtctgctgggcagaaaaccctaggctatgggtgccacatcagccatacacccacggcaacaccgccctgcctggagatctcacacccttgacctactgcatcaacaaaccatctgtaggtctactgcacaattagctctgactcccaagcacagaggatcagcaggcctccagtgtgctgtggatctcctggtgacctaatctttggctcgagctgccccaagggaggagagagcacaggctgccagggttccccttggggttaaagagatgtgggcatggtgccagtgactggagggggctcccctaaggcctggaaatggacctggcaggggatcatcgctaccccttcccaccacccccactgctgcaaatgtgctggaatacaaaagagccatgtgactgagagtctatttgccggccattattctcaagcaccatctactggattgaagcctaaattacaacaccccaaactcttccagtatacactgcctgtgaaatccagtgccagaatctagccacaagtattaataaatatcccatacagagtgttggccctctgaaagcacccagaaataaagccaactgactatactcagcttatgctacagtcaaacccacaagggatacaaagaatataaaaacaaaaagcctcatcgaaatgatagcaaattcaacaagataaaagaacacgtgccctctcagaagagaaagatttaatgcaagaactttggcaattcaaaaagtcagtgcctccttatctccaaacaattgtactagctcgccagaaattgttcttaactaaattgagatggctgaaatgacaaacatagaactcagaatctgggtggtaaggaagcttaatgagattcaggagacagctgaaacctaatccaaggaatttggtaaaatgatccaagagttaaaaagttgacaaagccattttaagaaacaaacaaactgaccttctggaattgaaaaattcactacagaaaatttcataatacagttggaagcattaacaacggaatagaccaagatgaggaaagaatctcagagctcaaagattggtccttcaaatcaattcagtcagacaaaaataaagaaaaaagaatttcgggccaggggtggtggctcatgcctatgatcccagcactttgggaggctgaggtgggaggatctcttggggccaggagtttgagacctgcctggccaacatggtgaaaccccatctctactaaaaatacaaaaactagtgaggcttggtggcacgcgcttgtagtcccagttactcaggaggctgaggcatgaaaattgcttgaacctgagaggtggaggatgtagtgagctgagatcacgccactgcactccagcctgggcgacagaccaagactctgtctcaaaaaaaaaaaaaaaaaaattgaaaatgaacaaaacctccaagaaataagagattatgtaaagagaccaaacctatgactcactggcatttctgaaagagaagaagagtaaacaacttggaaaacatatttgaaaatatagtgcgcaaaacttttcccaatctcactagagaagtcaataggcaaatttaagaaattcagcaaagtcctgtgagataccatacaagatgaccatcctcaagacatatagttaacagattcaccaaggtcaatgcaaaagaaaaaatcttaaaggcagctagagagaaaggtcagcttacttacaaaggaaatcccatcaggctaggagtagacctctcagcagaaacttgaaacttacaagtgagaagaaactgtggacctattttcagcattattaaataaaataaactccaaacaataatttgatattcttccaaagaaagcttcataagcaaaggagaaataaaatccttttcagacaatcaaagctaaggaaattcatgagcactagaccagtcttacaagaagtccttaaggaagtgctaaatgtggaaatgaaagaacagtacctggcaccacaaaaacacaagtacatggcccacagacaccataaaggagatacacaatcaaatctacaaagcaaccagccaacaatgtgatgacagcatcaaaatctcacatattgatataaaccttgaaggcaaatggtctaaatacccaacttaaaaggcttaggatggcaaaatggattaaaaaaataaggcccaaccatattctgtcttcaagagacccatctcacatgtaagaacacccacaggctcaaagtaaagggatggagaaagatctatcatgcaaatggaaaacaaaacgaaagcaggggtcactattcttatatcagataaaacagactttaaaccaacaatgatctaaaaggacaaagtagggcattacacagtgacaaagggaaaaattcaaaaagaagagttaactatcttaaatatacacacagctaacattggagcacccggattcataaaacaagttcttctggacctatgaaaagacttagtcacacaataatattgggagccttcaacacccaactggcaggattagagagatcatcaaagcgaaaaattaattaataaagaaattctggtcttaaattcaacacttgaccaattggactcaataaatatctacagactagtccactccaaaaccataggatatacagtcttcttatctgcacatggaatatactctaagatcgactatatgctcagccataaagcaaatctgaaaaagattaaaaacactgaaatcatctcaagcatactctcagaccacagtacaataaaaacagaaattactaccaagaagatctcccaaaactacacaattacttggaaattaaacaacttgctcctaaatgacttttgggtaaacaaatgaattcagaaatcaaaaaaattctttgaaattaatgaaaacagagacaaaacaaatcaaaatctttgggatgcagctaaagcagtgctaagagtatagtttatagtgctaaatgcctacatcaaagaagttaggaagatcttaaatgaacaacctgatgtctcacctagagaaactagaaaaaaagaacgaatcaatcccaaactagcagaagaaaacaaataaccaaaatcagagcagaactgaatgaaattaagatggaaaaatgcatacgaaagatcaacaaacaattttttttttttgagatggagtctcgctctgtctcccaggctggagtgcagtgacacaatctcagctcactgcaacctctgcctcttgggttcaagcaattctcctgtctcagcttcccaagtagctgggactgcaggtgcatgccatcacacctggctaatttttgtatttttagtagagacggggtttcgccatattgatcaggctggtctcgaactcctgacctcaggtgatccacccgcctcggcttcccaaagtgctgggatcacaggcatgagccaccgcgcctggtctgttttttgaaagaataaacaaaattgatagactgctagctaaacaacaaaaaaaggaaaatctaagcccaatcagaaatgacaaagatgacattacaactaatcccacagaaatataaaagatcttcagagattattataaatatctatgcacacgaaaaatagaaaatctagaggaaatgagtaaattcctgaaaactcccaagattcaaccaggaagaaattcctgttcaagaaaacctgaacagaccaataatgaattccaaaagtgaatcagtaataaaaatcctaccaaccaaaaaaagccctggaccagacggattcacagctaaagtctaccacatgtacaaagaagaactgctaccaatcctactgaaaccattccaaaaaattcaaggaggagggactcctctctaactcattctatgaagccattatcaacttgataccaaaatctgacagagacacaatgaaaaaaaagttcaagccaatatccccgatgaacatagaggcaaaaaaaaaaaaaatcctcaacaaaatactagcaaaacaaatgtaacaacacatcaaaaagataatgcactatgaccaagtgggatttatccccagaatgcaagtataatttgacatatgcaaatcaataaatgtgatatatcaacagaatgaatgacaaaaaccatatgagaatcttaatagatgtggaagaagcatttgataaaattcaacatgctttcatgataaaaaaaaaaactctaaacaaatgaggcatagaaggaacatatctaaacacaataaagacgatatatgacaaacacacagctaagatcatactgaatggggaaaagctcaaagcctttcttctaagaactggaaaacaggtcaagaatgcccacttttaccactcttattcagtataatgttggatgtcctagccattgcaattagtcaagagaaagaaataaggggcatccaaattggaaaaaaaggaaattaaattgtccttctttgcatgtaacatgactatatattcatatattcatatatatatgtatatatatatatatcccccaaaactaatgactctaccaaaacactctaagaactaataaactaattcagtacagttgcaggatacaaagtcgacatacaaaaatcagtgatatttctagactccaataacaaactagctgaaaggaaataaagaaggtgatcttatttacaatagctattaaaaaaaaaaaacacctaggataaatttaaccaaaaaagtaaaagacttctatgaggaaaactataaaacactgatgaaagaaacgaagaggacagaaacaaatggaaataatcctatgctaatgaattggaaaatggaatactatgcagccataaaaaaagagtgacatcctgtcattcacagcaatatggacaagtctggagaacattgcattaagcaaaacaaggcaggcacagaaagataaatactgcatgttctcatttatatatgagagctaaaaaatcaaactcatggaagtcaagagtagaactgtgggtattaaagatgataaggaaaggttggctaacaaatacaaaattaagctagataggaggaatgagctctggtgttctgcatcactgtagggcaaatatggttaattataatttattgtatatatttaaagagctaggagagaagatttttgatgttcacaacacaaagaaatgacaaatgtttgaggtgatgcatatgttaactaccttgatctgatcactacacattgtatacatatatctaaatatcactctctgtaccccacaaatatgtacaattattacatgtcaactaaaaataaaaggaaaaacaacatagatggaatcattttaacagataaaacttgagaataaaaataatcataaaggaaatattgtaatcatcacatctgattcctgtgtctatctcttagctggttccaaattaaaaacaaaagtaaaggattgtgaattattgactcaaactcaattatattattatgtttattttgcaaatgagaaaactagatttgagagaggatgagcaatttacccaaagtcaccaaaatctaaagtatgtggcaaaacaggcagtcaaacagggacccctcattaactcagaagtctacattttttctcacattcttatgtgcttgtcacttatattcattaaaaacaggcacattccatcaacattctctagtaagagtctaaacaccccgtgtaagatacagggaaggaaaaggaaatggaactcacattttctgtgtatctattatgttccagacactgtcctaagccattatttacaatacatactttaatcctcacaaacacccccaggaacctgcagcaagttcggtgagaatcaggtatccaaagctcatgtgcttttgatttactaagttgcttttgaagaccaaatattagtcttccaaatgatcaggctattaaatgtagtgtgtaaacaccaacagcatcagtgtatctgcttgattcacacacttactgaacagttctttacgatggcacagaacacgacatccacacataggaacacccctgtccggcctatgccggcactgcagtgaacaaccatgggtcctgtaaggtggctcttccttgcataacgaatatattttatgaagctatctgctgaggcaggagtgccatggtctggccacttggtgaactgcaactgttttacagagtgactagttcccgtctgttagagaaagaaacagagcgagaaagacatttattgatttcttatattagagacctcacgccaacttctaatattcaaatgataataataatggctatatggtattaccttggtattatatagaactttcaaaaagtactcaaacctctttttgatgtttataagaattctggaagttgctaggaatagaggttttctccattttacaaaggagagcacagtaacaacaataaaaataccagtattaacaggcaacaaaaattaagcacttgctatgtggcagttactatgctaggggcttcacatgaattctctcctttaatcttcacatcaaccatgtgagataggcaccattttatctccattttacagatgaaaatttaaggatgagggggacgagagatgtatgctaggtcagaaggttcacacgtttagagctggaactgtaatgtaggtgtcttgaattctaatctaccatcattcttctgtaccatgaggctacaggaaaaccaagatttcaaaatgcttagagtgagagatggactgtcatgttaggaataagaccaaaaggcaaagtatcttagtttagaaatgacatatgaaatttaattaagacatataggtgtctgacaagagaggcaccgatctcttccagcgatgaagacagggtagtcaatgaccatgagagtagattgtgggtcccactattgtgctgagcccccttgaagtggagtcatgaaactcttcccagcattgtcagataaagcactttgaatttacctatatctcatccaaagggatcatgaccctttcctcagtgtggggcccttattttatcacacatgggaacctaatggaagaactcaaaatgagtttctcacttctcctatgcttctcccgaatgcacctctttttcctaagctttctgaataaagatgctagtgctcagagctctattctaatccacagtgtcgactgaaatttgtgatagttaattttatctgtcaacttggctgagccctggtatccagatactaggccaaatattattttgtgcctctgtgaaggtattttttaggtgagattaacatttaaattggtagaatttgagtaaagcaggttattctccataaagtgggttggcttcatctaatcagctgaaggccttaagagaacaaaaactgacctcccatgagcaagaaggaattctaccagcagattgcttttggactcaaactccaattcttccctgggtcttcagcctactttcccaccctgcagatttgccaaccctccacaatcacttgaaccaactccttaaaattaatctctctctctggatcagtcccataacctgtattcagggatctcaatgttatactgctagaaaaatacacataatcacatattttgttgctactacaaatgtatgggtcaaacctcagcatcactcagcaacccttttcctggtgattgtgctccaatcaacttctttggtgatgactccaaaactcaccattctctgcaagtttcctgttcaactcctattcccttcactcttgttaacacatgtatcacctacctgccaactgaatccactagagcaatctaactcattgctttctcctataaaccattccttttctgttttctaagtctattagaccaaggaatccatgaattattctagaccaatgcttctcaacagaacttcctatactgaagcaaatgtcttaaatagtggcaatatagtagccactatcaacatgccactcataagccctaaaatgtggctacttgcaggtgaggaactcaatttgttattttacataaatttaaataacttaaatttaaacttaaatatccacatgtggttactgtattgaatatattttcaacccctcctctgtcacttataaatcataagtcataagtcacatatgtctcccaattttatctgcaaaacacttgcgtctgtgctttccacccccatgccaacagccgtagttgatcatgtcacttactaaaattcttcaatgtctcccaattatcttcataataaagttcatgctacttagctgaaatttaagacatttcacattctagctggcccctgcttacttttgagaacctcatctcatcttttattactccctggcactgaacttttacatttcagaaacacataactacttatatttgtctctacacacaccttatgctattttatattttgatcatctactttctccctccatctttttcatttgcataattctcaaaacaaatgccacctcctccagtaaacctgtctcaaaaccccaagtaaagccaagtgtttaccttctgagccccaaagtgcccaagacatatctcaacattatcactgaacacggtaagttaggtatctatcagtgagtgtaaccaacctctccactattcggtaagtactgatagtgcctggcccagtgattagcatactttaaggactcaatacgtatctgctacatttggcagaggcaggtataacccagaatcagacaacttcaacagtcactctccctgccccacctctcttttccaattttttcttctccacagaatctggttgaggagaagtagaagtggtggtggcttctggtaccagggacaagtaaaaagttacttaagaagtatcatcgatcgattttccatcctactcctaacttctagttctaagacatctgcttatgtggtgaaacatatatctaatactgatgtttaaaaacttacggacttctccacaacttgaaacattcgaatgatgaaatattgaagtatctggtagttctccaggaatacacggaagtgtttcaattccaatggcttcttcagagaaatgggccagtaatggtagcatttgataattccaccttctatctctctggttatcatggcaataacatttgaattattttccaacaccatttgccaaaagtcatctatggtgctcagcagtggtccttgagtagcgatataaaaatactcttctccacaattgactattctaatataactagcattgatgtagtccttgctttttccaagaggaacgcgtgttgaatcatctattacagaaacagaaacatctggtagataaaggtgggagatacatcacacccagacttcacgaaaggatttcacacatgtaaatccatatatctctttgaccaatagagaagatggcctaggagtttcttttcaaaatggttgagtccatgagtttaaattatttcctccctgaaaactattggcatgacctaagaaatatacaattatgggatgtttatttttcaaatcagtttttaataaatgcagaatgatatcattagcatccaggtacttttggaaatttctgctagaagtggcatgggcaaggttaagtcaagggaagtatcctatagtttgcaactgaacacaacagaggagaaactctttgtgggagtaaatgagtgatattatcctgcaaatctgaaacctgcaaacccagagcagcaggagccaggggaaaaaaaaaatctgatagttgactgcagacaaattctaggattaatggaattccaccactgtccccaaactagacagccatattttatgtccattctcagccttcatctggtgataggacatgttattcaaagcaaagatattgtggcaaaaggatgctaccaaggggaattgctccaagtaatatgggactcatctaacatggactgttataacaaatacgagagggaaaaccagctatttggcctactaaccttcactgctccaggagttccttcttcacctgacacagacatctgaagctctggttccaccaccatccccacagtgagagcagaaacacacacagcaaaggaggcccttctctgccatgcagctctctcaccaataacctctccttactactcagaatcacatggaccacttatctagtaaatatgctgacaagacctgaacaggcatttatataatatctggcagaactcttctcaaattttaacatagcacacagaaactttcccttgtaaatatgaatgaacagaaaaaatcagccaggcgcggtggctcacatctataatcccagttactcaggagactgaggcaggagaatcgcttgaaccagggaggcggaggctgcagtgatctgagaccgcgccactgtacttcagcctgggtgacagaatgagtgagactccatctcaaacaaaaaaaaaaaaaaaaaaaagctagatatataaagatacccggtatttcaaaaagggagaccattctaaaaaatcacaacaaatattctcctttctataaaagatgataacaccttaaaaactcctatttgtatattaaataaaattcaagagagcattaattatttaaaacaatactttatacctatgtttactaacaaatatgttatattactaaattataaaggtgataacaatggctttgtagggagatctttcatcatatttatgtagatatatgatgatatatgtcatataataataataagcctggcaagtgttcatcacaatgttagcagtagttattacagtatctaaaccatataaattacttcatagtaaaaaaagcattttttaaattttgaaatgagattaaatatgtgaaaattaaataatctaaaataataaaagcttgatttcatataaaagtcacaatcattcaactcaaactcctaaagcaggaattgaacagaaaaacaaatttatgtttagaaaatcagcttaaaaaattttcccagaactcagaaaaaaaagattaaaaaaacctacaataatgattaaaatggtaaaagacacagcgcatacaaggggaatgtaaaaaacgaatttcagaagcaaactgtggaattcactgcagaaaagaaataattcaagtgatcataggaaagctccctaaacagaagcaggagtactaacagaatgcagtgaaacatgcataccaggttcaagcagcatgatacgctacatgtatcaccttgtcaactccaaaacaaacctttgagggaggtgctattatattcatacttttcaaataaagaatctgtacaaagtaacttgttccatattatgcagcaatcttctagactccacagactaggtaaatctagactctggtccaaaaataattccatgctctgttgtccatcaaggaagactcaagtttgcagacagaaaggcctaagtgtcagacaacattaatgaagagagccactaagacccctagaccagcagagcataaggccacaggaacaggaacaggaagcaaaaattatgctaatggatgactaggggtaatggcaactggtgccactcccatttccaccccttgattcttgaatcttggctatggtagaaacagcatcatatattggatgctgacatggggcatgtataatctcctgaagaacattaccccagccctgcaaggtactgccacctagctttcactgtaattgagtcttcaaaaggccattcatccattctgtcaagccagccgctttgagaggataaggaatatggtaacatagtggcaatgaggccattgccacaaggtatttgccacaaagtgagttctttgattacagcaatgctgtatggaataccatgatggtggataaggcattctgtaggtccacagatggtaaattggtgggagcactgtgtgcagggaaggcaaatccatacccagagttactgtctattctagtaagaaaaaagcactgctccatgcattatggaagtggtcccagtgtaatcaacctgccatcagctagctggctgatcatcccatggaatagtgcccatcaggtactcaatgttggtctctgttgctggcagattggacactcagtagcagctgtagccaggtcagccttggtgagtggaagtccatgttgctgagctcatacataacttccatccctgccattatggccactttgttcatgagacctatgggcaatgacacaatgacaggggtgactgggggtatagtctagctgatattcatagagcatgtcactctattcacctgattattaaagtctgcccctgctgagatcaacctttggtgagcattcacatgggatacaaatatctttgtgtttgtgcctatctagcaagatctattcacgtgcctcttccccagaccttattgtcaccaatttttccaaccatgttccttcaaattccctgaccatccagctaagccattaaacatagcccatgaatcagtacacatttatacgtctggccatttctccaagcaaaaaacaaaaaaacaaaaagcaccaagtgcactacccaatgttctgcccactgggagttatttctcttcaccactgtccttcagagatgtctcaaaaaaggggctgtagtgctatagctgtcctcttctggctggtacctttatatcacgcagaaccttctgtagaccaggtccaagtcttctcttcttctgtcagctgatcataggcaactcctcatgagacaacaggtgctggctgaagagagcaggtaatgtagcaggggtgggaacagtgagcatttgggcagcttcttcgtgtaacttatttgtgccttcaggatctgctcaagcccaatgttgtatctaccactttcatttgatggtggagtgctgctgtgtatgcccaactttatggcttggtggcccatagttaagcattctctacttagttctctatgaagcagtctctaccaaggcccagtagcaggccaaaagctgtttctcaaaaagagagtccagagagggtggcaggaatttgctctaaaatcctacgtgcctgcactgtgattcatctaaaggggtctgccaaaggtccaaacagcatccttatctgccaatgacacttcaagcaccactggatctgctagatcatacagcccacgtggcagagaggcttgcatggcagactgatcctgtttcagagccttctcttgttttgggccccactcaaaactagcagcttttcacatcacttagtaaatggaccagagtagcacatcaaaataaggaatgtttcctccaaaacgccctggttcactagccattgtgcctcttttttgcttgtaggaagagccagatacaatttatccttcaccttatgattatctccacatgtcccacaacactggacctctagaaatttcactgaagtagaaggccactgaatttttgttggatatatctcctaccctctgacagacaaataagactaaagcatttgctacttcttgttcactagatccaatcagcacaatgtcatcaatgtaataaacctctgtaatatcctgtggaagggaaaggtgactgagatccctgagaactaaactacaacatagggctgaagagttaatacacccctgaggtaggacagtgagggtgtgttgttggccctgccagctgaaagtaaactacttttggtgttcttgattaataggtatagagaaaaaagcatttcccagatcaatagctacatagcaggtatgaagagatgtgctgattttctaaggcaatgaaactatatctggtatagcagctgcaactagagtcaccatctgaggaagcttacaataatccactgtcattctccaaattccatctcttttttgtgtaggtcaaataggtgagttgaatgggatgtgatagatatcaacatcacttcatccttaaagtccttgatggaggcattaatatcagcaatctcttcaggaatgtagtattgcttttgcttttttactattttcctaggtagaatcagttctactggcttccactggccctttcctgccataatattcctcactccacaggtcagagaagcaatgtggggattctaccagtttctgagtatgtttattccaattattcattccagggcttggaaaataatcacaagatggttttagggacctactgagtccactgtgaaatgaacttgaactaaagctccattgactatctgacctccataagcccctgctttgatttgtagaccacagtgatgttttgggtctcctggaattggtgtcagttcagagccagtgtccagtagtttctgaaagttctgactattttctttttccaaatgtacagtcaccctggcaaaaggctatagatccctttggagaaggctgaaagattaacagtatacatttttagcagtgtgccagggtcctccctttcattcaaggtgttctctgtgtgtaaactggctcaagtctgggaagttattgactggttgtgattctctgttcctatggttcaggttagaattttgctcacttgacctagaactcttctgcttacacctatcaaggaagaatttagtagacgtcccatctagttcacttctaggaacaccatgatcaactaatcaacaccacaggtctctacaggtcagactgttctgattgctgctttgactctgctattaccataccatgctcaccttgcctttggctatcaagtgccaccacctggcccttatctctctgggatccaattatacccactgcattcaggtttcccaactcagtggcagcaatttccactgcaatatctgaactacagagaagaacaatcacagtattcttcaaggattctgggactcgcctcacaaatatatttctcacagttatgagaaaagtacatcctctggacctcctggggtgggttggcaggtcttaaatgataaacctaatctaatattccaatctccctaatcctttggatcacagtatatagtatatcgaggcagttctggcattttatcttcatttagactgggccaccttttggtccatttaatacaaccaaccaaataaactgtaagagctctttctaactccctaatccacatattaagtccagaatctcttctttgtggtcccatttcaataaattcagcctgatcaaacactaagttccttccaccattgtcccacacccttaaaatccctccccacaaatatttcccagatttctgtcagtataaattggaaaaatcatgtagctcttttgtagcgtaacatacctccccatgggtcacactttgtaccttacctttaagggcctgctgggacttgagtctagttataggtctagaagcaatgaaggatggtagctgtgagtcttgagaagaatcagcaatgtcttgcaaggcaacaaactcaggggaggtaataaaagtttcctcaggtaaagtagcatcaatctcctcagatgggggtggcatggctgcttttactggcaaggaagactcatcagggtcaaggggttcgatacacccagctttataaggctcttcacatatgtctgcactccagttttcaagatcccattccttctcagttaatgccctcattttaacagcagacaccctaaaagggtggggattcaatttgcactgtaattcagccattttcaggatgagattttgggtttggttttcaataatctcagctttgttgttataaaatataagagtttctttcagggcagaaagagaaacttttgggttattcatgcggcacttgagctgggaaatttaatccctaagatcatcctttccttctctacattaggagtaactagccaatctcattgttctcatgagaactcaaaaatgttctaaggtatcaaatacagatgcccagaaccttgcttcttgtaaatgtctgaataggattacctaatggcaatactttgcatatctctactgtcacattacactatgaattattaatactctattcactactgaaaagtcattaatgcctttacatcttatcagattagggaagtaattcataaaactcatccttaaaattctgttcctctagaattgctctcagtaccaaattctgttactctagattctctagataaatagaatcaataggctgtatatatacagtgagaaagatttattttaaagaactgactcatgattgtggggactggcaagtcaatatctgcagggcaggccagcaggttagaccccagggaaaagttgacattgtagtcttgagtgcaaaggcagtctggaggtagaattccttcttcctctggaaattttagcgtttttttcttaatgacttcaactgactgaataaggcccactctcgttatggaggctaatcagctttactcaaagtctgctaatctaaatgttaattacatcttttaaaaaataccttcacaccaacatctagactaatatttgaccaaatagctgagtatcatagcctagcctagttgacacatgaaattaaccattaaacaagctaaaaattttagtagatgatttgaaggaggaaattttttaaaaacttatattagtttcctataaaaccaagtgaaagaaaaaaataagaataaaaatgagagagagagagagatagagaaagtacttgcaaaactacagaggtaaaagaagtaacgagaaaaggttttataagatagaaccaagaggcaaccctaaaattcatagaaactaaaaaaaaaaaaaaaaaagacaagagtagactgaagagtagaaattacaactaaaggaagatcaattaaagggtttatttgtctaggtaagaatgatggaaatgaagcatacctggtaacattatttaattccaggaaaatagttaaagattttgaaataaaagagcatatttctcatgaagaaaaggagtcagatggccattacagttctcatctaaaacactggaaggaagaggacagtgaagtaacactcagggaaaaaaaatgagaaaaaaaagaactaaaacccaagattcctaaaaccaacaaggatattcgtttatcaggataaaaaaaaaaaaaaaaaaaagtagagcttgagactgcatcaactacttatacccatctccaatcaaacaattaattcatcagaacagtgatttcaaattaagggaaaagggaaagaaaatgaagtaatagcaacaaatactacaaaacatagtttcatatctataagaagaatgacgagagccaggcattccagctacttgggaggctgagacagaaggatcacttgaagccaagagtttgagaccagcctaagcaaaagcgtgagtccctgtttctaaaaaaaaaataaatgaataaaaaattagctgggtatggtggcacatgcccatccccatagtcccaactacttgggaagctgaggtgggaggattgcttgagctcaggagtttgaggtttcggtgagctatgattatgctactgcactccaagtagactctgattcttaaagaaacaaaacagctctgtgcggtggctcatgcttataatcccagcactttgggaggccgaggtgggtggatcacctgaggtcaggagttcgagaccagcctgaccaacatggagaaaacccatctctactaaaaatacaaaattagccaggtgtggtggcacatgcctgtaatcccagctactcaggaggctgaggcaggaaaatcgcttgaacccaggaggcaaagggtgcggtgagctgagactatgccactgcactccagcctgggcgacagcgagactccatctcaaaaggagaaaaaaaaaaaggtttcttgaaataggaaagaaaacaatgtacaataaatacagtggtggttaggcctgggtttgaatcccagatctctctcctatttgcagtgtgaaagtgagaaaattacttatctcttttagcctttctgtaaacaaggacactaacatactgacaccttagaggtaggttgttgtggggattaaacattactacctataacagacttaaattagtaataagcaatagtaataaacatattagtgttactactactattattattagtgggtggtagtagcagaaacaaacatagagcaacctcaagaagtacagaaagaagcttgttaaatctctgccttgaagagcttgttttcccatctatctatattataatgctgaagtgtatgaaaattttttaaaagtgtaatataccttttgcactcacaaaccacctttttaacagtttatggaggtaaaactgtcatacatgtgcacccatgagaccaccaccacaataaagataattaaacatctccatcagtgcaaaactatcctcatgcctctttataatctatccttcttgctctcatcttgccccaaggcaaccactgagacgttctgtcaatacaaattagtttaaattttctaacattttatatatgtggaagcatacagtatattagttttctaggtttgaaatttattttcacattctggaggctggaagtccagtattgttatggtttggatgtttgtcctctccaaaccttatgttgaaaactgatccccaacattggaagtggggcctaatgggaggttttgagtcatggagacaaatcactcatgaatagattgatgcccttcctcagggttgagtgagttctcactctattcactgctgcaaaaaccgattattaaaaaggaccaggcacctctctctctccctcttgtgtcctctttcaccatgtaatctctgcacatgctgattccacttcaccttctaccatgagtggaagtagcctgaagccctcactagaggcccaatcttgaaccttccagccagcagaactgggaattaaataaacctcttttatttataaattaaccagccccaagtattcctttatagcaatacaaaatggaataagacagaaaattggtactgagaattggggtgttgctataaagatacctgaaaatgtggaagcagttttggaactgggcgatgagtggaggttggaagtgtgtggaaggctcagaaaaagacaataatatgagagagtgtctggaaaaagtgcccaaaggcacttcagaaatatttggggccaccccttccctaataggccccaaggccttctggggacagacctggagcaccactgcccttggccacctcaggatgctgctccccacatcctggctgctctggctccagcagtgggtcaaatggccccaggtagggtttgggccactgctcctgaggggctaagtggtaagccttggtggcattcatgtggtgttaagtctgcaggcatccagaatgcaagggacatggaggcttggcagctttaacctaaatttcagagaatatattaaaaagcctgggaaagcaggcagatgcctattgcaggagtggagccaccaaagagagcccctaccaaggcaatctttagtggaaatgttgggttggagtttccttagagtccccaccagggcaactcttagtggacccacaaaggtgctggaaccccacaatagtagagctatccacagcattccacctcagcctgaaaaagctgcagcattattacaacccatggaagcagccagtggtctacgcccagcaaagctatgggggaagggctactcaaggccttgggagcccaccccacacaccactgtgaccaatatgtaggagatagagtcaaaggagattattttggagctttaagatttaaagtgtgccctgctgtgttttggacttgcatggggcctattatccctttcttttgaccaatttttcctttttggaatggaaacatttacccagtgcctgtaccaccattgtaccttggaggtaaataatctcttttttgattttacaggcttacaactggaaagaacttactttgagtctcagatgtgactttgaacttttaagttggtgctgaaacaagttgacttttagggactattgggaaggaataattgtattttgcaatgtggtaagaacataagttttaaagggccgggggcaaaatgctatgatttagatgtttggcccttctaaacctcatgttgaaacttgattcccaatgttggaagtggagcctaatgggaggtgtttgagtcacaagggcacatccctcattaatagattaatggcaggagtgagctctcactctattcgttctgcaagagcctggtacctccccatttctctcctgcttcctctctcaccatgtgatctctgcatatgctggttttacttcactttccaccatgagtggaagcagcccatagccctcaccagatgcccactcttgaaccttccggtctgcagaactatgagctaactaaatccctttccttcataaattattcctctatagcaacacaaagaaactaagacaaagatcaaggtggcagcaggcttggtttttcctgaggcctctctccttggcctgccaatggctgccttcttgctgtgtcttcacatggacctttctctgtgcctttgaatccctgatgtctcttgtgtgtcccaatttcttctttatataaggacatctgatggattggattgggcacactctaagaacctcattttatattaattactactttaaaggccctatctccaaatcaggtcacattctgaggtacaaagggttggaacttcaacatacaaattttgggagaatttaatttggctcataacacacagtatatactcttttgactggcttatttcactgagtaaaattattttaagattcattcatgttgttcaatgcattgttagtcattttttattgcctagttgcattctattatgtagacataccacaatttgtttattcactcttccgttgatgggcatttgcactgtttccagtttttggctattataagtaaatctgatatgaacattagtatataagtctttatgcagacatatgctttaatttctcttaggtaaaacatatgaatagaactgctaaatcatatggtaggtacatgtttaactttattagaaacaaattccatttcattgcagtgagtgtaaaatggtatctcattatggttttaatttgcattttcctaatgatttacaatggtgaatatcatttcatgcatttatttgccatccttatatcttccctgagaagtgtctgctcaaattttttgctcatttagtgttgggttatttgtcctcttcttgatttgtagtaattatagattataaatataagtttttgtgagataaatgttttgcctgtatttttcttctagcctgttgctttcctttttggttttataataatatgctttgaagagcagggttttttttttaatttgatgaagtccaatttattttttttcttttacaatttgagggttttgtgtcctatttaggaaaaatttgccaaagccaagggcagtaacgttttctcctagggtttctttcagaagttttatgtttttaactctaatgataggtctataatctattttgagttaatttttatataagttgtgaggtaagaatcaaagttcatttttggtacatgaatatgcaactgtccagatgatttgttgaaagattatcccttccttattgtcttgcattaaatttagatattatcatcttctctgttcttctcacatgatcatacagaacactcaatgagaaatatataagcatgctctgaaaagtgagaagctaacagaaacctaagtcactaccttgattagttctgaataggtccctgatagataagtaacagaaaaaatattaggccaggagttggggaacctctgtgactcgctcttttattagccttcaaactgctttgtaagttgtgaaatggtaaagaaatggaagatattgtctttatacctaaaaattcctatactacataataaaggccattcttgcttggcatgatggtacagggccataaatatgaccatgcaagttgaaaccatgcgaaaggacctttgttgttgttgttgttgttgagacggagtcttgctctgtcgcccggggctggagtgcagtggcgctatctcagctcggctcactgcaagctccgcctcctgagttcacgccattctcctgcctcagcctcctgagtagctgggactacaggggcctccaccacgcccagctaatttttttgtatttttagtagagacagggtttcaccgtgttagccaggatggtcttgatctcctgacctcctgatctgcccgcctcagcctcccaaagtgctgggattacaggcatgagccaccgcgcccagtcacaaaaggatcttagtaattaataggaaatattattcttgtttcatggctcttaacattttttgtgaaatcattaaaaactcacttattgctggctatacatatatagagaagcaaaaaatagcaagactaatatttatttagaacattgtaatttaaaacattagaaatattgggaattaaagcatttaatttgttaaaaaaaaaaacaaaaaaacaaaacttacccagagtagtttgaacagtgtttgcctcttctttttgttgtataacttacaatacagagtgagcattttttctatgtctaggctaacttccaagtctggatcagtttccaccttttatccttggcacttatattgttgtgaaatagctccaaagtttctttaatgtcaagttttctaccatcattgcttcccctaggttgcctttatccttttcctcacaagcactttggtcattcatgtcggtaagttccccttccacaggtgccttaggctgcagctctagggtcttttgagcagtagcagtgtcagcatgtccctggtcagctagttcttctataactccattcaaatttcatttccaacattatcactttttatccctttattgcagtttcatctctctcagccaaatctctctcttgattatacattttggtaaaaggtcataggggtttaccattgagagacaaggagacaatacaatcacatgctttgctgtgtgtgaactgaataagaggctcacagttacctatcactgacatattttgaaagaagtaacatttattagtcactggtcatgatgcacatctgttatttacatagggacttgtggactaaagtgccagcaaagatgcttactactttaggcaattacttgcagtgaatatattgtggtaactaaaatgtgaattgtactgtgggactggtgttatttagctaaacacagtaactgatatttgagcatattggggccatgcaaagtgaaggttccctatatttgcagtgttcaaaggtgtgtgaattcatctatttagtgttctcagcatttgaagacgacaaataaattacttctttagctttcttaatatgagtcttcaggaaccttttctataaagtcaagaaatgtgtgattaaaaaaaccacagagctttctatgatggccacttaagttggctgagtttcagattagattacactgcgttatgaggtagatataccaatgggcctttaaaaagaatatggttgaattatagtttcttttcttttatgaaaagccaaaagttttacataacttcccttactttaatgatttaacattatttttattatctttgaatttcttagttgtaactcttttgatatccagaataaaaacttcaagtcagatcaaatattatgtgtaccttctattgtaaaatgagcttcttacaatcccgagaggctaatttttaaggcatgtttgcttttagtctccttgagggcaaactgcacatgcagaaatagaaattataaaatttggacctttgacattttggagaagcaacaaattattagtattatttattaaaatgtctaatcatggttcattattctgatttcagaagtattcatcaatgcacttctccacactctccccacagaagataacagaatagcttattttaaccatgttggatatgtacttgttttttatcatcataaagttagtttcaattctaataaaccaactaaacatgaaggtatttatctagtgaccgcagtcactgtgttccactctggtttttataataactatctcaagtctagtaggagaaacaaaagtgaaaataattaaaatatggtttggtagaaggggagagtggttacaagatgctgtgagactactggaaaaacaccaaacctagctttgaggaaaataagaaaagcctattggagctggttaagaaagatagcaggaactgcctcagcaaagaagggatgagtagttctttcaagaactgcaggttaagaggcataaaaaccaacaaataagaaaagaattatgaattctagataccaaaagaagttttgtgggagagctaaggctagagaggcaaacaggtgaaattcttaggccatgttaaacaactgtaccatgatagtaacaaagagccaagaaagagctttaaaagaagagctacatgttctgacttgcattttaagaaaatctcagtagcttttgtgaatgatcagaaagggaggcagtaaagaagaacgtaaccagctgagaggtaaaatgggctcagtctaagtcagcagcagtgggaactgagagatgggggaggaccccagaggtattatggaggtagaatcaactgactccctgttttctggtttgaacttggtgattacataagatatagaatataagaagagggtcaagttggaggaagtaaaatagtaaatttagttttgaaaaactttgactttgaaaggaatgtgagttatggaatgagatatcctgcctaagattaaaattgcattgctgtgttttgattctgctctttgaatggcctgagatggataactcctaagagtaactgagtgaggaggacagaaggtgccactaccctcccatccaacacagggaagcaacgttaaggctctgtggagacaatcaaaaggcagcctcctgttggagagcagattagcagctttattgtccaggatgaaggatgcaaatagctcttttttcgcgtgtctaaacaaaatagccagagaaggtggttaaggcttcgggtaccaaaagtggtgtatgactcagactattggattttatgttttggaaggctcatgctctgagaagcagcaatatatgagaacaaggctgaaggactgctgtaaaggaccctgtaacagtggctgaaggatgtaccagaaaacagaggacctgactctctcatatctagcacatatcttagaatatgcccagatcacccagtgctatgtaccagaaccctttatcatggtcacaggccaaaatgtctcatacaaaaagccatacagtgccctttgcactttttctaaatataaacaggaaaataatcaaaactatttttagcttacatggaagaatatctcggtatctgtttttttctctgttgcttggttgattcccagagttgaactcaccaggcagattcttaagttctaaagcctttaaaaggttaaaaatgaataaataaataaataataaattgtgtatttactataaccaataaaaaagaaaaaaatatgcctttgtttagtgctcatgatccttaaatccctatatgacatgacctgctatttaatgtgttgtatgataagtgaagctagatcctcatttaaaaagtgctatataaaatatctcaagtttcacatgccaatcaatgagttggttaataagaaaatgttaaactttctggagatactttccacttgaacttcattttcttcttctttcataaaaaaggaaatacaagctattcatttctcagaacctacccacagatctatcattttataaataaaaataacaacataacaacaacaaaaacatataaacaaaaaatatatacaaacagtctcacaatttacccttcccctttgaagaaattatagttaggaccctaagaatccttcctttcaaaaaatttctttaccaagtgtgaattcaacaaacacttattacacatttagtaggtacctggccctgtttcagacactggaatacagggatgaattggataatggcctcatccttaaggagtgaagagagtagttagaggacatgtaatcaaataccatgtgaccaatgtacggagacagtagtataaatgacagcactagattgcacctaaaagtcaagaagaaaagctcctcaaagggaaatagcccttgaactgggccttagtgagtcactggaagttagcatatgaaaaacagtgtgtatttagaaggaaagaggagagaaggtgaaggggtggaaataatggaggcatacatgtccctttgggaaactgtgactaatatggtaataagagcacaaagcacatgatctagtccaacaacagactaaaactataaaatatcttgtttcatatataaatgaaattaggaggtagctagtcatactttattagaatatttgtggagaaagcctgaaaatctatacattttcaaagctcttgggtaactcttgtgtagccaacctagcaaccgctgccatggggaacaaggagcctgtgaaggttttaagtagtacaataaaatgatcaagtctttctgaaaatcaattttaaaattaatctggaaaaaattctgtaggaagaatgagaaaaaattcatttatgaatgaataatgatggcagatgagtctcattagatgttaaaagataatatgaagctatgctaattaacagaacaataccaataaaggaataagaaaatcagtagaaaaagtccaagaataaattaaaatatatgtaaggctctagtatatgataaaagtggcattttacctcactcaagagaaattccaggagagtcttgggacaactggatagttatataatgctgagtccctatcaaacatcttataccaaattaaattctagctgcatcaaagatttaaatgcttaaaaatcataaaggtactagaaaaaaacatgaagtaattattacaatcctagagtaaaagaagcattcctaaagagcacagaaagccccaaacccagaagccccaaaagcaaagattgccatatttgaccactaaaaatcagctatttcttcacggtaaataggcatgtgtgtgcacatgcatgtgcacctgtgtgtaacacaaacaacagcagaaaaaatactacgtgtaagacacacaaaggcataattttttccttaaagagttagtaatcggccaggcgcggtggctcacgcctgtaatcccagcactttgggaggccaaggtgggctgatcaccttaggtcaggagtttgagagcagccctggccaacatggtgaaaccctgtctctactaaaaatacaaaaattagccaggtatggtggcaggcacctgtaatcccagctactcgggaggctgaggcaggagaatcgcttgaacctgggaggcggaggttgcagtgagccaagatcgcaccactgcactccagcctgggggacaagagcaagactcatctaaaaaaaaaaaaagagtaaccaataagaaaaaaaaaaaaaaggaaaatggggcaaagaattgaaactagcagttcactgaaaatataaaaggcttaaaaacatatggaaagatattcttttgttctcaaataaataccaattaagtaatcaataagaaataatttgtcatttaagagatgagaaaagatccaaaaaattgatagcccaaaatattaatattgtctttctaggaatttgttcaaaaaatatttaaatatatgcatacagtatatgaagagagatgaccgctgttcataatagcaaagactagaacaacctaaatgtccaaatgttccatggtagttaattatatggataagtaccctaatttcagaaattaaatattaaataaattaaggtacttatccatataattaccatgcaacacttaaaaaaatgagatactgctatacatgctgataatatacttggaaattgtatctaggaggaaaacaaatttaaggatgtaaagtgcattccgacaaatttttttaaaagtttgcatgacaaaatgacaaaatgaatagtgtaaaggggccctagaaagtcttgagagaaagagagagactttctattttatatccttttatgctatttggctttttttttaaccacgtacatctattactttaaaatatatataatatttaaaagtaaaaacaatgtactagaaccaaataaagaaagaaaagaaaagaaaccctctggcaatgatataaaaaaagaaatcacatatagactttcgttaagaaaatatttaccataaattcctgcatgatatcatacgctgctgttttttcctcaaggattttcaaacaatccttgatggctgtctgctcatgaaaattgaatattaatggccgaatctgagccaactgatctagttctccttcagaaacaattttgcgcgtatctaaggaagagaaaaattcacatatgtaagttactggtatatatgtgaagggagattttatttttgtttctgtttctcttaaagacacagccatttaagggtaaacagaagtttatttttccacgggtgaagagtctactactttgaaagaggcttcctttggaaaaatcatggctatttacaccttgaaattatacaaaatccactgcccttggagaaaactgttcagtgccataaacataacgaatgctgtggattgagaagtgttcagttttataatgtgaattgggtatatggattgaaaattatgccaaggcaagaacgtccaaggcttggattaggaaagagaacttttgccctccctgggaccaagtgtttggaagttcctagagtctgagatgtggtgacgtggagagttcacgtcctgtttcattactctgaaacagattgaacatgaacgcacacacgtgcacacacaccaaggatggagaggatctatgcaatataattaataagatggaataatggatacgtatggacacttgcaaccaataattggggagaacattctattaatatttaatagcacacatacaatctttttatttttaattatgatcttttaggtaatgttgacagtcaaggttccaaacatctgaaattttatacattatgtccactggccaaaatgcaataaatctagaagtcaacagtaaaagagtattttaaaagcttcaaaattttgaggtaagatgttcaagtaaaacaagttctcataatctctttgcaaagccaaataatgtgaacaataatcaagttaataccagcaaaaagatatatacaaaacaatatagcaaaagaaagaggtggaaatttctaagaatctgcacattcctgggaagcacatcttatcttggtactccactatatccagaggctctttgtagggttggaagtgagggctcttggttgggatagacaggcacagaaatcctaaaatttctcacaaatatccctaaccttagtatgagaggaggtctaagcaggctggaaggggagataaaattcccacaagcgtagaagccattttgatcatctttgatgcccaacagaaaaacccttagatcttcccattgtgttccacctttgctagtacaaaagctgggagaatgaagagagaaaaaaatgaaaatgtagaatgactgtaacaaacactggtgttgactccccaacactgattctacccctctggttagttaaagccatttgtgatcattccatagtaagatccttccagtgaataattcagaaataggtaggagatttgcgccaaccatagaaataggctggtcttgtaaaaaagagaagcaaacctctcttctaccctcatccctctgtacagacataaacaaagaagtataaggacctaattatcatagtctgccctcttatggccataaaaggaaagcgtatagcaaatgtgaaaaacataaagaaactatgttcttgatgacattagcaactgatcatattgaacctggaatccttcctatctctgggcttccattatggtagaaaatatatatatctttatcattaacatcattctgaatttggtctctttttcttgtagcctggtccaagaattccaatcaaagtataaaggtgaggtttcagctgtagatcctgggaatcatttcagccagtttacagaaagggatttgatctagctatttggtgttgtatcaccattgtgtgggcttgaagaacagatgcctctctcattatgatccaagaacaacactgcataatggtctgccaagaaaagttctgtctttgccacaattaggaaactgaggaagttggagaccattttttctagccactggctcctagatgacaccacttcagcaacaatggagaaataagaaagtcactaccacaactgttggctctagtaacacatcaccttacctataatgaggaccaggaacgccaagcctgctatgatgcatagcaataaaatggatgcctctctacacatttacatcttggctaagtgcatatgatcggcaaagcccaaataagctaccaggaagtcttgaaaatgtaatttttcatttttctgcctgggccatacaggaaggtacactaggagaagggtgtgactgatattgagtaagggcatctgtgatatctgcttaacatttcagccacaccatgccctttgagtatcctgctccttggcccctatcccttcagcacacttatcattgtcctcgggcaaaataaacaatgcagccctccaaaatacagtttacaagggaagatgatgagatccaaataaaaatggaaatcaggaagaattcattcctgctcaatcaacaaaaccgaagagacagaaaaagctatacatgttcataacaaaatggaataaaatgtgaaacacagaaaaaataataatataatatagcatgcagaataatttttaaaatctattctaaaatggaagataagcttaaaaaggaaaatgaactgtgtatgcaacatctgtcgaaagaaaaagaaaaattattttaaataagagttcacaaggagataagaaaacaatagaatgaggtttaaaaaaattagtttataaacctaagaaaataaaggtaaaactcaaaagtacataattacagcaataatttataattaaatcgaattctgcaagaaacaaagcaggcagttgaaaatcaacttattgccataggacaaaggcatgtatacatacagtaatgaagacaagaaaggtttaaaaacacagtgaaaagataatgcatgtgaggacctcatcagaggctcaggagaaaagctgcagacagggtgaggaacttgagaaatcctccttcgtggggcaagcttgggaaggggaaaaacagcatccacaggaatggcacaaagcatgcccaaaatgcttttccctatttccctaatggaccaaaagcataagaacctgagaaaacgcatgaaactctgtcatcctcaaggcacaaatgaagactcattaacattgggggtagggaagagagaagagcatcctggacccaggccataagatattccctacacctgcagaatggacaaaataataaaggaggtaccgcctgaggccttcctaagactgagactgaacaaggacagcagagaatgtcaccccaaccaggttggcaagcaaggtaatcataagtaagagctctctactgctgggaattagagaagatcatggagaagaccttctctgaggtgcatgtacaatgggaagagctaaagcagagggtggagtaaacactgaggcaaatcctctacatgtaaggtaacactggaggaatttgaagctggtggtgcactaagggtaaccatagcaacatcaaacccaagccctgctgcattactgagtaaattgatgcaactcctcacactgaaggcctaccaacaaaagagtcatgtccatccctatttacctcagcgtctagaacttagctaagaaatactacaatagctcccccttatctgcaggggatatgttccaagacccccagtggatgcatgaaactctggatagtattgaacctgatcgtcatcaactgaaacatatttttgttcatgtcttccacccataaatttaatgccttttccatcttaagtaagcatgtatcatgcactgtggccataactttggcactctgatgtgcaacagcaaaacttggatagaagattcattcttaccataggtctacgcaactttagcatatgatttttttctttccttattaagtcaagaactttcaccttttcatgtaaagaaagcactttacagcttccctttggcatatccaaattgccagcatcactactctttggggccattactaagtaaaataagggttacttgaacacaagcactgtgaggccaaaacagtagatctgataaccaagatgactactagttgactaagagacaggtagcacatagggcatgaatatgctggacaaaggaatgattcactcccaggcaggacagagcaggacagtgtgaggtttcatcacactactcagaacagtgtgcaatttaaaacttattgtttatatctggaattgtccacttaacatttttagtctgtggttgactgcaggtaactgaaactatgaagagtgaaaccatggataagacatttttacttctatctctagactatacaatattcagttttcaaccaaaaaattatagagtacacacagaagtaagaaaaagagaaaaaagttgccaagagacaaagcaatcaacagaaccagacagagatataacatatgttaaaactgtcaagtgatgaatttaaaatagtgataatcaatgtgtgaaaaggcagtgggaaaagtagacaatatacatgaacaaatggagaatttcaatggagagatggaagccataaaaataataaagtggaaatgcttaaagtaaaaaaaatattgtaagaaattaagcatgttattgataagctcatcagtagatttcacagaggcaagaaaagaattcatgaattacaaaatagatcaagaggaattatccgaattagaacacagagaaaaaaggtagatgaggggcagaggcagagaagaagagaccatccaagaactacaaaccaatatcaaacagactaatatattatacctgtaaatggaatcccaaaatagaagagaaggagaattgggcagaagaaatatttgaaaagataataactgagaattttttccaaaatgaatgaaagacaccaagcctcagatccaaaagctcatcaaaaacaatataagccagaagacaattgagtgacaactttaatgtaatcaaagaaaaaatcaaaataaagaaattaagatttcagtaaatacatgactaattataaaagctagtattcttgtaacaataatgtgtaacttcactttttcttttctacatgatttaagagatgactttttcctaaatttattagcctaaaaataaaaaaattatcataactttagattgtaaatcaacattttgttttctacatgagaaactaaagcattaaaaacattattttatgttttggaacacataatatataaaaatgtaattttgtgacaacaaatgaaagagatggggtcaaaactgtcaaaggtccacagtttttttttttttgtattttactgaattaggctggcataaattcaaattagagtgataagtttaggatgttaaatataatgcccatggtaaccacaaagaaaatagctaaaaacaatacataaaggaaattttttaagaatttaaatatttcattacaaaaggcaactaaatacaaaaggagacagtaaggcaaaaaaaaatgaggaacaaaaaagctacaagaaatatttttttaaaatagcaaaatgacagaagtctctccttatcagcaattactttagatataaatgaattaaactcaccaattgaaagaaagattggcagaatggattaaaaaataaaaacatgatccaactatacactgtctacaaaggactcactttagatccaaagacacgaataggttaaaagtaaaagaaatattccatgcaaacaggaaccaaaacagagcatgaatagctatattaatatcagataaaatcgattttaattttaaaaagttaaaaatgacaaagaaggacattatatatcataaaaggttcaatacagcaagaacatataacagttataaacatttacacgcctagtaacaatcaaaatacacaaagcaaaaattggcagaaatgaagagagaaacagttttacaataataattgaagatttcaatatcccattttcattagtggatagaacaattagacagaagtaagaaaagggaggacttgaacaatataataaacaaagtatatctaacagatacatacagaatcctctgtgcaacaacagaccacatatttaagaacacatggaatattttgcatgtgttaggctataaactaagtatcagtcaattttaaaacactggtatcacaaagagtatcttctcaaaatacaagagataaagttagaaatcaaatataagaaaaactgataaacttacagatttgtgaaaattgaacgacataattttaaaacaccaatggatcaaagaaggaattacaagggaaattagaaacatttagaaatgagtgaaaacataacacaacatatcaaaactatgggacacagcaaaagcagggttaaggggaaatttatagctataaatgcttacatgaaagaaacaaggcctcgaataaacaaactagctttacaacgtaaggaattacaaaaagaagaacaaactaaacctaaagctaacaaaaggaagaaaatagtaaagattagagcagagatcaaaatataaaatataaaaaagagaaaaatcaatgaaaccaaaagcaagttcttcaaaaatatcaacaaaatgatgtgatgaacctttaattagataaactaagataaaaagagaaaagactcaaactactaaaatcagaaataaaaatgaggacattactaccaattctaaagaaataaaaaagattataagggagtactatgagcaattgtatgcagaaaaactggataacctcaatgaaatagacaaatttatagaaacacaaaacctaccaaaaccaaaccacaaagaaacagaaaatctgaacagacctatgactagtaaggtgattgaataagttatcaaaactatcccaaaaaagtaagccctggatccaatgccttcactgttaaattctatcaaacatttaaaggagaactaacaccaatacttgtcaaactgtttaaaaaaattaaagagtagggaacactccctaacttaatctatgaggccagcattatcccaatatcaaagccagacaattatcctacatgaaaagaaaactaaaggccaatatccatcttaaacattgatgtaaaaatcctcaacaaaatagtagcaaagcaaatatttagcggcatattaaaaagatcatacaccatgactatgtgggatttattactggaatgcaaagatgacttaacatacaaaaatcaaggtaatacaatacgctaacagaaaaaaaggcatgcttatctcagttgatgcagagagagtatttgacaaaattcaacatcctttcaagaatatattctttttgagacagagtttcactgttgcgcaggctgaagtacagtggtgtgatcccagatcactgcaacctctgcctcctgggttcaagtgactctcctgctctgcctcagcctcagcctcccaagtagctgggattacaggcaactgctaccacgtctggctaatttttgtactttttctttagtagagacatgttgcctagggtggtcgtgaactccccaacctcaggtgatctgcctgccttggcctcccaaagtgctgagattactggcatgagccaccatgcctggcctatttgtttgtagaaaaaaaattcaacaaactaggaacataagaaaaatacataaacataataaaagttatgtatggaaaacccacagcaaatatactcaatgttgaaagagtaaaagcttttcccctaagatcagaaacaaggcacggatgccacttttgccacttctatttgacataatattggaagtcctagtcagagaaattaggaaaaaaaagaaataaaagccatccaaactggggaaagcaaaaagtaaacatctctgtttgccaatgatatgatattatatgtagaaaatcctaaagattactggattttacacacacatattcacacacacacagagttaaaaaaaataaattcagtaaagtagcaggatacaaagtcacacacaaaaatcagttgcatttatatacactcagatgaacaatctgaaaatgaaattaagaaaacaatttcatttacaataatatataaaaagaaataaaatactttgaaattaacttagccaagaaggggaagggaaagatttgtacaaagagacctataaaacattgctgaaaaaagaattaaacaaatatatctcatgttcatggtttggaagatttaatatcattaagatatcagtactacccaaaacgatctacagattcaatgtaatccttatcaaaatcccaatgactccttctgcagaaatagaaaaactcatcctaaaattcatatggaatttcaaaggaccccaaatagctaaaacaatcctgaaaaatatggggaaaaaagactcacacttcttgatttcaaaacttactacaatactacagtaatcaaaacagtctggtacaggcatagacagacatataggccaaaggaatagaagaaagagtccagaaataaaacccaaattattttcaaaaaagttatcaaggccatttaatgggaaaaacacagtctttacaacaaatggtgctgggaagctggatatccacatgcaaaataataaaattggatctttaccgaacgccatatacaaaaattaacttgaaatggatccattacctaaatgtaaaagctaaaactataaaactcttacaagaaagcatggcaataacttcaagacattggatctggcaatgattccaaaggtacaaacaaattttaaaaaatataattaataatactgaaatatacacttaaaatggataagatagtaaatgttatgttatgtaagatttacaacaataaaaataatttggagaaaatacctctaagtaacccacagatcaaaggggaagtcataagagaaatagggagacattttgttaaaaatgtgtagattgtattttttagaaaagttttacatgaaaaaaaaatgagcacttagaattcccatatatcccctgccaaagtttcacttattattaatgttttacatttggatggtacattcattagtattgaaccaatattgatacatttttgttaactaaagtccatcctgtattttggttttcttagatttccttaatatctttttactgtttcaggagcccatctaggataaaacattacatttagttgtcaagtctccttgggcaacttttggctatgatggcttctcagattttccttgtttttgatgaccttgataggtttgaagagtactggccaggtgtattcttcaatgccttactattgaaatttgtctaattttttctcatgattaagactggggttatgggttttcaggaataagatcacagaggtagagtgccatatttatccatagtatcaagggtatattatatcaacatgatgtatgacagttgatggtgaccttgatcacatggctgcagtagtgtttattaggtttctctactatgcagttattctttgtactcctctggccatactgtactctttgaaagaaagtcaatatgtgcaacccacacttaagaggtgggaaattatgatccacttcctttaaaattgaatattaacgtaatttatcaggaattcttctgcatgggagatttgtctcttcttccccatttattaacatatttaatcatttatttatatcagtatgaactcatggatgatgattttatacttcatactataatccactgctacattagattgttgttcaaattgttccaccttttgctacttagaatgagaaaacattataaattgaatgaaaataaaaacacctcaaaatgtgtgggatgcaactaaagcagtacttacaggaagatttgttgtattaaatacttgtactactgttgtccctctgtatttgcaaggaattggttccaggacctcccacagataccaaaatcctcagatgctcaagtcctttacacaaaatagcatagtatttgcatataatctaagcacaccctctctctcaaatactttaaatcatatctagattacttataatacctaatacaacataaatgccatgtaaatagttgttatatttttaaaatttgtaattttttgttgttgtattgttatctttgttcctaaaatatctttgatccatagttggttgaatttgtagatgcagaatctacagataaggagggccagttgtatttatgaaaaagaaatatatcaataatctaagtttccaccttaataaattaagaaaagataaaataaaatccaaagcaagaaggaaaaaggaaataataaagagcagaaatcaatgaaattgaaatcaatgagaaagtaagggaaactaaaagctagttcttggaaaatatcaatagaattgatacagtctctagccaaactgatcaagaaacacagaacaaagacacattttatgaaattgaaaaaaaagagaggtgatcagttaagataagacatcaaaaagttaatgagggaatattacaaacaactctagtcccataagttagacaatttacatgaatgggacaaattcactgaaaaatacaaactgccaaagctcattaaaaaaaagagagacacctaaatagtcctatatcaattaaataaattgaatattgttatgggctgaattgtggcccatatgtggccgtatttggagacagggtttataaagaggtgattaagttaaaatgaagtcattagaatagcccttaacgtaatataactgatatccttataagaagagattaagacacagatatacacagtgggaagaccatgtgaagacacagaggaaagacggccatctgcaagtcaaggagagaggcctcagaagaaatcaactttgctgacatcttgatgtttgactgctagcccacagaactgtaagatccattcttggatattttgttataaaagcacccccccaaaaaaaaaaaaaactaaaaactaaaaactaacacaaatatgtatttagaaacctcacaaattctgggtccagttggcctcactggtgaattttagcaaacatttaaggaagcaatactaccaattttatacaaacttttccagaatattgaagaggagaaaacacttcccaaataattttataagggaagcattactctgatactaaaaccggaaaaagatatcacaaaaaaagaaaattacagatgaatatctgtcatgaacataaacacaaaaaaagtcttcaggaaaatactagcaaatcaaatcgtaaaacataaaaacaatattacaccatcacaaagttgggcttatcccaggaatgcaaagcaggtgagatatttggaaatcaaccaaagtaactcatggtatatcaacaggcaaaaaaaagaaaaactatatgatgatctgaatagatgcagaaaaagcatttaacaaaagtaagagtccattcataataactccgggaaactaggataataggaaggctcccttaatctgataaatggcattcacaaaaatactacagcgaacattatactttatgatgaaaaacagaatgctttctccctaaaatggagaatctggaaaggatgtccactccctttcctcttattcaacattgaaccaaaagtcctagcgaatgcaataagttagtaagtcaaaaaaaaaaagaaagaaagaaagaaagaaaagaaatgaaaggcatatacattggaaaggtagaaaaataaaactgtgtttattcaccaacatgagtatctacttaaaaaaattccaaaaaatatatttaaaaggccctagaattaatgagcatttaggaaggttgaaggacacattggtaatatacaaaaatcaatcatatttctatctactatcaatgaacaatagaagttaaaatatttttcataagtctcatttacaatagcaccaaaacatgtgaaatattagatataaatctaacaaaacatatatacaatctatatgttaagactgcaaaacaaacaaacactgatgaaagaaatcaatgcagacctaaacagagtgaggaatgcttccgtcaggagaaacaacaacaaatccgttaaagtggaatttgagaacgccaccaggacattttgggttcctcatatgctactgaatcatcagggaaagggggattactacactgcctagtgtgctggattccaagtattaaggggaaactgggctgctgctttccaatggagtaacgaggaatacgtctgcaatgcaggtgatcctctagggtgtgtcaaggtgattaagtaaacagaaaactagaaccacccaatttaggcagaactactaatgacttagatcttgaggaatgaatgtgtgggtcaccctatcagacaaggaaccacaaccaaatgggatgtttgctgagctgaaagagaataccagacaggtgtaagacggcagtgatcaaaaccagatacaaccatgtgaccagctgcataaacagggataaaatattgtgaatttttctttcttttttgatatgcatattttatacatatatatatatcatatttttgttttcttttaaaaatattaaagggaatgtgaatcagttggaaaagaaagaatatcactcaagacaaaaaagagacacttttggagaaggggagagaatgttttcagttgtacacagattagttttatcactgtagatgcaagcataaggttgtccttatttggatattaagtaacatttaaaagggtgtatataggtgccaggctgatacagggtgaactgtgatagctttataatatgttgacatggctaggctggaccacttttcccagaattctgttctctgaatgtttccagctaaaacagggcacaagcgaggttctcatgtcagatctggaaggtgaacatggggcagcagctattctgtgctcagatgcactatggatgatctcctgactcccctcattctatatgtggaaggaagaacttaaaatcacaacagtgccaatcctacctgaatgaatataactggcatgtcattctatctaaatttcaaacaagtttacacaggaatgaacaaaataatttaaaatcaccgatgcagcaaaaacttgcccaaatagctacaaaaatgtattttttaaaaaattagagggaggattttcctttccagatatatttagaataagtagaatcaaaacagaataatataatatgtccacaggaacaaacaagtcagttagtgaaaaaaaatttagagaatacaaaaggatcaaacatttttggaaacttaatatgtgataaaagtatatataaattcatttgggaaatgtggtttacttagtgaatagtgctggtataactgtccagtcatatgaaagaaaatatagttttctatacccctataatatttagcaataaactgcagatagattcgtgatctaagcaaaataagtgaataaaaattctgaagaaaatttaggagaatatttgcatgtttttcctgtaaagaagacctttttaaacattttagaagttaagaatgttcatgaaagtctcccttcttaaggtatagaattgagggttacaatttatagcacatttgtcagacagacaacatgttaagatttccaacatgtgaagagttcctacaaattaataagaaaaacaatgaacaaagtttataaatatgcaaatccaagaagaagttaataaacatatattaagatacttgatcctagctgggcacagtggctcacgcctgtaatcccagcactttgggagaccaagacgggtagatcacaatgtcaggagttcgagaccagcctgaccaacatggggaaacctggactctattaaaaatacaaaaattagccgggcatggtggctaagcttttggaaaggaatctggtattgcccattaaaatataaaacgaacataaactttgacttaactatcttactttagggaatctaaccaaaatcaaagtaccagtacttaggaaatacgtgtaaatatatatattgcagaaaaagtcaactggagaatgggtgaatatattatggtatttccatacaatgaaatattagacaactattaatcctatgtcagaatatgtcttaacctatataataatatagtttaaattttaaaaactatggttgcagggtaattgtagagttgcagagcacacatcaatttttatttaaactttaaacagaaaatctgtttttatatctttgtgtattcttagataaactattatattggttgcctctgaaccaggattcaggatgatgggaggaaattattaactttttctctatatcattctatattgattttcactaaaatattagcatacattaactttataatttaattttttaaaattttggcttttaaaatattttattaaatgttaaataggtacaaaataataattaagtaaaatatctttaagaacaatacatacccaatttaaaacagaacattagcccctgatgctcctgtgtccccttcccagacctcattccttgtcctcctccctcagggaataatcactattctgaattgtactatcattccttttgtttgttttgtttaccctttatgctgttttgcatatttcacaaatttatatagattacattattttgttttaaatcttgacttttttgctaagactgcatctgggtttattcatcttcacattaaacaaaatacaatatctaattcatacatgctggtgttgacagatatctgagttgtttacagttgaagtctattaaaaacaagcctagtatggacattcttgcatatgtcttctggtagaaaaaggaaagagtttctctaagctaaataaccaggaaggaaattgctaggacatatggcatgtgcacactaaaaaaataccaaattattttccaaaatggtttccatcaagccacatactcaccaatatcaactattatcacatttttaaaaatggaaacaatctagtcagtgtaaattattatttcactatgatttaattttcacttccctgattcgaaattaggttggaccactttttcatattttctcttctgtgaaatgtttgttaatgtgttttgcccatttttctatttggttatcttttacttactaatatgcagtttcttatattttctaggcattaatcctttgtgagcatagacctcagtaacagaccctaggaggagcctaaccatagtcctaaactgaaactgaaaaggagggtactaagaaagaaaaaagcagtgtctatctacttttccctaggaactggccttactctaacagctaagaaatggtatttcctgtttgcaaagtaatgtgttcttatttttattttaaaaatatatttatattcaaaattccacttctgcctaaatatagaaagctagtatgagcatcactcctaccctaacaatatacataagttgaaaaaaaaacactaaatcaaaattttattgaacccattagagagctgaggttgcagggcaaccaagtagtctgcaatctaaggaaagacagactctcctaaggagtgacaggacatgaacactggctccctgtggcagttcaagggagaaagagataccaggcactatacaaatgggaaagaagtattcagacataaaatgtaatgcactgctgatagctggatgtgggccagtgtgacagtacagaacagcgtaaagccacagacacaaaaagaacttgcacacattcacagactcaagttcacagacctccaacaggtgctcataagaaagactgagagcagagcaggaaacgggaagaaccattccctcagaagggtaggcttggaggaggggagccactgtcatggtcgaaaatgcgtaaagccccacttagacctatttctcccagaacaaaagccttacactgcaggaggaggagcagcaatccctgctttgtataagtgtatacccactgcagttggaaacagagcaaacaaaatccatctattcctggagaaggtgcagaaaacagtcctaagcccaggatttaatgccattattattacaaaactcctaccactacactaagtgaaggggaggaaaccttctccactgtagacttgccaaaggtgtcaggcagagtctggatgccatgagaaggggtagtatcactaaccaagcctgtcactgaggaccagggacagaggacctgcccaaggctgagaatggaataggacaacaaagaatgacttggccctccctccccaggcacgcaagcaccagtctactgctggaagataggcaggagaaggaaagaaagcccttctaaagcacaggcacacaggggaggcctaaagctgaggacgaaacaggaagagaccaaaaataaaaactccttagcaccccagctgacaccctgcgcacaagctaaatcctaaggaattctaagccaatggttcaccataggtaatgagagcaacacaaaaccaaaacccagctcatgtcctaaatggcctaccagaggaataggcatgactatttctaggcataaattctatttactttagtctctttttttctacacccagtaccaacactcaatcagatatatagacacataatgaagctgcagcagctgcaacaacagaagccagtgtcaaaaagcaaagcaatcacagaaaaaaatatcagcaacaacccatctgtcagagttatccaccagggaattttaaataactatcattaacatgttaagctctatgaaaaatgcaaacaaaacgcattaacaacagagacggaatctgtaagaaggtgtcaaatggaaatgttgtacataaaaaacactgtgtgctttcaatgggttcattagtagacttgacacaaccaagaaaggaatcagtaaacttgaagaaaggttgacagaaattacctaactgaaatacaaagagtaagaagagtaggagaaaagaaaagtaaaaagcaacaaataatgttagtacagcttctttggaatacagtttgtctgttatacacttatgacccagcaatcccactcctagatatttaccttaaagtaatggaaacttatgtttacacaaagtttgtgaatatctgtagtacttttatccataattgccaaaatctggaaacaacccagtgtccttcaactggtgaatggaatactattcaataaaaaagaaattaaatactgataaatgcaatgacacagatgaatatcaaaagaattatgctaagtgaaagaagttggactcaaaaggctacatatttatgattccatttatacaataccttgaaaaagacaaaagtaaagagaatgaaaatagattactggttgctaggcaccggtggtagggtaaagggttaactataaaaaaatacaagagaaatttggggggagatagaaatgtactataccttgattgtgatggtaaaccttggtcaaacctcatagaactgtatgctaaaagggtgaattttactgtatgcctcagtttaattaagcatgttttaattaattaaaaattatgtctcgttttataaaagcatattcttataaactatttttgtaggagatctgcattttaataattgcataaggtgatattttcttaactggatttgacatttttcaaataaagtcattagagaagatgtttccaacatttgatgggatgttggttatggatgacctctaagatcctctccaactccaaggtttttgaggtgtgcatgtgatcccccaagtttacaaacacaaattttataaatatatatatatatatatacacatacacatatatgttaagtatatattcatagttctaattacatttatattatatatacatgtaaatacgtatacacaaaaagttctgaaatattcttcagtattataatttattatatatttgttattttctttttttccactataaacatgtgataatttgtaatccaaaaatgttattattttacttacaaagcatatattgtgcaacaaatttttaaaaaggaaataaggaagcaggttatttttcaaatctataaaatacctagctttaaaaaaatggattttactaaactgacatatttaatactttaaaatacttgaagaaaggacaggaattagccattgtgaatatggggtgtggagcatttttttaattgcatttttttatttttaaaagaaaatcctagaaaaccatattttcccatttttgaagttttccctagctctttctttcatttgtattagaaatatctttgtgcatatctctaaaatagagcctcaacttgctactacaaataggatgatgtcataccagaaagtagaggggagagagcctgtgatggccctgcagcctcctcatcctcactgctccacctgtctcttctgaaggggcctctggctgtccacatgctgggatcactgccactagaaaagaaatgtatatatttgcccatggtttcaaagaatatatacatttgagaaatactttctaatcatcttcattgattatttaattgacattcatttccatttcaattcagccacccactcccattgtcatcacctgaaactggcccacttgtgaaataattcccaaatcccaatatctgatcacaaactccatctcctcctactacttttaccttgcaaactagtcgcctcagatccatccacttatttaccttctcccctcctttacctagactgtgggagggaagtactcgggtcactgggctttctaatatcggcagagagccgtttggaaaataccagcatgtccctggttggtttcctgtaccactcttccatggcagcaaattccaagccaccatcttgttatagtccttattttaatactctctctgacttagtaaaaatgtaacttcttctagaaaatgcaagccagaaaatagaaattctttcaatttattatcttttaaaacatttacttagatgcatcaatgtctttcttattccttgctttctgcctgttcaaaattcctccttccgtgttcttaaccagattccttctgcctcctctaaggtatttttctataacttatttttttttaacatatcgtgaatttctccctatctacaaattctttcatatcataagaatacacaattttctgtatcttaaaaataggaaatgctttaaactctgtctagctactaattgttaacagatttttcaaatcctagcccatacccactttgtttcctttgcaacgtctccatactcaactgactcgctaatgctattaacttggctcttgttgcactttcatttgcaaccctacctagcaaaatcctcctaatttgacttctgcatctaaccttcaatgtttagagaaaattcttcctaaaatacaaacttaattacacctgcccaccaatatcaggataaatcaaggccccttatcagacacaaaagtttaggatattggccaggtggcctctgtctatttttccatcaccatctccactgatttcctacatgcactgtatgctttaaccttagcaaaataagtgcctttttcttttacttctgtaagaaaattcgggtttcttactcttttctccttctaatttttttcttggattactgtaaacatttaattaatctccactgactgccacttccagctatcctcaccttgccaccagcattcctccttctggatggataaatagatagttgcatgaataaaacaaaaagaccctccgtatgcatccttttgattttaacagactgaataaaatgtatactcagcttcacatatatggcattacttccctctccagcccacactgtattttgggctccacctctcatcttctgcagcttcctagcattccacctcacatacaccctacgactcttggcacctaatatttctccccattacccctaagatattttcacaactccttaccctcgctcaaacttctccctcttgcctgaaatgttcttctctttttcacctgctaggtttctatttaattaaatcctaaattcaaccaaaatatcttttcttcaaagaagcttgtgggaaacctccctcatgcatagtcaatcttctgtacccacaatctttggatttttactctaaaataatatttactatgttgtacatcaatttgtcttttatatgtctgtttccctaattaaactgtgaactaaagagcaaaaaatatatagtagtttgtatttgtgtacagtgcttagtgtatcacagaatctcaaaatgtctttggaattactattatttgtttaatgcacttctgaaaattgtacatataaatttcatacaatacgcatacaaaaacacataatataaagaatatacacattcttatacagtgctattccagtgagggtagctaatattactgataaatctctaagaaaatatggcttaacaaaatgtttcctcatttgatgtttttgcttataacacctaaatttgaacattttataagcatgaaaacttgtttctttgttttcctaatggaaatttactgttcttcaggtactttaaattttttaaatatatactaccagaaattcaccatactaataaacctgttgtttataccatataattttctttctgaaaacagattacatttctaataacatttagtgctgtaccgtgagcttcatgctacctcaagtacactgaccacttcaaaagctccaagcatatttgcaaaagctttgacgccatgtaactattgagaggatagagaaatcgaatccttcaagaatacttttcccttatgttaattaccatatttttgagatcataaacatatttctaagaaagctaaatcaagtttataaaaagctatatcttgaaaaattaaacatttcagggccattattcactgtctccatgcagagggctagctatgaatataagtagcataaacagaaaacccactaaataagcatattagttatacctttctgaaggctcttcaaaaacatcctcataatcattatgtgggaaattccgaagagaaagttttaccttctctgaattaactttattttcaaaaacctacagacataagaaaggaaacaaattatagcactggttttagaaaaatatggtttaaaacgtgatttctatagctacttaagaagagcaaaaagatctgcaataatggaattataaccacaatcacatagtataatgtctgctcctagaaaatcacttaattgtatatctccctattaaatatcttccaatctgtcaaaacagtgtagagtactatgtaaacagaagttatttatattgaattgctcaagtgatttttcaaaactaaatttttaaaaagcttcatttgagaaaaaatagatttattacttcagcccagaagagattttcttataagtgtttaccatgttttgtttactgtgaatataaaattcctgccactaaatttatctttactttagtacttgcaccatctaatctactaattctaagtatttctccacattccactgcccaattttgcaccgggcagtggacttcagtcttgataactcgcagtgccagtgccccagccaccacatacacgtttccttccttccttgtctaatactgtcttgccatacttggccttctattttctcaagaacatcttttgaatcagctgatcaaatctcattcacacacagaaataactttgggactattattgaaattaagtaatatgaattttttaatttaaattggaaataagtgatgtatttatatattaagtatcattatccactaatatgatatagctatccagcaaaaagattataaaatattctcaataaagacaatgtataccttttcttagatttactcctaaacaccttaagtggcacaattgtaaatgtaatgtcatagagcagaccttttatttgatacacactgctcaatccacaaaccacatgtttttacatctagtatttttgtgtacattccattctaaatactttaaacttccattatgatttcttctttgactaatgagtttgttagtgtttgcttggtgtatgtttaatttttactttaaaatcacaggaaaatgtccacctaagattccttctcattaaactatgtagctacaatacacgaaatgaaatgagcttcacagaattgaactagttttgaaatcagcactgattggcaaatccctaaaaattaatttcaggataattaaaattgaaatgtagaaagtgtggctccagtgggatggaggaaaagaagtgggacacatgctattacacaacatgatcccacttccctcttacgagacatgcttaaaagtcatttgagtacaattcatttacttagaaaaagtgatatctggaagtcctaacacaatttaaacctgagacatctttcagctcatggttcaaaatcaaatggattatatttattttttaaagaagcagactgttccagatggctgcaattcaaatttaaggctgactaacatatgtctgattgagtgaaaagtgattttgctaacaataccaagaactaacaaggagaaatataataaattatcaagatggcaggacttttggagattgctcacggaatcaaattaatatcaaattttttaaatgttagaaaatgttttctgaggagcctaagttagcttttctgtagtccatgcagcaaggatttatgaggacaaagtgaaaacagtaacacagataggagcctggtttctagtctgtgactcaagagttatatgatcatagacaaatcgcttcagctttcacctctaaaatgagtgctggcataaaaatgtctttaacaggccaggtgtagtggcttatgcctataatcccagcactttgggaggccaagacgggtggatcacctgaggccaggagctcaagaccagcctggccaacgtggtgaaaccccgtctctaccaaaaatccaaaaaataaattagcctgtctcaaaaaaaaaatttctttatgctccaaatctaaccaacttcaagtctatgagtctagacaatttctaggggacagcatcatatctgaaaggacataaaaatggctacagtatcaaattgtttcatgaaacataagaaaagcaagttctaataaaatcaggtaattttcccaacactataaaaaccatccaggaatgttctaagatccttttttatgaaaggaaactttaaagcatatcagaattcaccctagataggccaagctataacttagcaaaaaaacaaacaaacaagcaaaaaaaaacccaaagtaaaaatataaacaaaatcacaaaatgtgctcagttctagaagaagtcaaataagactataagactatataaaggatatacttgggccattctgtgaaggtgctccctttcaaatcgtctctgcttcaaagagaaaaccattctgatcagagaaaagaatcaagagtgagcggagagcccaacacggcactaacagccagagattcccagccaaagatgtgatggtagccttgatgtggccaacttaagtatagcagagaatggacaggagataataatcaagttacaacactgttcttaaaagctgcactcctgcccacctggggtggaggtggcaattgaacaggggaagtggtaggagcagtttttggtctatgtactgactttatctctattactcctgtaacttacaggaaatgaacacaaggccagcatcatcatcgcagttccaaagctccagttgactaggtaagagaaaaaaaaatgcaaagcacccaccagactaaaatgcatttccctttttttgtgctctaaccctagcactatctccacaaatggggtaatgtgttgaagtaagaggttttgtcacagacttttcacagccctctacttttccatagttcggagacacccaatcatgctgtctcaaacaatgaaaaagtccacaatcaatacatctaaaggtgcttcatacttcatgtgacatttattttgtatcttcattagtaacacaaaactagtgcctgtaaaatttccagagtagcattagaaaatgcaattcattagaaactttgcaaaaaattccactctttcaaatccccattttggtcactgtcaacactacagtgacaaaaaattaagaaatcattttggtgagaaccaaatagatacccatttcccagagagcacagtcagcaatttaggtattagccaaaattagtagagatccctctccttttagtcttacctttgatctaggtgtgttttcctgacttgatgaaggcaaagtctccctgaaattcaagtcttctgcttcagagtcatttccctcataatcgtttactgaacaaaggcggggggaaaaactgatcaaatagaaaacactatacagaaggaaaaatggagccttaatgagaaaaaacaagctacatgaggggcattttcatctacttttcctgttttccaaacaccccatctttatctcctatggtaatcatctctttctcccctgctttgaaaaaatcaacatagcaaagctgatccttcttctaggattatcctcagggagttgacttttgagcggttcccttgttcctcattgccatattattcaagaaagtactcttcaagtaaatcctagatatttacaacctgcagaacctatgcattgggatctacagaatacagtcttctgtgtttcagagtctatttcttgaataaagaatactgtgttacaaatgtcgcactgtaacttcttgtattatttataattcataagttagtaatatgttaaattatacagaaaattgttttcggctttgttgaataatgtaatatgaatcatcccaaggaaactctgggtttcttatatgattattcctaattactgtgttaattttactgcacagactctttcagataagaagccaagagaaaattttctctgatctcagtactgagcactcagagtactgtttctcataccatgggagccttaaatattatgatttagaaattctatggcatggcatattaccaaatcaataaaaatatagtaaacaagtactatggaaatgaaaaagtgtgttcctgaatgtgtgttaaaaaggaaatctaatagaaattatgaacctttataacacatgaattaattttataaattaaaacattaagaaatatcaatgaagggacaacatatcaaaactaatgtgaagtagctaaatgagtatttagatagagggaaaatgtataggtttaaatgtgtttacaaaaaaggcagaaaaaaaaagctgctataaatgagttttgtattcaatcatagaagccaaagaaaaactgaggaaacccagagaaactacaaaggagaaaatcataaagaaaaatataataacagaaaataagcctaaagaataatcagcaaaatccaataaactagttctttgaaaaaaaaaacttaaaaatacgcaaccctctttcactacaaatcaatggagagtaagtgcacaaataacattaaaaatgaaaaaggatcgcttctcggccttttggctaagatcaagtgtaaaaatgagaaagggcacagctacagatgcaactctcatttttaaaggtaataagcaaatattatgagaaactttagggaaatctgatgaaatggaaacttttataagagaattataagttatgcaaatttactccagaagatgtagaaagcctaaatagtgtaataaccatttaaaaagtcaaaccaataatcaaaaatatcactcccaagaggaaaaagcatctgggcccaaacaggtttccagatgggattttatcagactttcaatgaaaaaaatctctcatgcaaacggttctgaaaataggaaattccgcaaacctaggaaggagcttcaagtgctagaaaaaaaattaacaggaaaaaaaagtctatgagaattgtaaacaagcaactcatagaaggcgacttacaggccaataatatattcagaaaaagtccagcctcacctgacaaacaaaaaatgaaaagtaaaacaacctacaattgactttcatttatgcttatgagagatttactgtaataggacttaaccacaaccaaccagaaaataggacaaaatatataaaacaataattttcagaccttaaacaacagactgtgatcccagagagaagggggtgagccttctggttgctccagattatggcctccagaagtttgcaggctatagctcaggaaaggaatcaacgagtccagtgattcaatgagttgagaagaaaaagatcaaagttaggagaggctgaggcagccagaatttgtagggcagagtaccagggaggagggagctatacagaacaagagaagtctaagtagctgcaaagaaaccctctcatgtcctttgcagaatatggatatgcttatatgaaggaggacaatctctgacactcaggaaggaccaccggaaagtagcaagccacacaattcctaggaacagttcataggagccagaatgaggagaccctgtaatacagggggcgttgaggatagtgcacagaagagatacctcttagtactaaaactatccttggaacagaagctccttagggccacctataaaaaaggtgaagagcaagcctcagacaggatcaggttaaacttcaagtaacataactacaaggcagaaaaacccaacattctttaaagaaaaatcaaggccgggtgtggtggctcacgcctgtaatcccagcactttgggaggctgaagagggtggatcacgaggtcaggagttcgagatcagcctgacaaacatggtgaaaccccatctctactaaaaatacaaaaattagctgggcatggtggtgcgcacctgcaatcccagctactcaggaggctgaggcaggagaatcacttgaacccaggaggcagaaggttgcagtgagccaagattgcaccactgcactccagcctatgagacagagtgagactctgtctaagaaaaaaaaaaaaaaaagaaaagaaaaagaaaaaagaagaaaaaaagaaaagaaaaagaaaaaatccagcaccaaaatcatataattcacaatgtgtagtaaacaattaacaggtatgccaaggaatagaaaagtataacccacagccaaatcaatcaatcaatagaaatgtacttagaaatgacagatgataaaatttagaaaaaagaacttttaactattataaatttttaaaaggtgctcaaggaaataaagaaaaacatgatacaataaaaagagatataaatcatgtaaaaataagacctactgaaatttctagagacaatgtatgaactaaaataaattaacagcagataaggcagaaggaaaaaaaatcagtgtctgtcaacatacagcaagagtatatccaaaatgaagcgcacagtagcgaaaaaaagagactgaacagactcagcaaactgggacaacatcaagtgaactaaaattcctgtaactggaatgccaaaacaaatatgaagaaataatagctgaagtgttaccaaactagatgaaaactataaaccaacagaccaaagaaggtcaataaaatacaaatgtaatatatgagcttatagaaaaatcacattcatgtatgtcatattcaaattactgaaaagaaaaaatgccagagaaaacagacacattaaatatagaaaaacaaagataagaatgatggatttctcatcagaaatcatgcatgctagaagataatggtgagacattttaaagtattgaaagaacatagaattcttatagaatgtcaatatagaattctataccctgaaaatatatatttcaaaaaataagacttctgtagaccaataaaaactaagattatatccagcctgcactaaacaacaacaacaaaagttaaaggaagtttttcaggcacaaggaaaaggataaaatatgaaaatgtagaactatccaaaggaatgaagagtggcaaaactggaaaatacatgagcacataaaacatactctttcacatgttctaatttctttaaaagataactcaattataaggaaaaataataatctattgtagggtatacaacactcacaataaaattggtatcaataatagcatgaaaggcaaatgggaggaaatggaagtatcttatgttcctacaactatatgtgaaatggtaaagcagttcccgcttacccacagggaatgcctagttccaagacccccagtggatgccgaaaacttaggatagtacttcctgcactgaagtcttaaatccctcaaagtcatccatgagggttaaaatcagtttttcccaaactcccattaatgttgacattttgacctcctcccataaaccacaaatgttcttaatggcgtctagaatggggagttatttccaaaaggttttcaatttactttgcccagagccatcagaagaatcactatctatggcagctacagccttacaaaatgtttcttaaataatgagacatgaaactcaaaattactcattgatttctaggctatggaatagatactaaatcaggaactaactcagtaatttaaaaaaacctaccaatcagaaagagcccgggccagaaggattcacagtcaaattctaccagatgtataaacaagaggtggtaccaatcctactgaaactatttcaaataattaggaagagggactcctccctatctcattccataaggccagcatcgttctgataccaaaacctggcagaacacatggtctaatatccagaacttataatgaacttataaatgaacaagcaagaatcaaacaaccccgttaaaaaatgggcaaaggacatgaacagacacttttcaaaaggagacatacacatagccaagaagcatatgaaaaaatgctcaatatcactaatcatcagagaaatgcaaatgaaaaccacaatgagataccatcttacacaagccagaaaggctattattaaaaagtaaaaattaaaaaaaaaatgtttgtgaggttacagagaaaagggaacacttatacactgctgatgggaatttaagttcaaccactgtggaatgtggtttggagatttctcaatgaacataaaacagaactaccatttgattcagcaatcacatcactggctatatgaagggatataaattgttccgtcataaagacatatgcacatgtatgttcatcacagaacttttcacaatagcaaagacatggaatcaacctacatgcctgtcaacagtggaatggataaagaaaatgtggtgcaaaaacaccatggactattacacaaccataaaaagaatgaaatcatggctgggtgcggcggctcatgcctgtaatcccagcagtttgggaggccaaggcggatgaattacctgaggtcaggagtttgagaccagcctggccaacatgatgaaaccctgtctctactaaaaatacaaaaattagccgggcatggtggcacacgcctgtaatcccagctactcgggaggctgaggcagaagaattgcttgagcctgggagatggaggttgcagtgagccgagatcgtgccactgcactccacctggctgacagagcgagactctgtctcaaacaaaaacaacaacaacaacaataaaaaaaaaaaacaaaaaacagaatgaaatcatgtcctttgctgcaacatggatgtagctggaggccattatcttaagtgaatcactacctgggtgatgagatcatttgttcaccaaaccacagcaacaagcaatttgcccatgtaacaaaccttcctatgtacccccaagcctaaaataaaagttggaaagaactagtctacaaaaaagtttgggtagctttccatgtttttgcatattctagcttaactgatttatcattaaaattagctttttcataaaagtttgcaactgttaaaggatagtttccagaaaaagaaaatcacagctctcatacagacatataaatgcacatgttactttattatattcattaatcagtgagggaatcaggcagatgttatttttaaatttttttttaaaaaacccataatactgtgtgttagtctgttagcatcactacgtaggaatgtctaaggctgggtaatttataaagaaaagaggtttgttctggctcgtggttctgcaggctgtacaggaagcatggtgctggtatctgcttctagtatctaacctcaggaggcttatagtcatggcaaaaagtgaatgaggagccagcaaatcacatggtgagagacaaagcaagagagaaggggaggttccagactcctttgaacaatcagatctcacatgaactgagagagcactcactcatcaccagggggataacaccaagccattcacgaaggatctgcccctatgatccaacatctcccaccaggttggggattacctttcaacatgattagaagagataaacatccaaactataccatacaggaagtccttgccagagcaattaggcaagagaaacaaacaaaaggcatccagattgaaaagaaggaacaattaggcaacagaaacaaataaaaggtagccaaattgaaaaggaggaagtcaaatttgtccctgtttagagatgacatgctcttacaaatgcaaaaacctgaagaatccaccaaaaaactcttagaactgataaacaaattaagtaaagttgcaggatacaaaatcaacatgcaaaaatcagtagcatttctataaaacaataacaaactacctgaaaaagaaatcaagtaagcaatctcatttacaataactacaaaaaataatacctaggaataaatttaaccagagattaaagatctctagaataagaactataaaaaattgatgaaataaattgaggaagacacaaaccaatggaaagacatctcatgttcatggaataaaagaataaatatttttaaaatgacaatataaccaaagaatctgagagctcaatgcaattcctatcaaaataccaatgacattcttcagagaaattttaaaatcataaaattcatatggaagtacaaaaaatactccaaatagccaaagcaattctgagccaagaaaaacaaaaacaaaataaaaacaaacaaacaacaacaacaaaaaaacaagaacaaagcttggggtattacactacctgacttcaaaatacactacaaatctatagtaaccacaaaatcatgatactggtataaaaacagacacatataccagtggaatagaatagagaacccagaaataattccatatgtttatagccaactcttttatgacaaggcacaaagaacatatattggggacaagaaagtctcttctataaatggtcctggaaaaaactggatattcctatgcagaataaacttagactcctatccctcatcttacacataatctgacttacagatggaatccaggctcacaaaagcagatagcagaatggtggtttccaggggatagaggaaggaggaaatggggagttgttggtcagatggtatcaagtaacagttacacaagatgaatacgttctgaagatctgatgtatagcaaaatacatacaatactgtattgtaatgatatttgctaagagggtagatcttatgtttgtaatacacacatacacacaaagaaagaaaatggtaactgtgaggtggtggatatgttagcttaattgtggtaatcatttcacagtatatagacaaatcaaaacatcaagttgcacaccttatgtatacacaatttttgtcaattatacccgataaggattggaaaaacacttctagggagagagcaataataatgacaaggagggcggatagaagagggaatagaagctgggctgaaggtggaaggaatgagaaaaggcataaaagacatactgaaaaatgatggcaagctactaatgttttaagcaagacaatggcaatatgggtcggctgggagacagctgacatttaactaaaacactgcattagtagatgtatcaaaaaccttagaaatgtatatgccctgagttcacagctaacaaaattatggaaacaaacagctttgtggcagattacaggttgtttttattgtcttgttgttttctttgtgttttggtgcttttttgtacttcccaaattcttcacaataaacctatattacatttataatcaggaaaaaaaaatgccatttgaaaagggtaaagtaaaacactagagtttaattgttgttactctaagcgtgatggcttattagaaatgcagagtcttgccccccaccccaccccaccaagacccagaggatcagaatatgcaggataataatccacaggtggtccctatgcaaatctacagtctgagaggcactcctgtagctcctcctgatcccatacccacaaaagtagatgatgcacctaccaggctctgctctaaagtccctaggtgaagacatgttgttcccatcccctaaatgagactggtaaaaggcttcttcagaaaaggagccttagtgtcctgtgagtcaggccaaaggtctagttagtatcctgggggccagcaaacaatttttgttcac

SEQ ID NO: 2162 - DNA, 90882 bp, Homo sapiens; identical to SEQ ID NO: 2160

SEQ ID NO: 2163 - DNA, 90539 bp, Homo sapiens
acacagtaaatattttattttaataatagcatagaattcttctgaagaaaattgttatacattatagctattattttacagtaacagagagaaaataaaattagagatacaaatattaaaggccaattatcaaaatgaaattaacacagattattattcatatgaacaatgtaaacagaatcatctatttgatttaacatcaaatatatttttggcatataattatttttacaatgagaattattaattattcaaccaattcaaatatactcattcagccaaaagaacaaaataagcctcttagaaattcaagatttatagattgatattaaacattttctcaatacatagaatattctgatctccattgagttaaactgtacaaacactcatatctattgttttatagcttataattaggtatagcttgtcaccagaactccttgtccaaaatatcactattaattgtacgaggcaaagtcctataataaaattactgtaataatggccacatcttttcaaaaacagaatatggaagtttccattttcatgactatgaatctggttttccaaaattgggttcccaaatccagtttctaaatgtttcaacagaggtgagaaagtaaaggaaataaatgatttaatggaactctggaaaaaaaactatcatagatcttagtttgaaaaatacatcaaacatgagatataccatgaatgactcagaattatataataatgcctatatcaaactttattagttagctaaagggcaaagagtaagaggcaagttaaaggtaatacttgcttttaacaaagcagactaagtaatatgttaagtgttagggtgggataggaaagaactcaggcatggcaaaaatctcctcttgggctttctatataaacatctattttagttttggactgttcaccgagaggagctctccctatccatgaaatgcttcccagaccaacaggtcttggtctagcagctgtaggaaggcagcagtatgaaaatgtaggaaatggaagccaatttgtgtccaaagttagtccaccctaactggactctttttaaactgggttattcaaatgccagcaaaaagtacaggctctagctaaagaacatgaatagacatctgtcttaaaaatgcctggaagaggtcatgattattggccttatgttctcccagaataagaacttacaaagtcctggaaatcctcagctctctccagccacctttccaaataaaatcttaatgaatatattttaaatcctttattgggctctgtaatcccttcaaccaaatagccaagctgcaatcgttttatgtaacatctgtttcactggaaaatgtgggaagttattttgatattgtctagcaagatcaataagtaaacactgatcaccccaagccaaatgatattgcccttcagggagcttttagaaagaaaataaactgataaaccaagaaagcagattgtatgcatagcaaagcccttcagcacagtgcaaacatgttctttatgaggaggtgcaaacccacttggtaatttcaagtgagaggcaacagaagtctttcttaatccaaagtcagaagtttccgaagaacttcaagcacaatatcgtaacaaaagtgatactgctcctatatacatatatataaaaaacaacagaatgttaagtaattgaataacagaatccactttcagaaaacacatttgtaattttcagccacactggaaagttcctaaaaagagcaaacatttaactataaacacttaagaactttacgtgaatacatttttaaaactatgaggaagataaatgatcaaaatatagctcttggcctagaactagttaccttaaggcttaacataactgttttttttatcattatccatattctattaatctaccctcccaatgactactaacaaatctgtgacataaatgatgtctttttatgacgtcctgataaccttgacagtttagtggcaagtaaatatctcaaactgctatccagaaatgttttaaaaataactttagatgttacttaaatagcacggcattatggacaaggcatgtgtttggacacgaggagacctcaacttcaggcttggctcctccccttctatctgagtgaccccatggagcaggctttattgctctgaatttgaagtacttggtcaggaataccagagaatcagagcaaaactaatgtctacctcaaacagtaggaattcaatgagattatgtcaataaaagagcttttaagtggtaaaatgttatgcaatgttaatctttatattcattattcttattattatgtatgtggtgaaagcttaccttcgtttgaaccatgccagaacgttgttctctcatttgggccactatatccatgatgttgaactgtaataagatgacagtaattttgtatgatccacatgggggaaaaacacaaattcacagattgccaaaaagggtgaaagagatgtcaagatttaatcagaaagatctcattttcactcacaagaaaatgtgctatttttaacttagcccaatggataaggaagactattttaataggttttcaggagaaagcaggaagcaatcattcataataagaaatgctctccaaaataagtaataaatttgcccttgtgtgtccctgtttgttatccaaaggcagaacttaaagcagcactgtaattctggaaaggcacagaagactttctctggccccaacaatagcatatctgtttcttatatgaagatccctgtcaactcacacggaaactgggagcaacagtcgacccaacactagattccagactgtgtgtggacaccagtacagctgggtgtggtcattgagttggtgcaggcctacaaaggtctgttgctggtccacaatgagtcaagaaactgggagtaagtgctcagaaactcttatggcaatttgacactggcacagcactgagaagtgtgctcaactgaacaggatatagaccagctcaggtgttgctgaacttgcctggagagtcacatgtgggacaagctgagaatgagtcgtttcagcaagacattgtggacacatgtaaatgttgtcaactgtaaccccaaagcatataaaaatagaaaacaataagcattcctttattttcatagcttatcatttttataattaaaatttttaattaaccctttgaaaaaactttttgttttttagagacagggtcttgctctgttgtctcagctgctggagtacagcggtgtcatcatatttcactgcaatctcaaactacaatcctccctcctcaacctcctgagtagcaagaactataggtgcgttccaccatgcccagctaacttttttatttttatttttgtagagatggggtctccctatgttacccaggctggtttcaaactcctggcctaaagtgatcctcagccttggcctcctaaggtctgggattataggcgtcagccaccatatctgccataaaaaacattttattttataatacagatatacaggaagttgtacagggtggccctgtgtatctttcacccagtttcccagatggtgtcatcttgtttaacaagatataatatcaaaaccaggaaactgacattgggacaatccacaaagcttaattcagatttcaccagttttacatgcaactgttagtgagtgtgtgagagtgtgtatgtgtgcatgtgtgcatgcacagagctccatgcaattatatcatatgtgaagattcatgtaactataaccacagtccagatacagagctgttccaccacaagacttcctcctgctatccctatagagtcacactcatccaccccaatctctaacccttggaaaatagtaatctgttctccttctctatgcttttgctatttcaagaagaaatagcaaaattcactatatgaataaaattgcacaatagctaaccttttgtgattgacttttttcccacccagaataacttggagatccatccaagttgttggtgtaacaatagtttgcttccttttattgctaaataatattccatgatgtggatatgtgccactttatttaaccatcaatttgttgaaggacatctgggttgttctggtttttggctactgtgaatataatctgctatgaacatttacatacaggtttctgtatgaacataaattttgattaatctgggataaatgccccaagagtgctattgctgggttatatgtcaactttagttagttttgtttttgttttctttccaagaaactgctcaattgttttccgcagtggctggtaccagtctacattcccaatgtctcatacatatgggtaatgtatgagcaatacagtttctccaaatcttcacataattctccaaatcctcaccagcatttccaaatcttcatcagcatggggtgctgtcactatttttacataagcctttctgataggtgtgtaatgctactccatcctggttttaattagcatttccccaagggctaatgaagctgagcatcttttcacgtgcttgtcatctgtatgttctctttggtgaactgtctgttcatgtcttttacccatttctgtttttcttttttttttaactattgatttttgagggttccttataaattctagatccaaggcctttgttggatatgtgccctgcatatagttactctctagcttgtttttttttttttatcctcttcattgggtctttcacaaaacataaaattttagtttgctttccctctgagatcagtgatggcaacaacgcctgctctcaccactcttattcaatatagcacttgacattttagtacagcaataagaccagaaaataagtaggatgtatacagattgtatacagatcaaaaaggaagagacaaatctatatgcacatggcatgactgtctatgtagaacacactaaagaatctaaaaaaaaaaaaacctacaaaacctctaagagctaataagtaatttcaacaagatcacagggtacaagatcaacaaatgaaaatcaattaaatttctacgtactagcaatgaatatgtggaaactgaaagtacaaacacaataccatttacaattgctccaaagaaaatgaatagggtaaatttaacaaaacatatacaagatctatacactgaaaatgacaaaatgctgatgcaagaattcaaagaagacctaaataaatacacttaccatgttcatggattggaagattcaatacagtaaagatatcagctctctccaattaaactacagatttaaagtaatttccatccaaatcccagcaagttttgtgtagatgtagccaaactaattctaaaatttattagagaaagcacagaccctaggatagctcaaacaattttgaaaaaggagaataacgtgggaggaatcattctatctgatgttaaagcttactatatcactacaataatccaaagggtggtaccggcagaaggatagacacactaatcaatagaacagaatacggaaccagaaataggcccatacaaatatgcccaataatttttgacaaaggtacaacaataattcaatagaggaataacagaattttcaataaatgatattgaaacaactagccatcaataggccaaaaaatgaatcttcacctaaatttaataatttattaactcaaaatggactatggacttaaatgtcaaatatgaacttacagaattttcataaaagaacacaaaaaaattattcaggccctcagctaagtgatgagctgttagacttgatatcaaaacatgatccataaaaggaaaaactaataaaatacaatctcatcagaattaaaaactgtaacttctttaaaagcatttttttaattataatttaagattaggcaaattatggaaatacatttgaattactaatttttaatcagtttactgactataaaacaagcatgactggactgttcagttaagaaaagacacagctttccaaatgtggctgtagtggttaaccaaataatgaagatggaagtgactgcaatgaaatgaagacaaagagttatataattttcacttggagttatgattcctcatatattgagttttatagtcattattgattgtgaagctctaaaactacacttgtgttatttccaaagatgtactggttaacaaagcaaaggaaccattaagacttatttgtaatttacataaaaaataattaattcaaagataaaataattatcttaaagagaattagattaaaaagacaagagaggacttctggttccaaaataacagtgtagaagcaagctggcttcacttctttacaaagaaaaccaaaaccaaatatacagcactgaaattatcaccaacaatatcccagaaatcaaatacgaggagaagacagttcctggatccacagagatgggaaaaaaactctaagtaggcagtaagagaattgggtttccacatctgcaatgcccattcctccaatttgcccagcaccaagagtgcaaaaaatctccacctgattcatgatttctataccagaaaaggtgacatccaggtttcccaccatctgggttacctggcaggaaacctgtccctacctcaacccacaggaagcactacatgtgcctgaagaaagaaatatcctgagaacagtcagaaacaaacaggtgaggtgggactaccatccccagccctggaaactctggtctgtaactcagctaaaggagatgccaaaccagagtggttgtttagtagcaccacattgcagaagatacattgcacaggacccctgggcatgaatctctagccacctttcccacactgccatgatatctcctttgagactttccctaattggaatgagcagctctcttattgtttactggagccaaggcaaacttggtcgtaaggtgacatctagtgccaaaaagaaggcagcaacttagcccctcaccaaaaaaaaaaaaaaaaaaaaagaaaaaaaaaattcgacaggtaaattacatagaatctataaccaaatacattcaataaaaaacaaaaataagccagacagagaacactggaataaataactaatccttcattcaaagacatcaatacaagatatatatttcttgcacatccagaagaaactgcagtcaacacaaaaccatgacctccccaaatggataaagcaaggaaccagtgactgaccctcatgagatagccatataagagctccctgatcaaaaattcaaactagtattaatagctttgaggaaactcagagatctccaaggtaacagaacaccaattcaaaaatttattagacaaacttaacaaagagattgaaataatttaaaaatcaaatagaaatcttggagctgagaaatatattagctgaactgaaaaattcattacagcctcacaatagcagaatgaatcaagcagaggaaagaatcagtgagcttgaaaaccggctacttgaaaatgcagtcataggtggaaaaagaataaaaaagaatgaagatcatcaccaaatatagacaattacctcaaaagaccaaatccaaaaattactggtgttcaagagggagttgaacaagagcaaggggtaggaagcttattcaaagaaataataacaaaactttccaaaatgcaacagatataaatattcaggtataagagcatcagggccgggcgcggtggctcacgcttgtaatcccagcactttgggaggccgaggcgggcggatcacgaggtcaggagatcgagaccatcctggctaacacggtgaaaccccgtctctactaaaaaaatacaaaaaaattagccgggcgtgatggcgggcgcctgtagtcccagctacttgggaggctgaggcaggagaatggcgtgaacctgggaggcggcggagcttgcagtgagccgagattgcgccactgcactcccgcctgggccacagagcgagactccgtctcaaaaaaaaaaaaaaaaaaaaaaaaaagagcatcagagaacaccaaacatattcaacccaaataaggctacaccaaagcataaaataataaaactctcaaagctcaaggatagaggatcctaaaaagtagcaggagaaaagaagtaattaacatataaaagagctccaattcatctgacaattgactctcaacagaaatcatataggccaggaggaagtgggataaattttcaaagtgttgaaagaaaaaaaaaacctgttatccaagaacactatattcagcaaaggtacttttaaatatgaaggagtgataaagtatttttcagataaacaaaatctgaggattcaacagcagcagacctgacttacaagaaatgctaaagcgagttcttcagaaggaaaataaaaaaatacaaaaaaccacatacacattcaaaaagaaaacttttcaaggcataaaatccactggtaacattaacaacatggacaaaaccagaatactctattattgtaatgatggtgtgcaatccatgcctaactctggtatgaagctgaaagataaactcataaaaagccgtaatagctacagcaacctattaagagaaaggtaatataaaaatacacaaatttagataataagcagttgaaatgtggtggggatggagttaaagcatagagtatttttttaaaattttttctttgtttctattctttactttgtgatctaagataagttgtcacttctttaaaatagcttattgagatccactcaaggcaaaaagaactgggaagtccccacagctgtctgctgggcagaaaaccctaggctatgggtgccacatcagccatacacccacggcaacaccgccctgcctggagatctcacacccttgacctactgcatcaacaaaccatctgtaggtctactgcacaattagctctgactcccaagcacagaggatcagcaggcctccagtgtgctgtggatctcctggtgacctaatctttggctcgagctgccccaagggaggagagagcacaggctgccagggttccccttggggttaaagagatgtgggcatggtgccagtgactggagggggctcccctaaggcctggaaatggacctggcaggggatcatcgctaccccttcccaccacccccactgctgcaaatgtgctggaatacaaaagagccatgtgactgagagtctatttgccggccattattctcaagcaccatctactggattgaagcctaaattacaacaccccaaactcttccagtatacactgcctgtgaaatccagtgccagaatctagccacaagtattaataaatatcccatacagagtgttggccctctgaaagcacccagaaataaagccaactgactatactcagcttatgctacagtcaaacccacaagggatacaaagaatataaaaacaaaaagcctcatcgaaatgatagcaaattcaacaagataaaagaacacgtgccctctcagaagagaaagatttaatgcaagaactttggcaattcaaaaagtcagtgcctccttatctccaaacaattgtactagctcgccagaaattgttcttaactaaattgagatggctgaaatgacaaacatagaactcagaatctgggtggtaaggaagcttaatgagattcaggagacagctgaaacctaatccaaggaatttggtaaaatgatccaagagttaaaaagttgacaaagccattttaagaaacaaacaaactgaccttctggaattgaaaaattcactacagaaaatttcataatacagttggaagcattaacaacggaatagaccaagatgaggaaagaatctcagagctcaaagattggtccttcaaatcaattcagtcagacaaaaataaagaaaaaagaatttcgggccaggggtggtggctcatgcctatgatcccagcactttgggaggctgaggtgggaggatctcttggggccaggagtttgagacctgcctggccaacatggtgaaaccccatctctactaaaaatacaaaaactagtgaggcttggtggcacgcgcttgtagtcccagttactcaggaggctgaggcatgaaaattgcttgaacctgagaggtggaggatgtagtgagctgagatcacgccactgcactccagcctgggcgacagaccaagactctgtctcaaaaaaaaaaaaaaaaaaattgaaaatgaacaaaacctccaagaaataagagattatgtaaagagaccaaacctatgactcactggcatttctgaaagagaagaagagtaaacaacttggaaaacatatttgaaaatatagtgcgcaaaacttttcccaatctcactagagaagtcaataggcaaatttaagaaattcagcaaagtcctgtgagataccatacaagatgaccatcctcaagacatatagttaacagattcaccaaggtcaatgcaaaagaaaaaatcttaaaggcagctagagagaaaggtcagcttacttacaaaggaaatcccatcaggctaggagtagacctctcagcagaaacttgaaacttacaagtgagaagaaactgtggacctattttcagcattattaaataaaataaactccaaacaataatttgatattcttccaaagaaagcttcataagcaaaggagaaataaaatccttttcagacaatcaaagctaaggaaattcatgagcactagaccagtcttacaagaagtccttaaggaagtgctaaatgtggaaatgaaagaacagtacctggcaccacaaaaacacaagtacatggcccacagacaccataaaggagatacacaatcaaatctacaaagcaaccagccaacaatgtgatgacagcatcaaaatctcacatattgatataaaccttgaaggcaaatggtctaaatacccaacttaaaaggcttaggatggcaaaatggattaaaaaaataaggcccaaccatattctgtcttcaagagacccatctcacatgtaagaacacccacaggctcaaagtaaagggatggagaaagatctatcatgcaaatggaaaacaaaacgaaagcaggggtcactattcttatatcagataaaacagactttaaaccaacaatgatctaaaaggacaaagtagggcattacacagtgacaaagggaaaaattcaaaaagaagagttaactatcttaaatatacacacagctaacattggagcacccggattcataaaacaagttcttctggacctatgaaaagacttagtcacacaataatattgggagccttcaacacccaactggcaggattagagagatcatcaaagcgaaaaattaattaataaagaaattctggtcttaaattcaacacttgaccaattggactcaataaatatctacagactagtccactccaaaaccataggatatacagtcttcttatctgcacatggaatatactctaagatcgactatatgctcagccataaagcaaatctgaaaaagattaaaaacactgaaatcatctcaagcatactctcagaccacagtacaataaaaacagaaattactaccaagaagatctcccaaaactacacaattacttggaaattaaacaacttgctcctaaatgacttttgggtaaacaaatgaattcagaaatcaaaaaaattctttgaaattaatgaaaacagagacaaaacaaatcaaaatctttgggatgcagctaaagcagtgctaagagtatagtttatagtgctaaatgcctacatcaaagaagttaggaagatcttaaatgaacaacctgatgtctcacctagagaaactagaaaaaaagaacgaatcaatcccaaactagcagaagaaaacaaataaccaaaatcagagcagaactgaatgaaattaagatggaaaaatgcatacgaaagatcaacaaacaattttttttttttgagatggagtctcgctctgtctcccaggctggagtgcagtgacacaatctcagctcactgcaacctctgcctcttgggttcaagcaattctcctgtctcagcttcccaagtagctgggactgcaggtgcatgccatcacacctggctaatttttgtatttttagtagagacggggtttcgccatattgatcaggctggtctcgaactcctgacctcaggtgatccacccgcctcggcttcccaaagtgctgggatcacaggcatgagccaccgcgcctggtctgttttttgaaagaataaacaaaattgatagactgctagctaaacaacaaaaaaaggaaaatctaagcccaatcagaaatgacaaagatgacattacaactaatcccacagaaatataaaagatcttcagagattattataaatatctatgcacacgaaaaatagaaaatctagaggaaatgagtaaattcctgaaaactcccaagattcaaccaggaagaaattcctgttcaagaaaacctgaacagaccaataatgaattccaaaagtgaatcagtaataaaaatcctaccaaccaaaaaaagccctggaccagacggattcacagctaaagtctaccacatgtacaaagaagaactgctaccaatcctactgaaaccattccaaaaaattcaaggaggagggactcctctctaactcattctatgaagccattatcaacttgataccaaaatctgacagagacacaatgaaaaaaaagttcaagccaatatccccgatgaacatagaggcaaaaaaaaaaaaaatcctcaacaaaatactagcaaaacaaatgtaacaacacatcaaaaagataatgcactatgaccaagtgggatttatccccagaatgcaagtataatttgacatatgcaaatcaataaatgtgatatatcaacagaatgaatgacaaaaaccatatgagaatcttaatagatgtggaagaagcatttgataaaattcaacatgctttcatgataaaaaaaaaaactctaaacaaatgaggcatagaaggaacatatctaaacacaataaagacgatatatgacaaacacacagctaagatcatactgaatggggaaaagctcaaagcctttcttctaagaactggaaaacaggtcaagaatgcccacttttaccactcttattcagtataatgttggatgtcctagccattgcaattagtcaagagaaagaaataaggggcatccaaattggaaaaaaaggaaattaaattgtccttctttgcatgtaacatgactatatattcatatattcatatatatatgtatatatatatatatcccccaaaactaatgactctaccaaaacactctaagaactaataaactaattcagtacagttgcaggatacaaagtcgacatacaaaaatcagtgatatttctagactccaataacaaactagctgaaaggaaataaagaaggtgatcttatttacaatagctattaaaaaaaaaaaacacctaggataaatttaaccaaaaaagtaaaagacttctatgaggaaaactataaaacactgatgaaagaaacgaagaggacagaaacaaatggaaataatcctatgctaatgaattggaaaatggaatactatgcagccataaaaaaagagtgacatcctgtcattcacagcaatatggacaagtctggagaacattgcattaagcaaaacaaggcaggcacagaaagataaatactgcatgttctcatttatatatgagagctaaaaaatcaaactcatggaagtcaagagtagaactgtgggtattaaagatgataaggaaaggttggctaacaaatacaaaattaagctagataggaggaatgagctctggtgttctgcatcactgtagggcaaatatggttaattataatttattgtatatatttaaagagctaggagagaagatttttgatgttcacaacacaaagaaatgacaaatgtttgaggtgatgcatatgttaactaccttgatctgatcactacacattgtatacatatatctaaatatcactctctgtaccccacaaatatgtacaattattacatgtcaactaaaaataaaaggaaaaacaacatagatggaatcattttaacagataaaacttgagaataaaaataatcataaaggaaatattgtaatcatcacatctgattcctgtgtctatctcttagctggttccaaattaaaaacaaaagtaaaggattgtgaattattgactcaaactcaattatattattatgtttattttgcaaatgagaaaactagatttgagagaggatgagcaatttacccaaagtcaccaaaatctaaagtatgtggcaaaacaggcagtcaaacagggacccctcattaactcagaagtctacattttttctcacattcttatgtgcttgtcacttatattcattaaaaacaggcacattccatcaacattctctagtaagagtctaaacaccccgtgtaagatacagggaaggaaaaggaaatggaactcacattttctgtgtatctattatgttccagacactgtcctaagccattatttacaatacatactttaatcctcacaaacacccccaggaacctgcagcaagttcggtgagaatcaggtatccaaagctcatgtgcttttgatttactaagttgcttttgaagaccaaatattagtcttccaaatgatcaggctattaaatgtagtgtgtaaacaccaacagcatcagtgtatctgcttgattcacacacttactgaacagttctttacgatggcacagaacacgacatccacacataggaacacccctgtccggcctatgccggcactgcagtgaacaaccatgggtcctgtaaggtggctcttccttgcataacgaatatattttatgaagctatctgctgaggcaggagtgccatggtctggccacttggtgaactgcaactgttttacagagtgactagttcccgtctgttagagaaagaaacagagcgagaaagacatttattgatttcttatattagagacctcacgccaacttctaatattcaaatgataataataatggctatatggtattaccttggtattatatagaactttcaaaaagtactcaaacctctttttgatgtttataagaattctggaagttgctaggaatagaggttttctccattttacaaaggagagcacagtaacaacaataaaaataccagtattaacaggcaacaaaaattaagcacttgctatgtggcagttactatgctaggggcttcacatgaattctctcctttaatcttcacatcaaccatgtgagataggcaccattttatctccattttacagatgaaaatttaaggatgagggggacgagagatgtatgctaggtcagaaggttcacacgtttagagctggaactgtaatgtaggtgtcttgaattctaatctaccatcattcttctgtaccatgaggctacaggaaaaccaagatttcaaaatgcttagagtgagagatggactgtcatgttaggaataagaccaaaaggcaaagtatcttagtttagaaatgacatatgaaatttaattaagacatataggtgtctgacaagagaggcaccgatctcttccagcgatgaagacagggtagtcaatgaccatgagagtagattgtgggtcccactattgtgctgagcccccttgaagtggagtcatgaaactcttcccagcattgtcagataaagcactttgaatttacctatatctcatccaaagggatcatgaccctttcctcagtgtggggcccttattttatcacacatgggaacctaatggaagaactcaaaatgagtttctcacttctcctatgcttctcccgaatgcacctctttttcctaagctttctgaataaagatgctagtgctcagagctctattctaatccacagtgtcgactgaaatttgtgatagttaattttatctgtcaacttggctgagccctggtatccagatactaggccaaatattattttgtgcctctgtgaaggtattttttaggtgagattaacatttaaattggtagaatttgagtaaagcaggttattctccataaagtgggttggcttcatctaatcagctgaaggccttaagagaacaaaaactgacctcccatgagcaagaaggaattctaccagcagattgcttttggactcaaactccaattcttccctgggtcttcagcctactttcccaccctgcagatttgccaaccctccacaatcacttgaaccaactccttaaaattaatctctctctctggatcagtcccataacctgtattcagggatctcaatgttatactgctagaaaaatacacataatcacatattttgttgctactacaaatgtatgggtcaaacctcagcatcactcagcaacccttttcctggtgattgtgctccaatcaacttctttggtgatgactccaaaactcaccattctctgcaagtttcctgttcaactcctattcccttcactcttgttaacacatgtatcacctacctgccaactgaatccactagagcaatctaactcattgctttctcctataaaccattccttttctgttttctaagtctattagaccaaggaatccatgaattattctagaccaatgcttctcaacagaacttcctatactgaagcaaatgtcttaaatagtggcaatatagtagccactatcaacatgccactcataagccctaaaatgtggctacttgcaggtgaggaactcaatttgttattttacataaatttaaataacttaaatttaaacttaaatatccacatgtggttactgtattgaatatattttcaacccctcctctgtcacttataaatcataagtcataagtcacatatgtctcccaattttatctgcaaaacacttgcgtctgtgctttccacccccatgccaacagccgtagttgatcatgtcacttactaaaattcttcaatgtctcccaattatcttcataataaagttcatgctacttagctgaaatttaagacatttcacattctagctggcccctgcttacttttgagaacctcatctcatcttttattactccctggcactgaacttttacatttcagaaacacataactacttatatttgtctctacacacaccttatgctattttatattttgatcatctactttctccctccatctttttcatttgcataattctcaaaacaaatgccacctcctccagtaaacctgtctcaaaaccccaagtaaagccaagtgtttaccttctgagccccaaagtgcccaagacatatctcaacattatcactgaacacggtaagttaggtatctatcagtgagtgtaaccaacctctccactattcggtaagtactgatagtgcctggcccagtgattagcatactttaaggactcaatacgtatctgctacatttggcagaggcaggtataacccagaatcagacaacttcaacagtcactctccctgccccacctctcttttccaattttttcttctccacagaatctggttgaggagaagtagaagtggtggtggcttctggtaccagggacaagtaaaaagttacttaagaagtatcatcgatcgattttccatcctactcctaacttctagttctaagacatctgcttatgtggtgaaacatatatctaatactgatgtttaaaaacttacggacttctccacaacttgaaacattcgaatgatgaaatattgaagtatctggtagttctccaggaatacacggaagtgtttcaattccaatggcttcttcagagaaatgggccagtaatggtagcatttgataattccaccttctatctctctggttatcatggcaataacatttgaattattttccaacaccatttgccaaaagtcatctatggtgctcagcagtggtccttgagtagcgatataaaaatactcttctccacaattgactattctaatataactagcattgatgtagtccttgctttttccaagaggaacgcgtgttgaatcatctattacagaaacagaaacatctggtagataaaggtgggagatacatcacacccagacttcacgaaaggatttcacacatgtaaatccatatatctctttgaccaatagagaagatggcctaggagtttcttttcaaaatggttgagtccatgagtttaaattatttcctccctgaaaactattggcatgacctaagaaatatacaattatgggatgtttatttttcaaatcagtttttaataaatgcagaatgatatcattagcatccaggtacttttggaaatttctgctagaagtggcatgggcaaggttaagtcaagggaagtatcctatagtttgcaactgaacacaacagaggagaaactctttgtgggagtaaatgagtgatattatcctgcaaatctgaaacctgcaaacccagagcagcaggagccaggggaaaaaaaaaatctgatagttgactgcagacaaattctaggattaatggaattccaccactgtccccaaactagacagccatattttatgtccattctcagccttcatctggtgataggacatgttattcaaagcaaagatattgtggcaaaaggatgctaccaaggggaattgctccaagtaatatgggactcatctaacatggactgttataacaaatacgagagggaaaaccagctatttggcctactaaccttcactgctccaggagttccttcttcacctgacacagacatctgaagctctggttccaccaccatccccacagtgagagcagaaacacacacagcaaaggaggcccttctctgccatgcagctctctcaccaataacctctccttactactcagaatcacatggaccacttatctagtaaatatgctgacaagacctgaacaggcatttatataatatctggcagaactcttctcaaattttaacatagcacacagaaactttcccttgtaaatatgaatgaacagaaaaaatcagccaggcgcggtggctcacatctataatcccagttactcaggagactgaggcaggagaatcgcttgaaccagggaggcggaggctgcagtgatctgagaccgcgccactgtacttcagcctgggtgacagaatgagtgagactccatctcaaacaaaaaaaaaaaaaaaaaaaagctagatatataaagatacccggtatttcaaaaagggagaccattctaaaaaatcacaacaaatattctcctttctataaaagatgataacaccttaaaaactcctatttgtatattaaataaaattcaagagagcattaattatttaaaacaatactttatacctatgtttactaacaaatatgttatattactaaattataaaggtgataacaatggctttgtagggagatctttcatcatatttatgtagatatatgatgatatatgtcatataataataataagcctggcaagtgttcatcacaatgttagcagtagttattacagtatctaaaccatataaattacttcatagtaaaaaaagcattttttaaattttgaaatgagattaaatatgtgaaaattaaataatctaaaataataaaagcttgatttcatataaaagtcacaatcattcaactcaaactcctaaagcaggaattgaacagaaaaacaaatttatgtttagaaaatcagcttaaaaaattttcccagaactcagaaaaaaaagattaaaaaaacctacaataatgattaaaatggtaaaagacacagcgcatacaaggggaatgtaaaaaacgaatttcagaagcaaactgtggaattcactgcagaaaagaaataattcaagtgatcataggaaagctccctaaacagaagcaggagtactaacagaatgcagtgaaacatgcataccaggttcaagcagcatgatacgctacatgtatcaccttgtcaactccaaaacaaacctttgagggaggtgctattatattcatacttttcaaataaagaatctgtacaaagtaacttgttccatattatgcagcaatcttctagactccacagactaggtaaatctagactctggtccaaaaataattccatgctctgttgtccatcaaggaagactcaagtttgcagacagaaaggcctaagtgtcagacaacattaatgaagagagccactaagacccctagaccagcagagcataaggccacaggaacaggaacaggaagcaaaaattatgctaatggatgactaggggtaatggcaactggtgccactcccatttccaccccttgattcttgaatcttggctatggtagaaacagcatcatatattggatgctgacatggggcatgtataatctcctgaagaacattaccccagccctgcaaggtactgccacctagctttcactgtaattgagtcttcaaaaggccattcatccattctgtcaagccagccgctttgagaggataaggaatatggtaacatagtggcaatgaggccattgccacaaggtatttgccacaaagtgagttctttgattacagcaatgctgtatggaataccatgatggtggataaggcattctgtaggtccacagatggtaaattggtgggagcactgtgtgcagggaaggcaaatccatacccagagttactgtctattctagtaagaaaaaagcactgctccatgcattatggaagtggtcccagtgtaatcaacctgccatcagctagctggctgatcatcccatggaatagtgcccatcaggtactcaatgttggtctctgttgctggcagattggacactcagtagcagctgtagccaggtcagccttggtgagtggaagtccatgttgctgagctcatacataacttccatccctgccattatggccactttgttcatgagacctatgggcaatgacacaatgacaggggtgactgggggtatagtctagctgatattcatagagcatgtcactctattcacctgattattaaagtctgcccctgctgagatcaacctttggtgagcattcacatgggatacaaatatctttgtgtttgtgcctatctagcaagatctattcacgtgcctcttccccagaccttattgtcaccaatttttccaaccatgttccttcaaattccctgaccatccagctaagccattaaacatagcccatgaatcagtacacatttatacgtctggccatttctccaagcaaaaaacaaaaaaacaaaaagcaccaagtgcactacccaatgttctgcccactgggagttatttctcttcaccactgtccttcagagatgtctcaaaaaaggggctgtagtgctatagctgtcctcttctggctggtacctttatatcacgcagaaccttctgtagaccaggtccaagtcttctcttcttctgtcagctgatcataggcaactcctcatgagacaacaggtgctggctgaagagagcaggtaatgtagcaggggtgggaacagtgagcatttgggcagcttcttcgtgtaacttatttgtgccttcaggatctgctcaagcccaatgttgtatctaccactttcatttgatggtggagtgctgctgtgtatgcccaactttatggcttggtggcccatagttaagcattctctacttagttctctatgaagcagtctctaccaaggcccagtagcaggccaaaagctgtttctcaaaaagagagtccagagagggtggcaggaatttgctctaaaatcctacgtgcctgcactgtgattcatctaaaggggtctgccaaaggtccaaacagcatccttatctgccaatgacacttcaagcaccactggatctgctagatcatacagcccacgtggcagagaggcttgcatggcagactgatcctgtttcagagccttctcttgttttgggccccactcaaaactagcagcttttcacatcacttagtaaatggaccagagtagcacatcaaaataaggaatgtttcctccaaaacgccctggttcactagccattgtgcctcttttttgcttgtaggaagagccagatacaatttatccttcaccttatgattatctccacatgtcccacaacactggacctctagaaatttcactgaagtagaaggccactgaatttttgttggatatatctcctaccctctgacagacaaataagactaaagcatttgctacttcttgttcactagatccaatcagcacaatgtcatcaatgtaataaacctctgtaatatcctgtggaagggaaaggtgactgagatccctgagaactaaactacaacatagggctgaagagttaatacacccctgaggtaggacagtgagggtgtgttgttggccctgccagctgaaagtaaactacttttggtgttcttgattaataggtatagagaaaaaagcatttcccagatcaatagctacatagcaggtatgaagagatgtgctgattttctaaggcaatgaaactatatctggtatagcagctgcaactagagtcaccatctgaggaagcttacaataatccactgtcattctccaaattccatctcttttttgtgtaggtcaaataggtgagttgaatgggatgtgatagatatcaacatcacttcatccttaaagtccttgatggaggcattaatatcagcaatctcttcaggaatgtagtattgcttttgcttttttactattttcctaggtagaatcagttctactggcttccactggccctttcctgccataatattcctcactccacaggtcagagaagcaatgtggggattctaccagtttctgagtatgtttattccaattattcattccagggcttggaaaataatcacaagatggttttagggacctactgagtccactgtgaaatgaacttgaactaaagctccattgactatctgacctccataagcccctgctttgatttgtagaccacagtgatgttttgggtctcctggaattggtgtcagttcagagccagtgtccagtagtttctgaaagttctgactattttctttttccaaatgtacagtcaccctggcaaaaggctatagatccctttggagaaggctgaaagattaacagtatacatttttagcagtgtgccagggtcctccctttcattcaaggtgttctctgtgtgtaaactggctcaagtctgggaagttattgactggttgtgattctctgttcctatggttcaggttagaattttgctcacttgacctagaactcttctgcttacacctatcaaggaagaatttagtagacgtcccatctagttcacttctaggaacaccatgatcaactaatcaacaccacaggtctctacaggtcagactgttctgattgctgctttgactctgctattaccataccatgctcaccttgcctttggctatcaagtgccaccacctggcccttatctctctgggatccaattatacccactgcattcaggtttcccaactcagtggcagcaatttccactgcaatatctgaactacagagaagaacaatcacagtattcttcaaggattctgggactcgcctcacaaatatatttctcacagttatgagaaaagtacatcctctggacctcctggggtgggttggcaggtcttaaatgataaacctaatctaatattccaatctccctaatcctttggatcacagtatatagtatatcgaggcagttctggcattttatcttcatttagactgggccaccttttggtccatttaatacaaccaaccaaataaactgtaagagctctttctaactccctaatccacatattaagtccagaatctcttctttgtggtcccatttcaataaattcagcctgatcaaacactaagttccttccaccattgtcccacacccttaaaatccctccccacaaatatttcccagatttctgtcagtataaattggaaaaatcatgtagctcttttgtagcgtaacatacctccccatgggtcacactttgtaccttacctttaagggcctgctgggacttgagtctagttataggtctagaagcaatgaaggatggtagctgtgagtcttgagaagaatcagcaatgtcttgcaaggcaacaaactcaggggaggtaataaaagtttcctcaggtaaagtagcatcaatctcctcagatgggggtggcatggctgcttttactggcaaggaagactcatcagggtcaaggggttcgatacacccagctttataaggctcttcacatatgtctgcactccagttttcaagatcccattccttctcagttaatgccctcattttaacagcagacaccctaaaagggtggggattcaatttgcactgtaattcagccattttcaggatgagattttgggtttggttttcaataatctcagctttgttgttataaaatataagagtttctttcagggcagaaagagaaacttttgggttattcatgcggcacttgagctgggaaatttaatccctaagatcatcctttccttctctacattaggagtaactagccaatctcattgttctcatgagaactcaaaaatgttctaaggtatcaaatacagatgcccagaaccttgcttcttgtaaatgtctgaataggattacctaatggcaatactttgcatatctctactgtcacattacactatgaattattaatactctattcactactgaaaagtcattaatgcctttacatcttatcagattagggaagtaattcataaaactcatccttaaaattctgttcctctagaattgctctcagtaccaaattctgttactctagattctctagataaatagaatcaataggctgtatatatacagtgagaaagatttattttaaagaactgactcatgattgtggggactggcaagtcaatatctgcagggcaggccagcaggttagaccccagggaaaagttgacattgtagtcttgagtgcaaaggcagtctggaggtagaattccttcttcctctggaaattttagcgtttttttcttaatgacttcaactgactgaataaggcccactctcgttatggaggctaatcagctttactcaaagtctgctaatctaaatgttaattacatcttttaaaaaataccttcacaccaacatctagactaatatttgaccaaatagctgagtatcatagcctagcctagttgacacatgaaattaaccattaaacaagctaaaaattttagtagatgatttgaaggaggaaattttttaaaaacttatattagtttcctataaaaccaagtgaaagaaaaaaataagaataaaaatgagagagagagagagatagagaaagtacttgcaaaactacagaggtaaaagaagtaacgagaaaaggttttataagatagaaccaagaggcaaccctaaaattcatagaaactaaaaaaaaaaaaaaaaaagacaagagtagactgaagagtagaaattacaactaaaggaagatcaattaaagggtttatttgtctaggtaagaatgatggaaatgaagcatacctggtaacattatttaattccaggaaaatagttaaagattttgaaataaaagagcatatttctcatgaagaaaaggagtcagatggccattacagttctcatctaaaacactggaaggaagaggacagtgaagtaacactcagggaaaaaaaatgagaaaaaaaagaactaaaacccaagattcctaaaaccaacaaggatattcgtttatcaggataaaaaaaaaaaaaaaaaaaagtagagcttgagactgcatcaactacttatacccatctccaatcaaacaattaattcatcagaacagtgatttcaaattaagggaaaagggaaagaaaatgaagtaatagcaacaaatactacaaaacatagtttcatatctataagaagaatgacgagagccaggcattccagctacttgggaggctgagacagaaggatcacttgaagccaagagtttgagaccagcctaagcaaaagcgtgagtccctgtttctaaaaaaaaaataaatgaataaaaaattagctgggtatggtggcacatgcccatccccatagtcccaactacttgggaagctgaggtgggaggattgcttgagctcaggagtttgaggtttcggtgagctatgattatgctactgcactccaagtagactctgattcttaaagaaacaaaacagctctgtgcggtggctcatgcttataatcccagcactttgggaggccgaggtgggtggatcacctgaggtcaggagttcgagaccagcctgaccaacatggagaaaacccatctctactaaaaatacaaaattagccaggtgtggtggcacatgcctgtaatcccagctactcaggaggctgaggcaggaaaatcgcttgaacccaggaggcaaagggtgcggtgagctgagactatgccactgcactccagcctgggcgacagcgagactccatctcaaaaggagaaaaaaaaaaaggtttcttgaaataggaaagaaaacaatgtacaataaatacagtggtggttaggcctgggtttgaatcccagatctctctcctatttgcagtgtgaaagtgagaaaattacttatctcttttagcctttctgtaaacaaggacactaacatactgacaccttagaggtaggttgttgtggggattaaacattactacctataacagacttaaattagtaataagcaatagtaataaacatattagtgttactactactattattattagtgggtggtagtagcagaaacaaacatagagcaacctcaagaagtacagaaagaagcttgttaaatctctgccttgaagagcttgttttcccatctatctatattataatgctgaagtgtatgaaaattttttaaaagtgtaatataccttttgcactcacaaaccacctttttaacagtttatggaggtaaaactgtcatacatgtgcacccatgagaccaccaccacaataaagataattaaacatctccatcagtgcaaaactatcctcatgcctctttataatctatccttcttgctctcatcttgccccaaggcaaccactgagacgttctgtcaatacaaattagtttaaattttctaacattttatatatgtggaagcatacagtatattagttttctaggtttgaaatttattttcacattctggaggctggaagtccagtattgttatggtttggatgtttgtcctctccaaaccttatgttgaaaactgatccccaacattggaagtggggcctaatgggaggttttgagtcatggagacaaatcactcatgaatagattgatgcccttcctcagggttgagtgagttctcactctattcactgctgcaaaaaccgattattaaaaaggaccaggcacctctctctctccctcttgtgtcctctttcaccatgtaatctctgcacatgctgattccacttcaccttctaccatgagtggaagtagcctgaagccctcactagaggcccaatcttgaaccttccagccagcagaactgggaattaaataaacctcttttatttataaattaaccagccccaagtattcctttatagcaatacaaaatggaataagacagaaaattggtactgagaattggggtgttgctataaagatacctgaaaatgtggaagcagttttggaactgggcgatgagtggaggttggaagtgtgtggaaggctcagaaaaagacaataatatgagagagtgtctggaaaaagtgcccaaaggcacttcagaaatatttggggccaccccttccctaataggccccaaggccttctggggacagacctggagcaccactgcccttggccacctcaggatgctgctccccacatcctggctgctctggctccagcagtgggtcaaatggccccaggtagggtttgggccactgctcctgaggggctaagtggtaagccttggtggcattcatgtggtgttaagtctgcaggcatccagaatgcaagggacatggaggcttggcagctttaacctaaatttcagagaatatattaaaaagcctgggaaagcaggcagatgcctattgcaggagtggagccaccaaagagagcccctaccaaggcaatctttagtggaaatgttgggttggagtttccttagagtccccaccagggcaactcttagtggacccacaaaggtgctggaaccccacaatagtagagctatccacagcattccacctcagcctgaaaaagctgcagcattattacaacccatggaagcagccagtggtctacgcccagcaaagctatgggggaagggctactcaaggccttgggagcccaccccacacaccactgtgaccaatatgtaggagatagagtcaaaggagattattttggagctttaagatttaaagtgtgccctgctgtgttttggacttgcatggggcctattatccctttcttttgaccaatttttcctttttggaatggaaacatttacccagtgcctgtaccaccattgtaccttggaggtaaataatctcttttttgattttacaggcttacaactggaaagaacttactttgagtctcagatgtgactttgaacttttaagttggtgctgaaacaagttgacttttagggactattgggaaggaataattgtattttgcaatgtggtaagaacataagttttaaagggccgggggcaaaatgctatgatttagatgtttggcccttctaaacctcatgttgaaacttgattcccaatgttggaagtggagcctaatgggaggtgtttgagtcacaagggcacatccctcattaatagattaatggcaggagtgagctctcactctattcgttctgcaagagcctggtacctccccatttctctcctgcttcctctctcaccatgtgatctctgcatatgctggttttacttcactttccaccatgagtggaagcagcccatagccctcaccagatgcccactcttgaaccttccggtctgcagaactatgagctaactaaatccctttccttcataaattattcctctatagcaacacaaagaaactaagacaaagatcaaggtggcagcaggcttggtttttcctgaggcctctctccttggcctgccaatggctgccttcttgctgtgtcttcacatggacctttctctgtgcctttgaatccctgatgtctcttgtgtgtcccaatttcttctttatataaggacatctgatggattggattgggcacactctaagaacctcattttatattaattactactttaaaggccctatctccaaatcaggtcacattctgaggtacaaagggttggaacttcaacatacaaattttgggagaatttaatttggctcataacacacagtatatactcttttgactggcttatttcactgagtaaaattattttaagattcattcatgttgttcaatgcattgttagtcattttttattgcctagttgcattctattatgtagacataccacaatttgtttattcactcttccgttgatgggcatttgcactgtttccagtttttggctattataagtaaatctgatatgaacattagtatataagtctttatgcagacatatgctttaatttctcttaggtaaaacatatgaatagaactgctaaatcatatggtaggtacatgtttaactttattagaaacaaattccatttcattgcagtgagtgtaaaatggtatctcattatggttttaatttgcattttcctaatgatttacaatggtgaatatcatttcatgcatttatttgccatccttatatcttccctgagaagtgtctgctcaaattttttgctcatttagtgttgggttatttgtcctcttcttgatttgtagtaattatagattataaatataagtttttgtgagataaatgttttgcctgtatttttcttctagcctgttgctttcctttttggttttataataatatgctttgaagagcagggttttttttttaatttgatgaagtccaatttattttttttcttttacaatttgagggttttgtgtcctatttaggaaaaatttgccaaagccaagggcagtaacgttttctcctagggtttctttcagaagttttatgtttttaactctaatgataggtctataatctattttgagttaatttttatataagttgtgaggtaagaatcaaagttcatttttggtacatgaatatgcaactgtccagatgatttgttgaaagattatcccttccttattgtcttgcattaaatttagatattatcatcttctctgttcttctcacatgatcatacagaacactcaatgagaaatatataagcatgctctgaaaagtgagaagctaacagaaacctaagtcactaccttgattagttctgaataggtccctgatagataagtaacagaaaaaatattaggccaggagttggggaacctctgtgactcgctcttttattagccttcaaactgctttgtaagttgtgaaatggtaaagaaatggaagatattgtctttatacctaaaaattcctatactacataataaaggccattcttgcttggcatgatggtacagggccataaatatgaccatgcaagttgaaaccatgcgaaaggacctttgttgttgttgttgttgttgagacggagtcttgctctgtcgcccggggctggagtgcagtggcgctatctcagctcggctcactgcaagctccgcctcctgagttcacgccattctcctgcctcagcctcctgagtagctgggactacaggggcctccaccacgcccagctaatttttttgtatttttagtagagacagggtttcaccgtgttagccaggatggtcttgatctcctgacctcctgatctgcccgcctcagcctcccaaagtgctgggattacaggcatgagccaccgcgcccagtcacaaaaggatcttagtaattaataggaaatattattcttgtttcatggctcttaacattttttgtgaaatcattaaaaactcacttattgctggctatacatatatagagaagcaaaaaatagcaagactaatatttatttagaacattgtaatttaaaacattagaaatattgggaattaaagcatttaatttgttaaaaaaaaaaacaaaaaaacaaaacttacccagagtagtttgaacagtgtttgcctcttctttttgttgtataacttacaatacagagtgagcattttttctatgtctaggctaacttccaagtctggatcagtttccaccttttatccttggcacttatattgttgtgaaatagctccaaagtttctttaatgtcaagttttctaccatcattgcttcccctaggttgcctttatccttttcctcacaagcactttggtcattcatgtcggtaagttccccttccacaggtgccttaggctgcagctctagggtcttttgagcagtagcagtgtcagcatgtccctggtcagctagttcttctataactccattcaaatttcatttccaacattatcactttttatccctttattgcagtttcatctctctcagccaaatctctctcttgattatacattttggtaaaaggtcataggggtttaccattgagagacaaggagacaatacaatcacatgctttgctgtgtgtgaactgaataagaggctcacagttacctatcactgacatattttgaaagaagtaacatttattagtcactggtcatgatgcacatctgttatttacatagggacttgtggactaaagtgccagcaaagatgcttactactttaggcaattacttgcagtgaatatattgtggtaactaaaatgtgaattgtactgtgggactggtgttatttagctaaacacagtaactgatatttgagcatattggggccatgcaaagtgaaggttccctatatttgcagtgttcaaaggtgtgtgaattcatctatttagtgttctcagcatttgaagacgacaaataaattacttctttagctttcttaatatgagtcttcaggaaccttttctataaagtcaagaaatgtgtgattaaaaaaaccacagagctttctatgatggccacttaagttggctgagtttcagattagattacactgcgttatgaggtagatataccaatgggcctttaaaaagaatatggttgaattatagtttcttttcttttatgaaaagccaaaagttttacataacttcccttactttaatgatttaacattatttttattatctttgaatttcttagttgtaactcttttgatatccagaataaaaacttcaagtcagatcaaatattatgtgtaccttctattgtaaaatgagcttcttacaatcccgagaggctaatttttaaggcatgtttgcttttagtctccttgagggcaaactgcacatgcagaaatagaaattataaaatttggacctttgacattttggagaagcaacaaattattagtattatttattaaaatgtctaatcatggttcattattctgatttcagaagtattcatcaatgcacttctccacactctccccacagaagataacagaatagcttattttaaccatgttggatatgtacttgttttttatcatcataaagttagtttcaattctaataaaccaactaaacatgaaggtatttatctagtgaccgcagtcactgtgttccactctggtttttataataactatctcaagtctagtaggagaaacaaaagtgaaaataattaaaatatggtttggtagaaggggagagtggttacaagatgctgtgagactactggaaaaacaccaaacctagctttgaggaaaataagaaaagcctattggagctggttaagaaagatagcaggaactgcctcagcaaagaagggatgagtagttctttcaagaactgcaggttaagaggcataaaaaccaacaaataagaaaagaattatgaattctagataccaaaagaagttttgtgggagagctaaggctagagaggcaaacaggtgaaattcttaggccatgttaaacaactgtaccatgatagtaacaaagagccaagaaagagctttaaaagaagagctacatgttctgacttgcattttaagaaaatctcagtagcttttgtgaatgatcagaaagggaggcagtaaagaagaacgtaaccagctgagaggtaaaatgggctcagtctaagtcagcagcagtgggaactgagagatgggggaggaccccagaggtattatggaggtagaatcaactgactccctgttttctggtttgaacttggtgattacataagatatagaatataagaagagggtcaagttggaggaagtaaaatagtaaatttagttttgaaaaactttgactttgaaaggaatgtgagttatggaatgagatatcctgcctaagattaaaattgcattgctgtgttttgattctgctctttgaatggcctgagatggataactcctaagagtaactgagtgaggaggacagaaggtgccactaccctcccatccaacacagggaagcaacgttaaggctctgtggagacaatcaaaaggcagcctcctgttggagagcagattagcagctttattgtccaggatgaaggatgcaaatagctcttttttcgcgtgtctaaacaaaatagccagagaaggtggttaaggcttcgggtaccaaaagtggtgtatgactcagactattggattttatgttttggaaggctcatgctctgagaagcagcaatatatgagaacaaggctgaaggactgctgtaaaggaccctgtaacagtggctgaaggatgtaccagaaaacagaggacctgactctctcatatctagcacatatcttagaatatgcccagatcacccagtgctatgtaccagaaccctttatcatggtcacaggccaaaatgtctcatacaaaaagccatacagtgccctttgcactttttctaaatataaacaggaaaataatcaaaactatttttagcttacatggaagaatatctcggtatctgtttttttctctgttgcttggttgattcccagagttgaactcaccaggcagattcttaagttctaaagcctttaaaaggttaaaaatgaataaataaataaataataaattgtgtatttactataaccaataaaaaagaaaaaaatatgcctttgtttagtgctcatgatccttaaatccctatatgacatgacctgctatttaatgtgttgtatgataagtgaagctagatcctcatttaaaaagtgctatataaaatatctcaagtttcacatgccaatcaatgagttggttaataagaaaatgttaaactttctggagatactttccacttgaacttcattttcttcttctttcataaaaaaggaaatacaagctattcatttctcagaacctacccacagatctatcattttataaataaaaataacaacataacaacaacaaaaacatataaacaaaaaatatatacaaacagtctcacaatttacccttcccctttgaagaaattatagttaggaccctaagaatccttcctttcaaaaaatttctttaccaagtgtgaattcaacaaacacttattacacatttagtaggtacctggccctgtttcagacactggaatacagggatgaattggataatggcctcatccttaaggagtgaagagagtagttagaggacatgtaatcaaataccatgtgaccaatgtacggagacagtagtataaatgacagcactagattgcacctaaaagtcaagaagaaaagctcctcaaagggaaatagcccttgaactgggccttagtgagtcactggaagttagcatatgaaaaacagtgtgtatttagaaggaaagaggagagaaggtgaaggggtggaaataatggaggcatacatgtccctttgggaaactgtgactaatatggtaataagagcacaaagcacatgatctagtccaacaacagactaaaactataaaatatcttgtttcatatataaatgaaattaggaggtagctagtcatactttattagaatatttgtggagaaagcctgaaaatctatacattttcaaagctcttgggtaactcttgtgtagccaacctagcaaccgctgccatggggaacaaggagcctgtgaaggttttaagtagtacaataaaatgatcaagtctttctgaaaatcaattttaaaattaatctggaaaaaattctgtaggaagaatgagaaaaaattcatttatgaatgaataatgatggcagatgagtctcattagatgttaaaagataatatgaagctatgctaattaacagaacaataccaataaaggaataagaaaatcagtagaaaaagtccaagaataaattaaaatatatgtaaggctctagtatatgataaaagtggcattttacctcactcaagagaaattccaggagagtcttgggacaactggatagttatataatgctgagtccctatcaaacatcttataccaaattaaattctagctgcatcaaagatttaaatgcttaaaaatcataaaggtactagaaaaaaacatgaagtaattattacaatcctagagtaaaagaagcattcctaaagagcacagaaagccccaaacccagaagccccaaaagcaaagattgccatatttgaccactaaaaatcagctatttcttcacggtaaataggcatgtgtgtgcacatgcatgtgcacctgtgtgtaacacaaacaacagcagaaaaaatactacgtgtaagacacacaaaggcataattttttccttaaagagttagtaatcggccaggcgcggtggctcacgcctgtaatcccagcactttgggaggccaaggtgggctgatcaccttaggtcaggagtttgagagcagccctggccaacatggtgaaaccctgtctctactaaaaatacaaaaattagccaggtatggtggcaggcacctgtaatcccagctactcgggaggctgaggcaggagaatcgcttgaacctgggaggcggaggttgcagtgagccaagatcgcaccactgcactccagcctgggggacaagagcaagactcatctaaaaaaaaaaaaagagtaaccaataagaaaaaaaaaaaaaaggaaaatggggcaaagaattgaaactagcagttcactgaaaatataaaaggcttaaaaacatatggaaagatattcttttgttctcaaataaataccaattaagtaatcaataagaaataatttgtcatttaagagatgagaaaagatccaaaaaattgatagcccaaaatattaatattgtctttctaggaatttgttcaaaaaatatttaaatatatgcatacagtatatgaagagagatgaccgctgttcataatagcaaagactagaacaacctaaatgtccaaatgttccatggtagttaattatatggataagtaccctaatttcagaaattaaatattaaataaattaaggtacttatccatataattaccatgcaacacttaaaaaaatgagatactgctatacatgctgataatatacttggaaattgtatctaggaggaaaacaaatttaaggatgtaaagtgcattccgacaaatttttttaaaagtttgcatgacaaaatgacaaaatgaatagtgtaaaggggccctagaaagtcttgagagaaagagagagactttctattttatatccttttatgctatttggctttttttttaaccacgtacatctattactttaaaatatatataatatttaaaagtaaaaacaatgtactagaaccaaataaagaaagaaaagaaaagaaaccctctggcaatgatataaaaaaagaaatcacatatagactttcgttaagaaaatatttaccataaattcctgcatgatatcatacgctgctgttttttcctcaaggattttcaaacaatccttgatggctgtctgctcatgaaaattgaatattaatggccgaatctgagccaactgatctagttctccttcagaaacaattttgcgcgtatctaaggaagagaaaaattcacatatgtaagttactggtatatatgtgaagggagattttatttttgtttctgtttctcttaaagacacagccatttaagggtaaacagaagtttatttttccacgggtgaagagtctactactttgaaagaggcttcctttggaaaaatcatggctatttacaccttgaaattatacaaaatccactgcccttggagaaaactgttcagtgccataaacataacgaatgctgtggattgagaagtgttcagttttataatgtgaattgggtatatggattgaaaattatgccaaggcaagaacgtccaaggcttggattaggaaagagaacttttgccctccctgggaccaagtgtttggaagttcctagagtctgagatgtggtgacgtggagagttcacgtcctgtttcattactctgaaacagattgaacatgaacgcacacacgtgcacacacaccaaggatggagaggatctatgcaatataattaataagatggaataatggatacgtatggacacttgcaaccaataattggggagaacattctattaatatttaatagcacacatacaatctttttatttttaattatgatcttttaggtaatgttgacagtcaaggttccaaacatctgaaattttatacattatgtccactggccaaaatgcaataaatctagaagtcaacagtaaaagagtattttaaaagcttcaaaattttgaggtaagatgttcaagtaaaacaagttctcataatctctttgcaaagccaaataatgtgaacaataatcaagttaataccagcaaaaagatatatacaaaacaatatagcaaaagaaagaggtggaaatttctaagaatctgcacattcctgggaagcacatcttatcttggtactccactatatccagaggctctttgtagggttggaagtgagggctcttggttgggatagacaggcacagaaatcctaaaatttctcacaaatatccctaaccttagtatgagaggaggtctaagcaggctggaaggggagataaaattcccacaagcgtagaagccattttgatcatctttgatgcccaacagaaaaacccttagatcttcccattgtgttccacctttgctagtacaaaagctgggagaatgaagagagaaaaaaatgaaaatgtagaatgactgtaacaaacactggtgttgactccccaacactgattctacccctctggttagttaaagccatttgtgatcattccatagtaagatccttccagtgaataattcagaaataggtaggagatttgcgccaaccatagaaataggctggtcttgtaaaaaagagaagcaaacctctcttctaccctcatccctctgtacagacataaacaaagaagtataaggacctaattatcatagtctgccctcttatggccataaaaggaaagcgtatagcaaatgtgaaaaacataaagaaactatgttcttgatgacattagcaactgatcatattgaacctggaatccttcctatctctgggcttccattatggtagaaaatatatatatctttatcattaacatcattctgaatttggtctctttttcttgtagcctggtccaagaattccaatcaaagtataaaggtgaggtttcagctgtagatcctgggaatcatttcagccagtttacagaaagggatttgatctagctatttggtgttgtatcaccattgtgtgggcttgaagaacagatgcctctctcattatgatccaagaacaacactgcataatggtctgccaagaaaagttctgtctttgccacaattaggaaactgaggaagttggagaccattttttctagccactggctcctagatgacaccacttcagcaacaatggagaaataagaaagtcactaccacaactgttggctctagtaacacatcaccttacctataatgaggaccaggaacgccaagcctgctatgatgcatagcaataaaatggatgcctctctacacatttacatcttggctaagtgcatatgatcggcaaagcccaaataagctaccaggaagtcttgaaaatgtaatttttcatttttctgcctgggccatacaggaaggtacactaggagaagggtgtgactgatattgagtaagggcatctgtgatatctgcttaacatttcagccacaccatgccctttgagtatcctgctccttggcccctatcccttcagcacacttatcattgtcctcgggcaaaataaacaatgcagccctccaaaatacagtttacaagggaagatgatgagatccaaataaaaatggaaatcaggaagaattcattcctgctcaatcaacaaaaccgaagagacagaaaaagctatacatgttcataacaaaatggaataaaatgtgaaacacagaaaaaataataatataatatagcatgcagaataatttttaaaatctattctaaaatggaagataagcttaaaaaggaaaatgaactgtgtatgcaacatctgtcgaaagaaaaagaaaaattattttaaataagagttcacaaggagataagaaaacaatagaatgaggtttaaaaaaattagtttataaacctaagaaaataaaggtaaaactcaaaagtacataattacagcaataatttataattaaatcgaattctgcaagaaacaaagcaggcagttgaaaatcaacttattgccataggacaaaggcatgtatacatacagtaatgaagacaagaaaggtttaaaaacacagtgaaaagataatgcatgtgaggacctcatcagaggctcaggagaaaagctgcagacagggtgaggaacttgagaaatcctccttcgtggggcaagcttgggaaggggaaaaacagcatccacaggaatggcacaaagcatgcccaaaatgcttttccctatttccctaatggaccaaaagcataagaacctgagaaaacgcatgaaactctgtcatcctcaaggcacaaatgaagactcattaacattgggggtagggaagagagaagagcatcctggacccaggccataagatattccctacacctgcagaatggacaaaataataaaggaggtaccgcctgaggccttcctaagactgagactgaacaaggacagcagagaatgtcaccccaaccaggttggcaagcaaggtaatcataagtaagagctctctactgctgggaattagagaagatcatggagaagaccttctctgaggtgcatgtacaatgggaagagctaaagcagagggtggagtaaacactgaggcaaatcctctacatgtaaggtaacactggaggaatttgaagctggtggtgcactaagggtaaccatagcaacatcaaacccaagccctgctgcattactgagtaaattgatgcaactcctcacactgaaggcctaccaacaaaagagtcatgtccatccctatttacctcagcgtctagaacttagctaagaaatactacaatagctcccccttatctgcaggggatatgttccaagacccccagtggatgcatgaaactctggatagtattgaacctgatcgtcatcaactgaaacatatttttgttcatgtcttccacccataaatttaatgccttttccatcttaagtaagcatgtatcatgcactgtggccataactttggcactctgatgtgcaacagcaaaacttggatagaagattcattcttaccataggtctacgcaactttagcatatgatttttttctttccttattaagtcaagaactttcaccttttcatgtaaagaaagcactttacagcttccctttggcatatccaaattgccagcatcactactctttggggccattactaagtaaaataagggttacttgaacacaagcactgtgaggccaaaacagtagatctgataaccaagatgactactagttgactaagagacaggtagcacatagggcatgaatatgctggacaaaggaatgattcactcccaggcaggacagagcaggacagtgtgaggtttcatcacactactcagaacagtgtgcaatttaaaacttattgtttatatctggaattgtccacttaacatttttagtctgtggttgactgcaggtaactgaaactatgaagagtgaaaccatggataagacatttttacttctatctctagactatacaatattcagttttcaaccaaaaaattatagagtacacacagaagtaagaaaaagagaaaaaagttgccaagagacaaagcaatcaacagaaccagacagagatataacatatgttaaaactgtcaagtgatgaatttaaaatagtgataatcaatgtgtgaaaaggcagtgggaaaagtagacaatatacatgaacaaatggagaatttcaatggagagatggaagccataaaaataataaagtggaaatgcttaaagtaaaaaaaatattgtaagaaattaagcatgttattgataagctcatcagtagatttcacagaggcaagaaaagaattcatgaattacaaaatagatcaagaggaattatccgaattagaacacagagaaaaaaggtagatgaggggcagaggcagagaagaagagaccatccaagaactacaaaccaatatcaaacagactaatatattatacctgtaaatggaatcccaaaatagaagagaaggagaattgggcagaagaaatatttgaaaagataataactgagaattttttccaaaatgaatgaaagacaccaagcctcagatccaaaagctcatcaaaaacaatataagccagaagacaattgagtgacaactttaatgtaatcaaagaaaaaatcaaaataaagaaattaagatttcagtaaatacatgactaattataaaagctagtattcttgtaacaataatgtgtaacttcactttttcttttctacatgatttaagagatgactttttcctaaatttattagcctaaaaataaaaaaattatcataactttagattgtaaatcaacattttgttttctacatgagaaactaaagcattaaaaacattattttatgttttggaacacataatatataaaaatgtaattttgtgacaacaaatgaaagagatggggtcaaaactgtcaaaggtccacagtttttttttttttgtattttactgaattaggctggcataaattcaaattagagtgataagtttaggatgttaaatataatgcccatggtaaccacaaagaaaatagctaaaaacaatacataaaggaaattttttaagaatttaaatatttcattacaaaaggcaactaaatacaaaaggagacagtaaggcaaaaaaaaatgaggaacaaaaaagctacaagaaatatttttttaaaatagcaaaatgacagaagtctctccttatcagcaattactttagatataaatgaattaaactcaccaattgaaagaaagattggcagaatggattaaaaaataaaaacatgatccaactatacactgtctacaaaggactcactttagatccaaagacacgaataggttaaaagtaaaagaaatattccatgcaaacaggaaccaaaacagagcatgaatagctatattaatatcagataaaatcgattttaattttaaaaagttaaaaatgacaaagaaggacattatatatcataaaaggttcaatacagcaagaacatataacagttataaacatttacacgcctagtaacaatcaaaatacacaaagcaaaaattggcagaaatgaagagagaaacagttttacaataataattgaagatttcaatatcccattttcattagtggatagaacaattagacagaagtaagaaaagggaggacttgaacaatataataaacaaagtatatctaacagatacatacagaatcctctgtgcaacaacagaccacatatttaagaacacatggaatattttgcatgtgttaggctataaactaagtatcagtcaattttaaaacactggtatcacaaagagtatcttctcaaaatacaagagataaagttagaaatcaaatataagaaaaactgataaacttacagatttgtgaaaattgaacgacataattttaaaacaccaatggatcaaagaaggaattacaagggaaattagaaacatttagaaatgagtgaaaacataacacaacatatcaaaactatgggacacagcaaaagcagggttaaggggaaatttatagctataaatgcttacatgaaagaaacaaggcctcgaataaacaaactagctttacaacgtaaggaattacaaaaagaagaacaaactaaacctaaagctaacaaaaggaagaaaatagtaaagattagagcagagatcaaaatataaaatataaaaaagagaaaaatcaatgaaaccaaaagcaagttcttcaaaaatatcaacaaaatgatgtgatgaacctttaattagataaactaagataaaaagagaaaagactcaaactactaaaatcagaaataaaaatgaggacattactaccaattctaaagaaataaaaaagattataagggagtactatgagcaattgtatgcagaaaaactggataacctcaatgaaatagacaaatttatagaaacacaaaacctaccaaaaccaaaccacaaagaaacagaaaatctgaacagacctatgactagtaaggtgattgaataagttatcaaaactatcccaaaaaagtaagccctggatccaatgccttcactgttaaattctatcaaacatttaaaggagaactaacaccaatacttgtcaaactgtttaaaaaaattaaagagtagggaacactccctaacttaatctatgaggccagcattatcccaatatcaaagccagacaattatcctacatgaaaagaaaactaaaggccaatatccatcttaaacattgatgtaaaaatcctcaacaaaatagtagcaaagcaaatatttagcggcatattaaaaagatcatacaccatgactatgtgggatttattactggaatgcaaagatgacttaacatacaaaaatcaaggtaatacaatacgctaacagaaaaaaaggcatgcttatctcagttgatgcagagagagtatttgacaaaattcaacatcctttcaagaatatattctttttgagacagagtttcactgttgcgcaggctgaagtacagtggtgtgatcccagatcactgcaacctctgcctcctgggttcaagtgactctcctgctctgcctcagcctcagcctcccaagtagctgggattacaggcaactgctaccacgtctggctaatttttgtactttttctttagtagagacatgttgcctagggtggtcgtgaactccccaacctcaggtgatctgcctgccttggcctcccaaagtgctgagattactggcatgagccaccatgcctggcctatttgtttgtagaaaaaaaattcaacaaactaggaacataagaaaaatacataaacataataaaagttatgtatggaaaacccacagcaaatatactcaatgttgaaagagtaaaagcttttcccctaagatcagaaacaaggcacggatgccacttttgccacttctatttgacataatattggaagtcctagtcagagaaattaggaaaaaaaagaaataaaagccatccaaactggggaaagcaaaaagtaaacatctctgtttgccaatgatatgatattatatgtagaaaatcctaaagattactggattttacacacacatattcacacacacacagagttaaaaaaaataaattcagtaaagtagcaggatacaaagtcacacacaaaaatcagttgcatttatatacactcagatgaacaatctgaaaatgaaattaagaaaacaatttcatttacaataatatataaaaagaaataaaatactttgaaattaacttagccaagaaggggaagggaaagatttgtacaaagagacctataaaacattgctgaaaaaagaattaaacaaatatatctcatgttcatggtttggaagatttaatatcattaagatatcagtactacccaaaacgatctacagattcaatgtaatccttatcaaaatcccaatgactccttctgcagaaatagaaaaactcatcctaaaattcatatggaatttcaaaggaccccaaatagctaaaacaatcctgaaaaatatggggaaaaaagactcacacttcttgatttcaaaacttactacaatactacagtaatcaaaacagtctggtacaggcatagacagacatataggccaaaggaatagaagaaagagtccagaaataaaacccaaattattttcaaaaaagttatcaaggccatttaatgggaaaaacacagtctttacaacaaatggtgctgggaagctggatatccacatgcaaaataataaaattggatctttaccgaacgccatatacaaaaattaacttgaaatggatccattacctaaatgtaaaagctaaaactataaaactcttacaagaaagcatggcaataacttcaagacattggatctggcaatgattccaaaggtacaaacaaattttaaaaaatataattaataatactgaaatatacacttaaaatggataagatagtaaatgttatgttatgtaagatttacaacaataaaaataatttggagaaaatacctctaagtaacccacagatcaaaggggaagtcataagagaaatagggagacattttgttaaaaatgtgtagattgtattttttagaaaagttttacatgaaaaaaaaatgagcacttagaattcccatatatcccctgccaaagtttcacttattattaatgttttacatttggatggtacattcattagtattgaaccaatattgatacatttttgttaactaaagtccatcctgtattttggttttcttagatttccttaatatctttttactgtttcaggagcccatctaggataaaacattacatttagttgtcaagtctccttgggcaacttttggctatgatggcttctcagattttccttgtttttgatgaccttgataggtttgaagagtactggccaggtgtattcttcaatgccttactattgaaatttgtctaattttttctcatgattaagactggggttatgggttttcaggaataagatcacagaggtagagtgccatatttatccatagtatcaagggtatattatatcaacatgatgtatgacagttgatggtgaccttgatcacatggctgcagtagtgtttattaggtttctctactatgcagttattctttgtactcctctggccatactgtactctttgaaagaaagtcaatatgtgcaacccacacttaagaggtgggaaattatgatccacttcctttaaaattgaatattaacgtaatttatcaggaattcttctgcatgggagatttgtctcttcttccccatttattaacatatttaatcatttatttatatcagtatgaactcatggatgatgattttatacttcatactataatccactgctacattagattgttgttcaaattgttccaccttttgctacttagaatgagaaaacattataaattgaatgaaaataaaaacacctcaaaatgtgtgggatgcaactaaagcagtacttacaggaagatttgttgtattaaatacttgtactactgttgtccctctgtatttgcaaggaattggttccaggacctcccacagataccaaaatcctcagatgctcaagtcctttacacaaaatagcatagtatttgcatataatctaagcacaccctctctctcaaatactttaaatcatatctagattacttataatacctaatacaacataaatgccatgtaaatagttgttatatttttaaaatttgtaattttttgttgttgtattgttatctttgttcctaaaatatctttgatccatagttggttgaatttgtagatgcagaatctacagataaggagggccagttgtatttatgaaaaagaaatatatcaataatctaagtttccaccttaataaattaagaaaagataaaataaaatccaaagcaagaaggaaaaaggaaataataaagagcagaaatcaatgaaattgaaatcaatgagaaagtaagggaaactaaaagctagttcttggaaaatatcaatagaattgatacagtctctagccaaactgatcaagaaacacagaacaaagacacattttatgaaattgaaaaaaaagagaggtgatcagttaagataagacatcaaaaagttaatgagggaatattacaaacaactctagtcccataagttagacaatttacatgaatgggacaaattcactgaaaaatacaaactgccaaagctcattaaaaaaaagagagacacctaaatagtcctatatcaattaaataaattgaatattgttatgggctgaattgtggcccatatgtggccgtatttggagacagggtttataaagaggtgattaagttaaaatgaagtcattagaatagcccttaacgtaatataactgatatccttataagaagagattaagacacagatatacacagtgggaagaccatgtgaagacacagaggaaagacggccatctgcaagtcaaggagagaggcctcagaagaaatcaactttgctgacatcttgatgtttgactgctagcccacagaactgtaagatccattcttggatattttgttataaaagcacccccccaaaaaaaaaaaaaactaaaaactaaaaactaacacaaatatgtatttagaaacctcacaaattctgggtccagttggcctcactggtgaattttagcaaacatttaaggaagcaatactaccaattttatacaaacttttccagaatattgaagaggagaaaacacttcccaaataattttataagggaagcattactctgatactaaaaccggaaaaagatatcacaaaaaaagaaaattacagatgaatatctgtcatgaacataaacacaaaaaaagtcttcaggaaaatactagcaaatcaaatcgtaaaacataaaaacaatattacaccatcacaaagttgggcttatcccaggaatgcaaagcaggtgagatatttggaaatcaaccaaagtaactcatggtatatcaacaggcaaaaaaaagaaaaactatatgatgatctgaatagatgcagaaaaagcatttaacaaaagtaagagtccattcataataactccgggaaactaggataataggaaggctcccttaatctgataaatggcattcacaaaaatactacagcgaacattatactttatgatgaaaaacagaatgctttctccctaaaatggagaatctggaaaggatgtccactccctttcctcttattcaacattgaaccaaaagtcctagcgaatgcaataagttagtaagtcaaaaaaaaaaagaaagaaagaaagaaagaaaagaaatgaaaggcatatacattggaaaggtagaaaaataaaactgtgtttattcaccaacatgagtatctacttaaaaaaattccaaaaaatatatttaaaaggccctagaattaatgagcatttaggaaggttgaaggacacattggtaatatacaaaaatcaatcatatttctatctactatcaatgaacaatagaagttaaaatatttttcataagtctcatttacaatagcaccaaaacatgtgaaatattagatataaatctaacaaaacatatatacaatctatatgttaagactgcaaaacaaacaaacactgatgaaagaaatcaatgcagacctaaacagagtgaggaatgcttccgtcaggagaaacaacaacaaatccgttaaagtggaatttgagaacgccaccaggacattttgggttcctcatatgctactgaatcatcagggaaagggggattactacactgcctagtgtgctggattccaagtattaaggggaaactgggctgctgctttccaatggagtaacgaggaatacgtctgcaatgcaggtgatcctctagggtgtgtcaaggtgattaagtaaacagaaaactagaaccacccaatttaggcagaactactaatgacttagatcttgaggaatgaatgtgtgggtcaccctatcagacaaggaaccacaaccaaatgggatgtttgctgagctgaaagagaataccagacaggtgtaagacggcagtgatcaaaaccagatacaaccatgtgaccagctgcataaacagggataaaatattgtgaatttttctttcttttttgatatgcatattttatacatatatatatatcatatttttgttttcttttaaaaatattaaagggaatgtgaatcagttggaaaagaaagaatatcactcaagacaaaaaagagacacttttggagaaggggagagaatgttttcagttgtacacagattagttttatcactgtagatgcaagcataaggttgtccttatttggatattaagtaacatttaaaagggtgtatataggtgccaggctgatacagggtgaactgtgatagctttataatatgttgacatggctaggctggaccacttttcccagaattctgttctctgaatgtttccagctaaaacagggcacaagcgaggttctcatgtcagatctggaaggtgaacatggggcagcagctattctgtgctcagatgcactatggatgatctcctgactcccctcattctatatgtggaaggaagaacttaaaatcacaacagtgccaatcctacctgaatgaatataactggcatgtcattctatctaaatttcaaacaagtttacacaggaatgaacaaaataatttaaaatcaccgatgcagcaaaaacttgcccaaatagctacaaaaatgtattttttaaaaaattagagggaggattttcctttccagatatatttagaataagtagaatcaaaacagaataatataatatgtccacaggaacaaacaagtcagttagtgaaaaaaaatttagagaatacaaaaggatcaaacatttttggaaacttaatatgtgataaaagtatatataaattcatttgggaaatgtggtttacttagtgaatagtgctggtataactgtccagtcatatgaaagaaaatatagttttctatacccctataatatttagcaataaactgcagatagattcgtgatctaagcaaaataagtgaataaaaattctgaagaaaatttaggagaatatttgcatgtttttcctgtaaagaagacctttttaaacattttagaagttaagaatgttcatgaaagtctcccttcttaaggtatagaattgagggttacaatttatagcacatttgtcagacagacaacatgttaagatttccaacatgtgaagagttcctacaaattaataagaaaaacaatgaacaaagtttataaatatgcaaatccaagaagaagttaataaacatatattaagatacttgatcctagctgggcacagtggctcacgcctgtaatcccagcactttgggagaccaagacgggtagatcacaatgtcaggagttcgagaccagcctgaccaacatggggaaacctggactctattaaaaatacaaaaattagccgggcatggtggctaagcttttggaaaggaatctggtattgcccattaaaatataaaacgaacataaactttgacttaactatcttactttagggaatctaaccaaaatcaaagtaccagtacttaggaaatacgtgtaaatatatatattgcagaaaaagtcaactggagaatgggtgaatatattatggtatttccatacaatgaaatattagacaactattaatcctatgtcagaatatgtcttaacctatataataatatagtttaaattttaaaaactatggttgcagggtaattgtagagttgcagagcacacatcaatttttatttaaactttaaacagaaaatctgtttttatatctttgtgtattcttagataaactattatattggttgcctctgaaccaggattcaggatgatgggaggaaattattaactttttctctatatcattctatattgattttcactaaaatattagcatacattaactttataatttaattttttaaaattttggcttttaaaatattttattaaatgttaaataggtacaaaataataattaagtaaaatatctttaagaacaatacatacccaatttaaaacagaacattagcccctgatgctcctgtgtccccttcccagacctcattccttgtcctcctccctcagggaataatcactattctgaattgtactatcattccttttgtttgttttgtttaccctttatgctgttttgcatatttcacaaatttatatagattacattattttgttttaaatcttgacttttttgctaagactgcatctgggtttattcatcttcacattaaacaaaatacaatatctaattcatacatgctggtgttgacagatatctgagttgtttacagttgaagtctattaaaaacaagcctagtatggacattcttgcatatgtcttctggtagaaaaaggaaagagtttctctaagctaaataaccaggaaggaaattgctaggacatatggcatgtgcacactaaaaaaataccaaattattttccaaaatggtttccatcaagccacatactcaccaatatcaactattatcacatttttaaaaatggaaacaatctagtcagtgtaaattattatttcactatgatttaattttcacttccctgattcgaaattaggttggaccactttttcatattttctcttctgtgaaatgtttgttaatgtgttttgcccatttttctatttggttatcttttacttactaatatgcagtttcttatattttctaggcattaatcctttgtgagcatagacctcagtaacagaccctaggaggagcctaaccatagtcctaaactgaaactgaaaaggagggtactaagaaagaaaaaagcagtgtctatctacttttccctaggaactggccttactctaacagctaagaaatggtatttcctgtttgcaaagtaatgtgttcttatttttattttaaaaatatatttatattcaaaattccacttctgcctaaatatagaaagctagtatgagcatcactcctaccctaacaatatacataagttgaaaaaaaaacactaaatcaaaattttattgaacccattagagagctgaggttgcagggcaaccaagtagtctgcaatctaaggaaagacagactctcctaaggagtgacaggacatgaacactggctccctgtggcagttcaagggagaaagagataccaggcactatacaaatgggaaagaagtattcagacataaaatgtaatgcactgctgatagctggatgtgggccagtgtgacagtacagaacagcgtaaagccacagacacaaaaagaacttgcacacattcacagactcaagttcacagacctccaacaggtgctcataagaaagactgagagcagagcaggaaacgggaagaaccattccctcagaagggtaggcttggaggaggggagccactgtcatggtcgaaaatgcgtaaagccccacttagacctatttctcccagaacaaaagccttacactgcaggaggaggagcagcaatccctgctttgtataagtgtatacccactgcagttggaaacagagcaaacaaaatccatctattcctggagaaggtgcagaaaacagtcctaagcccaggatttaatgccattattattacaaaactcctaccactacactaagtgaaggggaggaaaccttctccactgtagacttgccaaaggtgtcaggcagagtctggatgccatgagaaggggtagtatcactaaccaagcctgtcactgaggaccagggacagaggacctgcccaaggctgagaatggaataggacaacaaagaatgacttggccctccctccccaggcacgcaagcaccagtctactgctggaagataggcaggagaaggaaagaaagcccttctaaagcacaggcacacaggggaggcctaaagctgaggacgaaacaggaagagaccaaaaataaaaactccttagcaccccagctgacaccctgcgcacaagctaaatcctaaggaattctaagccaatggttcaccataggtaatgagagcaacacaaaaccaaaacccagctcatgtcctaaatggcctaccagaggaataggcatgactatttctaggcataaattctatttactttagtctctttttttctacacccagtaccaacactcaatcagatatatagacacataatgaagctgcagcagctgcaacaacagaagccagtgtcaaaaagcaaagcaatcacagaaaaaaatatcagcaacaacccatctgtcagagttatccaccagggaattttaaataactatcattaacatgttaagctctatgaaaaatgcaaacaaaacgcattaacaacagagacggaatctgtaagaaggtgtcaaatggaaatgttgtacataaaaaacactgtgtgctttcaatgggttcattagtagacttgacacaaccaagaaaggaatcagtaaacttgaagaaaggttgacagaaattacctaactgaaatacaaagagtaagaagagtaggagaaaagaaaagtaaaaagcaacaaataatgttagtacagcttctttggaatacagtttgtctgttatacacttatgacccagcaatcccactcctagatatttaccttaaagtaatggaaacttatgtttacacaaagtttgtgaatatctgtagtacttttatccataattgccaaaatctggaaacaacccagtgtccttcaactggtgaatggaatactattcaataaaaaagaaattaaatactgataaatgcaatgacacagatgaatatcaaaagaattatgctaagtgaaagaagttggactcaaaaggctacatatttatgattccatttatacaataccttgaaaaagacaaaagtaaagagaatgaaaatagattactggttgctaggcaccggtggtagggtaaagggttaactataaaaaaatacaagagaaatttggggggagatagaaatgtactataccttgattgtgatggtaaaccttggtcaaacctcatagaactgtatgctaaaagggtgaattttactgtatgcctcagtttaattaagcatgttttaattaattaaaaattatgtctcgttttataaaagcatattcttataaactatttttgtaggagatctgcattttaataattgcataaggtgatattttcttaactggatttgacatttttcaaataaagtcattagagaagatgtttccaacatttgatgggatgttggttatggatgacctctaagatcctctccaactccaaggtttttgaggtgtgcatgtgatcccccaagtttacaaacacaaattttataaatatatatatatatatatacacatacacatatatgttaagtatatattcatagttctaattacatttatattatatatacatgtaaatacgtatacacaaaaagttctgaaatattcttcagtattataatttattatatatttgttattttctttttttccactataaacatgtgataatttgtaatccaaaaatgttattattttacttacaaagcatatattgtgcaacaaatttttaaaaaggaaataaggaagcaggttatttttcaaatctataaaatacctagctttaaaaaaatggattttactaaactgacatatttaatactttaaaatacttgaagaaaggacaggaattagccattgtgaatatggggtgtggagcatttttttaattgcatttttttatttttaaaagaaaatcctagaaaaccatattttcccatttttgaagttttccctagctctttctttcatttgtattagaaatatctttgtgcatatctctaaaatagagcctcaacttgctactacaaataggatgatgtcataccagaaagtagaggggagagagcctgtgatggccctgcagcctcctcatcctcactgctccacctgtctcttctgaaggggcctctggctgtccacatgctgggatcactgccactagaaaagaaatgtatatatttgcccatggtttcaaagaatatatacatttgagaaatactttctaatcatcttcattgattatttaattgacattcatttccatttcaattcagccacccactcccattgtcatcacctgaaactggcccacttgtgaaataattcccaaatcccaatatctgatcacaaactccatctcctcctactacttttaccttgcaaactagtcgcctcagatccatccacttatttaccttctcccctcctttacctagactgtgggagggaagtactcgggtcactgggctttctaatatcggcagagagccgtttggaaaataccagcatgtccctggttggtttcctgtaccactcttccatggcagcaaattccaagccaccatcttgttatagtccttattttaatactctctctgacttagtaaaaatgtaacttcttctagaaaatgcaagccagaaaatagaaattctttcaatttattatcttttaaaacatttacttagatgcatcaatgtctttcttattccttgctttctgcctgttcaaaattcctccttccgtgttcttaaccagattccttctgcctcctctaaggtatttttctataacttatttttttttaacatatcgtgaatttctccctatctacaaattctttcatatcataagaatacacaattttctgtatcttaaaaataggaaatgctttaaactctgtctagctactaattgttaacagatttttcaaatcctagcccatacccactttgtttcctttgcaacgtctccatactcaactgactcgctaatgctattaacttggctcttgttgcactttcatttgcaaccctacctagcaaaatcctcctaatttgacttctgcatctaaccttcaatgtttagagaaaattcttcctaaaatacaaacttaattacacctgcccaccaatatcaggataaatcaaggccccttatcagacacaaaagtttaggatattggccaggtggcctctgtctatttttccatcaccatctccactgatttcctacatgcactgtatgctttaaccttagcaaaataagtgcctttttcttttacttctgtaagaaaattcgggtttcttactcttttctccttctaatttttttcttggattactgtaaacatttaattaatctccactgactgccacttccagctatcctcaccttgccaccagcattcctccttctggatggataaatagatagttgcatgaataaaacaaaaagaccctccgtatgcatccttttgattttaacagactgaataaaatgtatactcagcttcacatatatggcattacttccctctccagcccacactgtattttgggctccacctctcatcttctgcagcttcctagcattccacctcacatacaccctacgactcttggcacctaatatttctccccattacccctaagatattttcacaactccttaccctcgctcaaacttctccctcttgcctgaaatgttcttctctttttcacctgctaggtttctatttaattaaatcctaaattcaaccaaaatatcttttcttcaaagaagcttgtgggaaacctccctcatgcatagtcaatcttctgtacccacaatctttggatttttactctaaaataatatttactatgttgtacatcaatttgtcttttatatgtctgtttccctaattaaactgtgaactaaagagcaaaaaatatatagtagtttgtatttgtgtacagtgcttagtgtatcacagaatctcaaaatgtctttggaattactattatttgtttaatgcacttctgaaaattgtacatataaatttcatacaatacgcatacaaaaacacataatataaagaatatacacattcttatacagtgctattccagtgagggtagctaatattactgataaatctctaagaaaatatggcttaacaaaatgtttcctcatttgatgtttttgcttataacacctaaatttgaacattttataagcatgaaaacttgtttctttgttttcctaatggaaatttactgttcttcaggtactttaaattttttaaatatatactaccagaaattcaccatactaataaacctgttgtttataccatataattttctttctgaaaacagattacatttctaataacatttagtgctgtaccgtgagcttcatgctacctcaagtacactgaccacttcaaaagctccaagcatatttgcaaaagctttgacgccatgtaactattgagaggatagagaaatcgaatccttcaagaatacttttcccttatgttaattaccatatttttgagatcataaacatatttctaagaaagctaaatcaagtttataaaaagctatatcttgaaaaattaaacatttcagggccattattcactgtctccatgcagagggctagctatgaatataagtagcataaacagaaaacccactaaataagcatattagttatacctttctgaaggctcttcaaaaacatcctcataatcattatgtgggaaattccgaagagaaagttttaccttctctgaattaactttattttcaaaaacctacagacataagaaaggaaacaaattatagcactggttttagaaaaatatggtttaaaacgtgatttctatagctacttaagaagagcaaaaagatctgcaataatggaattataaccacaatcacatagtataatgtctgctcctagaaaatcacttaattgtatatctccctattaaatatcttccaatctgtcaaaacagtgtagagtactatgtaaacagaagttatttatattgaattgctcaagtgatttttcaaaactaaatttttaaaaagcttcatttgagaaaaaatagatttattacttcagcccagaagagattttcttataagtgtttaccatgttttgtttactgtgaatataaaattcctgccactaaatttatctttactttagtacttgcaccatctaatctactaattctaagtatttctccacattccactgcccaattttgcaccgggcagtggacttcagtcttgataactcgcagtgccagtgccccagccaccacatacacgtttccttccttccttgtctaatactgtcttgccatacttggccttctattttctcaagaacatcttttgaatcagctgatcaaatctcattcacacacagaaataactttgggactattattgaaattaagtaatatgaattttttaatttaaattggaaataagtgatgtatttatatattaagtatcattatccactaatatgatatagctatccagcaaaaagattataaaatattctcaataaagacaatgtataccttttcttagatttactcctaaacaccttaagtggcacaattgtaaatgtaatgtcatagagcagaccttttatttgatacacactgctcaatccacaaaccacatgtttttacatctagtatttttgtgtacattccattctaaatactttaaacttccattatgatttcttctttgactaatgagtttgttagtgtttgcttggtgtatgtttaatttttactttaaaatcacaggaaaatgtccacctaagattccttctcattaaactatgtagctacaatacacgaaatgaaatgagcttcacagaattgaactagttttgaaatcagcactgattggcaaatccctaaaaattaatttcaggataattaaaattgaaatgtagaaagtgtggctccagtgggatggaggaaaagaagtgggacacatgctattacacaacatgatcccacttccctcttacgagacatgcttaaaagtcatttgagtacaattcatttacttagaaaaagtgatatctggaagtcctaacacaatttaaacctgagacatctttcagctcatggttcaaaatcaaatggattatatttattttttaaagaagcagactgttccagatggctgcaattcaaatttaaggctgactaacatatgtctgattgagtgaaaagtgattttgctaacaataccaagaactaacaaggagaaatataataaattatcaagatggcaggacttttggagattgctcacggaatcaaattaatatcaaattttttaaatgttagaaaatgttttctgaggagcctaagttagcttttctgtagtccatgcagcaaggatttatgaggacaaagtgaaaacagtaacacagataggagcctggtttctagtctgtgactcaagagttatatgatcatagacaaatcgcttcagctttcacctctaaaatgagtgctggcataaaaatgtctttaacaggccaggtgtagtggcttatgcctataatcccagcactttgggaggccaagacgggtggatcacctgaggccaggagctcaagaccagcctggccaacgtggtgaaaccccgtctctaccaaaaatccaaaaaataaattagcctgtctcaaaaaaaaaatttctttatgctccaaatctaaccaacttcaagtctatgagtctagacaatttctaggggacagcatcatatctgaaaggacataaaaatggctacagtatcaaattgtttcatgaaacataagaaaagcaagttctaataaaatcaggtaattttcccaacactataaaaaccatccaggaatgttctaagatccttttttatgaaaggaaactttaaagcatatcagaattcaccctagataggccaagctataacttagcaaaaaaacaaacaaacaagcaaaaaaaaacccaaagtaaaaatataaacaaaatcacaaaatgtgctcagttctagaagaagtcaaataagactataagactatataaaggatatacttgggccattctgtgaaggtgctccctttcaaatcgtctctgcttcaaagagaaaaccattctgatcagagaaaagaatcaagagtgagcggagagcccaacacggcactaacagccagagattcccagccaaagatgtgatggtagccttgatgtggccaacttaagtatagcagagaatggacaggagataataatcaagttacaacactgttcttaaaagctgcactcctgcccacctggggtggaggtggcaattgaacaggggaagtggtaggagcagtttttggtctatgtactgactttatctctattactcctgtaacttacaggaaatgaacacaaggccagcatcatcatcgcagttccaaagctccagttgactaggtaagagaaaaaaaaatgcaaagcacccaccagactaaaatgcatttccctttttttgtgctctaaccctagcactatctccacaaatggggtaatgtgttgaagtaagaggttttgtcacagacttttcacagccctctacttttccatagttcggagacacccaatcatgctgtctcaaacaatgaaaaagtccacaatcaatacatctaaaggtgcttcatacttcatgtgacatttattttgtatcttcattagtaacacaaaactagtgcctgtaaaatttccagagtagcattagaaaatgcaattcattagaaactttgcaaaaaattccactctttcaaatccccattttggtcactgtcaacactacagtgacaaaaaattaagaaatcattttggtgagaaccaaatagatacccatttcccagagagcacagtcagcaatttaggtattagccaaaattagtagagatccctctccttttagtcttacctttgatctaggtgtgttttcctgacttgatgaaggcaaagtctccctgaaattcaagtcttctgcttcagagtcatttccctcataatcgtttactgaacaaaggcggggggaaaaactgatcaaatagaaaacactatacagaaggaaaaatggagccttaatgagaaaaaacaagctacatgaggggcattttcatctacttttcctgttttccaaacaccccatctttatctcctatggtaatcatctctttctcccctgctttgaaaaaatcaacatagcaaagctgatccttcttctaggattatcctcagggagttgacttttgagcggttcccttgttcctcattgccatattattcaagaaagtactcttcaagtaaatcctagatatttacaacctgcagaacctatgcattgggatctacagaatacagtcttctgtgtttcagagtctatttcttgaataaagaatactgtgttacaaatgtcgcactgtaacttcttgtattatttataattcataagttagtaatatgttaaattatacagaaaattgttttcggctttgttgaataatgtaatatgaatcatcccaaggaaactctgggtttcttatatgattattcctaattactgtgttaattttactgcacagactctttcagataagaagccaagagaaaattttctctgatctcagtactgagcactcagagtactgtttctcataccatgggagccttaaatattatgatttagaaattctatggcatggcatattaccaaatcaataaaaatatagtaaacaagtactatggaaatgaaaaagtgtgttcctgaatgtgtgttaaaaaggaaatctaatagaaattatgaacctttataacacatgaattaattttataaattaaaacattaagaaatatcaatgaagggacaacatatcaaaactaatgtgaagtagctaaatgagtatttagatagagggaaaatgtataggtttaaatgtgtttacaaaaaaggcagaaaaaaaaagctgctataaatgagttttgtattcaatcatagaagccaaagaaaaactgaggaaacccagagaaactacaaaggagaaaatcataaagaaaaatataataacagaaaataagcctaaagaataatcagcaaaatccaataaactagttctttgaaaaaaaaaacttaaaaatacgcaaccctctttcactacaaatcaatggagagtaagtgcacaaataacattaaaaatgaaaaaggatcgcttctcggccttttggctaagatcaagtgtaaaaatgagaaagggcacagctacagatgcaactctcatttttaaaggtaataagcaaatattatgagaaactttagggaaatctgatgaaatggaaacttttataagagaattataagttatgcaaatttactccagaagatgtagaaagcctaaatagtgtaataaccatttaaaaagtcaaaccaataatcaaaaatatcactcccaagaggaaaaagcatctgggcccaaacaggtttccagatgggattttatcagactttcaatgaaaaaaatctctcatgcaaacggttctgaaaataggaaattccgcaaacctaggaaggagcttcaagtgctagaaaaaaaattaacaggaaaaaaaagtctatgagaattgtaaacaagcaactcatagaaggcgacttacaggccaataatatattcagaaaaagtccagcctcacctgacaaacaaaaaatgaaaagtaaaacaacctacaattgactttcatttatgcttatgagagatttactgtaataggacttaaccacaaccaaccagaaaataggacaaaatatataaaacaataattttcagaccttaaacaacagactgtgatcccagagagaagggggtgagccttctggttgctccagattatggcctccagaagtttgcaggctatagctcaggaaaggaatcaacgagtccagtgattcaatgagttgagaagaaaaagatcaaagttaggagaggctgaggcagccagaatttgtagggcagagtaccagggaggagggagctatacagaacaagagaagtctaagtagctgcaaagaaaccctctcatgtcctttgcagaatatggatatgcttatatgaaggaggacaatctctgacactcaggaaggaccaccggaaagtagcaagccacacaattcctaggaacagttcataggagccagaatgaggagaccctgtaatacagggggcgttgaggatagtgcacagaagagatacctcttagtactaaaactatccttggaacagaagctccttagggccacctataaaaaaggtgaagagcaagcctcagacaggatcaggttaaacttcaagtaacataactacaaggcagaaaaacccaacattctttaaagaaaaatcaaggccgggtgtggtggctcacgcctgtaatcccagcactttgggaggctgaagagggtggatcacgaggtcaggagttcgagatcagcctgacaaacatggtgaaaccccatctctactaaaaatacaaaaattagctgggcatggtggtgcgcacctgcaatcccagctactcaggaggctgaggcaggagaatcacttgaacccaggaggcagaaggttgcagtgagccaagattgcaccactgcactccagcctatgagacagagtgagactctgtctaagaaaaaaaaaaaaaaaagaaaagaaaaagaaaaaagaagaaaaaaagaaaagaaaaagaaaaaatccagcaccaaaatcatataattcacaatgtgtagtaaacaattaacaggtatgccaaggaatagaaaagtataacccacagccaaatcaatcaatcaatagaaatgtacttagaaatgacagatgataaaatttagaaaaaagaacttttaactattataaatttttaaaaggtgctcaaggaaataaagaaaaacatgatacaataaaaagagatataaatcatgtaaaaataagacctactgaaatttctagagacaatgtatgaactaaaataaattaacagcagataaggcagaaggaaaaaaaatcagtgtctgtcaacatacagcaagagtatatccaaaatgaagcgcacagtagcgaaaaaaagagactgaacagactcagcaaactgggacaacatcaagtgaactaaaattcctgtaactggaatgccaaaacaaatatgaagaaataatagctgaagtgttaccaaactagatgaaaactataaaccaacagaccaaagaaggtcaataaaatacaaatgtaatatatgagcttatagaaaaatcacattcatgtatgtcatattcaaattactgaaaagaaaaaatgccagagaaaacagacacattaaatatagaaaaacaaagataagaatgatggatttctcatcagaaatcatgcatgctagaagataatggtgagacattttaaagtattgaaagaacatagaattcttatagaatgtcaatatagaattctataccctgaaaatatatatttcaaaaaataagacttctgtagaccaataaaaactaagattatatccagcctgcactaaacaacaacaacaaaagttaaaggaagtttttcaggcacaaggaaaaggataaaatatgaaaatgtagaactatccaaaggaatgaagagtggcaaaactggaaaatacatgagcacataaaacatactctttcacatgttctaatttctttaaaagataactcaattataaggaaaaataataatctattgtagggtatacaacactcacaataaaattggtatcaataatagcatgaaaggcaaatgggaggaaatggaagtatcttatgttcctacaactatatgtgaaatggtaaagcagttcccgcttacccacagggaatgcctagttccaagacccccagtggatgccgaaaacttaggatagtacttcctgcactgaagtcttaaatccctcaaagtcatccatgagggttaaaatcagtttttcccaaactcccattaatgttgacattttgacctcctcccataaaccacaaatgttcttaatggcgtctagaatggggagttatttccaaaaggttttcaatttactttgcccagagccatcagaagaatcactatctatggcagctacagccttacaaaatgtttcttaaataatgagacatgaaactcaaaattactcattgatttctaggctatggaatagatactaaatcaggaactaactcagtaatttaaaaaaacctaccaatcagaaagagcccgggccagaaggattcacagtcaaattctaccagatgtataaacaagaggtggtaccaatcctactgaaactatttcaaataattaggaagagggactcctccctatctcattccataaggccagcatcgttctgataccaaaacctggcagaacacatggtctaatatccagaacttataatgaacttataaatgaacaagcaagaatcaaacaaccccgttaaaaaatgggcaaaggacatgaacagacacttttcaaaaggagacatacacatagccaagaagcatatgaaaaaatgctcaatatcactaatcatcagagaaatgcaaatgaaaaccacaatgagataccatcttacacaagccagaaaggctattattaaaaagtaaaaattaaaaaaaaaatgtttgtgaggttacagagaaaagggaacacttatacactgctgatgggaatttaagttcaaccactgtggaatgtggtttggagatttctcaatgaacataaaacagaactaccatttgattcagcaatcacatcactggctatatgaagggatataaattgttccgtcataaagacatatgcacatgtatgttcatcacagaacttttcacaatagcaaagacatggaatcaacctacatgcctgtcaacagtggaatggataaagaaaatgtggtgcaaaaacaccatggactattacacaaccataaaaagaatgaaatcatggctgggtgcggcggctcatgcctgtaatcccagcagtttgggaggccaaggcggatgaattacctgaggtcaggagtttgagaccagcctggccaacatgatgaaaccctgtctctactaaaaatacaaaaattagccgggcatggtggcacacgcctgtaatcccagctactcgggaggctgaggcagaagaattgcttgagcctgggagatggaggttgcagtgagccgagatcgtgccactgcactccacctggctgacagagcgagactctgtctcaaacaaaaacaacaacaacaacaataaaaaaaaaaaacaaaaaacagaatgaaatcatgtcctttgctgcaacatggatgtagctggaggccattatcttaagtgaatcactacctgggtgatgagatcatttgttcaccaaaccacagcaacaagcaatttgcccatgtaacaaaccttcctatgtacccccaagcctaaaataaaagttggaaagaactagtctacaaaaaagtttgggtagctttccatgtttttgcatattctagcttaactgatttatcattaaaattagctttttcataaaagtttgcaactgttaaaggatagtttccagaaaaagaaaatcacagctctcatacagacatataaatgcacatgttactttattatattcattaatcagtgagggaatcaggcagatgttatttttaaatttttttttaaaaaacccataatactgtgtgttagtctgttagcatcactacgtaggaatgtctaaggctgggtaatttataaagaaaagaggtttgttctggctcgtggttctgcaggctgtacaggaagcatggtgctggtatctgcttctagtatctaacctcaggaggcttatagtcatggcaaaaagtgaatgaggagccagcaaatcacatggtgagagacaaagcaagagagaaggggaggttccagactcctttgaacaatcagatctcacatgaactgagagagcactcactcatcaccagggggataacaccaagccattcacgaaggatctgcccctatgatccaacatctcccaccaggttggggattacctttcaacatgattagaagagataaacatccaaactataccatacaggaagtccttgccagagcaattaggcaagagaaacaaacaaaaggcatccagattgaaaagaaggaacaattaggcaacagaaacaaataaaaggtagccaaattgaaaaggaggaagtcaaatttgtccctgtttagagatgacatgctcttacaaatgcaaaaacctgaagaatccaccaaaaaactcttagaactgataaacaaattaagtaaagttgcaggatacaaaatcaacatgcaaaaatcagtagcatttctataaaacaataacaaactacctgaaaaagaaatcaagtaagcaatctcatttacaataactacaaaaaataatacctaggaataaatttaaccagagattaaagatctctagaataagaactataaaaaattgatgaaataaattgaggaagacacaaaccaatggaaagacatctcatgttcatggaataaaagaataaatatttttaaaatgacaatataaccaaagaatctgagagctcaatgcaattcctatcaaaataccaatgacattcttcagagaaattttaaaatcataaaattcatatggaagtacaaaaaatactccaaatagccaaagcaattctgagccaagaaaaacaaaaacaaaataaaaacaaacaaacaacaacaacaaaaaaacaagaacaaagcttggggtattacactacctgacttcaaaatacactacaaatctatagtaaccacaaaatcatgatactggtataaaaacagacacatataccagtggaatagaatagagaacccagaaataattccatatgtttatagccaactcttttatgacaaggcacaaagaacatatattggggacaagaaagtctcttctataaatggtcctggaaaaaactggatattcctatgcagaataaacttagactcctatccctcatcttacacataatctgacttacagatggaatccaggctcacaaaagcagatagcagaatggtggtttccaggggatagaggaaggaggaaatggggagttgttggtcagatggtatcaagtaacagttacacaagatgaatacgttctgaagatctgatgtatagcaaaatacatacaatactgtattgtaatgatatttgctaagagggtagatcttatgtttgtaatacacacatacacacaaagaaagaaaatggtaactgtgaggtggtggatatgttagcttaattgtggtaatcatttcacagtatatagacaaatcaaaacatcaagttgcacaccttatgtatacacaatttttgtcaattatacccgataaggattggaaaaacacttctagggagagagcaataataatgacaaggagggcggatagaagagggaatagaagctgggctgaaggtggaaggaatgagaaaaggcataaaagacatactgaaaaatgatggcaagctactaatgttttaagcaagacaatggcaatatgggtcggctgggagacagctgacatttaactaaaacactgcattagtagatgtatcaaaaaccttagaaatgtatatgccctgagttcacagctaacaaaattatggaaacaaacagctttgtggcagattacaggttgtttttattgtcttgttgttttctttgtgttttggtgcttttttgtacttcccaaattcttcacaataaacctatattacatttataatcaggaaaaaaaaatgccatttgaaaagggtaaagtaaaacactagagtttaattgttgttactctaagcgtgatggcttattagaaatgcagagtcttgccccccaccccaccccaccaagacccagaggatcagaatatgcaggataataatccacaggtggtccctatgcaaatctacagtctgagaggcactcctgtagctcctcctgatcccatacccacaaaagtagatgatgcacctaccaggctctgctctaaagtccctaggtgaagacatgttgttcccatcccctaaatgagactggtaaaaggcttcttcagaaaaggagccttagtgtcctgtgagtcaggccaaaggtctagttagtatcctgggggccagcaaacaatttttgttcacctggtaaaacacacaaagccaaagatttttctgttacacaactggagctatcacagctttgacatattattactcatcaattcaaaatatttaaaactgcaattttaattaaagacaaaataaatttcatttgaaattttatcaaataatttcaggatattccttgagaactggagatacgcttatttattcaaataccagagcttaaatatgctataccttgcattccacaaataaatatgtgaatggcccctccactccaatgatgtatctctttatataaacacacacacacacacacacacacacaaattcaatcaatgtcactcaatggaaactcagttatttaaatgccacacctaagctaaattaggtgctgagaattcagtactgaataaataagaattaattacagagaccgtcttcaaggagttcttgttcattcaatctataaaaagttctcacacagaataaatcttttttcttttctaattcttgccataaagggcctgtaaggccatgttacattgctcccattggttaaaaccaagaatacttttatctggagacctttccattaactacctgcaaataaaatggtattactataatctgaatctaaagttaatgtgtgaaacagatttattttaaaaactttgagatataggtgttaaaaaattatttaagactaggtgtagtggctcatgcctacaatcctagcactttgggaggccaaggcaggaggatcgcttgagctcaggagtttgagaccagctggggcaattgggtgaaaccctgtctctacaaaaattagacgggtgtggtggcacacacctgtggtcccagctacttgaaaagctgaggtaggagaatggcttgagcctgggaggaggatacagtgagccaagatcatgccactgcagtctagcctgggcaacagagccagaccctgtggcagaaaaaataaaattaaattaaattaaaatgtgaaagtaaggcaaaagataagtggaatgtcacttcaatgtcataaaataatgacaggccatcccaaagattacttatgtggggaaattgtactttattcagttcattgtttactactgattaaaagtcctagacttaatgcaattacaacgtaacctatagatttttgtccagcagtgatacaaataatttctgtctgataaggtaacactaaagattataatttatttctgtctggcattaaccaggttttcttaatctaatctagcattcttactctaacattggttcaaaacgccagtgaaaaacctagatcctcaaactgttctttgaactacctttgccatcttcctggtttcttcactaattaatacattgagtaaaatgtttaacctggtttcatttcaaatttgtgagtcacatttataatttttaaaaaactctgctttgacaaggggaagaatatcttttttaaataggaggagggctaggcacagtggctcacacccgtaatcccagcactttgggaggccgaggtgggaagatcacttgagctcaagagttcgaggccagcctgagcaacccagtgagacctcatctctaccaaaaattaaaaaaaagaaaaagatagccaggtgtggtggcactcacctgtagtcccagctacttgggcggctaaggcaggaggatcacttgagcccgcaagatggaggctgcaataagctatgattgtgccactgtactccagcctatgcaacagagcaagactctgtctcaattaaaaacaaaaacaaaaggatggcagtgttcttgtgactggcagtgaggtaacagatttcagtaaggagccttccctggaagcagacatgagatcttaaggacctcagaattaactaagaacctctaagaatgacacctaagcttctgcctaccaactatgttattgaaaagatacaaaatagtacaattttaattaaagacaaaataaattttgtttcgaattttatcaagtaatttcaagacactccttgataactggagacactcttactaattcaaatactagggtttaaacatgctataccttgcattccacaaataaatatgtgaatggtcctttaccccaatgacttatcctctttatataaatacacacacatattattaagacctctccagtgcacagatgaatagactaaaattcatatcaaaccataccaatagtcagttgttcaaaccttccatcagaacagctttgatcagaaatgcatgcctaatcctagtattttaataaacaacagtgcagtgagtcacagataaccctacagaagcacaagaattaaactggataaatttccctttcctggcatgttttctagtatatcttaaaatagacaaaacaaagcaatattaaaatcattaacatttaattcaattttgagttgcagctactgtagtaaaccagtaataagatcatacaagtcaacatcaacacatgtgtactgaaattttaggtagcctagaaaagtaaactatatgataaaaacaaaatcttcatttgcagaagaaaacctttcagaaaatatagtgcaagcttttaccatatttcccacctcccctcaagcttggctaagtaagcccctgcaagtgcttcccctataagctccatgttttataatgatttctggactcatctcctcgggttggaccataagcatcttgaggacagaaactgtaacattttcacttttcaatctccagccactagactaacacaatggagacatggcaagaaatgtttgagggactaattagttaaattccataaagaatgtgtatgtatcaccaggtaactaatctgcatgtccacatcaagaactctgagaagtcacagaggtaccacttgagtgataggcactcggtcccttagggaaagattgtgaaagatattgagggaccagtggtcaggttcgtaagataaaggtttccctccaactcctggggaaggtgcaatagtatagaaaatagagaattagccctgataaaagagaaatccttaaaaaagtattacttattctgtgatagagcactgaggaaagaggaacaaaagctccaatatgaaacaaagtgatcccatctaatcataaataaaagaaaaactacaagtgtttggtttgctcaggaaacaaaagcaaaacacctttcctcaggtggcagggtgacataattggagagtcactgaatactgtacatattctcaaattctcagctgggacactattttcagtctatctcaaactctctcaaaactgaagcaggtgctaacaaagactatttcttcacagtggactttgggttgggtgcaagatgccaaaatagacaatgtaaaatgacatgctcagcaccttgggcctctggcaattcttagcaccagggctacttctaattcttgtgaaagttctatcatacactactccctgagacctatactagcctgaagagaagggaatgaaagaagtctcaaatgttcaatagtgacttactcttgccctacctgtaggcaccccagggatatgagttccttcctctgaaatctgtatttcctgtgactaaattctcagtacaagcttcttagactactagtaattatttggcatgttttatgccttttaataatggctcttagttttctataaggaatggtggtattgctttttctgattataaacataaccattaagaaatgtcattccgtggtttcttaatcaatcattccctgtagtgtgtgagtataggactgggggctcagagggaagcagggagaagtgaagtgctaaagtgctacctccagagccactgacagttctgcccaatgcaatcaggcaaaacaagaaaaataaaataaaaggattcatattgggaaggaagaaggaaaaccatctttacttgcaaggttaaaagctttatacataattacacctcaataaagttgacttttaaaaagccacaaaaagataatgtacttaaattaaaataaaatacagaaactctaggataaagataatatcaagttattaatgcaagtttaaacattaaaaaatagttgctacccactcatcacagacatgagcagcaagctcattaaagattactgtgagcattcattggaataatggaagactcaaggttccaaaggcactgagaccctatatcaacaatgcttcacccttgaaacccagggactgatgatgatacagttgccatgagctacattctgagtaaatactttatcaattattagaacggttcaagtaaaagtaatgaatgacttaagacatctttctgaaatgactcttttatctggatgcctctgctattagggtgcaaggcaaacaaccttctactgtttgtttcattcatgatataaattgctttggcatattccctccaacctcctgaacctcaggtcgatctgtttgtccatttgtctgtttacacttcttttcttccctccttcctacgttcctctccctctcttgtggaagtgtatcagtaattataagagggtgctttatttcagaagacacaattcctgtacctccaatcactgttaccaagcaaaagagttcactgttcaatgtgttagaagccaatactatggcactgggtttttgagaaaagaaagacttttttctaggtcaaccaacaaggagacaggagtctagctcaaatctgtcttcctgtactgtttttaaggcagtatttttattagaaaatgtgtagggagtgaatttggggatagtaggagattggtagaaggaaaggggggtctgaaaaggctttgggcatttgcagtatctcttcatgctatctcatgggtcacatatgtaaattcagggggagttagtacgaaacatgcagtggaaatttgggctgtggcgtcagcaagctcattctgtgtagactctagtttgctgtattggttccaactgatttcagccagttttgttatcttaaaagcagagagaatttcagtgtttcagaaagttgtttttgttttttatttttatgaaccaatcctataaattcaagaatttctctttgccactggttaactctttggggcacagtttcattagtagaccttggcctccatactccaaagaactacttatctactgggtgcagctgaaccatttccataactgagatcatgtaagtcaggaatgtatacacattacacatgtgtgcagacaaaagttcatgacttcacctaccaggtccaagacgagtctccttaggaatgcctgcatacaagcctggcccttggctggtgtctgggaacttggctggtaaaatcattgcctacactaatataaattttttctaaatgagaaaagtagctcacttctcctaaaacatctgttttccttctaggtatctggaatttcagtgactgctatcagtcacactgacagtctgtgctcatgactaacccctgataaaaaccctaaactcttaagctcagacgagcttccctgatagacaacacttcacacaagtttccataccttgttattcagaaaattaagtgcatcctatgtgactccacaaggagaatattctggggagtttgtatctgatatcccttgttgattttgctttctaccttttcagtctaccatatcttagccatgaatgtgactacctgctgaaccccatgaatccttctatccaatcgttgaacctgggagagctctgacaaaggctagcatgggaaaatacgttgtcttcctcattaacagacccttcttagttatatctcactttctaagttcctgccttccacttcctaggagagaaaaaactacacagcattacctgaacatcatcccagggtaatcacagagcagccatctccgcaaaagaaggaaaaatgaactgtgtaatgttgcaatatttttaactgcaaataattttgcatacaaggcttacctacaattgaccatttttgcactaaatgcttttttaaagtaacaagctaatatcttcttaatataaaaatatacatgtccaacaaaatttaacttgttctgctatcatgaaaagaggaattccagacaaatgtctcataatgtgcagtcagtgggcttatataaataaggactaaaattacaagctcaataaaagatcatcaaaccagggaaaactccaagtaaaattataatacacagttgtccctcccacctgagactcacctgagactcatactttccttccaacatgcctgttctgcctattccctcaagactcagacttcaaatgagttccctttaagtagataagaacagtttcgcaacggattccagaaaaaccaatatgccacctaaaggacaaggaaggcatctacactaagaaaatgaaaagaagtcagagagagaacttcctgacttactcagattatatacccatgggtccacatatgcctaaaggccaaccttgtccttaatctttagtcactcaatctataaaataaaagatttagaaaagggctatgggcaatatggatcttttgcaggtacaaaattttttaagtccataaactttctctttaaaacactgaagaccattagtgatggttataatattcttgtctgaactgagagctatagtcaggctccttttagaagccctgccatgaacagagaaaaaagaaaaggcatgttcctactcctctatcctctgtagacatcttctccgtgataagttaataatgagaagagaaaaccaaccttctagctttctcatcatttaatggtttgaaccctgagtttctgcagcctggaaaaaaaaaaaaaaaagaggaagcagcagcagcagcagcagcaagttctcctcatctgaaattcttccctctcctagctcaccttccccaccttctcactcctttgtggtcctcacagtcagatatgaggtaataggtggaaaatacttccctgtgataaggcagtgatgcctgagccacccacttctggtaagaaagctgttcctaaagaatagcaaatggtactcatgttttgggggactctatgctacttagaagcgagtggctaaagttgcacggtgactaattcaagaacaaacagaagaaaaggacaaacagaaaaataaacagaaagaggcatgcccttagcctcaatcaggtagttctaagaaagtgattaggatggttcggagaccaccagccccataccttatccagtcaccaaacaacccaggctggggtgtggttgcctggcaaccacaccttccatgtaccgagtatgtcacaaatatgtctttccggtgtgtgatctcttgactgtgaaaagtaaaacgctaaatcaattcagcaggctttgagtgtctacaatgtgctagtcactgtatcagagatgtggatccagggatgatgcaataacttctgcctccaaggagctcatagtttagtggacatctggcaaagtactcactgattcttgacaattcatataatcatatcaatagatgcaaaaaagcatttgacaaaatccaaattccatccttgatttaaaaaaaaaaaattcttagaaaactaggactagaggcaaactttctcaacttgataaaaaatatctacaaaaaaaatctacagggagaatctagaggctttcccctaagataggtaacaaggcaaggatgttctcttttaccactcctattcaacatcttatacaacttctgactaattcagtaagaaaaggcatacagttgaaaaggaaaaaataaaactgccttgcttctcagatgacataaatgtctatataaaatatctcaaagaataaacaaaaacaattagccacttaatctataaaataaaagatttagaaaagggctatgggcaatatggatcttttgcaggtacaaaattttttaagtccataaactttctccttcaaacaccgaagacctggaacttagctgggcgtggtggctcacacctgtaatcccagcaccttgggaggctgaggcatgcggatcacttgaggtcaggagtttgagaccagcctgaccaagatggtgaagtgccatctctactaaaaatacaaaaaattagccaggcatggtgccgtgcacctgtaatctcagctactcgagaggctgaggcaggagattctcttgaacccgggaggcagtggttgcagtgacctgagatcgcgccactgcactccagcctgggcaacagagcgagactccatctcgaaataaatcaataaataaaaactcctggaacttaataagcaattacagcaaggttgcagaatacaaagttaatatgcaaaagtcaattccttttctataaaccagcaattaacaattggaattggaaatataaaacacagtatcatttacattagctgctccccaaaactgaaatatacaggtataaatataacaaaatatatacaggatctatatgagaaactctaccaaactttgacaaaggaaagcaaatatctaaacaaatggagagatatttcatgttcatgtatagaaacactcaatatttttaagacctcaattcttcccaatatggtttataaagccaatgtaattccaacaaaaataccagcaaattgtttcatgggtatcaacaaattcattctgaagtctatatgaaaacgcagaaaacccaaaataatcaacaaaatactaaagaagaacaaagttggaagacagataatacaagatttcaagacaagaccacaaggtactgttgaaagaatagacaaatagatcaatggaacagaatacagtatccatataaatatatccacacaaatgtagtcaactgatctttagtaaagaagcaaagaaaattcagtgaagaaagaatattctttttcaaaaaatgataatggaacagaccttacacctttcacaaaaaaataactcaaaatgaatcacagacctaaatgtaaaacacaaaaactctcaaacttctagaagataactgtattggtgcccaagagctgctataacatggtaccacaaactaggtggcttaaaagaagggaaaacaaatctggaaattagaagccttaaatcaaggtgtcagcagggctgcactctatctgaaggctctaggggagtatacttccttgtctcttcctgtcttttggtggttgccagaaatccctggacagcacgattcaactgtctcacacaatttaaaccacaacagtcttctctccaatcccccaaaagtcatatccttactgtatgcaaaacacattcaccccatttcaacatctccaggacccttgacccattccagcatcaactctaagtcaaaattgcctctaaatatcaactgtaatgtcccaaatctcatctcctaaatcatctaaatcaagtatgtgtgagatcctgggtatggtccagcctggggcaaagtttctctcctatggacactgaaatccacaaaacaagttatctgcttccaaaatacaacaggcataggacagacagtcaccttccaaaagggagaaactggaaggaaaaagtgggtcacaggtctcaaacaagtccaaaacatggcagggaaattttcattaggtttccagggcctgagagggctgtctggatccatgagtcacacaggtaatcttttcagtgaatggttgttcagccacacccttggtcctgtttcgggagtatgtttcctggattggctgagaactttcaaacccatcaagtgctggttcctttgcttaacaattccttcctcaagttatctctttccttttgcatttcactataagcagcaaggaaaaaccatggccccatctttcacgctttacttagaaatctcctcagctcactgcctacaagttctgctttccacccacaggtaaaacacagttcacccaaatttctgccactctgtaataaggatcacttttcctccagtgtctgataatatattcaccacttcctttctaaggcctcacaagaagcacctttaaagttcacatttctagtaacattctgttcatgacaacatatgtattctctaagatgcaaagaatctatgatagatgctttttctaaaattcccctctctactgagccttcaccagaatcacctttaatatctgtatttctacaaatagtcttttcaaagcagtctaggctttttatgttatgcacctaaaaattattccagtctatacacaattccaaagccacttacatgttttttaggtagttattccaacagaaaaagatttccgggtatcaaaatatgtattcatttcctatggctgccataacaaagtgccacaaattggatggcttaaaaatgcagaaatgtattctctcacagttctgggggcagaagtctgagggtggcagcaaggccatgccctctgttaggccccagggaaggatgtttaattgtctcttcctaacttttggtggtttcagtaatccttgatgttccctggttatagacatcccactccaatttcagcctctgctgttacatgaatttctccctctgtgtccaaatttcccttgttttacagggacaccagtcattgcattaggacctcagcttaacttgtttaacatttgcaaagatcctatttctaagtaaggttggactcacaggtatctggggttaggacttcaaaatattctcttggggtataaaattcaaccacacaacaataataaaagagaaaatctatgtgaccttggttttggcaatgagattttaaatacaacaccaaaaggataatccaggaaacaaagttgataagctggactttattaaaattaaaaacttcttttctgcaaaatacactgttaagagactacaaagacaagctacagaccaggagaaaatgtttgagaaagcacatatctgacagaaaatttctaataaaaaataaacaaagaactcttaaagctcaacaatgagaaaacaaacaacctcatttaaaaattggcaaaataggcatgccactgcaaattccgtgaaacaggagaaaaactgtgagttcccaaagtgtaagagggagaaaaccgacctccaaacacacatccctgctgggaatctgaaaatccagatcacaggagaagaatttaaccttacctagagatggaagggatttagagagtcacacaaaatatgaaagtagaagtagcagcaggaagtgccttgtatgcactcccagtctccagctcgagcatagggacgccatccctgactatatctcactggggcccttgtggaagacaaccagcagaactgcggaagtgttgtggggtgaagaaagctcccagatgaaattggtagtggtttcgactgggcacacattttctggagtggagtccgaggaaggagcaggagctgctgcagatacaagcaagtacaggagtacaagaactgccaccaacagagcaggggcaaggtctgggcggggcattgcaggatatgcgggcttgccaactgcatgggagttgagtcaggcctcttgctactggctatccctgacttccctggcaaactatataatacagtagaggcggccaagatcccctatggaacataaccccattggccggagaaccaacccccagcccccacagtggcctcagcaagccccgcccaaggagcttgcctaaccctgctgcctaaccagacctgcctaaccctgctgccacctgacggcatttccctacctgccctggtagcctaacacaaaacatagaaactctggggagcttcatcccctgaaccctgcccccagcaccctctgctctggagggttgtctttaattgtctatggagcatatatatatatactctttccctatggtatataagccctgagtctggggagtaatggtgtgaacatctacctgtcttacacgaacacatttctgcccaagaacacatttctgtccataagtttcccctaaaaatcaccctctgccaataaactagatatgcctgcctcattctttgatttcttggctccttctgtatttggaggttattttgcatatatggccctttcaaggaatatctatctatataaagataaaacaataagctatcaagctataataagatatggagaaagcttaaatcaatgtttctaaagaaaagaagccaatttgaaaggctgcatactatataattccaactatatgacactaggaaaagcaaaacttttgagacagcaaaaagatcagtggtaagcaggggttcaggggttgagctagaataatgaacagaagaagcacagaagacttttagggcaatgaaactattttatatgatactataattgtggatacatgacattatacatttgtcaaaacccatagaaatgtacaatataactagtgaaccttaatgtaaactacagacttcagttaatactaatctatagatattggcttattaactatagcaaatgtaccaaacaaacacaacatattaataacagggaaaaccatggggctgagggggtatagggtaactttctgtactatctactcaattttttaataaatctaaaactgttctaaaagtagtctgtaaaataagatttttaagagcaaacagaacaagaattttaaaagataattgtctgaagcacaaataatgacaattatatggtgcactttataagatatgtagatgtaaaatgtatggcaatcataacacaaagtatgggtgggaaataatggaagcacactgttgtaaggtatatatattatactatatgtgaaatgatatattatttgaaggtagactgtgacaaacttatacagcctagagtaaccactaagaaaagaataaaaagaaggagaagaagcatggaggagaaaaagcagaagcaacataagggcagagtggagataaaatggagtaaaaaattgagtcattaaagaaagcctcatttaagccaaaagggtatgggaaaagaagggactagattaaagaacaggtaaggcaagtgcaaacctggcaagatgatagattaagatctaatcatatcaataattatattaaatgtaaatggtctggccatccaaattaaaagtcagggattgtctgactggattaaaaaagtgagatccaattatatactgtctacaaggaacccaccgtacatataaagacattgataaactaaaaaaatggaaaaaagataacccatgtaaacactaatcaaaagaaggtagaatggccatattaacatcgacaacatagactttaaaaaatgataaacatttccagaaatgaaaaggggcattacataatacataggaattctaaatgtgtgtgtatccaacaacatagcttccaaagtgataaaatgaaaactgaaatgaaaaaaacagaaaaatctacaacaatgttggagacaagtaggcagataataaggacacagaaaacctgaataacattatgaagcaatttggcctaacttttatagggcatcccagccaacaacaaaataagtattaaagtggacacggaacattcacaaggatagtccatattctgggcctaaaaacaaaccataaaacattaaactgaaatacaaaatatgtttttaaaaatggaattaaaatagaaatcaacagaaataaatctttaaaattctcaaatatttggaaattaaacaatatatttctaaataactcccaattcaaagaagtgacaaaggaaattatacaatattctgaattgaatgaaggtaaaaatacaacatcaaaattagtggatgcagctaaaacagtgctgatagagaaatttatagcattaaatatttatattgggaaataatagaggccttaaatgagtaatctaagttcttaccttaagaaattaaaaaagaaattaaatccaaggcaagcaaaaagagggaaataataaagaggaaaaaaaatcaatgaaatggaaaataaaaaaataacagagaaaaatcaatgaaacccaaaacaggtccatgaaaagattttaaaaaaaattgctaacctctagaccctcaatgtccagtagaactttgtataatgatgaaaacattctatatagcagcaccctccaatgtggaagccacttgggactactgatcacttaaaatgtggccagtgtgactgaggaactcaatttttaatgtaattttattgaaattaatttacatttaaatagacacatgtgactagggataactattgaacagtgcagctctagaattgactactgaaagaaaggaaggggtgggaaggaaagaggaagaggaagagataaaggagggagagaaagagggaggcagagaagatgagatacacaaataaccaaaatcggaaatgaaatgaaaaagaggacttcactacagatcctaatgttagtgccattaaaaggataataagaaagtattacaaacaactgtatgccaaagttgataacatagatgaaaaaaactaattccttgaaagacacaaagtactaaagttcactcaaaaagaactgagtagcatatacaatctgaatagccatatatagttttaaaaacttgagtccatggtataaaactaacacaaggaaactctaggcccagatacctccctgttgacctctaccaaacctttaaggacgaataacaatcctatacaaaatgttccagaaaatagaaaagagaacactccaaactaatttatgagaccaccattaaccttgataccaaaatcaagaatattacagaccaatatctttatacaccaatatccctcatgaatgtatatgcaaaaaaaaccttaacaaaatattatcaagtagaatagatttatttctccatttatttggttttctctcttcaatgttttagagtttttagtattcaaatattacagaacatcattagatttatccctcagtttttcatgtttttgataccattgtaaactgtatttctaagttttaatttccaattgttcattgccagtgctaaatacaattgatttttgtatattggcctcacatcctgtgtctttgccaaagtcatgttatttctagttgcttttttgtagattcctcgggctcctacataaacaatcatgttgtctgcaaataaagacaattttatttcttccttttttatctgtgtacatttatatcttttccttcctttatttcactgactaggacctccctataacgaacagaaattgtgaatggaacatccaatgtgatgctggtataagaatagacatatacctcagcaggaaagaacagagagattagaaataattcacacatagcaacaattgatttaggaggggaaaggtgccaagataatataatggggataggatagtgctttcaacaagtgtgtgggaaaatgagacatccacatacagaattatgaacttcaccccatactcatattatgtacaaaaatccactcaaaatagatgacagacctaaatgcaaactctaaacctataaaacttctagcttaaagcttaggggaaagcttttgtgacactggattacacaaagatttcttaagacactaagcacaaaccacaaaagaaataattgataacttgactttgaaaaaatcaaaagcttctgctcttcagaagacagcattaagaaaatgcaaagtcaagtcccagtctgggagaagatatttgcaaaacacacatctgaggaaggacctatatcctaaatatatagacccttataactcaaaaagaggacgacccaattttaaatagtcaaaagatgtgaacagatacttcaccaaagaagaaacatagatggcaaataaatatatgaaaacatgattaagacaactggtcaacataaaaatgcaaaggaaaaccatacgaaatactgctacatacctactagaaatgctaaaatcaagcacacacacacagtccaatacaaagtgattctggtgaggatgtggagcaaatggaatctcatgcattgctgctgggatctctactcatcatcttgctttatttttcccaaaaccactttttattaccttaaagtttgcttacccatgtaagtccatatatatcttctcacatgtttattgtctatcttccccaatataagtactatgaggctggcaacttggtctgtcctgtcatcactgtgtcattctggcaccaagaacagtgtctggcaatctttacatatttattaaaagtgaggaaggggtggaaagaaaagacactaagacatctataagtgaatatatgaaggcaaggaacccagtcacagccatctacagaggagcgttaagagaaaattaatttagaccaccaggaagctgcatgttgtaatgcatgattcccaatttcagctgcacattagaattagctggagagctttgcaaaatcccaattccaggccacaccagaccaacaaaatctgaatctctgagaatggaacaccagcactggtcatttttttttttttttttttttttttagacggagtcttgctctgttgccacgctggagtgcagtggtgccatcttggctcactacaacccccacctcccagattccagtgattctcctgcctcagcctcccaagtaactggaactacaggtgcatgccaccacgcccagctaatttttgtatttttagtagaaatggggcttcaccatgctggccaggatggtcttgatctcttgacttcgtgatccgcccgcctcagcctcccaaagtgctgggattacaggcgtaagccaccacacccagccaagcactggtaattttaaagttcccaggtgatcccagtgtgcactcaaagttgagaatcactgaaaaaatggaacctagaccttggaaatgtacacaactgagtgtgcaagctacttaacctcccttagcctcaaaattctcatctacaacatgggaaatatatgtacctcccagagttgctgaaatattgagattctatataaggctctcaggaaatgtaaattctcatccccaagggaaacttgatcaaatcttcatagcttagggtaagaaatgctaattctaccagcaattcacatttttcattgttagctgattattttattgaacatttacattgaggaaattcagaaatgctcatttttccactttcctggtggtaagatgctgcctgaagctatgtttaaattttcaagagtaaataaactatggcgggaaatctagctgactatgccagtgaatctcaaacctagctgtacattagaatcatctcagaaatttttttaaagaaacacacgtacgtccagaactcaccaggccaaattaaatcagaatccctggggtggctccagaatatcagtatttttttaaaaagctgatagaaaggtaattgtaaaacacagtcagggcttaaaagcactgatttgtactaacgatatgccatgctaactgcacatcacagtcacttggggagctcttaaaaaagttgattgattccagaaccctaccgagacttactgattcagaatctgtggaagtggagcctgtcattgtgcaaatcttcataaaactccccactggtgattctgatgcaaactcactgagaaccactactttgtatcatacatttactctacgtgttgtatatcagaaagatcatttaaaactttcagtggtctcaaatgccaagcctgccagttacttttaatcagtaactgacacaacacatcacagtaactccaatgactttacagatcttttcagaacacttttatgtccagcccactgacccacatcacctaccctatgctgtgccaaatactggctatgtagtccgttggtatttctaaccaaattcctctaaatgggctgctgatctgggaaaagcaacatggaatcacattactccccaagccttattcccctttgctaagtggtatgtaatgccaggattaatgaaatgaactctattggtcaaatgagtctgaatgaaatctgagttgttgtctgctcctggaagcaaactgttatctatttgtttccctcagagagataaactcagaggaaacaggagtgatccctgaggtgggaataatatagtgggctgcaattttaaaactctgcttagacaataacaggacacttggaatcttattttgatagatcaaaccaatcagtatatacagcaccatggtggtactaccaggcaggtgataatagtagcatttaaacaaccaggcactatattaggcatattaaatatattaactcatgtgattctcaactgcgatgataatagccctatcaggcaggtactattattatttccattttgtcaaaaaagaaacaaaggcacacagaagttagatgatttacccaaagtcccatagctactaagtggcagttttctgaaaccaggcaatctggctttggagtccaacatcttaagtactccactgcaatgcagatgagtgatggccaagcagtttaaaaaaaaagaaaaagttattgtctgcagtagaaactggaggtcagggtatgggtaccttgggcaaattacttaacctcttggagcctatttttgcatctgaaaaatcaggataataattgtacctgccttgtagagctgaggtgatgattaaacaagattaggcatgtgatgtgcttagaaaagtacttggcacttttaagagctttctgtcagccattattattatttgtattttaaaacagctcaagtggtcagggagaaatgaaaatctattaaactgaaaattttcctgccaatcttagatttgtagattctgtagattaccagtacatcagatccaatatgaaatgcagtcataaaagattttcacaaaaacttaaggactgtcactgtgacaaaccccagcccaaacagtccaggacaatggctctaaaaagcaaacatcttcaattatcaagctgtgtacatgtaaacacaacaggaaccagacttctgagtagctgcaaactgcagttctctgtgatgggagaacatgccccagaacagcctgtcaagtggtaattgccagccatcctcagtcacatatgtataaacagaaaagaaaaacaaaacgagggctcaaataaaaagcgttaacattcattaaacgcctgacactctattaaatgtttttcatgcattaccttctttaatcctcacaacacccttccaaagttgaacatgaaacaaccacactggtttatatcactttaaatgtaagactacacgtctcaaatgggccctgagcactgcctgggaatccaactctatttctctagtacgctcactttcaccctctctaggactctgtcacatatctctcctccaagttcccacacctttcctctcccccgctgccctccctctaagctgatggatgcctataccaatagactcttttcccaccacccactgtatctgcacctgttatctcagcttcccctctagttacaacagagtaagtgtccctgctcatttcaaaaccaactactcacctgcttagggtcttctcctttctcaggtattcaacaactaccctttacaatgttcccctctttcatctgcagcagtttttcctttctacgagtttaatcacattgccatataaacattctgctttcttctatcttgaaaaaaactctacccaaccttaaggcccctcttccccattaaagttgttcttgtcaaaatgattaaaatcctcctaattaccaaaggcatcttatacggtaacattcaacatggttgaccactacctccctcccttttttggcttcgcctcctcttctttgtgtacactattaaactagatgtcttcaccagtcccatatattttaaatactatgtacagtatatgatgccgattccaaaggttaactctagcccgacatcctccagaacttcagatttaaatttctaaaaagcacatttgatatctcaacccaaatatctactagataatttatgtgtgtatatttcaccatactaaaaaaaactaccaggtgactgataaatggagagaaggtgaataggtaatgtgaaaaatcaaatgtgctaaatattcatggcacctgtaggtggtaggtggtcagagtcctctgcaaaattcttcccagctatgcttatgtcttctattgggaaaaacctactgggcatctcaaacctaacacattcaaaacataagtactgattccacaacttccaaaaatgaaacctaccccatcctacagttttccttgagtcaaggctagcatatgagggccttggcatatgggggcattgcctatcgcgttcatagatattctgagcttctagaacagcatctggcacacaggaggcgttcaaaatagctgctgaatggattgatgaattcatgttctttctttctaggtccctcgacctccacccgcccttgagtcattgggaagttctgggctgtctcagcgcctgatgatggcttcttaccaatcataccacacggctgctcctcagggagttggtggcattcccctaccacagagccacag

SEQ ID NO: 2164 - DNA, 69937 bp, Homo sapiens; identical to SEQ ID NO: 2161

SEQ ID NO: 2165 - DNA, 90539 bp, Homo sapiens; identical to SEQ ID NO: 2163

SEQ ID NO: 2166 - DNA, 90539 bp, Homo sapiens; identical to SEQ ID NO: 2163

SEQ ID NO: 2167 - DNA, 90882 bp, Homo sapiens; identical to SEQ ID NO: 2160

SEQ ID NO: 2168 - DNA, 90882 bp, Homo sapiens; identical to SEQ ID NO: 2160

SEQ ID NO: 2169 - DNA, 90539 bp, Homo sapiens; identical to SEQ ID NO: 2163

SEQ ID NO: 2170 - DNA, 90882 bp, Homo sapiens; identical to SEQ ID NO: 2160

SEQ ID NO: 2171 - DNA, 90539 bp, Homo sapiens; identical to SEQ ID NO: 2163

SEQ ID NO: 2172 - DNA, 90539 bp, Homo sapiens; identical to SEQ ID NO: 2163

SEQ ID NO: 2173 - DNA, 90539 bp, Homo sapiens; identical to SEQ ID NO: 2163

SEQ ID NO: 2174 - DNA, 90539 bp, Homo sapiens; identical to SEQ ID NO: 2163

SEQ ID NO: 2175 - DNA, 90882 bp, Homo sapiens; identical to SEQ ID NO: 2160

SEQ ID NO: 2176 - DNA, 90539 bp, Homo sapiens; identical to SEQ ID NO: 2163

SEQ ID NO: 2177 - DNA, 90539 bp, Homo sapiens; identical to SEQ ID NO: 2163

SEQ ID NO: 2178 - DNA, 90882 bp, Homo sapiens; identical to SEQ ID NO: 2160

SEQ ID NO: 2179 - DNA, 90882 bp, Homo sapiens; identical to SEQ ID NO: 2160

SEQ ID NO: 2180 - DNA, 54948 bp, Homo sapiens
gtctatgagcttttcctttattagggagaaagatcccagggaacaagatgaagaatatggggaaggagacagggaaggagggagagtcaatctgaagatgcgctactgagctggcagctgattactcggtatctcttaaaaccatcttaggacagtttgtctggacgaaaaaagaggtaagaactcatccatcggtttccatattcccttggcaaaggttcgtacatggagcattacctccccacactctggggacacacaggaacactgaacatacctggacataaacagagcaggtcctgcagagatgagaaggatgtttggggtgtgaggtgaggcgccatcaggtcgcacctgtgtgaagccagtgagctctctcagagctggtgcctcagtgggtgctggaccaagaggccagtgaggacaagaggatcataagcagagcagaaacagcatccaattcagggtcagaggaggtggtgtgggctgaactgtgtccccccaaactcatatattgaattcctaaccaacggtacctcatcatgtggccttctttggaagcagtgtcattgcaggtataattagttaagatgaggtcatactggaatatagtgggtccctaatccaatcccttggcaaaggttcatacattgagcattgtccgtataagactggtgtccttataagaaggggaaatttggacacagaaacacacacagggaggatgtgttgtgaccatgaaggcagagttcagggtagtccttctacaagccaaggcatgctgaagatggaagtaatccactagaagctgagggacaggcacccaacaggctcctgcacagccttccgaaggaaccaaccctgctgacaccttgaccttgaacttgcagcctccagaactgtgagaccataagtttctgtcgttttagccgctctgcctgtaacgctttgttgtggcaaccccaggaaactaacagaggaggtgagattgggggcagggaggcccatctgtggggggcatcatgtcagtcaggcactcagtaactgggggaaaatcccaaactcaagtgggtgatggcaaaatggggaaattatcggctcatggaatggggctctccaaaggaagttctttgacttcaggcttgattcaagggtttgaacgaggatggtagggctctctagtccttgcccccttgtctccacatgttttgaactgcacgtttgtgtgcctccagaattcctatgttgaaaccctaacccacaatgggatggtatgtggagatggagcctttgagaagtgattagatttagttgaagttatggggattcttcatgacgggattaggcccttaccagaagagaccaaagagcatgctctctctctctctctctctctttctctgtctttctgtctctctctctctctctctctctgccatgtgaagatacatcagggagatgtccatctgcaacccaggaagagagccctcacgaggaaacaagcaggccagtaccccagtctgtaggacttcccagcctccagaacagtgagaaataaatttctgtggtttataagccacccagcttaaggcattttgtcacagcagccagaacagaccaagagaggtgcctgtgtcttgatctctagagagagcattggccaaggccaacccagccatgagagagagacagagagaggcagggctgggctgtggctggctggggtgtggactgatccagagctggcagtgggccagaggaagttcagctccccagggctggatctggtgagaggacatggaggtcagcaaacaagttagggtcctgaggcaccgggtgggggtggggttcagcaaggaggtcttggtggacaggatgtggcagtggcagaggagctagttctccagagctgagaccagagatgataccaggtaagtggcccttcacctgtgctctgtggcctcacttctgtagagaatcgaggccagcttcagggtcaagcttctcggctggaagctgggagttgttgctgtggttcactgagtggcagggatacagtgatgactgagaaaatgctgaagagacctggaagtcccccatagaagaaatctgattcttacagcgctgcggagaggcagtctgggaaggcctttcttcccagagtatctcttcaaggttctgatacacctcacaagccctgcaaatacagacagaccggaatggggctcccaggtccagaggagatattgggaaagggtccgaggagcagagcaagatgtctgcttagccggcagtagccagcactcccggcctgggcagccaaacaggcatctgcaaggggacttgacaatgatcggtggagcaggagggtgcttgagagtgtggctgcttaatcatggccttgaggtttgttgttgtttaaatgtcaccacttatttgaaactaattcctgtcagactgcgaaaagtttatcagtgtaattgggtgccggcaaaaagctctcttaaaatacacatcctttcattcataaagctatcaatggggcatttgattagcatctttttgactgccaaggaaaccatactgaaagcagggcatgcattcagaacaaagaactccagctcgtgggtgaaaactctgcgatagccatatctcccccaccagatagtgtgctttgtgatggctggcagcctgtgccccttggaaatgtcattttcagccccttctgggcttgtgactaaggtgtgggtggtggatctacaaaggatttcccaaaaagaaggcctcctttacataccttttgttctgtggactgacccacttgtcccacccacatacctgcagcaggcgggagagttgtgccttaactgggcagctgtgagcaccagtttttttccccaaattcctgggtgctatctgagcatgctgctatttggcagtggggcctcagtcacatcctgatggagaaaatgtgaaggtttgtcatcagcttatttaacaattcagaggctggagtctattccactttttgtccagtatgtagctttaaaacagttacatataacatggaacagtatgacatgaaaagagagaggtttatagagggagatgggaatcgtgacagcccctgcttacggagtttgcccctccagtcctgaattcttctgcatccccacatcctgcttgtctggaaaacggctgcagcttactacttcgattcttggccttccagaaactggactcctggcccatcttttcatctctttggagaaacaaacaacaaacaataatctcgtcataattaaaattcactgtgatataaagctactctaaaaatagtacaattaaaattaaaatttatttcatttcttgagctgacatttcagacagccaggggcctcccactaaacttgaaggtgatgagtctctgctcagtctcacctcccgggcttctgttccagcatgagtctgagctccattcaactcttcccgggccttttcagctctaggtgtaaaggttcagtgtgaactcgtagaaagaagacaggcttttcagtcaacagatctgaattcttacacgcactgtctcatagtccttggtctcagtttccatgtttgtacagtgaggatcatgggttccaaggatttgggttccaaggtggggttggacaatgaaaccatagctgtccagtgtggtggccatgggccacatgtgacttctgagcacgtgaaatagaactggcacaaattgagatgtgccaagtgtaaattacacattgaatttcaaagacagcccctacaaagaatgtgaagtgtctcattaataattttgtatattgattatatgttgaaatagcaatattttagatatattgggttaaagtatgaaaatcaacatcaatcttttcgttttactctcactattttttagagcagctttatagtcacagtgaaatggagtagaaagaacccaaatgaccactccatctgtcctaagccagtctgagggctttctgtccagccctaacgctgtaccatgatcctcactgtacaaatatggaaactgagaccaaggactatgagacagtccttataagaattcagatctgttgactgaaaagcctgtcttctttctacgagttcacactgaacctttacacctagagctgaaaaggcccaggaagagttgaatggagctcagactcacactggaacagaagtccaggaggtgagactgagcagagactcattaccttcgagtttagtgggaggccactgggctgtctgaaatgtcagctcaagaaatgaaataaattttaattttaattgtactatttttagagtagctttatatcacagtgaattttaattatgacgagattattgtttgttgtttgtttctccaaagagatgaaaagatgggccaggagtccagtttctggaaggccaagaaggacttcccgtatccttcctgggccccaaacatgcacagcctccccgttagctacactgtccactagagtggtgtgtttgttacagttgatgccagactccatggttcggggtttgctcttggtgttgtacattctatggatttggacaaatgcatcatgacacgtaaccaccattatagtatcacacagaatagtttcatggccctaaaaatcctccgtgtcttacctatttatcacctcctttcctgttaaaccctggcaaccaccgatctttttaccatccccgtagttttgccttttccggaaagccatgtagttggaataatactgtaagttgtctttcatattggcttttttcacttaataataagcatttaaagttcctccatttcttttcatggcttgacagctcatttctttttagagctgagtgatattccattgtctggatgtgccaaaatttatttatccactcacctactcgaggacatcttggttgcttccaagttttggcaatgatgaataaagctactgctgtaaacatccatgtgcaggtttttatgtgaacataagctttcaactcctttgggtaaatatcaaggagtacttttgctggattgtatggcaatggtgtgtttagttttgtaagccactgccaaacttcagccgattcctggtttccctattctcggcaggctggcctcacaaagttcgtctcctgcagagctccaaggaagctggttttggctgaatctgaagatgatcaacactggtaggatgctgctgtgtcatagactggaaccccagctcctgatcatgctggagtggggctgctgctccctgcaaccccacctgcctcccccttgagctggaagagaagggctgacggccagagttctgccataccccactacgatcagatcaagctctgatcccaccaggccaggggctgtgcttccttgatcatataagcccaaggtccggggtcgctctcctggagtctgacatcagcccggctaggtcccagtgcgctgctctggaagggtcagaacgcttgttcctgagcttatctctgtggattttccctgatgaactctgatctagcaggcagtgtatgggctgctaagtacttttcccttgtttgctcaaggagtttgcggccccaagatcatttccaaagccttttgcttcagcttgctaaagggaagctgctgtcactctcttcagcttgctaaagggaggcggagttctgaggaaggcaggcaccttaagggatgttgaaagttgcctctgtttgctgtgcctaccacctacttctagtcctcctctcgccgcccagatcatcccctacaatgcattacccatgcctgccccccaccacccagaagctatgggggctctggtccaagccccacacttgtccgaaagaggtgcctgggccccacagaagccttgtcagatgatggcagctctcttctgatagttcaatggatctgccacctacacagagaggtctggaagtcgctaactctctttgagtctcagattccatagtagtcaaatgaagggtttgaaccagaatattttcaagaatttgtgctcttctaagagtccatggtttttttaaaagttaatttaagttttaaaatttattttttattttatttaaacatttttatttattttttaaaatcttttattttaggtttcagggtacatgtgcaggtttgttacataggtaaacttgtgtcatggggatttgttgcacagattatttaatcactcaggtactgagcctagtacccaacagttatttttctgatcctctccctcatcctactctccatactcaagtaggccccagtgtctgtcattcccctctttctgcccatgggctctcatcatttagctcccacttataagtgagaacatgtggtattttgttttctgttcctgtgctaatttgctaaggataatggcctccagctctagcctacactatggaatactatgcagccataaaaaagaacgagatcatgttcctgtaaaggacatgatctcattcttttttatggctgcatagtattccatagtgtatatgtaccacatcttctttatccaatctaccattgatgggcatttaggttgattccatgtctttgctattgtgaatagtgatgcaatgaacatgtgcatgcatgtgtctttatggtagaacgatttatattcctttgcgtatatacccagtagtgggatttctgggttgaatggtagttccgtttttaggtctttgggggaattacctcactgttttccacaatgattgaattaatttacactcccatcaacagtgtataagcattcctttttctctacaaccttaccagcatctgttattttttgagtctatgatttatctttgtgggaaatagagtaattttaaggccctccaacctctccatggaatgaagtagagatctgccagcaaagccagcatcaggaccgagtagaatatccagtacatggcaggtgctgcgtgatttttgttaaaatcataatctcattttaagaggactgtcctacacaggccaagcttgattccatggctcttccagttaatttcctcatctaagttagtattagccatgtccacatctgagctgtgctattaaaagccagaccagcagcctcattgctcccatcgacaggcatatggtactagataaaaagccataaatgtccaaactgttgagaaaaaatgtgagatgagttgagggggacacaggttgccagcctgccactctgggccccgtgctggcctgggtgcagccctgtgtcctgtgttgctgacctgtctcccagtgtcaggcttgggcctccctaggaaaattttccatggggctctgggcctcctcctccctcctgccttgcctgaactggccccacactcaggactggggagtgtcaaagtgtctgagcctgggggaaggaacaaatgcaaagcacgtgaggattcctcctctggggagagtttatcccataagtaatgacatcacggttccccagccttccaggatggcatcctcaaggtcatcttcatcctctcttcctctacaggctctgccactgcagctacaaactgcagcgaaggcccccattaggaaaaatactccccacgactttgccagcccctgttctggaccttcttcccctcagagccaagccccacaagagtgttctacactcctggccaccacactctcactttctctttgcttctcagctgacaggcattttcacttctgtgactgctgaagctgctctgcataaaagcccatctctactaaagataaaaaattagctgaatgtgatggtggacaactgtaatcccagctacttgagaggctgaggcaggagaatcacttgaacccaggaggcggaggttgcagtgagccgagatcgcaccattgcactccagcctgggcactaagagcaaaactctgtctcaaaaaaaaaaaaaaaaaagcacaagtggcatggtcttgccatgcgatttgggtccttgcaatacttgatctttgcagcttcattcttgacatcacctccctgaaatctcctcttcccttagctcccatggcctgactccagctaggtcctctgtccctcatatgccaggctttcctggttctgctgtagcttttgtgtcctgcccccaacaccctccataagcaattgcaactgtgccccgttcccagactcacaccttctccagtctccgtctacctgcaggctggacgcctccacggcgtgttccacacatacctcaagtgcaagtccaaagcaaaatatggtccttctcagattccagctggattttccatcacagttattcctattgtgaaccactgaattgcctagttaggggcatctgattcagacttgttcctttagcttggactatgtcaagaacctccctcaatgacatctctgccaccaggccttttgtccagcgatcctttctctggacaacgtctcacatctgaccttgactctcccactcagcggttcctgccctctgcaggatggggtccccgtgctttcacatggcccctggccattcacagcttccccctggctggccttcctctcctgcttgttccagcaccccctcactcccaccccatgcttgaatccacagactccttatttttgggtcctcacatatgccacactgtgcccagctcaatgccttccgaatctcatgctttccaattccaagtttaccttctctgaaaacttttcctggctcccttgtttcgtgtctgcatccctggattttgcactttgccttgttcctgttgggcacttagggaatcttagagctggaaggatgcaatagagtctccatcttttcacctggctgtaaccccggcaaacaaagggtgtaggttgttatctcctgggcagctggcacagtgcctggcccagaataatgccccctgagagcacagtaaattggtttccaccgtgaagaacagatattggagcttgaaggtgagctagcctccaacaggggaccagggaggtgctaggccagcgagcccaccttccccacgatgcagccaatcaagactccagagggctccagcaacagcatgaaaaaaatagctctccatacaaagcatggaaactagactttagggcctaggggaatggggcttgtctgcctctatgtaagaaagcaggacaggccgggcatggtggctcacacctgtaatcccagcactttgggaggccgaggagggtggatcatgaggtcaggagttcaagacctgcctggccaacatggtgaaacaccgtctctactacaaatacaaaaaattagccaggcgtggtggtgggcgtctgtaatcccagctactcgggaagctgaggcagagaaatgcttgaatttggagggaggaggttgcagtgagccgagatcatgccactgcactccagcttaggcgacagagcgagattccatctcaaaaaaaaaaaaaaagaaaagaaagcaggacagtatattgcaaattaagctcaataaaaagagagaaagagagggagagagagagaaagagggagggaggaagggagggatagtgagaaggaaaggggcagtcaggcagaccatggtcccctgccaattctctgggcaccggtggaagcaagttctgcgtcttgggcacagtactttatcacctgattgtacttcctccacctctccccaggcagaactattgacccagggatctataacatttgtatatatcaacacagaaaccaattaacaaatgcttatattcctgtgcaaatatgcaaacttccttctgcagacaggggtaagcagacacctggcagtatttttagaaatatttaagaaacacagttcaggtaagaagcaggctgctgtaccctcctccgggaggaccagtacctagaaccatctgtttttctttgtcttccctgctctgctctgagcgtggggatggtccttatccttagcttcatctttattaaagctggcattttcggctgggcatggtggctcacgtctgtaatcccagcactttgggaggccaaggtagatggatcacttgaggtcaggagtttgagatcagcctggccaacatggtgaaaccccgtctctgctaaaaatacaaaaattagccaggcgtggtggcatgtgcctcgagtcccagcactcgggaggctgaggcaccaggattgcttgaaccctctgcagtcagccaagattgcgtcacggcactccagcctgggggacagagactctgtctcaaaaaaaggaaaaaaaaacagctggaattttcttcagtgcttacgctgtgccagatacatgcatttactcacttcacaatgagagggaagccactatgtttatcagtgaagcagggtcatttgggaagcattatccaacaccacctactatgggcccagcccatggcaactggaagcagcactactcagaaggaaaggcatgtggagaagctcagagctgacaggggagtctatacttgattgtaagatttctgtacaaaatgcctttctgtgtgctgtatcatgtagtgaaagataagaaacaatagaatgtccagcaatcagagaaggcttgacatgacaggctactttttaacagcactgagaaaagcttgctatctattaaatattttaaaatcaggtgctaagccgcagagtaagcacctcattatttggaaatgcacttatacattcacagaagcaacacccctggaaggaaataccccagtgatcatgggattgtagtaacatttttgtttgtactttttatataccttaaatttaaaattccttatgaataggtgaaaagcctgtccaggaagctttgtagggtcccctgagttcttggtgttctgtcagtggaggctggtttgagtcattcctgtaggagagctacccaaaacaaaacgaaggggaagcaagagatgcaagcttctaagcctctgacaccttttgcaaaattgctttcctgcaaggctgtgctgcttcacctgctcccccaccagctggtgtgagaggcacagggtttggagcagacagctgtgttctgaagggatggcattctgtctggtgacacttagtggcagtccacttttctcccacaggttgctggctgatctagttgccaaggctcctgcgtaggtgttatctccaaacatgcaggcatagttaagagatgagaaatacacgtgtttggacaaaagactggagcacagttcaatcagcctcagcaacattatctctaaaagcaaatgagtcctgctgttgctggggacctacccctctgccttggctggaagtgtttgagtctgtctgaacggtctgttatctccagggcaacataaagtttgcaggaggcctgttcactccaggtgttatcgctgtcgctgagatggtgctaagcctacaggcggcagaaggccaattgctaaggcagagggagcctttagtggggagccaggcagcctggggaccctgggccacagcttccttccctatgacatgcactctcatgcccttcccactcaaacatccagtcattctgcacgtcctggtagagggagatgccaggcgaaccctcggggtaaccccagcacctggaaaaactcctcagtgggtttgctcagtgtcatttaaggatcccaaccttgaaggttttggacttgggatcacacattgtttcattcagagtgttaggataggggtctgtctagttcaggcatctcaagttagagatgagaaaccagactcagaagtctgacggtccttggaggctggccgagagaaagacctgaggctccccgtctccctgcctgggcacctcataccaccttgcttttccctgccccatgtcaagagcaagctggagccgaatttggggctcccagttgggctccaagtgtgatttcctccacacttgatgaccaggaggccatttgtaggaggctgggatgagcaaagtgggtcaaagtgccccctgcctccaaatgctcgcgtggaggttgggcagtcagacaccatgggggagaaaccccaggactttagcagaacaaaagaagggcaccctcccttcctgggccctgccagactcttggcagaaggccagggctactcatggggcggggagtgggggaaggagggaggagcagggatggtctgttccagccctcctgtgttcatcctgagccgagtcactgaggcctgcagcacagctatgacacaacttttggggtgtcctggtaggagggctttgggctgcaggtggggcattggaagcagatttctctctatagtaaggcagtagatccccaggccttgccctctgttcctgaaaatgtgagttgtaccttgaaccacaaaatggctgtggggtgcagcttggtgtgttggaaggagggctttggatgtgggctgcaactgcatcatccttgctcagttctcatgtggcaggtgtgctcctgcctggtctggggcagtctggcaggctgctctgtagccccaagcctggatctgccaaaactggcaaggagtggaggcctccccgtggagcagtgcctgaacctgcagcccctggggcagacactcctggctcctgggcacctcactcaccatggctccccactttcttagttggctcgggccgctattgcagaatgccatacaccacgtggcacgtggacaacataagtttatttcttacagttctggaggctgggaagtccaggatcaagtagctgaaacagatttggtttctggtgagggcctcttactctttcatagatggcgccttcttgctgtgtcctcctatggcagaaggggtgagggatctctccagggtcttttataagggacctaatcacccctgcacaacccagcctcctaatagcatcaccttgaggtttaggatttcagcacatgcactttgggtaaacaccgtcaatctagagcatcctccccccccatcatgctggcttccagactctgctcccaagtgaatgtccacacccaaggggggccctgagtcttccttaagtctctttgtctaggacagactgtgctgaaagggcccatctaatctcctgatatggtttggctgtgtctccatccaaatgtcatcttgaatgatagctcccataattcccacgtgtcgtgggaggggcctggtgggaagtaattgtatcatgggggcaggtctttcccatactgttctcgtgatgctgaataagtctcatgagatctgatgattttataaagagaagttcccctgcacatgctctcttttgcctgccaccatgtaggatgtgactttgctcctcattcaccttccaccatgattgagaggcctctccagccatgtggaactgtgagacgattaaacctttttcttttacccagtcttggatatgtctttattagcagtgtgagaatgagctaatacatctcccaacagcctgggccccacccacccccactcctcaaacctcctcagtctgtccttgtacaggttccttctcctccagccccatctcgcttcatgtgacttctttcttccttaaactctctgcactctctcctgctcccaggattttgtatctgcagtttcctctgcctggaatgtactccacctggtctacaactcccagctagcctggagtggagagcttctatgtcactccctctgggatgctcctgctgacccccaagactggctcaggccctgagttcgaccctcttgtggttcagagaattcctgggcatagccatgccctcacttgtgcttccactgccacatggggttgctggactgttgtccacttcctcaggggcatctgcttcctcagaacagggcctgggcattttgtcacctaggattccagtgccagcacagagagtgggctcagctgcagacactcagcaatgttgactgaatcaggaggcagcaggtgactcgatgttatgggctcacgggaaaacccctctcctcttcagagggccttaccctgaggtggcctcaccccagttgtcttcactgggtatgggtctctttgcccacccgctgctgcctcactaaccttcctggcctcagacaaatctaaactcaagtcaaaaccagggtgaagatgggcctacgtcagctccagagagggacagcctgaattcccctccctctggtcccatttccttgggaggatcagcctcttcctggatgatgacaccagggctcttcaccccctagggaggggtccagcccatgtctgtggctctggtctgggccctgaggggacacacagtaagtggcaaacacagacggaccaggccgagagcaagacaacatcctcaatggttaagatgtataggccagagggaaattgatcaggaaatgaacttagaagtatccagggactgatggggaaggagctgtatttggaggacctgtgatgcaagttacagaatcaaagatgtggcccctggttttgctgtgtcctcctggaatgggtagcaggacaggagccaccatgcagagggtggtcacacactcgggcttgctttaacctgggtctttccttaccaatgcatttctggctacactggggaaaacgaggtggctaacacattttttttaggtgttagaagacctgtgtgcactttctctctttctccctgcactccagccacactggcctttgagtttgtagaatgcctacactctgctctgcctcagggcctttgcatgtactgtgctcactttatggaaagctttgttctcaatctcatccaatctctttaattatttgaatgctatccatccttcaacattcagttcaaatatcatagccagtaaaatctgctgtaataaactctcttagtttcctccaatttttcttcctaatatttatctcagtttgtagtcatgtattcttgcgatggttgggctaatatctgcctcctcactggtgtttaacctctagtaaacactagaggtttaatctctgaggtcacatctctgagggcagagatatgagtgacaggtccagtcttattcccaacatcaaggccagagcctgtcaggcagcaaatgcttagtaagcatttgttgagttgactttgaattgtcagagctagagggtcggtttagcattgacacatgggggacatcatgggagaagccacgttttgttaggacctggccctggggagatttcttaagccaaaggctttgggtctgccacccttccatccaaggagaagtctgaagacagggtcagcattttgtttgtcctccacagttgctaactttttttttattttttgagacagagtctccctttttcacctaggctggagtgcagtggcatgacttcagctcactgcaacctccgcctcccgggttcaggcaattctcctgcctcagccttccgagtagctgagattacaggcatgtgccaccaagcccagctaatttttgtatttttagtagagacagggtttcaccatattggccaggttggtcttgaactcctgaccttgtgatccaccctcctcggcttcccaaagtgctgggataacgggcgtgagccaccgagcctggcccacagttgctaacttttaacacacaggacatttcatgtaaaaattgtgacttgcagcttcttttgaagaatctgaagtcaagcagccctggcctgcatttgtgcatggctacctttgtgggatcttggtcacagctgaccctttgggtgggcatgctactcttcagttagttgggccctcttcactagttttttcactagtttttagcacctgcttgcccctgttagcaggtatggacttttacctgaacactcagattagaaagagatggaaaaaccacatggccttgcagaataagggagatctcatctccatgcaatgaggaatcagtggcaggcctctttgcagaacctccctggaagggaattgctatggttgcatgtgtcccacaaagtttatgtgttggaaacttaatccccaatgcagcagttttgagaggagggagtaatgtacagaaaaatatccagaaatctgtacagttgatatggcttggctctatgtccctacccaaatctcctgttgaattgtggtctttagtgttggaggagaggcctggggggagatgattggatcataggggcagatttcccccttgctgttcttgtgatagtgagtgagttctcatgagattatcactccccctcctgctccaccatgtgaaggatgtgtttgctttctcttccccttcttccatgattttaagttttctgaggcttccccaaccatgcttcctgtacagcctgtggaactgtgagtcaactaaacctctttaactcataaattacccagtctcaggtcattctttatagcagtgtgagaacagattaatacaacagggttccccatggatctgttataaaaattaggttgtggatgtctatcataaaactccaggaggctgggcaaagggtgattggaaagcagtgagcaggcactttcagagctcatgtgggacatggggggactcctgcattcctaccagccagagtggagcgtccttgtagaaaatctggtgcgttcagttgacatcccagaaaagtcatgtcttggcaggaggagtaaagaagccctaaataaagtctaatctaacccctttccttcagtcaaagcttcaaaacaaacctcaaaagggtcagggtaatttctaagtaactcagctggctgccagaaaaatatctaccaatctttagaggaggacaacaaaatctagcattaagtaaggtataattaacaatgttcggtgtcatataagaaatacagacatgtaaaaatgcacagaagtgcaactcctaccaagagaaaaaccagtcaatagaaacacactcaggaatgatggatgttggaaatagcacacaaaggattgaaaacaccaattacagatatacacacgaatttaaaggaaacatgaaagtaatcatcaaagaaggagaaaaattaaaaaggaaatacaagggccaaaaataaaaatcttaaataaaaaaatttctttatgaaatgaacagattagacgtgaagaagaaaagatcagtgaacttgaaagttgcaatagaaactttcaaaactaaaattcagtcaaaagagactaaaaagaaaatttaaatgaatctttagtaacctgtgggaaaatattcatgcaagtatatggatcacatacttgtaattggaagctgagaaggaaaggaaagagggaagagaaaaaatatttgaataatggtaaaaaatgctccaaatttgatgaaacatacaaaaccacccatccatgatgctcaatagatcaaaagcaagataagcacaaagaaaactatgcaaggtaaaacataatccaattgctaaatgccagtggctaagaaatgtgggtgggcttcatcaaatctattgaagatctgaatagaacagacagactgactctcctgcaagtaagagagaatttcatcctgcctgactgctttgagctgggaggtggttttttttttttcctgccatttttgaactgaagtatcagctttttatgagtcttgagcctgccagcctttgaactggaagtacaccattggctctgctgtttccagcttactaactgcagattttgggacttgtcagcctcaataatcataggagccaattccttacacacacacacacacacacacacacacgttatgcatatgtacaaaattatatatagttatatattatatttaagtataatcatatctatctattccaaaattgggtctctaatctgattacattttaagttgctaataactttatttccaactgtaaagagagcactaatagtccatggcatgatctaacaataaagatatcaccactggatactcctaatcaaccccttataagagacaaggagctgggtaactgtgtatactttcaattattttcctcacactaacaaatataataagactcaccaggtgtttctaatgtgaagtgatactaagtggacaaaggatgaaaaacacttaatggtaagtatgtgggtaaatacaaaggcttttctcatttttaaatttccttaaaagataattgattgtttaaacaaaaataataacaacgtactgtgtggcttataacctattaaagcaaaatatgtaatgatagcatgatggacagaatggaggaaatggaagtatatggttgtaaggtcttacattgtacataaagtgttataatagtatatttgtaatgagctaatgatacatattgtataccctcatgcaaccactaaacatgaagccagagttatagctaatgaactcacagtggagataaaatagaaccataaacatttttaattcctctaaaagaaatcaagaaaagagaaataaaggatgaagaacagatgaaataaacagagaacaaatgacaaatggtagatttatacccaactatactgataattatataaaatgaaactggtctaaaaattccaataaaaagacaaatatttttagactgtataataaggcaagactcaactctatgttgtctgaagacctcaataatttaaaggcacaggtaggtcaaaagtaagaggatggaaaaaaatatactatgtagcaccaattataacaaagttggaggggctagttaaatatcagaaaaagtaaacttcagaacaagaaatatgcagaacaagaaataaacgagaacatttcataatgataaatttatcagaaagagaaaaattgtaaacatatattcacctaataatagaacttcaaaatatgacaaagaaatggacagaaatgaagggggaagtagagaaatctacacttatatttacaaattgtcatacttgtttctcagtaacttatagaacaagtagaaaaaatgaataaaggggaaggacacttgaacaatactactaaccaacttgatttaattgatgcctatagaaccttctacctaaatacagatttttaggtgtagtgttttatatcctaggaatgcaaagtcagtttaatcaacagcgcaataaatcaatcaatgcaattcagcatattcgtagaatccacattgtttccaactgaacacaaaactttcattataatggaccatatctggggcagaaaacaagtttatacatttaagaggaccaaaataatatagaacatgttatctaaattcagtggaactaaaatagaagttaatagcagaaggatatctagaaaatccccaagtatttggaaactgagcaacatacttttaaataatacatggatcaaagagaaaatcacaaaagatattttaaaataatttttcctaaataagaattagaacacagactatcaaaatttttgtaatgattagagacaaatttataactttaaatgatttttattagaaaatataaaaagtccaaggtcaatgatttaagctttacttttagaagttggaaaaagaggagccaattaaacctaatgtaagtagaagaaaggaaatcaagttaatagcagaaaacaatgtaatagaaaacggaataataaagaaagtcaataagataaaaagttctttgaaaagatcaataaaattgataaactcctaataaaaagtcataaaacaaactaccaacatcactaataaaagagggaataaaaattacagactatgtagagattaaagaaataatatggggatattatagaagctttacggcaacaaatttgacaacccagaggaaatgggaaaatttttcaaaagaaaaattactaaagcccagtgaagaaaaaatagataacctgaatagctttataaccattaaagaaattaactttgtaattaaaaactttcacacaaggaaaattccaggctccagtgacttctctagtgaattcaatcaaatatttaaggaagtagtagtatcacttttatacaaacttgcagaaagtaaaggaggaggaaagactttctaacttaatttatgggatcagcataatcctgatatcaaactcagagaaaagatactacaagaaaaaaatcttataggccaatgtccacaaggaatatacatgcagctgggcaccatgctcacgcctgtaatcccagcactttgagaggctgaggtgggtggatcacttgaggccaggagttcaagaccagcctgggcaacatggtgaaaccccatctctactaaaaatacaaaaaattagctgggtgtggtggtgtacgcatgtaatccccgctattcaggaagctgaggcaggagaatcacttgaacctgggaagtggaggttgcagtgagctgagatcgtaccactgtactccaggctgggagacagagcaagactctgtctccaaaaaaaaaaaaaaaaaaggaatatacatgcaaacatccttaaaatatttcagtatgttgaatctaggaatatatgtagagggtaatacactatgaccaagagtgcttatcctagaaatgcaaagttaatcagtgcaattgaccaatcaatgaatgcaattctagcagtttaaagcagaaaacccaggtgatgatctagatagatgttataaaagcatttgacaatatgcaatactcattcacgatgtactttttttaaaaaaaataaaatcctcttaaaacactggagtagaagggaaactcatcaacctgaaaaaatgctgtcatgaaaaacctacaggtattatcaaatttgatagtgaaagtcataacgttttcctcctcaggttgggagtgaggcaggaatgtccacttttgccatgatcattcaacactgtaccaaaagtcctaggtggtgcaataatgtaagaggaaataccgacataagattcgaaaggaggaggtaaaactgaatccattcatagaagaaataataatgtacttgaaaatcctaaggaatttacaaaaagttactaaaataagcgaatttagcaaggtcataagatacaatggtcaataaacaaaagatcagttgttttcctaaattgtggcaatttggaagattaaattatataaataatactgtctatagtaccatttgaaaatacttacaagatgagcaaaatctctatgtaaaaaactatgaaacattgtggagacaaagtgaattgccaatattgttaagaagtcagctctcctgatttttggttgaaattgacaaagcgattccaaaatctacatggaagtacaaataatctagaataatcaaagcaatttttacaaagaatgaatgttgaggacttatctactttatttcaacattacaggaaagccagtaatgaagacatgtggtataggtttcagtttagacaattcatcagtggaacagaatcagatgtcctgtttctggacatacataatatgttgattcctaacaaagttaccaaagtaatttgatggggaaaaagatagtctttgaataaatggtgctaaaacaagtgaagatctatacatgaaaaaagtgaacttcaacccttacctataccataacttgaaatgtatcacagacaaaaataaaagctaaatttgtaaagcttctagagaaaaacataagagaaaatcttcacaacttgggcaggcaaagatttctcagggcacataaaatttttgaggaaaaaaattgataaatgggccttattgaaattaaaagtttttggtctacaaaagacaccatgaagaaaatgaaagggcaagttgcagaccaggagaaaatatacacaggtatttggcaaagtaatggtatgcaaaaattaaaaagaaccctggaagattagtaagaagaagacaaaacaactttatcaaaatgggcagaaaattttgagcaaacacttcccgaaacaaccaataaacacataaaaagatgcactgcagcattacacatcagggaaatgtgacgacccctcacaccatgaggatgcctgaacttaaagatcgacaattctgaatttttgtaagaatcaggagcaactggaactcttgtacaatgttagtggaaattcaggattaatgctgtcacttcgaaaaacagtttggaagtttcttatgaatttaaatatatacttaccatacaaaccagaaatttccacatcaagttaaaaagctgcacagcaaaggaaatgacaaagtgaagagacagcctacagaatgggagaaaatatttgcaaactacccatctgatcaataaccagaatctatgcaaagctcaaacaactaaataggaagaaatctaataatataattaaaaatgggtaaaatatctgaatagacgcttctcaaaagaggtcatacaaatgaaacataggcatatgaaaaggtgctcaacatcattgactgtcagagatatgcaaatcaaaactacaatgggatctcatgtcaacccggttaaagtggcttttatccaagaaaggcaataacaaatgttggtgaggatgtggagaaaagtgaacccttatacactgttggtgggaatgtaaattaatacagccactaggatgaacaatatggaggttccccaaacaactgaaaatagaactaccctatgatccagcaatcctactggtaggtaaatacccaaaagaaaggaaattagtatatcaaagagatagctgcacttccatgtttattgcaacactattcacaatagccaagatttgaaatcactctaattgttcaccaatagacaaatggataaagaaactgtggtacatatatacgatggagtacgattcagccataaaaaagaataagatcctgtcatttacaacaacatggatggaattagaggacataatgttaaatgaaataaaaaaggcacagaaacacaaattttgcatgttcttactcatttgtgggagctaaaaattaaaaatattgaactcatggagatagagagtggaatgatggtcaccagagctgggaaaaggttgtgggtgtggggggtgggaaatggagatggttaatgggtacaaaagtagagttaaatacaatgaataagatgcagtatttgatagcacaacaggttggccagtcaacgataatttttagtatatttaaaaataagtaaacgtgtataattggaatttttgtatcacaaagaaatgataaatgcttgaggtgatggataccttgtttaccctgatgtgattattacgcattgcatgcctgtatcaaaacacctcatgtactccataaatatatacacctactatgtgcccataaaaataaaaaaaaaaacagaaattcctctcctaggtatttatttattcaagaggaataaaaacacctgtgttcacaaggacttataaacaaatatttataacaattttagtagcctcaaactggggaaaaaccccagacagtagaatggataagcaaattgtgatattgctgcagaatggaacactacccaacattaaagcaggagagattacagatacacatgacaaggagaatggagctcagaaacattatgatgagtgaaaggagcccacacaagagactacagtcatggtggtatagtttggctgtgtccccacccaaatctcatcttgaattcccgtgtgttgtgggagggacccagtggagggtaatggaatcatgggggcagatctttactgtgctgttctcatgatagtgaataaacctcatgagatgtgatggtattataagggggagttcccttgcacaagctctctctttgcctgctgctaaccatgtaagacgcgacttgctcctccttgcctcccgccgtgattgtgaggcctccccagccacctggaactgtaagtccattaaatctttttttttttttgtaaattgcccagtcttgggtatgtctctatcagcagcttgaaaatggattaatacacaacgatgctcaatgacagtgatgcgttctcagaaacacatcattaggggattttgtcattgtgtgaacatcatagagtgtacttacacaaacctaaatggtacagcccattacatacctgggctctatggcatagcctgttgctcctaggctaccaatctgtgcagcatgtgactgtactgaatactgcaggcaactgtaacacggtaatatttgtatatccaaacatagctaaacataggaagggtagagtgaaaatacagcatagaagacaaaaagtagtgcacctctgtggggcatctaccatgaatgaagcttgcaggtctggaaattgctctggatgagctagtgagtgagtggtgagtgaatgtgaagtcccaggacatcattgtacactattacagattttataaacactataaacttaggctacactaaatgtattttaaatttttttcttccttcaataataaatgaaccttagcttctttatgttatcaactttatttttttaactttttgacttttttatattaatacttagcttaagacacatgttgtataactgtacaaaaatattttctttctttatatccttatcctataagcttttttctttttttacattttaaattagaaaaaaattaaaatgaagacacacacattagcccacacctacccagggtcaggattatcaatatcactgcgttccacccccacatcttgtcctaccagatggtcttctggggccgtcatgcacatggagctgtcatctcctgtgatgagagtgccttgttctggaatccctcctgaagaacctgcctgaggatgtgttacattaactttttctttttaataagtagaaggagtgcattgtaaaataatcatgaaagtatagtatagtaaatacataaactgctaacagtcgtttgttatcattgtcaagtactatgcactgtacataattctatgtgctagattttatacaactggcagtgcaggtttgtttacaccagcatcaccacaaacacctaaataatacattgcactaggttgttgccaggcgataagattctttcagctccattataatttaatgggatcaccgtctgtagttgactgaagtgtcacacagcatgtgactgtatgcatattcacctcctagaacccagactcatacgaagaagtagggaataccctactcgcaaccatgttttatttcctagtttcttccattggccattttctttttcaggctggagacttccctcccatccccactggcgttcccagtctctctgcctcctaagtcttcctctgttgctctctggggaccagcttgtgcagcagttttgtatcactgtagggtagggcttcaatgagccctgtcctgtgtccttccctggctcactgcgtcttgccttcccttcctcgcacagcccagggcctgacaccacctcctgcagttggtcattcaggagcagggcactcagggaaggagacggctctgcttcgagtatagcctgggcaccatccacaaacgccttggtgtttgaactcacctgtgcatcccagatacaggtatagtctctccaaaacaaagggtgtaggaaatatttttacttctccatctttccaaagtatccttcccttagtatctcagcaaccttccccggagaggctctttgggctgtggatgtagtacccagtatcctgggctgcagattcattgattttccatgctttgattgggtataatcatgctcagagctgagcaaggttggcagtgagtgggtcactgacatcagcttattcatgatctctctgtgctccgattctgacatgaacttccttttctgtctcagaggagagagatttcagggctgtgagcctgaggatggaccaacacgcacgtcagttgtgtctctgaggactaaagatggccaggacccaggaccccagctagcctccagatgctgctggctgctggggacccgtgacctaaggcacacccctcaacacattttctttcattcctgtcaatctcctgtactggtgactgggctgggacctcctgctggcctccagggccccacctgagcctctggtcccggcctcagtcaggcccaggcctaggggaccggcttcttgtttcctttcccgagagctctctgggagtccttacaatagattccaacccaggcacttttgacagtgaaagaagatttgtattattttcttagggctgccgtaacaaattgccacaaacttcacggtttaaaagaacagaaatttattatctcacggttctggaagtcagaagtccgaaatcacagtgtcacagggctgtgctccctacttaggctccaggcaaggttcttctttgctttcctgcttccagtagctccaagcttggctcgtggctctgatctctgcctccagcctcccatagccttctcctctgtgtgtgtctctccttttctgtctcttacaaggactgagtactcaaacttatatctaacaaagtactggtatcaaaaatataaaaattactcctgcaattcaataataagaagacaaacaacttaattaaaaatggcaaagtcaggatgaacttacctgaagatccttaatttaattacatctacaaagctgttttatccaaataaggttatagtcacaggatccaggagtttggacccagaccaaccttttgtgggggccacaattcaacccactccaggattttaataataactattccataacaaaagacagaacaccatgactgtccctccattcacctgcatggcctctgaaacctaaggacaccttagaagtggcatctctagctcggcgtggtggttcatgcctgtaatcccaacactttgggaagccgaggccggcagagcacttgaaatcaggagtttgagacaagcctgggcaacatggcaaaaccccgtctccactaaaaatacaaaaattagccagatgaggtggtgcacgcctgtaatcccagctatgtgggaggctgaggcaggaaaatcatttaaacctgggaggtggaggttgcagtcagccgagatcgagccactgcactccagcctggaagatacagtgaggttctgtctcaaaaaaaaaaagtgtcatctccaccactggctccctgggccacagacaggcagggaggaaaaggactcagatccctcgtgtgccttccaccgacggcttcgcctcctcctctaacaggtctgtggtctgatgttgagtccatgtggcccccagtctatgccggaggtactccccggctaaccctagaagccagttgtattagtcctttttcatgctgctatgaagaaacacccaagactgggtaatttctaaagaaaagaggtttaatagactcacagttcttcacagggcagcaggagagagaatgagtgttagcaggagaaatgctgggcacttataaagccatcagatctcacgagactcactcactatcatgagaacagcatgggggaaaccgcccccattatccaattaccttcatctatctagtcctaactttaacacgtaaggattatggggatcgtaattcaagatgaggttttgggtggggacacagccaaatcatatcaacgatgttatcctgtcagaactcaagagaagggtgagggctgggggagggccgggggatgatcccatctgaagtggccagtggaagcagttggccttctggagagggaggcaggaaaggctaggaggtaggtggccttggaggcccagagggtagggggagaacgtgggggtggagtgacagctggacatcccgaggtagggactggaaaaggaggcctagggagttccagatgtacccacctttctctttgtaacttaatgctggttgcatgacctgtaggtaacgttgcaggggacttggggtacagtatgagctctgtggttccctgctttgagaaaaggaatcctctttacaaactttctatgtgattgtggtgggggtaataataaagagagccccccactgcccaccacaagggcagtcagaggacccacattggccagagtgtgtcacacattggacgtgcttattaggttgggatcagcacgtggacagcagggccaactagggtccattgttaggaaactgagtgctgggagagcagttgtctctccttcggcatgtgctctaaggagtctgagcttggacctgctgagcaccatagctgtctcctggggagactgtgtctgaagctggagcccaacagagccctgcagaggccagagacggggagggaaagttcaggaccttgcttggactcctggatccaacctcacttcaaagtcatggtcacggatttcccagttagagagctcaccttgagaggtggggtctctgtcccatcccctggaatctaggtgagctctatgacttctctgacccatagagtgaggcacatggtgctgtgcccgcttctaagctcagggctaagaggctgtcagcttccacttcctgcctttctgatccagatgccatgctgtgagaaggcccaagccacatggaggagctgtgcctaggcctgcagaccacagccctcactcggttcccagctgccagctatgtgaggaagccacttgggatgtccagccctgtcgggcctttggatgactcagacgccatctgactaacccagggagagaccccacacaacacctgcctggcttagccaagccaactccttcaactgtgaaagatggtgacaaattattgttttaagccactaggttttgaggttattatgcattatttgaaaataattaaaattatttcaaaaactgtttattgtgactgatatggatgcctaaggtccttgcataaatgtgtcctcacttgatttagatgccaaaataggaatctgcaccttgaatctcatcatgagctccatgaagctttgggtagcctcaagaattctagagtgcaggggcttaaattcaaataactctggcagaacactgatggcctccctcctctggctgtatcatgcacagcctgcttcagctaaggggacagaaggagggagccagcatttctctgagaaccaattataaacaccttgggggaactctcatgatcagtaagatgctttctgagcatcgctttatgcatatgctaagaagctggggcaagagtagctttttttttaatagtacattttatgtaaatttttactgaagtgaacagacatatacaaaaatacacaaattataattatatggttcgattaatctttgccaagggaaccatgtcaccagcactcagattcaataattgaacattgtaagcacccaagaaactgacttgcaccctgtgttgatcatgcccccccaacagtgatagtcacctcattctccagaggccttaggcattgcctcaggatcatggtggaagcttctctgggtggggctgcttggggaccagccatcctgcagtgggcccatgataagcacctgtggcgccacacccctggctagcaggcctgctgggaacacctgtaggaagaccttggcaggatcattggcccttgagtcagctgcttgctcaacttcatgatcagagataaaggtgaatgcaagtactgtggccatgccatgcttaggactcgagaatggtgcagcctctctgtaggccagggaaggaccactaatatggctcccagccaagggcctcagggattctgaatggcacagtctctgcagaacttgcactgtgtggcttcaggtcttccaggacagctaaaatgtgtgggccttgagggtgcctttgggtgctcatagcctcattagggagatgaagaggtgagcagatgtcacatatgccaagacagtggaagcattaagaaaggggaaaggatggggaggatatcaccccaaaggtatgggaaaggacctggtatgtctggaaagtgaagaaggccagtgtggctggaacaaaaggcacctggccagagagctgggagatgagggcagacaaggaggaaggggctttccaggcaaggctgaagcctggatttacccagaaggcaatgaagagccaccagacactttaggggggccatggtgttgtaaaatgaagcatttgggctttgtcccaggttcctggaagggagcttggcattttcagggtggcaggagtgtctttgctattcatcgtgggtccctggggccacaccggagtttatgctgaccaggtgcttcaaggtgggactccatagcttcaggatgcaggctggccaaccatggcaagaccagccatgtgaataaagggtcaggactttgagccacatgatatcagcctgacctctggggagagagtgggtattggaattgagtacaaaggtgtaagcaatgatttcatcaatcatgcctaggtaacaaaccccaataaaaactctggacattgtagctcagtgcagccaccctggttggtaatcgtataaccatgttctgggaggcttcacatttgggaatctccccaaacctctccctgtgcatcttttcatttagcttgtcctgatttgtaccaatcaataaaactggaattgtaagtgcagaggttggtgagtcattctaatgaattatttattcaacttgaagccctgagtgggagcctctatcttggtagccagtgattggaagtgtgggtgcactgggaatgcagctggcatcctgcagggccctaagtctgtggcatctgtgctaacatcaggtggttactgtcaagactttcttcactcagtcaggtctgtgcttcaggtgcactgctctgtggagtggggagggggcctggagtgcatttctgctcatggggctcatgatttgaactcaggcctaatatgttaatgagcagacacctggccaagccctgggggcctcaaaaaaccaagacaggggaagcatcaagaatgtgatgagagagtacgcggccatgggagtgtcacctttgccttctcttctccctgtggctggaaaggctggcctgtctggctgcccaaggatagacggggagaggtttaattgaatcacctactgtgttgggtaaagtaaactgtcgtcattgcaaatataatcaggactgtattttaacagtagaaaatgtgattataatgacatatttatcagctcctttcacctgggtggatctgaggacatttcagaaaacaagtgattggaattgcttggcctacctcacacacttacacacacacactctcacacactcacagagacacacacttataagcacacacagtcctgtgcatgcacacaagtgtatacacacccacgcacatttccacatgcatgtgtgtgcacactcacatacacaaacacacagagacacacccttacagggcatctggtgctctggcctgctctgacacgcagcccctcctgggagtgggcagtaagcattggggggacatgtaggtagtccctggggaagctggaaggctgaccacctggcgagcagcagggcacactcactggagcccctgcctggatgagctggctttgctcagctccagctgtggttccctctgtagactgtgggatcagaaagccctcatcacatgatgtaactctcacaaggctgcaatctacttccctgtccaggtcccagaggctccaggctctttgtggagtcacctgcttgggcagccacggttctgtggagctgcttgtcagagagtgcgcaggctctggagtcagtcagacctgggtttgactgctgactccatctcttacctgctgtgtggccatgagcaaatgcctgttctcactgggactcagtttcctcatctacaaagtgaaacgtgttcatacttcccttatggtcagtgaggatggaatgggataacattctgcaccccgcctggccccacaggcatatgaggtattcgataagtgaatgattgtgccagacaagaaagctgcctgccctcctcctcctcggccctgtgcagggactggggtggatgagaaagcccgtgtttcctgaacacctgtttgcaccaggcacctatttggctgctgcctggatgtccttctcaggttccagctcaggtctcttggaccagtcccctggtctggggtagggatgcctggaacggctctagcggcaaggtcatatctcgccaggctgccaggatgagctgagcattgtgtccacggtgggtgtctgaaggaaataatgtatacagtggtccatttccaagaccaagtgccttgaatcggcttaggtcagcaaactatagaagcaacaggacatactaggcccctgcttggatagctgctgcctgcttgtcggcctcccccttcttccctcttccccacccccttagttgccctcacccgaaccaaagaagtttagataaaagtttattagtctgcaagatagcttgatttgtctcttcttgtcagcctgcctagctacttaggtcataagtcaaacacttgaagagcccctgagctgactaggattgcaatgcattgtgagctgcaacaaaatgcagcaagacaaccctaaaaaaaaacacctaaagcccctacctaacaatcaataggcaacatccgggaaaattgtgaccccatagtactcagtctatgagcaactgggggagggacccgtactctagggataaactgcttgtcgaaactgctgggtgtgcttgtccatcagacacctgatcttgcaagttcatcattaaaagtttcactttcgctgttctctgggtatctgagtccattctttgggtttggacgggtaagtttgtttctcacatgtacaagccagaggtccatgagtgagaatcgggggccaaggagctttgtccatggggccgtaatgggatgagagggcagaggttatcaaactctgagggctggaggaagacatggtttctacctcttatctcatttcctactcatttagccttcggaggcaggcactgccgctatcccaccgaggaggagtctgacactgtgggtggtgaaggccacagttacccggtgagtagctgggctggactccacccttgctccctcctacaatcaacctcctgctcctcccaacaactttcctgaaaggaggcagtgaccactgtgcccttgcagcctccccggcaaccgacttctgaatcatcccactgcagagatctcattactgcagtgagtgtggctccagcctcccctcccttggctgctaatgagcgccctaatttgattgcctccaaatgagtgtgatgcaaaattaaaagatgccagaagacatgaccataaatccagtgagttggcttcaatttattatgtttgaattcaattagatttctcctccgatgttttccgaatatttatctagctgctggctacagaacgataactggaaggggctattactgtttaattccagcctcctccattcagcttgggctctggcaataccgttggatggaaaatctcagcctggatgtggggaggtcaagggagttcaaggtcagctgctgagccttctgccagccagccagcatatttcctgttggggaagggattcaaagcaatataccctattaaaatgttttaaaaatgatttttagtgcataaacactacaagggactccacagaagggagtgttggtgtcaaggcctttgttgtgtcacaggcagcaggggggatggggatctggggtctgggctcagcctggccacgaactttgtgtgacttgggaaaatcactaaccttttccagccttggcttctccatttgcaaaacgacggagttggactctgggaactgttttcagtggccctggattctgcactgctactctccttttagtttcagggtgtttgcccactctccttccccacccccacagccatgtgtcctgcttgaccctgggaacctgacttctttaagctgcctctcaggctttcttactgactgggcagaggttggaattagccagtgggagactctagctggaaggcaaaagtataggaagagagagagtggtcagtgtatccccccaccccgtccccactgcccctccccaaggctgtgtctctccaagacatcagctcctgctggaaaccccttctccacatctctagctcttactggctgtggcaacactattcctctctgtctagccccatgagtaacagcatcctagagttgtttgttttcgtgcttctcaacatccctgttcatcctcttcacctggccacacttctgtaaggactactgccattaaagtctcatcatttgaagcattcaatgccatttcttgccatgaccctgaacaatgcagatactaaatccatttttcgactgtggttttccatggagggctccccaggtctagaggggagctgagacaaaagcattcccggcttgggagcctgttgtgcagttggggaggtcccagagcaccaaggccaagctggggagacgttgtccctatgggcatggccaggcctccggcctcagggaggagagggagacggtgatcatggaggggaggccctgggagtgagaagctgggggaattgttccaccctgcccctccccccaacctccagagagcgaaagacgatgggatgtgggaggacggcaaaggggaagaggaagaggctccctgtcctgctgggtccttagccaagttggaagtgggagagtgagaagcccccatctagggtaaaggagtatgcccccaggggaggagagaaaggctgatgacacagagggctcatttgctctgaaatgggcctcccagtggaacagtgacgaagaggcagagtcagccgtggcggaagagcaggaaggagaggagtcccagagcaggatggagggagcatcagggagatgggtggatggccagggctggcctatggggcgatgaccaaaggttgcaggggtgggttcaggaatgagaccaatgaagtctcctgatttatggcttccagctttggtgtaagtcaatgacccgaatccctggagaagggtggggaatctgactctgaatatgtggcccaggagccctgcatgaaggagctggggcctgaagagtaactctgcattgagtactaggcttccaaatcagatcctggccagctgctgtctctgatggctcccagtcctcccctcagacccatggctgtaggccagactggcaggggcaagaggcaggagccaagtgggacatgtccagtgtcctggccaaacatacactggacgcagatgagccatatgcctgggaaacagagaaatggggtgaggccaggtcttcttgtgagaatgaatgtgccttactctctcctggagagagggtgatgacaagagttcattcattcattcataattgctttttgatttaagcaggcgagtttgttgtttaacaggctgggaacatctctcttttattgaaacatgtgacatagcaggttaaactcctaaagattcagcacagcagatgagaatcaaggagtttccttcttaaaaagcataacttgcatatgaatgaagatgattccaaattatgttttttccccatgaccctaaaattttatcccaaaaggagttatcatattagatattgatcagatcagcatttcatatcaaagctcaggacatccatctaaatatttaaaaatctttcactctcacagcacatcttgtgatcaatgtaaaacaaacagataggaacaaatcaaatatgagagaagggtttatggtgagagaaaacagtttctatcctctcccctccccagtcctggcctcactctccagaggcaacttcttgtaaacatttccatttttagtacttctggtgggtgcctccacaatgcttagtagcatgtataggcacccttatttttttattcatctggagaaaatttatctacctcctgtgatggaacataagaaatggcctcattatgcacctctgcttcctcccttcatccttccaaagttttatcattttggcataattatttttagttttctgttatttacttttaaaactttaaaccatataattgtactttgattctgcattccatccacctcagggagagtaacggtctggggcggtcaggttgggtctgttcccataccctccccttcttctgaaaggactctcccctccctcccgggggcctgtgcccatgaccagccagtcacagggccaggcatatgtcctgggccctggccactgtgggatacaggcatgctccccaatcttgaccactaggaatcctgcaggactttcactactaaaactgctctcttcaggtcacaacagtaactatcagttcaactacaccaaaggtttctgaagacaatggcttctccacccaagcaggttgtatataaattccaaatagaacttggcatcaccctgaaggaattctaacttcacactgttggggaaatttaccaagatagcttcagagtaaactaactttacacagcacattaaaacaaaagacatttattcagcgtcatgatcagactattacatttagcaatcaacagcatgggtgcaaaaaaaaaacctatattaaaacccttagctggaatgctttacacttcccacagaacagaaactaaaataacctgttatacagttagtcacaaatacagtcctcgagttttttgcccatacacatgagtatttgtctaaaacatgtcttctttgtagcagctaggccctgccaccactgtgcttggctgagttcacaaatctgtcgtaacctgtagattccctgtcatttctctggctctcctctcctgctaagctttgtttcctaattaaaatctgccactgccatagctactgctgctgctggaaccgccaatagccaccttggtttcatggttttgcaaagtataggcctccattgccacaggggccagagcttctgcctccaaaatttcctcccttcatgggtccaaaatttgaagactcattgttgtaattgccaaaatcattgtagcttccaccacctccaaaattgcttccatcattaccaaatccattacagccatccccactgccaccatatccaccaccaccacgactgccaccaaagccaccaagaccactgaagtttcctccaataccaaagttgtcattcccactgaaaccacctccacgaccaccaccaaagtttccagaaccacttcgacctctttggctggatgaagcactagccatctcttgctttgacagggctttcctaacttcacagttgtggtcattcacagtatggtatttctgaatgacaatcttatcgacggagtcatggtcatcaaaagttacaaaggcaaagccccttttctagccactgactcggtcagtcatgatttcagtcaccattaaaagggattacccaagcaaaatcatggaattattggttataaaagtaattgttggcacatcctatgtaacatatctaattgaataatggtaccagattaaattatagatgggaatgaagcttgtgtatcatccattatcatgtgtaatcaataaacaatttaattctcttgaaaaaaataaataaaactgctctcttttgttctgggattacctctaggaaggaaatgtaaagtcagctcttgtagggtgcctccaggcccctgacacgtggaaagatcgtgcaggagaaaaccaacccagaggtcagtggaggtggagaggaagttgtgagagagatcaagctgtggtggtgagaaaggcagctggtcctgctcactgaagcctccattgcttccggactgtcacagttacaccgacctgacaatttcagtattagcattagagaattgtttcagctttccaactaacacagggtgtattgtactccccacctcaggtaagatgagaattagcacgtaggctgcctgtgctagttttctgttgctgctgtaacaaatttccacaaatttatgatttgcttagagcaccacaaatcttagttctggaggccagaagtccagcatgggcctcacggggctaaaatcagtgtcacagggcagctgtgttcccatgaggcggctgtgttcccataaggctccgggtggagactgtttccttgccttttccagcttctagaagctgatggagttccttggccagccactttctccctccattgtcacagcaggtgtggcttcactctgacctcttctgcttctcccttccaccgaagggcccctgtggttacattgggtacacctgggggcttagcctgtctaatattgccacaccctcttgtgaatcttcttttttcttttctaagagatggggtctcgctttgttgcctaggctggagtagggtggtgtgacggtaacaaactgcaggcttcaattcctgtcctcaagcgatcctcctgcctcagcctcccaaagtgctgggattacaggtgggagccacagtgctaggcctctcatgaaccttgtcttccagaaatgtgttggactctcatccattagtaagccatctttctctcttttttaatgcttttcccttatagatttacttcattttaaatttataagcttaaatttcagtgatgatgtcttaggaagaacaggagaggaggaacaaaggaacaaacttctttaatgggaagctgaaaggacccttttaaaagtgtgcagtggagagatcctgggcttggtctctggtaaacctggtgaatggtgggttaacactccctccctcactcggtgttgctgggaggataagacagaacatgtggcgagcaggtgtccaatagctgcctcttgctatgtgcagccagtgccacatccaggctgagtgctgtggggagtgtggctcatcccactggggccacccctggcctcgctcactggagactccagaatcagggctgactgagcagcttgtggcactgaagaatgttctaggaaaggaggtgtgtcctccttggaaggggaagcttcatggtgggtgagctgagggtaaggggtgggtgagggccatttgaagagtcacctcccctacattcttttatcttttggagcctccatccacgccacttcaaacaatgaacacacacatccaagtcagtaagtgcactttgtgtatatctatataagtgatgcgcaattactgtataacagttcactagctgacctgacattattcacatatcgtaggcatgtgactaattgtaggtgtgtaatgaagtgttcacatcttattacatatttaattcctaaggcatttctacagttttatttgagaattttggaactgccagtgtgtttttcatgtttcaaaccttttcacaggccctgaaaaaacccaaaggccttatattctgggaccgtaatggacaaaacagccctgggaagtatgcttgggaggatggcgaaggctgggtttgctgagggaggtgccagctaaggtgctgggcacaccagaggcaagggatctggaccacaactgtcagtttgatgaacacactaatggtggagtgacccccaccaggagtggccagcaagcagggtccaacaggaaagacatctgggaggccagcaggtggaatcctggctctgccaccttcgtgctatgtgatatcagccaagttacttgccctctctgattctcaaatgctcggaggccctttgacctctagagtctatgggacctgagtgaccacagggctctggtttgttggtggctgcctctttatttaactccttttctcaaatacggtctatgggctttgcttaaagtgaggtgtcctgtgcacactcttctccatgactttgaggccgtgagaaggcccgccctgcagaaggactgaggaaactagtgctggagtctcctttcttgtatcagtgaaggaaggggagagaggagataaagtgctcaggttacagaatgtgaggatcgtgccccttttttccaactgaagacattcctaggcattttatctcccctgttgcaacttctaaatcacaaaaaccttatgcatccagtttggctgacatccacctgcaatgggagtgagtgagattgagccactcctcaggtgaatggaaaattaaggccaaccaaggcccaccccatgccccactgtggggtctaaaaggagcaggcactggcctgctttctttttccctaaagaaagctctttggggacccagcagaaacagcagaggtggggatgcgagcttccgcctgcatttgttccagggtgggccagtgaggatttgggaggaatggtgtggaaaggccctgcccaagaaggctggatgctggctggggaatgcccagggtgccagctccctaccctggggaaaggccaggctggcatatgccggagccagggtccaaggtcacagagaggccacacctgggcacccctcccagcaagggaaggtccaagctgggaattacttctctttggaaagtgaggggagtggtacagaaatagtgctattgttgctgttgtcctgtcacttctggcattggaaatggtgttgagcttctacgtgacgggcattggaggtcaaacctgaaacaggtgaggcccatccctttactaggctcacgttctaggtagggaggaggcaggtacctcctccacctaagaaacaacaagagatagagaatgcagtaactgtcctaaagagaaaaaccaggggatggagagagaataatggttgtcaggacgggtcagactttaggatggtaaatgaggagtggtctctgagaagggatgaggcagaggaagtgaggctcagggaagtgaagcacttgcccaaggcagcctgctggtcatggcagagctggcaagctcattccctcctcattatgtcaaccttctgggaccagagtctgggcagggcagaaactactgcaccaggggtgcgtggctccagcagagagagacaaagtgccccatgcaatccagaaactgagccctctgggctcaatcttcaaaggaatgactctcagagttgtgtcccctgccttttcttcaccatggaacttttcccagctccactctggtgggcttggggacaggacctgccctctgcaaagtgatgaccaaggataagtcggattttcaaggagaccttggagaacaccaccctcttattgtgcaaaagaggaaacaggtccagagagggtgagccattttttcagcatcacacagctgacctggagcagagtttcctaaaagctccctcggtgctctttcccctgctgtggctagacccctccacaggaacttaacaggaacccaaaggaacgagtcactcatggcagaatcactaatgtgatggagggcaggagtgagagacggcataatgtcaatgctggcacactcctggcacacgggaagctgtccatgagtggttgcttcccaccacttccatcgcccagtttgggacatgtctgagatccagtgctgagcccagggtctagcatgtcatgggagctcaggagttcctaattgactacatgaatgctaaggtgtgggatgtgctccttcctgctttctcattctcaaagaacactcttatacacctggttgtggggagggtatataggcaatcaacttttgcgtactcacttccattgtaggatcatgcatgcatgtggacgtgcgcacacacacaaacacaaatgcacacacacacacacacctgccttctcaaacttgtgggaccagaaaggatgctgcaaggcctaagataataattgctggtctcttttttcttatgctttagcaggaaaaacacactcttccaagcacacagctgcagaggtcttcctgagcatcatgtagtctttaatcatgttgtggaggacaggatgatctgtgcctcaggaatcagcttagttgataactcaattccatggctgggccccatttgtaagcagtcatggcacatcccatggaaacctataatctaattatggctgctgcatcagtcctcatccttcatgctgtcatccacagctcctcaccacccatcttacttggatgaaggctctctgaggtatgaaggacaaacatctgatccttccacttgaggcctaggctgctttccttattctcacagcagccacaagtattgggatcacagcttgaaaggctcttcttggtccgtgggactgaggcagtcaggacaatttcaggcctttagtgaatggaggcatttcattacttcagatctcacctagtcttggaggtcttgggcatttttagaactcacccagccaggctgccactcagggtgaggctacctggattgtttattggtaacgaatgtttgaatcagagaccgttagaaaaccaaaaatgaagattttaacaatacaaaaagcagaacctaaagaggtttaatcagtaggattggtaccagttctttgtatgtctgatagaatttagctgtgaatccatctagtccagggctttttgttgttgtcgttggtaggttttttattattggtttaatttcagagcttgatattggtctagtcagggtatcagtctcttcctgattcaatcttgggagattgtatgttcccaggaatttatccatttcctctagattttctaatttgtgtgcatagaattactcacagtattttctgaggatcttttgtatttctgcatgtatcagtatgccatactgttcaagcacatggactttgcagttggacattcctgagtacaaattctgcttctggcagagcatttaggtgacttagtctgctgactaagctgcagtatcttcatctgcaaatgaagatgaattgtaatatctttgtcatttctcacagtacttatttggaaattcttttttctttgttaatctagctagtggtctctcagtcttgtttatttttttgaaaatcaacttttggtttcatttatcttttgtatggatttttgcatctcaatttcattaagttcttctttaattttagttatttattttcttctgctagctttggggttggtttgctctttttctctagttcttctaggtgcaaacttagactgttaatttgagattgttttaacttcttggtgaaggcatttaacgttataaactttcctcttaacactgctttggctgtatcccagagactttgttaagttgtatctccattttcattactttcaaagatttttttatttctgccttaattttgattttcacctaggagttaatcaggaaaaagttgtttaatatccatgtatttgtgtagttttgagagatcttcttgatattagtttctatttttatcgcactgtggtccaagagtgtgtttggtataatttcaattttttaaaatttattgagacttgctttatgactcagcatatggttgatctgagaatatgttctgtgtacagataggaagaatgtatattctgtggttgttgggtggagtgaatgtctatgaggcccctgtagataaaataatagctgaaattagaaaaagaggtttaaccagctttactcatttaaaatgcaaatgtgctattagataagggccacatcacttggcatcaggccataagacaagatgtgtgtggattatcctgggattaatactcatttccaaacttctaggactattgagagttgttttttttttctagaaatctctgatggactacatttgttccatagttcagcctcatcatcttatgaactatttagataagggatagaaagtatcttttgaattcatgtcagcaccaatagattggtggtcgctgctttaaaaactgggcctagaaggattctgaattcttaactgggcttagagcgaaagaatgccatgttcaaagaagaaagttatcaatggctgcaggaggggtgaggtggcccatgtgtcacatgacttgctatctttgcactgggcaaccctaacctctgagagggtccttgttgaataagataagtaggtccagccctcaagttgttatcagtatagcagagatggtgagccacgaagtgctgccagatcactgtattgtgttctggtcatggcaggtgcatgtatcagtatgccatactgttcaagcacatggactttgcagttggccattcctgagtacaaattccgcttctgacagagcatttaggtgacttagtctgctgactaagctgcagtatcttcatctgcaaatgaagataatacccacctcacagggtagctggggtcattaaatgatatcagatttcaaagcattagatgctcaccttgtagtaatcattattactataattactgttggtgtggaaacacagacacgcctctaaactgtcctgggtacagagaagtctctacagacaggccctgttttaaattgcaagtgatactcaggcagtcttcagtagacaaaggcagaggccattcagtgcaggggaggacattctgtcccctggttaggaaacctgaactatggaatagaaaaaaacttagactcaatattcagaacaactttcctgaaataaaggaagacttgaattttctgaccgaagggtaaattgatttagagaagtcaatgctgagatgacagatcctaacaaaatgaatgtttgccttcaaagaaaagaatcctaggagtatccagtagaaaaccatctctccaaaaaccaatcaagacaacaacaaaaataaaaacaactaccccaaacaatcacatgaaaactcaaaccaagagaaacacttgcagaatgtcagaataaggacttctgaaaatccttccttaacaacaatgagagcactggcaaaaatgtcaaaattaacattttcagagtcctggaaattaaccaaaggctttcagcaatccaagttagatttattcaagaaacacagctgaatctcagtaagaatagcaaattttgtggtgttttaatttgccttattcgtagtcttcttttccaagctctatgatagacttgaacataaatgttctcagctaggcatggtggctcactcctataatcctagcactttgggaggctgagatgggaggattgcttaagtccatgagtttgagaccagtctggacaacacagagacaacctctgtctttacacacacacacacacacacacacacacacacaattaacattctcacaaccatgacagctgtgaaaaccagcagcctggtagccactggggaggacagaataggtttaaagctctccaaaaatcccatcctcagaaagttgttactatttgatctgtctgacagctccctggaaaagacacattcccagggattgtctttgcttaacatggtttggagcttagtctgtgtgaacagccctatcctgagggaatctgtcaaaaacaatcagcaaaaattgtttgacattgcaactgcctgagatggcagtaccagttggggctaataagaggctgaccaaaacagttacaaggaaaaactggggaatgaggtattcatagaggctttggaaaagctctgacatattcttaagaacctagaaggccatgtgcacgtgcagggttgtacacatgtccaagacagatctaactagagcttaacttttgtttggctttgaggctctgtgcaagcaggaagtaaactctgaggcagagttgtcagctgcttgctgaagcatcgaaggcatggctcaacacaaacaaagcttcccagcaaaggtaggtagatttagttgtgcaaggaatttaaagaaatctctgtccaaaaattaatggacaactaaactgaggaaagacttcggtggctacacatgacaaaaagtatacattaaaacttagtccaggaaattcactaaacagagaaacagcagcatcagcaacaacaacaaacagaagcaacaacaaattgtgaagaggggtgaggtctgatttttggagatgccacattattttatttaaaacattcagtttttaagaaaaaaatatgagaaatacaaagaaacaaaatgtgtgacctattcacagggaaaaagctgccattagaaactttttcttgaggaagcccagacattggacttactatcaaagattttagaacaagtcttaaaaacatgtttaaacaactaaaggaaaacatgtttaaagaatgttaaaaagcatgacaatgatgtcttaccaaatacagcatatcaataaagagatagaaaattatataaaaaagggaaaaaaataaaattctgggttgaaagtgcaactgaaataaaaaattattaaccagaggggcttaacagccaatttgagcaggcagaaaaaagattcagtaagttgaatatgggtcaattgagattatacaatccagggaacagaaagtcaaaagaatgaagaaaaatgaacagagcctcagagagcataccaatatgtatataatgagaatcccaaaagaagaggagataaaggggcagaaagaatatttgaagaaataattgccataaacttcccaaatttgatgaagaacattaatttacatgctcaagaaattcaacgaactacaagtggtataaaaacaaagaaatccatacctagatacatcagagtcaaactatcaaaagccaatgacaaaaagagaatctcgaaagctacaaaagaaaaataactcagcatatacactctagcttcaaattcctcaataagattaacaactgacttcttatcaaaaccattcaggcaagaaggcaatgggataacatattaaaagtattgtaagaaaatgactgtcaaccaagaattctatatctagcaaaggtatctttgaaaaaaaagaagaaatgtccagataaatgaaaaatgagagagttcatcatgagtagatcttccctacaagaaatactaaaaggagtctctcaggctgaaatgaaaggacactagatggtaacttcatccacacaaagaaataaagagcactgcagggtaattacataattaaaaagacagtataatgtatttttaattgtaattctcttcttatcctatctgatttaaaaatagctacataaatgagtaattataaaactgggttgttgggcttataatgtataaagatgtaatttgtacgataatattaacacaaaggaagggggcaggaaatggacctatattgaagcaatctttaaatatattgttgaaattaagttggattgatatggattagattgttttatgataaaatgttataatccccagggcaagaataagaaaataactaaaaatatatggtaaaacaaacaaaagaattaaaatgatatgctagaaaatatcaattgaattcaaaagaagacagtaatgagggaaaagaaaaacaaaaaagatgtaggacatataaaaatagcaaaatggaaggtgtagagcctatcttttcagtaaatcatattaaatgtaaatagagtaaacataccaatcaaaatgcagaggttgtgattttaaaaaatgaatcaactgttatctataagagacatactttacattcaaagacacaaataggttgaaagtaataggatggaaaaagataatccatgaaagtagtaaccaaaggggagctggagtggctagttatactaacagtagaccaaatagactcttaagacaaaaattattacaagagacaaagaaaaacattttataattgtaaaagtttcaatctattaagaagacatggcaattaagaatatatatgcacttaatagcagagatccaaatacatgaagcaaaaactgaagtgagaaatagaaaattcaacaattatagttggagacatcattactccactttcaacaacggatagaacaactaggcagaagatccacaaggatatagaagatctgaaaaaaacagtaaacccactagagctggtagttacccacagaacactccaccaccatcaacagaatagacattctttatatgtgtatatggaatgttctcaagaataaatcttgtcatgagaagaatagtggcccccaaagatatccatgccctaatccctggaaccacgttacattacatgacaaaaggggctttgcagatatgattaagggtataaaccttgagatgcggagattaccctggattgtttgggtgggcccaatcaaaatacatgagttcttaaaagtggagacactttcctaaccatggtagggagatgaaatggaaggaggaggagacaattgaggtgtgagaaaggtttaagtgactactaaactgatggacttgatccaccattgctgcctttgaggatggaggaaggggactattaataagggaatgtgggtagcttctagaagctgggaacagttcagctgacagccagcaaggaagtgggaatctcagtcctacaacttacaggaactgaattctgccaacaactcgaatgaacaagggaactctccgagaatttccacaaaggaatacaaccacacagattcctatttttagcccagtaagacatgtcagacttctgatcttcagaaccacaagataataaatttgtgttaggtgcaaatttgtggtaatttgttatggcagcaatagaaaacacatacatgtatattcatccataaaacaaaatgcagtaaatttaaaataattgaaatcatatagaatatgttctctaacaatagcagagtgaaattcaaaaccaaaaacagaaagaaatttcggacatccacaaatatgtagaaattaaatgacacactccaaaataatcaatgggtcaaagaagaaatcacaatgaaaattagaaaattatttgaaatgaatgaaaataaaatcacaacatatcaaagtgtatgggatgcagtcaaagcaatacttagggagacttttatagctgtaaatgcctatattaaaaagaagaaagatctcgataacccagacttccaccttaagaaagtagaaaaggaagcgcaaactaagcccaaagcaagcagaaagaagaaaataataaagattgtagtggaaataaataaaacagggaatagaaaaaacactaagggaaaaaacaagagtaattgcttcactgaaaagagcaataaaattagtaaacctttagcttgactgagaagaaaaaagttatgtgccctatttcattccctatacattaaattattaaattattaatgtatagggaattaaattattaaattaataatgtttagagaatgaaatagggcacatcactaccacctcatagaaataaaaggattataaaggaatactataaacaattgtaagacagcaaaattttaacttaggtgaaatggaaaaattcctagaaagacaggaactacaaaaactgaatcaagaacaaatagaaaatttcaatagaccttagtaagtaaagggattaaattagtaattaagaaactcaccatgcacaaaaaagctcagtaccaaatggtttcgctgattagttttcccaaacatttaaaaaagattattgttaattcttcacaatcttttccaaaaatagaagaaacaaacttcaactcattctatgatgtcattattctcatgataccaaaacaaaagacattctaagagaacacagcaatatctttcatgaatattaatacaaaaattatcaacaaaatactagcacactaaacctagaaacatataaaaatgattatgtatcacaatcaagtgaaatttatttcaggaatgcaaagttggtttaacataataaaataaatctaattaatacaccacattaataaaatgaaggataaaatccacctaatctcaatagatgcagaaaaaacatttgacaaaatcaatatcctttcatgataaaacactcataaaactagaaatagaggagaatttatgaaatctaataaagaacatctatgaaaaaccacaactgacatcatcccaaagggtgaaagagtggatactttccttctaagaccagtaagaaggaaaggaagtccatgctcaccacttctattcaacattgtattagagatctgagctagggcaattatgcaaataagtatgtaaatttaaaaaatagcatccaaattgaaaagaaagatgtaaactatatttacagatgacataatctaaggaattcacaaaataactattacgactaataaatgagttcagcaagattgcagatacaagaacaatatgaaaaacaattgtatttctacacactagcaatgaataatctgaatataagattaagaacagaattccatttacaatggcatcagacaaaataaaaggcttatgaataaattcaacaaataagtctaagacttgtacgtactgaaaacaataaaacaccactgaaggaaattaaagaagacctaaataaatgaaaaaacatcctatgttcatggatttggaagacttaatattgttaagatgtcaatgtttcccaaattggtctacagattcaatgcaatcttgattgaaagattgtgtgcctttttctcagaagttcacatgcagatgcaagagacccagaatagccaacatgatcttgaaagagagaggactacacttcctgatttaaaaacttaatacaggttgggtgcagtggctcacacctgtaatgccagcactttgggaggctaagttgggaggattgcttgagcccagagtttgagattaacctgggcaacataatgagaccccatctctacaaaaaataaaaaaagattagctgggtgtggtggtgtgtgcctgtagtcccagcaacttgggaggccgaggtgggaggatcacttgagcccaagaggtctatgatgcagtgacctatgatcaaggcactgcactccagcctgggcaacagaacaagaccctatctcaaaaacaaaatgaaacaaaacaacccccccaaaccccaaagaaaaccaaacttactaccaacgtctaggaatcaagatagcccaatactagaaatgtaatagaattgaaaatccaatattaaaccttcacatttatggttaactgatttttgacaaaggtgtcaagacaattcaagaggattaaaaaaaagccttaacaaatgatgctgggccaaccggatttccacatgtgaaggaatgaagctggacacttaccttacatcatgtacaaaacttaactcaaaatggaccaaagttctaaatgtaagagctaaaactataaaaccatagaggcaaatgttcatgaccttggattggtaaaaggattattagatataataccaaaagcagaagtgaccaaacaaaaaaaaataagtggggcattatcaaaattgacagcttttgtgcttcaaaggacaccatcaagaaagtcaaaaagcaacccacagaatgggaagaagtatttgcaaatcatatatatatacatacatatatatatatatatatatatatatatatatataaaatttgataagccacttgtatccagaatatatgaagaactctaacaattcagcaataaaagacaataacctaattaaaacatgggcaaatgatttgaataaatatttgtccaaagaagatatactcatgatcaaaaagcacctgaaaagatgcttgacattattagtcattaggaaagtgcaaatagaaccgcaataagatacaactacacacccattaggatggctttcatagaaaaagacaggcaataagaagtgttggtgaagatgcagagaaattgaaaaccccgttcattgctggtgtgaacataagatggtgctgtcactttggaaaacagtttggtagttcctcaaaaagttgggtgtagtattatcatatgaccaaggaattccactcctagatacatacccaagagaactgaaaacctatatccacacaatatcttgtacaagtgttttcaaagcagcattattcataacacccgaaaagtagaaacaatccaaatgtccgtcaacgaatgggtaaacaactgtggtattcctttccagtggtaagagacagaattgattagggaaatgaggcagattcactaaactccactgaaggatggacctgagccaacagttcacaggaaaatgacacaaaaggcctttaaatatataaaaagcatcatgtttaaagcttcacttgtcatcatgggaagtcaaactaaaacactgaattactatactttgtccaccagatgagtgaggatcaaattttgaagatgtactgtcttagtaagaggtttaggaaattggtattttccttctgtactgatgagaatggggacttcttgacaaaatctatcttaagtacaattccacatgccctttgatctaaacacaatattttaggagtctatcctatgatgatacaaagtaatataagaatgtttattgcaataacttccaataacaagctaccgaaaccagcctaaacaaccaaaaacagattaaatgagtagagattggttaaataaattatggtacattcacaatgaaatcttacactgctgttaaaaagtattaatttttcctaaagatatattaaatacatataattaaaaatagaaagaagactagcattagacaaaagctagagaagtagggaaagtacatatatttttgcgtattcctagagaatttctagaagcatatacaggaaacttaacaatcgtgagagagtttggagaggactttggctgggggttctggagtggtgcagagatttattttcaccacttactcttttgtactacttgattttctagaagcatatgcaagatgaatttctagaagcatatacaagaaacttaataactgtgagagagtttggagaggactttggctggggtctctagagtggtgcagagatttattttcaccatttactcttttgtactacttgatttttatcaagtgcgtgcattacttttttgccttttaggtttttattttatgcatgtttagacttttaaattttcaaataatcatagattgacaagaatttgtgaaggggtcccaatatccttcacccagtttctccactgtttacgttttacattctacaaaacaatatcaaaacaaagaaactgacattagcacaatgtgtgttcttctattacattgtatcacatgtgtagattcctgtaaccaccaagacacaaaactatcccatcatcccaagatctctcctgctacctctttgtagtcacacttccccaccaccgcctctaacgcctgccaaccactaatctgttttcactgtttataattttgcccctggaagaatgttatacaagtgaaatcgtacagtatgtgactttttgagattggtttttttcacttagcctaatgctcttgagatccatccatttagttatttgcatgaataatgtttctttttattgctgaatattggcatagatgtgtcacttagtttaagcattcacttagtgagggacattttggttcttttctagtttctggctatgataggaagacacaggagaaaatcatctggacctaggagttgaggatgagttcataggcatggcacccaagtacgattcattaaagaaagaattgataaattggacttcatcaaaattaaaaactttgcctctgcaaaatattctgttaagatgatgaaaggacaagctatggaggggagaaaatatttgcaaactgcatatctgacaaaggactcacatttacaatgcataaagagctctcaaaactcaacagtaaaaaaaaaaatctgataagaaattgggcaatagacatgaagagacatttcatggccgagtcaaatcagcatgtggaaatatatttaacatcattagcctttggggaaatgcaaattgagatcatgagaaatcactgcacacttatttgagcagttgaaacaaaaatataatgataaaaccaaatgctagcaaggatgcagagaaaccaaatttctcatcccttgcttgtgagaatataacatgatacacacagccactcccaaaaatagattgacagtttctcaaaaaacatgcacttaccatattactcaacaatcacattcctgggcttttatcagagaaattataatttaagtttgcacaaaaagctacacacaaatgctcataactgctctattcgtcatgtttttattggcaggtaatttacatacaaagaaattcaaaaatcttaaatttcacaattcaatgtgttttgtcaaatgcctgcactcctgtccctcccccactgtaagatttacaacactctagcacccccaaaaagttatttcatgcccccttcagctaacctctaccatgccactccatccataaaccccaaagcaactattaaaaaaaaaaaaggcaaaaaacgcaattactttcgcaccaacctaatactagtctgatttttaaatcacagattcattttcatataaatggaatcatacaatgtttattctttcatacctgacttctttcattcaggaacacgattcagagcttctgctgtgcagtagggggcatcagtagttcattttctttttattgtctgctaacattccattgtatggattcaacctagtctgtttattcattcttcttactgatgaagttttttttttctcacggcttaagtccaaggtgtgtctttttcatccagccaggtggccccggcaggtcgctcctcagggacccacatgggtcagggcggtgcagcagtgacccacaggggccagtgcagttgaagtggctttgaaacctgattggagaaacagactgctcagctgttaagaacacacagcgctccagaaaactggtgttcaacacaacgcgtcactccggcttccactgctgctgcggagagtcaggttctccggcaaggccccgcgcgcccgcccccgc

SEQ ID NO: 2181 - DNA, 65766 bp, Homo sapiens
catcaggtcacgtgaggccggtcacgccccgggcagcttggctggggctaggcttccggggctctgcggtcctcggcctgtgctggcagcctcggagcccaccgagccgggcggctgggatggtgagggcggcgggccggagaggggccggcctgggctggggccgccgtccctgccgccctcaggctcagcctctcttctcgtttttttcgctgcagatgaaccggacgacccccgaccaggagctggtgccggcgtcggagcccgtgtgggagcggccgtggtcggtggaggagatccgcaggagcagccagagctggtcgctggcggccgacgcgggcgtgagaggcgggccccggggacgcgagagcggcaggggtgacgcttggcttgcgcgcaggagggccggaccgcgactgcccctgcacctggcccgtcccgttgcctgccctcttaggaacacacgccccgtttagcccccgagaatgccaccctggcagtccccggccaccagggagaggggcagaccctgaccgtggcccagacgcgacgttcccttcatggggtttctggctcagctccatccggaggggagatccgtttccgccacactgagggattgctcgggcactagggaggcgattcctgttgggacctggactaaatggggtgggaaacaagccagtatgtggatatcctttaatgggattcttcaaatcgggggcccaaaaagctcagaactgttcgagtcccaaatgaataggatttttgaataagagtggtggttgattagctaacccttggtctgtgatctctgtagattgacaaccaaagaggacttttaaaaggagacagggttttgccctgtcgcccaggctggagtgcaagtggctcgatcttggctcactgaatcctctggggttcaggtgatcctctcacctcagcgtcctgagtagctgggactataggcgtccaccacacctgtctgatttgtttatttatttaattttagtagagatgggggtcttgctatgttgcccagactggtctgcaactcctggactctagcgataaccctgcctcagcctcccaaagtgttggattacaagcgtgagccaccatacccagtgccaaaaagggattttaaatttttccagaaacgagataggtgtccattagctcactgccactcttttgatgagctttcttagtgttttccaatgtcacttggttttagtacttgtcaaaccagcattccggccgggcacagtggctcacacctgtaatcctagcactttgggaggccgaggtgggcgaatcacgaggtcaggagttcgagaccagcctggccaacatggtgaaaccccgtctctactaaaaatacacaaaattagttgggcgttgtggcgggcacctgtaattccagctactcgggaggctgaggcaggagaatcgcttgaacgcgggaggtgcagtgagccgagatggcgccactgtactccagcccaggcaacagagtgaaactctctctcaaaaaaaaaaaaaagcatttctttcacattctaacactcaaaggtgaaaggaaatgggttcttttttgatgtgacatgcagaatagttacatgtaacattgatactactgtatgtttattttttaaaatagctactacagtttctacaggaattctcacagcaaactatctctaggacccatgaaatcaagaaacaagtggacggactaatccgggaaaccaaagccacagattgtcgcctgcataatgtcttcaatgacttccttatgctctctaatacccagttcatagagaatgtgagttatttagttatattataattccttttttgggagtaggagatattgtaattttaaataacttactgttaggttccctcctaaattttggtggaagtgtggttcttggtaattgtagcttttttctctgggattaacgcctcttttttatttgtaaagttttaagtccttttttccaagcctctaaaaaagtctaatgataaaattttcttatacttcagtgcttccatcttttgtcgttttgagagtagtcagcaattgtgctgaattgtgtggcactcacactgcctttgttgtggcgtgatctgtaaggacagctgtttacctggttagaccctctggacaccagcatatggtttcagttgttgattggggtcattctgttctgataaattatattcaggggatatatatgtctgcttgcaatattctcaactaaagtttatgatggccgaacttacaatatggaatcaactgtaaacagattactgagcttaaatctatgtgtgatttctgtctatttactgtttcttctaggtggtaggaatacataggtaaattagatagagcctctcccttggcaaatagtataattccagcatacaaaggaagtaagtatggctggagcagagtggagacttaagagatgaggatggagaggaagcttaggtaacagacctgtgtttctcatagggtgtcccaactttctgaatatcagcattcatttgtggaaaaaggattattaaagtaagcgatctcccgagattgttagatataaagtaataaaattttcagaatcacaaaattattaaaaaagcccaagatttagaatagttaagagaatgccatgtagtcaacttgtgcagcatgtttgtgcattttttaatagctcaagttaaatgccacttcctgtctttttttggagagctatatataaaataaagacattaataaaggtgttagagatctctttgccagttatttcctttaacagcaaaggagtacttatgagtttgaaaaataacaagtattcggccaggcgtggtggctcatgcctgtaatcccagcactttgggaggccaagacgggtggatcacctgaggttgggagttcgagaccagcctgaccaacatggagaaaccccgtctctactaaaaaaatacaaaattagccgggcatggtggcgcatgcctgtaatcccagctacttgggaaggctgaggcaggagaatcgcttgaacctgggaggcggaggttgcggtgagccgagatcctgccattgtactccagcctgggcaataagagcgaaactccgtctcaaaaaaaaaaaaaagtattcaagtaaaatcagtagttttctgattgtttacacagaatgtccatgcttggtcctgactatctcactggaaaagtcagggactctagactcaacttctctggtgtgcacagccccataatgttttcatcaagattaatttggtgtccttttaagcactcctgttcttttcattctgtacttttcttgctggatcaggtagtcagcacttctctgcagtcagtgctgcagcaccagagtcccaaaggatttgggaagtttctttttttttttgagatggagtctcactctgtcacccaggctggagtgcagtggtgcgatctccgctcactgcaagctccgcctcccgggttcacgccattctcctgcctcaaccttccaagtagctgggactacaggcgcgtgccaccacgcctggctaattttttgtatttttagaagagacggggtttcaccgagttagccaggatgatctcgatctcctgacctcgtgatccgcccacctcgacctcccaaagtgctgggattacaggcctgagccacggcgcccggcaagggaagtttactttgtacccagtgtgcctgtaccagattggtactagattggtaccagatcaatacttcagtgggaagaaatggggaacatcatacaatttttctcaatcacagtcttaggtcttatcttttctccagctcttttctagccaagttttcgtagattctgagttttccatgttgtagtttttgtggagtttttttggttttgttttattgtgttttggtaattgttctttatttctgtccaatactggggatttcctgttttccatccatctctccatccctttagccttagcttttttttttttcttccgagacagagtcttgctctgtcatccaggctggagtgcagtgacaccatctcggctcactgcaacatccgcctcccgtgttcaagcaattctcctgcccacacctcccatgtagttgggattacaggctcccgccaccaggcctggctaattttttttctatttttagtagagatggggtttcaccatgttggtgagtctgcttttgaacttctgacctcaagcgatctgcccattgcaacctccgcctcccgggttcaagcagttatcctacttcagcctcccaaagtgctaggattacaggcgcgagccactgcgctcggcccttagtgttaagtcttgatgccccttcgccttccagtctgcagccagaactcttctccggatgtgctggttgccgctgccaaatcttaattacttcccagaccttccataaggccacatgctataggtttttttcatttgtggcaaagcatgataatactgagaaaacagctaatgcataataaaactctgaaaaaatatacttgctgatatatatttgtaagtgatctggctttttttttttttttttttgagacggagtctcactctgtcgcccaggctggagtgcagtggtgcaatctcagcccactgcaagctctacctcccgggttcatgccattctcctgcctcagcctcctgagtagctgggatgacaggcacccgccaccacacctggctaattttttttgcatttttagtagagatggggtttcaccgtgttagccaggatggtctcgatctcctgacctcatgatccacccgccttggcctcccaaagtgctgggattacaggtgtgagccaccatacccggcaatctggctttttaatgttttattttcaatccctgacatcagtacttaggtgttacaattccagcttgaattatggtgccatttggtttcatggtaatttatcagaaacattcaaagtcagataggtttctgggttttattaattagcctcaggggcagccacaaagttgcaaactatattataaagttagtgaaacaatccgtactttctagggcgagaacagtcaggactttttagggcaagagaaattagtaccattagtaaaggctcaagaggggacttggagggagaagaaatactaattaacattggccagtgttctagtgtctaattagaaggcaacacaattctaaaggcttaattatctgttaatttaggaattggatcctgaaatagcaagtgccatagttaatgactttagtttgttaaatgaactggtgagggaggattttttctttttaaagtcaattgtttcaaaatcttagctttgtaaaattaaaaaaaaaattccagaatgaaacaaattaacctgtttatgcccaaggttagaattttttttgtgaaaagccagaccttggcaatgaccttgagcagtaggatatacataattctgacaagcttagtgttccaataatgggacactaggcataaatgggttaattttccagatcatcttcctgttgatttataaaagctgaattttggtcatttttccctccttttctacttttctattgaagaaacagatggagttgctgaaactgtcaagtactcagcaattagagagaaggaggtaaagcccaaaagccttattaacatataatttcctgcacaggtttttccctctccccctagacctgctttattttacataatgccccttgcttttgacactccagccttctcattccttggagatgccatatgccctgctgctacggggcctttgcttacattgcttcctatgcctctaccctttgattgacatctgtctgtcttctaggtctctgctcaattatattacttcctcctggaccctctgcactaggcacaccccctggataaaagcagctgaagcatcacattctttagtagacttcttacaattgtaattttacaattattgatgggatttgatgagttggaccctcccactaaatcaagccccatatttttaacaacaaatatatttgaggggtccagcacaagcctgatatttagggatccagtgaatatttgaatgaatgagagtacgcataaatgaaaggggaccagggctgtgtatagtctgttactctccagccctggtccctttttccccagttcccctctttccccttttaccctgtctccccagatgaggagcaataccaaagatatttaacagtcctgggtatagctatctgactgtaaattgatcacaaaacacatgaagctgtgagtttagcaggtgaggatgaaagaagttagcattggttatctgctggatatgaagtacttgaggatgcatagtcctgctcaccctgaaaagatcccatgggctttaggtcccatgggtttaggtttcttagatgtcatgtttggctttctagctgcaggctgctgatgggtaaccatggtagctgccaggtcttaaagtctcacttttgagatttacttaactttttggagtcctgactttgaaaattaccaaagtaatccctgatctttatagagcaattaggaaaagtaagaaaaagaaaaatcatgtgaaatttcctcagcttgaggggagcctctcaacgtttagcacatatattctaagtccatttcccatgcagacatcaggcttaaaagaattgaacctacagtaggccgggtgcggtggctcacgcctgtagcactttgggaggccgaggtgggcggatcaggaggtcaggagattgagaccatcctgactaacacggtgaagctccatctttactaaaaaatacaaaaaaattagccaggcgtggtggcaggcgcctgtagtcccagctactcgggagcctgaggcaggagaagggcatgaacccgggaggcagagcttgcagtgagccgagatcccgccactgcacttcagccagggtgacagagcaagactccgtctcaaaaaaataataataaataaataaataaataattgaacctacaaaaaatcagctaccccaaattaaccaaccattgaacttttcagtgtatttttttctgttcttgttttttaactttaaccttttctagatgactgtgtgtgtgtgtgtgtgtgtgtgtgtattttcatttgcagcctactttttttcttaatgtgaacttatttaacccatctttgagacttttgtgaatttaatttttttgttcttaaaccgtatcataatttatttaataatcttctaatattaaatgttatttatgaaatgtttcataaatttcataaatgtttcataaataaatagaaaagttcagagagaaaccacaagtgctaagaaaatgtagcacctagcatcagtggttttgtatcttgccacatttgcttcaaaggtgcctacccaccatattcgtccttaactctaatcattttgggtggggattccttggtatctctgcctttttattctttttttgtttttgagacaggatctccctctgttgcccaggctggagttcagtggtgcagacagctcactgcagcctcaaactcctgggctcaagccatcctcccatctcagcctcctgaatagctggctaggaccacaggtgttcgccaccatgcctggccaactttttattctttttacctagagagggatttcatttttatcccttatagataacctttattgtgtagttgttcttttcttcattgactattatgtatgaatgtttgtgtgtgtttatgtgaaaataaaatcaggcctccatggaattgtgggtctgtttctgccctctgctgtttgttttgtttctctgctgtttgacagtatcataatcttaaatactgcagatttctaatgtcttattagggcaagtccccataatctgtttttattcagaattgtcatggttatcaatctttggctttttacttttctgtgtgaatttgaggattatcttttacttatttatttatttttttgaaatagagtttcagtcttgttgctcagactggagtgcaattgtgcaatctcggctcactgcaacctctgcctcccaagtttaagcgattctcctgcctcagcctcctgagtagctgggattacaggcaccggccaccacatcaagctaatttttatatttttagtaaagatggggttttgccatggtttcaccatgttggccaggctggtctcaaactcctgaccgcaggtgatcccaaagtgctgggattacaggtatgagcctcccaaagtgctgggattacaggcatgagccactgtccccagcaggattatcttactatattgtgccacagaatattttattagcgtttgattggaattacatagaattataaatttggtatttgtgactttctgctggaaatcatgataccatgaacattctgatgtttgcgtttatgataattttcatgggagctaaatttcaagaagtagaattttgggtcagaggatatgatcatttaaaagcaacattgtttgatcagattggcagatacttaaagatgggtggacaggagccattgctggcaaaggtttgggtaaggggcacttgagtatgctgctagtgacagggaattctacgcatttgtgcatagaatctgggaatgactattaagatttatttattccctctctaggtaaaatccttctctaggtatataaataaataataaataataaataaataatcagtttcagccaggcacaatggctcacacctgtaatcccagcactttgggaggccaaggccgatggatcacttgaggtcaaggagtttgagaccagtctggccaacgtggtgaaaccccatctctactaaaaaaaaaaaaaatgcaggccgggcatggtggctcacacctgtaatcccagcactttgggaggccgaggtgggcgaatcatgaggtcagattgagaccatcctggttaacatggtgaaaccccatctctactaaaaatacaaaaaaaattagctgggcatggtggcaggcacctgtagtcccagctactcaggaggctgaggcaggagaatggcgtgaacccaggaggcagagcttgcagtgagccgagatcgcaccactgcactccagccttggcaacagagtgagactccatctcaaaaaaaaaaaaaaaaaaaaaaaaaaaaaaaagggcaaaaacaaattagccgggtgtggtggtgcacgcctgtaatcccaattacttgggaggctgaggcaagagaatcatttgagcctgggaggtggcggttgcagtgagccaagatcctgccactgcactccagcctgggtgacagagctagactctgtctctaaataaataaataaataagcaggaagggtaggagagctctaaatatatgcacgtgttagcttatatttgtgttcagagcctcaggaaatgagcatacacaccaggcttaaattgggtattccaaggatcaggttggggatagggagggaactattttaaaatacatctcttttccatgtgcctttatattgacttaaaattttaaaaattgagatagaattcacataccataaaattcagtcctttaaaaagtatacaatttggtggtttttactgtactcaaagttttataatcacggccactgtctaatgccagaagattttcatcagttcatttatattgacttcttatttctttctttgtaaaaaattttaatttcatttcattttatttttgagatagagtctcactttttcacccaagctgcagtgcagtggtgcaatcagggctcactgcagcctttacctcccaagctcaagagttcctcctgactaagccccacaagtagctggaattacaggtgcacaccaccatacctggctaatttttgtattttttgtagagatgaggtctcactatgttgcccaggctgatcttgaactcctgagctcaagtgatccccttgcctcggtctcagagagtgctggccttacaggcgtgagccaccgcacctggcctatattgactttttataacaagcatgttgtacttcggtagtttttaaaacataaaaatgattttaaaaaccaagaatcacagtgatttggcagagcagtgggtcttttctggaaaagagagtcttgcctacccatgctgtcagggttagtcaaatgcccaggctttctggcaagtcagtggtagatttttctctctgctttcatacaaatgggataataaaaatttatcagccattttaagcaactgaatgaaaataagttttgcctttaccattttccttgttcaaaatcctgaagttctagtttcctagttgataaattacatcagttgacattctccataagctggggtcagaatactgtatcattgcccatcaacattattaggttaaatgaaaaggtgtgaaaactgatatcttactgtttttgcaactcttggtttacaacgaggttaaagtttcatcatgtttcctagtcatttgtatttaaattttttttttttttttttttggtgaatggactattctttgctgttagtccatgacccactgttacggacacccacctggtagtggtctcagccctttgctgaataaccatttccttccgcatctttgtccttagttactgtgtgaattcttatattgtgatttatttccaatgacgtgttgaccttttaacattgagtttgcttccatatttagcgtgtatatgatgaagaagtggaggagccagtactcaaggctgaggcagaaaaaacagagcaggtacttgtataaaatcactcttagctgagtttctgactttgaaaagtgtggtggagatcgatgtgttatgtgggaactgggggatggtgggtggggttgggaaagggagggactgctcctgacagcagcccaagaggggattctttcctttgtttctgaaatgtagtatattaactaatacagagatcaaatccttgaattctgatataagaatagagtagaagtcagcaaacttcttttgtaaagggccagatagtacatattacagatttggagggtcacagaggtcatttttttcctgtggcttcctgagttacagatggaccagccttcttcctgagatcttctcacaccagagcccaaaacatagctaagaggttctgggtcacactgacttcttagcactccagcagagatttctttttcttccactcaggaaggcacatggactgtgaataagtttattattggagtagctttgattttgttctcatttattcagaaaatatggatcacctgtaaaggttggccctttgtcagcaattattacttgtaacagatgaagctgttagactaggaaaagggtattcaaaaccagctatagttctgcctgttgccagcatttttttaaaaaagttattttattttattttttatttaaaaaatttttttattttgagatggagtctcactctgttgcccaggctggagtgcagtggcacgatatcagctcactgcaacctctgcctcctgggtgcaagtgattctcctggctcagcttcccgagtagctgggactacaggcgtgtgccaccacgcctggctaatttttttgtatttattgtagagacggggtttcgccatgttggccaggctggtctcaaactcctgacctcaaatgatccgccagccttggcctcccaaagtgctaggattacaggtgtgagctactgtgcccagcaggttattttatttttaatagaactcaaggatttgctagccatttaagtgcagtagtatctggttataccaattcagggtttaatttgaaggtgataggtatttagtgtactatttttaaaaactgctatatatttcatacacattttcacaaactcagtacaatattagctatttaactcagaatcaagcatatccaaatagaaaaatacacaaccaagacaaaaaagttcagttagaaagacttcagtacttgagataaaagactaaaatgctcgtagggtttttttttttttttgcctttggccctcagaacaacactgtgtggtttggttccttctagaatatttgtagagggggaaatgacactaaatatttttcggtatttctcacaatggcacacttgtgtctgtggggactgccattgagaactgctgttgcaggaagaagacacctgagggagattctcagcctgttggtgatatgaacaaaccttttttcttgaatggggcattgttgtagggtatacacagaatagaccggagatgaaaatgacccccttttgatgtagaacagatttataaaataattgtaattgtccagttttttttttttttgtctctttaaactgtaattgaaaaatgagacctctgtgaccttccttctaagtcttaacacctaaaattacccaagggataaccagggctcgtgggatagtcatggtgagtctgagagtctaggccctccagcagtggggaaacagcatgcattcattgttgggatacttctccacacactagttgtacctctgcttttgtagacgatgacccttgagctctggaaccttaggtagtttgatgcatgtccagaaaggggcaaacttgggatttaaaacttgcagtcttactccaaagtctgtgtcaaggcattcagcagaatttgacttttttaacatttttaataagtttttttggagcttgaggctaggctttagagaacattcacagtattcttttggggcagtatcagtatattggagacccatactgcatggtatttattttgtaggagaagacacgagagcagaaagaagtagatctcattcctaaagtccaggaggctgtgaactatggcttacaagtattggacagtgcctttgagcaacttgatatcaaagcaggaaactcagactccgaggaagatgatgctaatgggcgggtggaactgatccttgaaccaaaggtgaagacattcaacttaaatatttattgcacaactattatgtttgggctactttaattgggcacacgattagtaagtcatggacttaacctctgggaagtgagtatgtcacttagtagtctcacattgactccaccagaaagactcgctttacctgagcactgatggagtacttgtgaggtgcaaggcaacatgtcaagttggggtgcaaagatgcagagcatggcctctactctcgaggtgtgtgttgcagtctggtgggagagaggagacatacatacgaataaccattgtaaatgccctgagagagaattgatttccagctggaattttggggcaaagatgatatttgaattggggtttgaagggtggggaggctcaaaagagacagagagtgttgggaacctgaaattatgtagcttgggctaaggaagactgcagaagaactgaaaggcatttgggttgtttccggtttgggcaattattaaatacaaatgaagctgctgtgagcattcatgtccaggctccctcatagcctagtgagtgttggttgcttgacacactttctcccacattgttcaaagagacaattggggtgacacagagtctctcggtagtgaacacagaaagttaccacagtgatttatagaaagaggccttgtgacacacaaggccttccgaattaaaacatgccacagaaccaaacccttttttttttttgagacggagtttcactctgtcctccaggctggagtgcgtggcacgatgttggctcactgcaacctctgcctcccaggttcaagcgattctcctgccccagcctcccgagtagctgggattacaggcgcccaccaccacacccagctaatttttgtatttttagtatagacagggtttcaccatgttggccaggctggtctcgaactcccaacctcaggtgatccgcctgccttggcctcccaaagtgctgggattacagacatgagccaccccacccagcctgaaccactcttctagtcattctgtagctgcacatttctcttccagtttgagctttgctgagtcacaccaaattgaggcagatcatttggcactgaccagtacacttgctgcttggattttcactgtatgcctttaaaagtcagcagtggactctgggaaatggattgcctggaccacacttgatacttccaagacacacagcactttctcccttttttttttccccttgcagagaaagttgtggaggtacacttttcttttgtaggaggatttggggatgtcttctgagtcagtgagaattagtccaaattaacgctgtctttgccttatgctccattggttgctgtgacgtcgttgaacctttactttaaccttcccaatctttctgttgttgtgtgaaacgtcagaattattctcccctgccccagagtcctttgacaaggaagagatatcattgccaaagggcaatgcctcacaggggacagggcagcatttccttcagcagtggaggtaggaggctgtgcaagggtggagcactttcttgaccctatttttttttttttttttgagacagagtttcactcttgttgcccaagctggagtggcgcaatctcggctcactgcagcttctgtctcctgggttcaagcgattctcctgcctcagccttccaagtagctgggattacaggcatgtaacatgacacctggctaatttttgtattttttagtagagacggggtttcaccatggtgaccaggctggtcttgaactcctgacctcaagtgatccgcccgcctcggcctcccaaaagtactgggattacaggtgggagctactgcaaccgaccaaccctaaatttttaatgtgtgtgtggtgtgggactgacaggagtagacggctgacatgggcagatctccagcatgtgctgttggggccacagtctcctgccctcactctgttttctcatctggtcttattttaccaacttcacttttctaaattcaacagtgtggaaccactagggggtattgttcttctgtttattgagttataatcttttttatttatttatttatttattttgagtcggagtttcgctcttgttgcccaggctggagtggagtgatgtgatgttggctcactgcaacctccacctcctgggttcaagagattctcctgtcttagtctcctgagtaaatgggattataggtgtgcgccaccacacccagctaatttttagtattttcggtagatattgggtttcaccacgttggccaggctggtctcaaactcctgacctcaagtgatccatctgcctcagcctcccaaagtgctgggattacaggcatgagccactgtgcccggcctaatctatttttatattaaaatatatagatatattatgtctcattagtactgctttttaggggacagctcaccagaatgttcagtttctttccttggtcctcctcttcttggaccttatactaggaggttgtacccttttccctgtttgcttgctgctgatagacttttggtaggcttttgccatttttgttaaattttgttaattaggcccttggggagggagattctgtgtgatacagctttactttggcatcttttttctttttttttttttttgagatggagttttgctcttattgcccaggctagagtgcagtagtgcaatctcagctcactgcaacactgtttcctgggttcaagtgattctcctgcctcagcctcccgagtagctaggatgacagttacccgccaccatgtcccgctaatttttttggatttttagtagagacggggtttcaccacgttggtcaggctggtctcaaactcctgacctcaagtgatccacccgccttggcttcccaaagtgctaggattacaggcgtgagccatggtgcccggccttaccttgacatctttacctaggatttgacttttaaaaaaatcagtgaaaaaaagaattttttttttaacttttagtcctgctgtgtttcttattctccaccttcgttatgtagcttgtttgggatagtcagatggaacagggtatcaggtggcacatgtaagtttgttttcaactgaaatgtttgacagcctattcctttcatcatgtacaggatctatacattgatcgtcctttaccatatctcattgggtcaaagctgttcatggaacaagaagatgtaggtcttggagagctgtccagtgaaggtacttttcttcaccaaataattttattccttaacatttcttttttattttaaaataatttcaaattttacattaaagtttcaagaatagttcaaagaactctcatatacccttcacctgggtttaccagttaacatttcaccacatttgttagattgttctctacatatacgtaatattttgtcttgagcctatttgggagacatcatgctcatgccctgttacttctaaatgtttctctgtgtgttttctttttttcttttctttgtctttttctttttttgagacagagtctcgctctgtggcccaggctggagtgcagtggtgcgatctcagctcactgcaacctccgcctcccggatttaagcgatttttctgcctcagcctcctgagtagctgggaccacaggcgtgcaccaccacacctggccaatttttgtatttttagtagagatggggtttcaccatattgtccaggctggtctcgaattcctgacctcatgatctgcccgcctcggcctcccaaagtgctgggattacaagcatgagccaccgtgcccggctctttttctttctttctttctttcttttttgagccggagtttctctctggtcacccaggctggaatgcaatggtgcgatcttggctcactgcaacctccacctcctgggttcaagcaattctcctacctcagcctcctgagtagctgggattacaggtgcccaccaccacacctggctaatttttgtatttttagtagagatggggttttaccatgttgggcaggttggtctcgaacgcctgacctcaggtgatcctctgtgtgtgttttctaagaacaaggacatctcttgtataatcacagtagaattacaaagccaggatattttcctggacataagggtattatccaatctgctgctatgttcacattttgccgtttgtcccagtgacaccctttacagtctctctcttttgttctgtggtccgggactcaatccaggaccagccaccacatttggttgtcaaatcttcagttatcttttaatctgatgccatttctcagcctttctttgctttttatgaccctgacatctttaaagagtacaagcaagttttttttttatttgtaatgaataatttttggggggagagatacttcaagactacataaatatgtaattcctcaccataatgacactttcaattccagtaagtgggtatagatggttttatcaagatctctgtgatgctgttgtatggtggtttgtgattttgagctaaggacattttcttgtgaatattggtgtggtgacccttatctctcttctcaacagaaggctctgtaggcagtgatcgtggcagtattgtggacactgaggaagagaaagaagaggaggtaagggctgtttggtatgaccaggtcacggtgggcagcaagcttaatttaagatgggcctagcaggctaagtaaatagcataactgtgaattcgtaatctgcttccataaagcttttaacagtgatagaagccacattctgagttttttttcccaagggttagatttcctttttgccttatgtacaataatagggaaagctgctttcatctcttccactattatcctctctcccaccttgccaccaaatatctctttcacccaatatatttttgagaagggcagcttagatgttttggtggaatctctgcctgggatatagtctttgagtatattccgtctttgaataattctaagggaaaaaatctacatttagaacttttgtaaactataaaacctagagcaggatataccgaaagccaccacttacattctattttgctgctgccgctagcgctttcatatccacagagcataatttcatttccttgtctagagtttgagtctgtgggccttgactacagttgaatctgtagttgttctttagatgggatattcgttattggaaaggacacagccatgttgcaggagagtcctcgagtatgggatttccgaaaggagacagtgttgtgtatgtgcttttctcttctggttggtccccctttctgcactctccctgcccgcctttcttccagtcctccaaagaaaaacctgacagcaggaaatgagcttttcttaagtaactttcgtataacaaaagcagtgctcattaggggaatcccttgcttttagccaccgatgtggcacttctatgtggcacttcatcaatagttgctcgtagcaactattgatgtccccttcttgggcctaatgaagtagttatttttattttttatttttattatactttaagttttagggtacatgtgcacattgtgcaggttagttacatatgtatacatgtgccatgctggtgcgctgcacccattaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctattattgttggacatttgggttggttccaagtctttgctattgtgaataatgcaaggaaatagagacagtatagtccaaaatgtaaaataacacaaactgactttcagtaatttagttagttaaatgtgcaactctttaaatccaaaggcaagagttgaaagtgcaggtgatgtgaacaaattgttagaggcatttaagtgaaccacaaaaattacatgttaactggaacaacccttcacaatattgccagctacccagcttatctgcaccttgatacttaaggtgaccagtagtcagtacaaagagactgagtgtcagagctttttctccacttgacatagaatcagcctgccccagagacttagacctgcaatcatttctgtgcttctaagtaaagcccatttaacaacaaagccttttcttacccataaaggagtcagatgaagattttgcccatcacagtgacaatgaacaaaaccaggtaaggctcatatattgaaatgactttgtttttacattttaattgaagcatagtatatatactaaaattactttggaatgatttatgaccaagtgaggattttttcatgtatacaatttattttcctttaagcatttcatgtatttaggctaactacctcctttgtatatattttttccaattttgctttatagtttatttttcttagaaaagaagtttcaaagaagtgaaaagcacaattggaaaacagagcctctaaaagaagactcagttacccaaactgaactactttgcatgagtccctcttctgttttaaaattggagacaatctagcagtaacattattgagtattcacaagatgaaaacttcttaccctactgtcttagcacggttatcttaatttttgaatatctaaaggcgtattcttttcatagtgtgcatcgttcattttctgccattttatgttaacattttataaatgtgtccttatttattattattatttttttgagatggagttttgctcttgttgtccaggctggagtgccgtggcgtgatctcagctcactgcaacctccgcctcctgggttcaaataattcttctgcctcagcctcccgagtagctggcattacaggtgcccaccaccatgctcagccaattttttttgtatttttagtagagatggggtttcaccatgttggccaggctggtctcgagctcctgacctcaggtaatccacccaccttggcctcccaaaatgctgggattacaggcgtgagccaccatgcctggcctccttattttaaatagcctttgcagtttgcgttgtaaacttctatacttttaaacatactgagtatgatactgtcatagtctctaaatgtataagggaaagagtttatttctagagttgtatttttgatgtaataatgtattcaatattttcttttcttttttttgagacagagtctcgctctgttgcctaggctggagtgcagtggtgtgatctcagctcaatgtaatctccgcctacagggttcaagcgattctcatgcctcagcctccctgagtagctgggactatgggtgtgtggcaccatgcccggctaattttttgtatttttagtggagtcagggtcttcccatgtttcccaggctggtcttgagctcaggcaaaccacccactttgccctcccagagtactgggattacaggtatgagccaccacgcccagccaatattttcatatatagaaatcctttgcttcggtgaactgtttcttcagaatgaggtggtatagagttatgttaataactcttaatgtctggtggacattctaaattaagtattatgcatgtagattttcctacaatctcatcactggggtgattattttaaatttcttttagttaaaaatttgcatttaaatttcttaactgggaaatatttttttcacaaaaatgtttaactatcaaatgaaggattttatactttctggttgttactgtattttcctggttgtattcataaatgtggttgatctctataattttaacgatcagtctttcttcataggatatttgtttctatggaatttcctattaagatctgtaaatgcaaacagtttttctttccttttttttttttttttttttttttgagacagagtctctctctgttacccaggctggagtgcagtggcacgatattggttcactccaacctccacctcctcggttcaagtgattctcatgcctcagcctcccaagtagctgggattataggcatgtgccaccatgcccagctagtttttgtatttttagtggagatggggtatcgccatgttggcgcggctggtcttgaactcctgacctcaggtgatccgcctgcctcagcttcccaaagtgttgggattacaggcgtgagccaccacgcccggccacaaacagtttttcaaaaacagtacagtatagtgagtaaaagcactagcttatgcaacaggttggttttgtgtgctgcagctaacctcaaagttgtaaggattaaattagataataaagtgcttttagtaacatgcctggcacagttcattgattcaaacattgaaaaaaaatttttttaattatacatagtagtgtgtacctttggaaaaattagaacttaacagataaggctaagtttgagccttccagtcctttccttctctgcatactcttcagaggtaactgggatcatgctctgggagcatgtcattccaagtctgtttctttgcttttataaacacatctgtttccatagaaatgctgtagtgtttgcagagggggcggggcttggtatcatcctggatttgttattctgcgcttttttgcttgacctaccttggatggctctctagtcattacagcttttaccttttaactattactcagtattcttactaaggtaagactatgctgatgatgtttatatttctctagtaaaaggctgggcatggtggctcacgcctgtaatcccagtgctttgagaatgtaatcccagcgctttgggaagctgaggtggttggatcacctgaggtcaggagttcgagaccagcctgcccaacatggtgaaaccccgtctctaccaaaaatataaaaattagccgggcgtggtggcgggtgcctgtaatcctagctactcagagggctgaggcaggagaatggcttgaacctaggaggcggaggttgcagtgagccgagatcaccccattgcacttcagcctgggcaaaaagagcgaaactccttctcaaaaataaataaataaaaatatttctctagtaacagccatttttgatattttaatattctgctttttatattcttgttgttacattcttataaaggatacatttttaggccgggcttggtggctcacgcctgtaatcctagcagtttgggaggctgaggcgggtggatcacctgaagtcaggagttcaagaccagcctagacaacatggtgaaaccccatctctactaaaaatacaaaaaatttgctgggcgtagtggtgcatgcgtgtaatcccagctactcggaaggccgaggcaggagaatagcatgaactgggcaggcagaggtttcagtgagccgagatcgtgctgatgcactccagcctgggccacagagcaagactccatctcaaaaaaaaaaaatatatatatatatatatatttatatatatatatatttatattttatatatatttttatatattttttttcttagattcaaagtaaatcttgtgtattatttcttccagcacatcttttgcttcataacttgctgcatcatgtttatgattattattttaaaaagctgttacttctttgaaggaggagcctaaaggctgacagtatctcttctttagcttaataactagtagttctaatttggtattttatactcttagcacaccacacaaatgagtgatgaggaagaggatgatgatggctgtgacctttttgctgactctgagaaggaggaggaagatattgaggacattgaagaaaatactagacctgtaaggaaggctgtagttgctatcacttggcagagttttagaaccaatgacttgtttttctttttattgtgacttactttgtacatcactcattttggcatatttgtcatttcatttacactttggaaaataatggcaagcatctcaaattgcctcacaagtaccactttcttgtccagatgttatgattttatgagtcagatcattcagaatatgtctagttccagagtttgaagaccatagtgctcctgtctctccacccattcacctttttcttattttcgtatttagatttttaagtattaaagtcaagtattaaaaagaataaggaaataaagggcatctccctttgaaggaacattttatgagtcctattccttgggtgagctgtatagggtacatatgtttaaattcatttaattaaactctgttttctcctcagttcaatttctttgctcttgtatacataatgttgttaggtgtccaaagtgaagtgtactagtttgttacaaaaaagcgattcttttgatttctcctgctgtagaaaagaagcagacctacatcgtttgcagatgagctggctgcccgcatcaagggggatgccatgggtcgagtggacgaggagccgacaagtgagccccagccacgttgatggggagtaggggaggagtagtgcagggccctctgctggcttcaccaaaggcggatttctctttttattagtaattactacatatatttattagtaattgctacatataatttaaattgtagcgcttattccttttttggttaatgggctcctttagataactgaacactgtggacccacaagaaaaacgtacatgtacacatgtagataaccctttacatataatttcaggggattaatggaaactccagagaaccatgggcaacagcttaagaattcctggctgaatatttactcctatattttgaacacgtaagaatgtgctatatagcatattctagttataacagggtagaaagataacacaataattctttcaacaaatacaatcctgttatgcacatgagcctggtacgaaagcagaagccttctgccttacaaagagactcttgagtgcccactgtgggcagggccagggagttcagtgctctggtgcagctgagatgaaaggcagatgtcttgctcttagctgtgagttatgaggatgacagacgtggaaagaaccaggatgtgtatactgagggaggacttagtactattaaaactgtgaactgttcttcaagccttaccctcaggagaagcaaaacctcggaagacactcaaagagaagaaggaaaggagaactccttcagacggtgggccttttccctcaattctgttattttaggagcctgttgactaaggaatgttgcttacataattcatgaagtactgctttacatgctgttttccctctgacaaatgggtctgtctccatttacttttctaaagcctctgggctggacgcggtggctcacacatgtaatcccagcgctttgggaggccgaggcgggtggatcatgaggtcaggagtttaagaccagcctggccaacatagtgaaaccccatttctactaaaaatacaaaaaattagcttggcatggtggtgggtgcctgttgtcccagctacttgggaggctgaggcaggagaatcacttgaacccgggaggcagagatggcagtgagccttgatcgcgccactgcattccagcccgggtgatggtgcgagactccatcccaaaaacaaacagaagccttggaaggcatgttttggggtgctgggaggatatgtgggtgtggagtaaaaattcctgtagagatttgatttattagattttacagcaatcatttcttgtcttcctagaattcttagaagtatagaaacttaggaatctcaagcatttgttttcaataaaggatacaccaggccttttcctgcaaacagccatgtcgattacattagacttgtccctgtgtcagtttgcagatccctttgtttattctgcccttccttcccccagattggttggggaatgggtcttgaatgtggcgtctgacccgaatgcttgcttcagagtaaatctagatccagggtgctggcctagagaatgaatgctgtgtgccacagacgtggacagacttgagagtggaggcccagagagtcttttgagggtgtcagtggactgtgccaggggtttagtgtgaaattcatcagactgcctcacactttgttaaatagtgtcagataaactccatgccagtttggagacacagcagatgccaacccgggaatttgagttctggacccatctttaatactccctgcaaaacattgctttctgtttgctagatgaagaggataacttattcgcaccccccaagctgaccgacgaggacttctcgccatttggctctggaggtggcctgttcagtggcggcaaggggctatttgatgatgaggacgaggaggtgagtccatggcacccagcaacactccctgcagctagctgtgtcaggggtccacagggaagatataggctttgcttgtttagtgggggaaaaacagtttctcagttggaagttgcttctattttcatattttgggacattttgaactaagaatcacagagtgagaaatgccgtatccttctatgctttgttaggtgaggagaagatgtgcacgtgttaatgtgaataatttactaggtgattgtttcttgccttatctgttgtcttccacgtttgtttttaattcctggacaggcctaaattattttagggtctgattttgccatagttatcactttgcaactgattttctggcagagtagtaaatatgtagctttaaatcttgtaggttatttttccttaggaatcctcacatgcagctatgctttctcctggttttttgaattctttgtcatataccttatttcaaccagagtgacctcttcacggaagcctcccaggatcggcaagctggagcctctgttaaggagggtaagctggggctgggcagctgcgtctccgtgtgcagagttccaaaactgtctttctcactaggagatggaacaaggttgttcccaagccttgtttctgtgtcaagcaagaagctgttgtttttactgcggtccagttgaaagtaattcatcttcactaattcatgtcttggaaaaaacagtaccatctgtaaacccataccacagtcttgcctctttgttaggagagaactcatagaaagtcaaacaagaaaagtaccctagagcaatgttgaggatggttttcattgaatgaagtttaatttaaagaaacatttttaacattctgtatataagttggagaccagtaattccccaacccagtgtgcattaaaatcatctgtgcaggtttttttgtttttttgttttttgtttttgtatttttagtagagacagggtttcaccatgttggacggttggacaggctggtcttaaactcctatcctcaagtgatcacccgcctagacctggcaaaatgctaggaatacaggcatgagccactgcacctgtccccttggtgcagtttttaaaaaacacaaatataaatatgttttttttttttttctttttttttaacctacaaatgttactcaataggtttgtggtagttcttgggacttgggaattagtgattctaagtgccgagtctcccgggcgcaggcatcagagctgggccttggaggccgctccttgtgcctgctgtgcgggctgctagcctggctctcctctgctttctgctgtccatgttttggcatcagtgacttgcttggtttccccctttgctcttatgtctttatttttttactgatgactcacatgtttttgcggttctttttcacccgttcattctcatccaactggaatgggtagaggtggaactgtttgggggagccccggtcatgctgtccctgcctctgctgtgctcacctcctcccttggtgtcccccagctgacccactgctgtggcttgatgacggtcagcatgctcttccatttgagtcacagctcagattgtgttaatcccaaaaaaaaagtcctgacatcggtagagaagaaaatactaaggaattttaaaatggcttgttcaggaaaaagtagtttcaaaaggtctggtactagctgtgtgttacattgcacgtatttcaggaagaaaatagcaaggaaagttatttcccttgtaaaatggttaccccttgctttctcattctagagtcttcatcatccaaacctggaaagaaaatcccagcaggagctgtttctgtatttttaggtaacataacttaggtttgttttctaaaaactacacaaatactgttttttgcatttcaaaattatcatcttctaaagtctggctggagatgaggaagtacctgggagcttcaaagggctttgagcatcttatagaaagagctcatttactgatattagctcttattctcctagagctcagtggccttggacttttttgtgtttgagcgacctggtgattctccgttgtgagatgttctgtagcagtaatggatggaggctattgggccctgttatgcattttgtggattaactgaaatggaaagtttttggtgggtgataatttttttctgtaaattcaaccggcccacactggctcacagctgtggctgtcttgtcccttcactcacaggagacacggatgtgtttggtgctgcctccgttccatcactgaaggagccacagaagcctgagcagcccactccaaggaaaagcccctatggtccccctcccactggcctctttgatgatgatgatggtgatgatgatgacgactttttctcggcaccccacagcaaaccttctaaaacacgtatgtgttcctgcctccgtttctaggacttcagccagaaaaagaatgttgcctaaaaagaacataagctcacctagttctgtatctcttacagtgccagaatcccttctccagcattcctgtcattgagttgttgtgtctgtacttacataggtgtggtgcctgggaggtctgttttatgacccaatcttttctgctctgtaagctaattactatgattattttccttatagagagctgaaatccttttctgtataatttttgcttgcaatttccagttctgacctttggtattgtaaagttttaatcatcctttcttccagccgaccttagtcaattacatgagcagcaggttgtgtgccggccatttatttcccagcttctcatttctctgccaaaaagctcaggtggccttggtctttcctcagatgatgttttcatccccttggccactttggcattctcctctcttttcctcttaaatgtaagtcctatgtcctgaagtcattcccataaatcatttgtttttaaatgtgcagatgaatcttccaggggcttttgtcaaaatgaagattccgattcagtaggtccagggtggggcctgagaatttacatttccagcaagcttcatggtctgtagatcacacttcgaatagcaagacttagatccattgactgctcttccagaaaagaaaggtagatccctagatccctaaggtgcacatgattttcagcaactttaaaaaataaaaaaggatggcataggaatggatggaactagaatgcatttagaagccggctgtctggactcactctcttccagtgttaggtgtagaaagtaaggatggaagccgaagtgtgagggaaaacgatagcctagttaatctagaaagagtgcaaacggatgcagaatgcacacaggtctcagtgaagatgacaatgcacacaggtctcggtgaagatgacagtgaatgaaggtagtagtgctttttgtagctccacagggctcttacttagtggatatctttgagaactgatttagaatccctagtaaattgatgctgctttctttgacaactcctagtctcttcagacattcatgagtcagtgacctcatttcagcaacacatgccctattcggtacagcagtgcttatggtgatgaaaggttggaaaccacccaaatacttatcagtagagtaagctatggcccttctattcagtggactattctgtgacagttaaaaagaaaggggtctacgcttgttgacttgggaagattttgtaggtacattgagtggaaaacacaaatggtaagacattgttcaaattatcttcttatttatagccttatttataaataactagtgttaattcattagtacatcctttgggggaattagaagcatgtatgctgaactgttcccaatgttcatcttgtttgagtagactggtggaattatgaggggatttcattatttgcttttatctgcttttgtacagtttgattttttttaaagcaggagccaagccttcatttctcagattccttagatgattgacttggtggccctcttaaatgatctttcttcctctagatctctcttcaccttgtaagccagtccaagctactctaagcacaggaaatggctgcttggataagcatgtcagccacgtggataaactatctgttctgtctttcaactgaactgctactatgcactttgaaaaattccaagggaagagtatagttccacttactatttctttataactaatcaagaaacaacataactttttatgtttattctttgggagggaagaattttttaatctgtgaattttgtgataggatgtttgacgttagtgtcattttatgccttggtattttttacaggcaaagtccaatccactgccgatatctttggtgacgaagaaggagatctgttcaaagaaaaagccgtagcatcgccagaagccactgtgagtcagacagatgaaaataaagcaagagcagaaaaaaaggtgagcaggagggaagacttaacgcaggagcattgatctgcagcattttaataattcatccggaacccagagggaagtactgttccctttcacgttcatattgaagaacttcaaacagaaagtggaaagaacattgcagtgaacacccaaataactgccacccagattgatcagttcttagggttttggcaaacactttatggatgtaaaccttgttacatatctatttttttcctgaactatttgcatgtaagttgtttgaactgtttgctgcatggaactgtttccatgtagtcattgtgacattctacccctaaatatttcattaagcctctcttgaaaagacttccatataagcacaatgccattatcaacagctgtgagactaacagtaattctatagtagaatctaatatctagtctgtattagaattgctccagttgccccagaatgtctttgcaaaatcaccccaacaaatagaatacagatttaaaattatctcgcatatagttcatactgcaatttcctctcttgtccccaaaatgccatttacggcagtgatccccaacctttttggcattagggatataaggagagtgcaacctgcaatctagatccctcgcatgcacagttcacaatagcgtttgccttcctatgagaatctgatgctgccactgatctgacaggaggaggagcttaggcagtaatgcttgctgctcacctcacctcctgctgtgcggcccggcttctaacaggccatggactggtctgcagcccagggttggggacccctgctttatagtatttttttatgttttgattttttttttgttctaagaaactcaggattcggacagtgtgtctgcattgcatttggttgtcatgtctctttggtctccttaatctagagcaacacctcccacatctttttttttttaatatccagccacttgtcttgtagaatgtgtctcgtgaatttgcttgattattttcctatgaatagattcagggtgagaagttttggcaagaatacaagcaggcagggttgtgcacttccagttggatcacctcccaagacacatcaggtccactgtctgcctcattcagacacgtttgtcacttggttgttagggtgcccaccacactgcttcattggaaaggtaccctgttctcttttgccattgctcagttgatctctaaagtgatagttgaacacagtgtgaatacctgttctctcccagccttttactcagtgttttgaaaatccactgatgatcttttcttgactcagttaatctgttagcgggcacaaaccactatttttttaattctatatttcttattagttggcattcttctgaataaagttctttctctccccctccttccccgatttttagtattgctttgggatcatgtattcattcttcagtgtagatgataatccattaccatcattcttcttctttttttttttttttttgtgagacagggtcttgctctgttgcccaggctggagtgtagtggtacaatcacagctcactgcagcctcaacctcctgggttcaagcgattctccagcctcagcctaccaagtagctgggactatatgcgtgcgccaccatgcccggctaattttttgtggagacgggttttgcccatgttggccaaaccatcattctttttgatgctcagattgacctgcatttggccagtgtgtgtgtccccagcagtctttaagcccttctgactgcttgtcctttcactgctgtcctgtacagctggtccctcctctttctacagttttgtctctttgtgtcatgtcctggctgtgaagccctgactttctcctgccgaccacctaaggcccagcattcagaacctgtcaggcccgtcaggcagcctgtctttccatgctgtctctcattgcatatgtcccatctgtgcacccattgacccagactgtgtgtcctgctccctgatacaccagatgtgtcctctgtttgtcttgctgttctcttaacagccccctcagcttgctgcctatcacagcagagactccgtgcgttttctcgattgattgagtaaaccctcttttctgggtatcttacgtgttaatgcttaatttttctttttctttttttcttccccaccccccccccacccccgacaaaggttaccttatcttacagcaaaaatctcaagccctcatcagaaacaaagactcaaaaaggcttattttcagatgaggaggactctgaggtatggaattcttttgcttagttgtgggtattagtctatggatatgacatagaaactatttttgaatcaggtttttctcaatagagttataagactttttgttaagtactccagttctttaaaaattatctctagaggcaaggagtggtggttcatgcctgtaatcccagcactttggtaggccaaggcaggcggatacctgaggtcaggagttggagaccaggctggccaacatgatgaaaccctgtctctattaaaaagacaaaaattagccgggtatggtggtgcgagcctgtaatcccagttactcagaaggctgagataggagattcacttgaacccgggaggcagaagttgcaatgaaccgagatcacaccattgcactccagtctaggcgacagagcgagacttcatctcaaaataaataaatgaataaaaaataatctcttgagagcacaggggctttagaaagcaatatgtttacaatacttttcactttgggttggactgtatttacatttcctgggatgaaaatcctctctctttaggatgctcagattttaaactgttcatgggctcatgatgtgatgaggagcttgcaccagagtggaggtcaccatgctacttcctttattcacattctcactaactagaccgtggcttaatgctgtagcagatgggttctggcatagccatctgtcttgtcgagactgagaccactaacagcctctgggaccctggttcataggttgctttggtccctccaggcaccttagaaccacctctcagaatttcactgcttttcctgagtctctcaggcctaggtcgtcttagatccaattttaagttggccttttaggagatcggagacctgtatgagaaatgtaatgggaaataataagccccttttacagaaaaacatgtggacatggcagaaacttacatgtatttcaagaaactgtgggctctaggttaggctgtcatggttgggctttgcactcacagcaaggatgaacatggaaccctttggaagtatagtgattgcccttgacgtaaagaatacctttgaggctattatttcattgaaggcgagtgtacaaaacatggcaattaaccaaagtccagtcaagtcacaaccctgacccctgagaaacagcatgatggggcctccaccgtcttatgctcatggatcccctgtgtcacccacacctgcacctcggggtctttgcaccggcccctgccactctgaggaatgctgttcccagaatccagctttcttcctcactcttcgatttctctgtgaggcctcgctgatgaaatacacacaacaggaagcctgctagcacataccacgctgtgctcctggtcctctttcctatttcactgtttaccacagcacgtgttgccagggacagtgtatatttgcttattcattgtctctacttcccactaaagtacgtgccatgagggcaggactttgtattccctatttgtatccctaacaccccgtccttaatacctgtgcttggcatgttgtaagccatccagtaattgttgattagacaagaaaaccaaatgtgagcaatttcagtgacttacgagatgttctggttatttgttgctatgaaacaagtaactcaaaaacctagtggttcataacacccatagttttgttgtctcacagttcgagaggttgactgggcttagctaggccgttgtcactgagggtctcttgtgtctgaaggtggctgggctgagggtcagctcactcatatgtctggtacctgggcactggggcccctgggacatctctcactagccctgtgtggctcccagcatgtagtcagggaagccggtcctcttacatactggctcagggctgtaggggagagtcctcagagagagcccgatggaggccatgtcgccttctgtgttccagccttggaagtcaacggtggtccttttccttcatttgttggtcaagatggtcacaatggcccatccaggtttatggggagaggccataggctccccttcttgatggtgggagtgtaaatgtactctcagacttgtgtgaaaaccctaccaaaggctttgccccatgtgtgtcatcatagagtgaatgtttttattggatattgttcagattctgaggcaaggagaagtaaaactaaggcagtctaagtaagagttaaagctttggacccaaaggaatgcgtcctgactcctttctctatatctgaagtgtgaggctgaagcttgccctgtgaagtcattttgggggaacatatttgaggtaacggaagtgtcttttcttgcagtaccaagaaaggtatcagttaagggtccgaaactgtgatgttgacatttgtttttgttctttgctttggtttactttcattttcttagaacagcagaaccctttctcttgccattgtgtaacatgcaggaggggcacgggatgcctggaatcccccacgtggcctcttctatctaaataaacccatgggactccggggagcacaggggaaaaacactgtgtggaggagatctcacttagtgaactcattaggtctatatttaggagtagacagcgaccccataattaaaaaaaaaaaaaaactgtccaaagaggtcttagaaatatcttcttgtcctatttaattgttcggctcttgtgtattgaagtttatcttcccaagggaatagatgtcccattttatgtttctacttcatgtaggtcaacttgcaggtctttctttgcaggataagctgatgttttataacattttgaaaatttcttgatttttatattttttagctattttgagatgaaattatactctttttgcctaggctggagtgcaatggtgggatcttggctcactgcaacctctgccttccaggttcaagcaattctcctgccacagcctcctgagtagctgagataacaggcacccaccaccacacctggctaatctggtatttttacaaaattaatataggctggtcttgaactcctgacctcaggtgatctgcctgccccagcctcccaaaatgctgggattatagacatgagccacagcaccgagctgaaagtttctttagaatctatcaggtcttatcctggtttgcaacgtcatatacctatagttaagctaagtagactagcaaacatttaaaaataaagtttaatttgtatttatttaaaagaaataagtcggccgggtgtggtggctcaagcctgtaatcccagcacttggggaagccgaggcgggcggatcacaaggtcaggagatcgagaccatcctggctaacatggtgaaaccccgtctctactaaaaatacaaaaaaattagccgggcgtggtggcaggcgcctgtagtctcagctactcaggaggcagaggcaggagaatggtgtgaatccgggaggcggagctttcagtgagccgagattgcaccactgcactgcagcctgggcaacagagcgagactctgcctcaaaaaaaagaaaaagaagtaagtcataatcttaggagaggagggtgttactaaataaaatagttgtagctccattaatttgggaatctagcccctgtttctttattgaccctgtctaatctctgattctttagacagtaatgggaagccatgcttatatatttatttttttagcatggtgtaggaaattgattcaaaaacttattcctgccttctgtcattcaggtgggaatacagaagcccctgggctctgcgagcccaccagatcctgtagctctcctcctccttagcgccactgcacacaccctgcacagaccctgaggcctatccctttaaggactctgtctgagccaccttccctctcaggaaagaagcctagacacatggcagctgtcatgtctgagtcacttgtgttttatactgacctgatattttaaaaactgatattcctgttaaccagcaactttaatttcaatccaacaggatttgttttcttctcaaagtgcgagtaacttaaaaggtgcatctctgctgcctggcaagctccccacgtcggtttccctgtttgatgatgaagatgaagaggtaaacattgttattgtaacactagataatttagattaggagaaaacggttgttgatgtaactttctacccagaggctcatatactagcaaaaggtggtagggaagcagtcaggctacctgaagtttatataacaaaaatatttctgtttttatttcagtgacttcttccttatattttcctagctgtgcaatggagaagacattagattcttgacgcagttctttttttttttttttccgagttggagactttctctgtcacccaggctggagtgcagtgatgcgatcttggctcactgtaaccgggttcaggtgattctcctgcctcgacctcccaagtagctgggactacaggtacgcaccaccactcccggctaatttttgtattgttagtagagacagggtttcaccatgttggccaggctagtttcgaactcctgatctcaggtgatccgcctgcctcggcctccctaagtgctaggattacaggtgtgagccaccgtgcctggcttcttgacacagttcttatggagtgaaatctacaggttttatttttagaaatctgcctttgagaaatacaattgaccctttaacagtgtggaggttattttgacttccacattgcagtgaaaaatccatatataacttcttacttcccaaaaacttatctactgatagcttactgttaaccagaagcctcatggataacataaacaggtgattaacatataaatagtataatatctatttatatatttttgtattcctgacatatccagcttttccttattttttttatgatatttctaggccacatggtttgtctgcaagatttttcaaattgttgcaaatgtccaaaaaaattttcaacatattactgagaaaacatttgtgtagaagtggacctgtgcagctcaaacctgtgtcattcagggtgagctgtactttagtctagaggatggatcaacatatacccaatgacctacaagaatgttttggatcaagtggagatacaaaggaggaggcagccatgtcctgaccattgtctttctttcccgtcctggctggagagagcacagtggggaagagaaataagagagaagacaacccaaaccttaactctcatgcagtactgggcggtggtgagctcaaaggctttgccatcagacccctgggttcatatcccagctccaccacttgcaaaccaggaacctggggcaagtaacttaaccttccttaagctcatgtggcttaacagtgagtagggtcactgtggcagctgtaactactagtgtgaagctcttgcagagtgccggcacataataagtgcatagtgaatgtgagctctgtcattagcatccccaatggacaccagctcattattctcctggcctgtcctacattaccgcactctccttaaaggagacttcatccaggaagacactcccttcatccatcttcacattccagggctgttcacctgagtttgtccatcctaactcagactcaggccctctgatgcttttgttccccttatctgaataaaagcaccttaataaatataacttttggggagtgcttgaccacagaagaatttacaaatgccattaaacttagtacaccagcaattttatttagtaagctatttctccactttgtataatctctttgaaactaatgagaaacacaagtcatgccttccctccatcccaggtgtatgtctttctgacctgtaaaggagtggagacagacccccagttctctcctttcagccattgttctggtttctcattcgtggagacaacagtgtgagtttctggctgctgcgggggctcccgtgcccatcgcaggctgtaaccacctgaaatgagcagagaggcacttgcccacagggtgactggatggggctcagtttctccttgtacttcatgatctcatttgcatgttgttctcctgcttatatgcagctgttctgccttcgagttctatggtaatctctttcccttctatgggtgcagtgagaaaaggctgtagtttgggatttactagcattttgcggtttttccccgccagagttgttatttgtatacctgactggagacttacttccttaaagtttgatataggaggacatcctatgttttctgattataaagttgtcttacctttctgccatttgcttttctaggataatctttttgggggtacagctgctaagaagcagacattgtctctacaagctcagagagaagagaaagcaaaagcctccgagctctccaaaaagaaagcatctgccctgttgttcagcagtgatgaggaggtgagctgaggtttctgctaaaaaagaggggattatttcatgggatttaagagttaaagccatcccaagtctttttctacctgttttatatctcgtgatgttcagtcaccaaaggcgatgttcacaagattgtcttttctgaaggaagacatttaatgtaatatattaatttaaagatgaatctcttcaaaatggttaggaataagtatgactcccacacaatagtgtatgctccttcaaatgagttaggccggctaggggggaaatgatttctcagccatcgctagttcatggtcgagtcccttagaacaaatgacagattaaccagagaaaagtgtgcaagtttacgtaagataagttttaccagacacaggagccttcagaaagaaaaactcaagagaaacaggaaatcctgtgtcaattttatgcagtctgatgaagaagcggacagttttgggggagcacgattagatgaaaggggtgtgacctgatgggaataagctggggggagctcagcaaggcctgtgtggtcagatcattctctgcatctttacaaataaggaggctcctttcctctgggaatagggaggactggaatgaaggttttatgacctactccagagagggttagaggattcttctatgtcctgcttcagaggagaagggccagggaaaggtcagagagacctttctgcttctgttttctcaaatgccaaggtgtcatattttgaggtagcatgtcccgtataccccaatggccatatatactagtatcttgttaaatgactactgtgtttcattaatttagaactatagttaggaggagttacctattgaggttaaactcctttttgagggagtcttaacaatatttctgtttgtgatctggatagatactaccaaatcagttagtttagttgctaactcaatcagatttagtagcagggaatcagatttagctgtgcagaaaaagactttaaatatgatgatataaaaaatcctgagtattaaacatcttcctgtgttataataattcctcttttttttaacattgtaggcaagttagtagggggtgaagtggatatataagtcatagatatgttcatgtccttactgaaagcaatttaaaaattctgaagcagattgcaaaaaaaaatgtattaaaagcttatgcggccgggcgtggtagctcacgtctgtaatcccagcactttgagagtctgaggcaggcagatcacttgaggttgggagttcgagaccagcctaaccaacatggagaaaccttgtctctattaaaaatacaaaaaaattagcaggttgtggtggcgcatgcctgtaatcccaactactcaggaggctgaggcaggagaatcacttgaacccaggagatggaggttgtcgtgaaccgagatcacgccattgcactccagcctgggcaacgagcgaaactccgtctcaaaaaaaagcttatgcaacacacatgtgaacaagacacaatgaaaaactgctagtaatccttttactacaaaagtctgagtctggcctttagaaagcgtttaaggaattcccacccagctgtgctcatgccttcacatcaaggaactcccaagcatatataatttgtgttttctactcaaatgtatgaatttatgatagattatccagtttttttcttttaaacattgtcagtgattgttccccctgtagcaacagccagacatcagtgtagttgctcctactagagtattatagtggttcagggaaaataaaaacattacctaaagcttggagcaaaaagacatgcagaagaaagacagccaaggttctagaacaggggcgtccagtcttttggcttccctggcccacactggaagaagaagaattgtcttgggtcacacataaagtgcgctaatactaacaatagctgacgaactaaaaaaataaaaaggttcgtgcataaatcccataatgttttaagaaagtttacagatttgtggtgggccgcattcaaagccatactgggctgtgtgtggcccatgggccacaggttggacaagcttgtcctagaacaaaggctgtcaacttcggctgctcattgggatccatggggaacttaaaagagtgctgacaggccgggcacagtggctcacgcctgtaatcccagcactctgggaggccaaggaggtgggcagatcacctgagattaggagtttgagaccagcctggccaacatggcgaaactctgtctctactaaaaaatacaaaaattatctgggtgttgtggtgcttgcctgtaatcccagctactcaggaggctgaggcaagagaatcacttgaacccgggaggcagaggttgcagtgagccgagaccgcgccactgcactccagcccgggccacagagcaagactctgtctcgaaaaaggaaaaaaaaaaaaaaaaaaaaagaaagagaagacctaacgagtgctgacagtggatcccagctccagagattctgaattaatctggttggggtacagcctcgtcattggagttttgtgatactctctagtggatttcagcgtttagtcactgctaaacattgaggagcacttctcaaaccttcatgtttaggaaatcacccaggcaccctgtgaaatgcaggttctgattcagaaaataggggcggggcctgaaattctgcataatctgctgctggcttgtggactccagtttggtttgcaagactctagactccagagatagagcacttatgcaagtgcttgggagttctttgatttgaaggggtgtgagcatagttgagtagaattcccttaaatgctttctaaaggccacattcagacttgtggtaaaaggattactagcagtttttcattgtgtcttgttcacatgtgtgttgcgtgagtttttacactttttttttcaatctgctttaggatttttaaaattaaaatattcttctctggagttggaagttcttgagttcttggtatttttacatttggcttccttcttatagcctctgtaattaatgttgattccctgaaatagacaagtcgcttgtaatacagtgcagaaccacattgggaagagacatcgtggcaggtgttggaggaggaaatcatgagaagctctgtgaggtcagagagcccagctgtctagatttgagttcaaagaaaagtcttaagcatgagctttcttcaagactgatgcactaagtttaatacttagtttaaatacaacttagtttaacaaatataagtttgattttactccccatgttttataatctaaattgccattggagttttttttcttttttttgagacagagtctcgctctgtcccccaggctggagtgcagtggcacgatctccgttcactgcaagctctgcctcctgggttcactccattctcctgcctcagcctcccaagtagctgggactacaggctcccgccaccacgcccggctaattttcttgtatttttagtagagatggggtttcaccgtgttagcaaggatggtcttgatctgctgatctcgtgattcacccgcctcggcctcccaaagtgctgggattataggtatgagccactgcgcctggcctggagttttaatatatattttatgttttaaggaccagtggaatattcctgcttcacagacccacttagcatctgacagcaggtctaaaggagaacccagggattctgggaccctccagagccaggaggccaaggctgtgaaaaagaccagtctctttgaggaagacaaagaagatgatctttttgccattgccaaggacaggtgagatagtcattggaaggagtccctcactccattaccgtggtaacaagaaaaggaatctgatgcacaatctagttcatcgggtgattgctaatcatggatcacatagtgattgtgccagtgagaatgtctttgcttttcaatggcaccatcttttccctcagtacccggaaatgtttgtctttgtggatccttatctgatttcttccccaatcattattttttaaccatattctttttctttgtttgtcagggatttgagtatcttttgtttgtgatttttctctgggctactctaaagtatgtcaggtttggtcaggattacttaaaagttactttaggccaggcacgttggctcacgcctgtaatcccagcactttgggaggccgaggtgggcagatcacgatgtcaggagttcaagaccagcctggccaatatggtgaaaccctgtctctactaaaaaaatataaaaattagccgggtgtggtggcacgcgcctgtagtcccagctacttgggaggctgaggcagaagaatggcttgaactcgggaggtggaggttgcagtgagctgagatggcaccactgcactccagcctgggcaacggagcaagactccatctcaaaaaaaaaaaaaaaaaagttatttgaatagaaatctgctcagcatttaacacatcctgttaggaggaagttccctgtagagctgtgcagtatcactccaggggctgataacccatagccaacctaggtgcctctccccattaatgctggaactgaagctgctaggatattcagagtgagcgtgggctgtggttggtataacatgctgccagattagcttatgggttcagaattacttccctgcaaatactttttttccttttgaaagcctgacatgattactttgaaattcacctgaatgttattagcagaaagaagtaactgattggacatgtaaatcctatgctttggtgtggttaagcgtcatttgatagattcagaagtacctcaggtttctgtctccaaatactcgaatcttgtcaagcatcaccatttctgcattaggcctctgtaacttgacactcggatgcatctttggtctctgatttagaatataggctctggaaagttgatattaaattctgattctgccagttcctgtctgaataaccttgggcaagttacctaacttccctgtgcctcaatttcctcatttgttaaacaaaaataaaaacagcatttctctcatcggtttgttgggatgatgaggtggaatctaaatgtgaaacgctgagcacaagagctggcacattctgagccctcaggtattgccagttagcatcgtgactgcagggaaatagtacattcctttatttttgttgctctctcctgggacattcttcttcctgtgttgcctggccaccttctttcaaaactaagtgtaagtttcttaagaagccttcccggctgggcgcagtggctcacgcctgtaatcccagcacttggggaggccgaggcaggcagatcacgaggtcaggagttgaagaacagcctgaccaacatggtgaaaccccgtctctactaaaaatacaaaaatgagctgggcgtcgtgtcacgcacctgtaatcccagctactcgggaggctgaggcaggagaattgcttgaacctgggaggcagaggttacagtgagccaagatctcaccactgcactccagcctgggcaacagagagagactccatctcaaaaaaaaaaaaaaaaaaaaaggcctttcctaactttaaacagacaagaaagagaagaaatagggagtagagggcagacatggctccaccttcataccccaacaccctcagctgagcattttctgcactgtatccaggttagcttattcccatgagtgtccactacccccaccccacacaaggtcataaatctggcagtctgaaccccatcttgtttgtgggtcctggttccagccacacaccatacctggctttcaggaatgctttctctgctccagatacatcctacctcctattgttcccgaagttgtctgtcaagttttgtgtatggaaagtaattcataccttcatcagatctcaaaagaagctttacacacacaagaagaagttgaggtgaggatgtggaggaattggaaccctcatacactgctggtgggaacgtaaaatggtgtagtcactttggaaagtagtttggcatttcctcaaaatgttaaacatagagtcaccatatgacataatagtttcattcctatgtatatacataagagaaatgaaattagttgttcatataaaaacttgtacatgagtgtttattgcagccttagtcataacagccgaaagtgtaaacaacccaaatgtccatcaactgatgactggataaacaaaatgtataaccatacgatagactgttcttcagcaataaaaaagaataaagtagtgatgcatcctagaacatgaatgaacctagaaaattttatgttacttgaaagaagctggtcacagaaaaccacatattgtattgttccatttatatgaaatgtatagataaaccacagagacagaaagtagattagtggttgccagggcctgtggggcagggggaatggagagtgatggctcataggcatggcggttctttttggggtcatgataatgttgtgcacttaggttgtagtgatattgcacaactcgatgagtatattaaagaaaacattgaagtatgcactttaaaagagtgaatctggattaagaaaaccattgaagtgtacgcactttaaaagagtgaatctggccaggtgcaacggctcatgcctgtaatcctaactgattgggaggccaagtggaaggatctcttgaggccaggtgtttgagaccagcctgagcaacatagagcgacctcacctctccaaaaaagtaaaaaaattagccaggcatggtgacgtgtgcctgtagtcgtagctacttgagaggctaaggcaggagatcacttgagttcaggaatttgaggctgcagtgggatatgattgtgccattgctctccagcctgggcagtagagtgagaccctgtcttaaaaagtaaaataaatattaaaaatagagtaaatacaaggtgaattttatggaatgtaaattatgtctcgataacgctactaaaaaaaagaaatagaagccaggcacagggtcatttcccagtgctaatcctggccctgtgatctctcttggcaaccgtcttcatgacaattctggaaataggcacgtccgctttgattctttttgtgctataggaagtgggagagaatgttctgcttgggaaggctcaggcatcgtgtgccttgcagcggtaacagctgatgaacctgcactggatagtaacaggaaaggggcaacctgaggcaggagggacagaggctggtgatttgttggagtcagatttcatctatttcaaaggtctttcctgtttgctttcaactgtgtaaggtcaactaatggcttgggtgtttgggtggtaggtggattcctgtaggtgcagtctagaagaaatattgttgttatggtttttgtttttttcatcacacttttccttaatttgaccttttgtttgtttgtgtagccaaaagaagacccagagagtgtcactcctctttgaagacgatgttgatagcggaggctctctgtttggctctcctcccacatctgttcctcctgcaacaaaggtattcttcatctcttagtcccaggaaatgtccttgagtttatgctgcatcagtagtggtacttccccgaatcagctcttcatacctaaccttggaggctgagtcttatggaagaccttatttgcctggtttcagaaagagatcttctgattaatagtattctacagaagaagcacacgtgcaaagccatcattcagtgtcaggtgtaggcacaaggaactgggtctcagaagaggcttgggccccattggcatggaattctgctaacattagactaggccagttaaggcaaaatcattccttttatgagtgtgtgtcgagtactaacactggtcctggtttatattagccagtcagtaaaaaggaaggaaattctcacatgtgctacaaaatgcatgaaccttgaggccgttatactccatcagtggagaaatggtcacacaggtcctagtacagttagactgtggaatactatacagtggtaaaaaaaaacccagggtggagcttattgggatgaaaaacatactgcaggccaaaaaaaaaaaaaaaaaaaaaaagcgtaaacacgtaaacatggtgtaatttaaactttacaaaacaagaaatacacatgaatgcctggaaaccggcctgaaagcatcgatagcacattgttaccagtgattatgtccagggaaaggtatggaatggggaacttcatactctcaatgcctttttaaagcctttttaaggaaggcatttgtgcattactgtggaattagaaataaactccaaacaaaaaatatctaggagatatggaagaagacccttcctgttaaatggagttgctcagcttataccagaagctctcagccctgggccagcatgctgcccaccctgggccccaggctccctgctgctgcttctacggggctcctgagcctttccttgggtgctctgtacttacatctccccctttaaggacatccagtggttgtacaattaaaggagtcaggagatctgattggtttttctttgtaaattataaataaactactctggaggataactgagcaataaattaatgaattttggagcctctggagctgtaaaacttctttcaacctatggtaattatgattgttaaataaaacaaaaggtcaagacacacaacttaagtagctgaatagcctacacgtttttgattatttgtgaaatataatcatctttagacaatagtaaataaaagatatttcttgtttacagatatttcagtgtaagttaattgtgacttggttgtaagcctatgttgaccaaaaggttaaaccacaggcaggagaacttaaagaaatgtaatgtgagttttgttttgagccaagcttgagaactactagcccagtaaagagactccacacaaactgagaatgcgtcccagagtgggccacacgagacacagcatttatacatttctgttatatagaaaatgggaaaagggggcagtgaagcaacggtgactttcttaattcagattggtgctcaatgacattgaatataagataaagtaaatatgtggttaatgtattttcctcattagccttttaccctaatgagtacataggggtcgcagttgcagggtcaggagagggatggttgattttgtgctgcctttgtgcttcatccaataggcaggttgtaatcggtgcctgtcagtgtgatatttgacagactctggccttgcaggtgaggttcagctttcgttcataggcccggtttctattacccatatggccaagatgcagccattttagacaatttttttttcttcagactttccttattttctgacacctatcaagaaagtaaatttgaccaggcacggtggctcacgcctgtaatcccaacactttgggaggctgaggtgggtggatcacctgaggtcagaagtttaggaccagcctggccaacatggtggaaccccatctctattaaaaatacaaaaattagccaggcatggtggtgcacgcctgtgatcccagctactagggaggctggggcaggagaatcgcttgaacctgagagatggattttgcagtgagctgaggttgtgccagtgcactccagcctgggcaacagagtgagactccatctcaaaaaaaaaaaaaagaaagaaaaaaacaggaagtaaacttcatgacaaggatgagcttgtcttcaagaagattaaaactggtactttgggtagcattttctgtggtttaaggaccttagttatatatgaaggaagaatatgatttgccatacttaagtctctttttgtctcccctatcaactatttgcattgaattttttttttttttttttttgagacggagtcttgctctttcgtccaggctggagtgcagtggcgcatctcggctcactgcaagctccgcctcccgggttcacgccattctgcctcagcctccctagtagctgggactacaggcacccaccaccatgcccgactaattttttgtatttctttagtagagacggggtttcactttgttagccaggatggtctcgatctcctgatctcatgatccgcccaccttggcctctcaaagtgcttggattacaggtgtgagccaccgtgcccggcctgcactgaatttttatgtagttttcagtgagtccaggatgttccacaaaagccttttcctttgatcacttcagtgttgccttatctcttctgaaattctttatgccttccagtgttcttttatgtcaagttcaatggttttgcactttacttatctcttcctaactaaaaatccccttgctctcttctttcttcattcatcacattttaaaatcatgattagcaatgtccttccttagtttcccaaatctgccttcctaacttgatttaggcattgcctcaaagcacacttcctcgtgtcatatggtatgatttgtatctgtactatactataatagagctttagttttttctcaagcacttgttgataagtcacttgctgcaaaaatgccatgaattccaggaaagtcacaaacctcagtttcctagtccccaaatccctgcctccctgataaggaagagatgagaaatgggctgaagtgcttgcagacttgtattgaacactgagttggtataaaacactgggactgtccatgaaaatatagtgtatagtcctttcagatgaacagacaaacagatgtgtgctagctgttatataagttaggaagaaagtcaaggaagggtcaagtagagagataaatattatgcttattcaacaaagcaactgacacttaactgaagaggacagagaccgtgggtgacatctgcgtgggggccctgcttgaaggatggggaggatttgcacctacagacatcgagggcagcgtggcatggaagtttgaaagtttgcagcgaccttaaggaacagcagggaaaggaggagatgcatatgagtagagggatagaatggggtatctgctgagtgtcatttgcttcatgcaaggagtgctggtttgggttgggagaggacctgatccagcaggtgttttgttttagcaagacaacgctggataatgtcttctagttgaaatataagaggagtgaggcagagagagagactcatgatcgtctggtggcagagataaggatctgagggagggaggcatgggggttgacagacacaagtagacagatacaggtgatatggtggcgtgaagtgtcctgtccacaagtcccgggtggtggtgtttgttgcttctcccttttggtgctaccttcactatcctgtcctctcttccttgatcacatttagctgaagccctaagaggatggtttgggcttgttctgtatatggccatgctggtcagacacacttttttattgttgtggatgtcatgtactcttcttttggtagaaaaaagagactgtctctgaggcaccacctttgctgttcagcgatgaagaagagaaggaggcacaacttggagtgaagtctgtggataagaaggttgagagtgccaaggagtcattaaaatttgggagaactgatgtggctgagtcagaaaaggtggactttttttcttgtatacttgaatgcatttgtctctcgtatgttgtttcaaacacacccaaccccttaagttttttgaccacagaaaataaatggcccatttgtagacagatttgaaaacatagacaagcaggctgtgtccccacagtgcaggaagcctctgcagggcctttcctcccggcccttctccaagacatgtgcgcactgtggtgtgcctgctcctgtctctgtggttactgtcacgtcatggcatctttgctttctaacttgttctcttctgtgcagtgttcctgttacccttggtcctcctttggtccccaagtgcacttgaatttaaatgtcagttttaaggagattttagtttagcatccttttacttttagatgatattggcaaggattacagagtagagtgaaatttctactctttctaaaacactagctttcaagtcctggacggtctgccgtctcttgcaggaggcctgtgggtagttctgctggccacacctgggcatccagctttgtggttgccttcagtctctatatgcctcttttctttctctaacttttcttatacgctgtgtgtccagctgcttaggtctaagatctcccagggcctgtgtgaagagcgttgcatttgcatttgctgctgaggctccttggagctacagtgatacaagcatttcatttgtacctgtgttcctgtgtgaaattctcttcctagtggctgtgtgtggaccccagtcctatcccagtcctggtccacacttgactctgactggttgctgtactgccctctccctgagtgtaagccccttgcggactaggcccagtttgttttgctcaccatcatatctgtagtactggcatattaccttgcacacagtaggcactatgttataaactttgtatttctttaaagaagcatttttttaatagtttgagtactctgaaatcgggatgtacctcataatcaatggtatcttacctgaaatgtgccatttgttgaatgaataaatactgcattttagaattatttcagagattcttcttcaattgcctatacagtgtaagccttttacaatttgagggtctgattttcctgattagatttcccccttggggcttatgtattagttaaatgctacgaattcatggtccactcccaatgattggcacttgtattggttatctttgacacttagaagttcttcctagttcatgagcaaccagtgtgcatcaggattatagccgtcctatcacttgataggagagagggacccatggtcttaatgcttggaaaagttatctttggctacggatgattgtacaagactgtctcttggagcagccaatcaagaattgacctcagtgttttgttacttgggcacagatgtgattcactgtgccctgagtcatgcaaatgtggcagttactgaattaacgagaagcttggcaggctccatgataggatttgtatttccaggtgttacttattttttccccctattattttcattttcaggaaggacttttgactagatctgctcaggaaacagtcaagcattctgatttattttcttcatcatccccatgggacaaaggaaccaagcctagaaccaaaactgttcttagcttgtttgatgaggaagaggataaaatggaagatcaaaacattatccaggctccacagaaagaagtaggaaaggtaagcaaaaagcagtagtggttcaagtctctggatgagataaaagactctcatctcatggttgtcattctgtcatgtgagtttctgaaggaatcttaaccttcaatgtagtgtgttaatgattctgtgcagtcatttagatatttgggaatcttaatcaggaactcttacctcaagtagcagtgttaggataggggattagaatttcacccccctcttctgggatttacagaccttgttgttccttctagcaaaactttgccccttggccagttgtgggatgtaaacagcaggaaagggaagttaggctggagctgtacagttaagtatttctaacattcagtttaagaaaaagtgttgtagatgaacctttcatactgatcaggtgtcagcaaactatttctataaaggaccatataatgactattttagcttttgcagcctatttgggctctgtcataactgcctagctctgccattggcagcatgaaaacagccctaggaaacatgaagatggatgggcatgactgtgttccagtaagttttattaataaaaataggtgatggtcagctgggcatggtggctcacacctgtaatcccagcactttaggaggccaaggtgggtggatcacaaggtcaagagatcgagaccatcctggccaacataatgaaaccctgtttctactaaaaatacaagaaatagcttggcgtgatgacgcttgcctgtaatcccagctacttgggaggctgaggcaggagaattgcttgaaccaggaagtcagaggttgtagtgagccgagatcgcaccactgcactccagtgtggcaacagaacgagactccatctcaaaaaaaaaaaaaaaaaaatagatgatggtcattctgtgaggttagtatgaccctgatattaaaactagacagcgacatcaccagaaagctagatatcctttatgaatgtagaggccaaaatcctcaacaaaaatactactaaacccaattcagcaaaatataaaaaggattgcacattatgagaagtgagatttacccctggaatgcaaggttggttcaacatctaaaattagttgatataatgcactgtatcaataaaatacagaattaaaaggcgcatgatcatctcaacagatgcagaaaaagcttttaataaaatccaaaccttttcatggtaaagcactcaattaggcataggaggaagcttaatgaacttgataaaggacatctatgaaatccctcagctgacatcatacttaatggtgaaagactgcatgcttttcaaccctaacatcatgaacaacacaacaatgtccactcttggtaattctaatcaaccttgtactggggattctaagcaagccatgtaggtgagaaaatgaaataaaaggcattcagattggaaaggaaaaagtgaaatgaagcaatctgtatttgcagatggcatgatcttttatatagaaagtcttaaggaatctgcaaaaaacatccattggaaataaagtcattaagattgaaggatgtaagatcaatatgtgaaaaccaattgtagttctgtaagctagtaatgaacatttactaacttacaaaagttactactagtaactttcttttttttttttttttgcaatggagtttcactcttgtcccccaggctggattgaaatggcacaatcttggctcactgcaacctttgcctcccgggttcaagcgattctcctgcctcagcctcctgagtagctgggattataggcacccaccaccatgcccagctattttttgtatttttagtagagacagggtttcaccgtgttggccacgctgaccttgaactcttgacctcaggtgatccacctgccttagcctcccgaagtgctgggattacaggcatgagccactgcacccaacctactagtagtaactttcataagcaattaccagcttatgaatgaaattaagaaatcagtttcttttatagtaataccaagaagggtaaaatacttaggagtaaatttagcaaaagaagtacaagacttgtaaactaaaatctacaaaacattgaaagaaattaaagacctaaaattgatggaaagacatcttgtgtttatggaccagaaaccttaatattggtaaggtggcaatacttccttcccaaattgatttattgtaatctctatcaaaattccagcttgctttttgcagaaatggacaagctgatcctaaaatttttatggaactgtaagagaccaagaatagccaacagtcttgaaaaggaagaacaaagttagaagactcacacttcctgatttcaaaacttactttaagacaggatggtattggcataaggttaaaatatatagatcagtgaagtagaattgagagtctagaaataaaccctcacatttacagtcagttgcttaaggtgctaagatatttcagtggggacagaatagtcttcagcagatgtgccaggatgctgattatctacatgcaaagggatgaagttggacccattaataaataaactcagatccaatgtaagatccaaatgtaagaactaaaactgtacaactcctagaatctagagagtatgtgagtaaattatcatgaccttggattaggcaaagccttcttagataagacaccaaaagcacaagtgacaaaaatagctaaattggactttatttaaatgaaaaacattgtgcttcaaagggcaccatctggaaagtcaaacgaccacccacaaaatgggagaaaagatttacagatcatgtatttgataaaggactcagatccagaatatgtaaaagacttataagtcaataataaaaagacaaatagcccagttgaaagaagggataggccaggcgtcgtggctcatgcctgtaatcccagcactttgggagaccaggacgggaggattgctttaggctgggagttcaagaccagcctgggcaacatagcaagatcctgtctctacaaaaaattttaaaaattagccaggcctggttgcgtgctcctatagttctatctccttgggaagttgaggcagaagagtcctttgagcccaggagttcaaggctgtagtgggctgtgatcacaccattgcactcaggctgagtgacagaacgagaccctgtctgaaaaaaaataggtaagacagacatctgaatagagattttactgaagaagatagacaaatggccaaaaaggatatagaaagatgctcagcatcagggaagccaaaaccacagtgacataccacttcatacccgggaagaggaccataataaaaaaaaaaaaaaaaagggaagtaacgagtgttggtaaggatgtggataaatggaaattctcattccttgctgctgcaagtgtggaacagtacaaccactttggagaacagtttgctgttcttcaaattcttataacataaagctaccacacaatccggaattttattcctgggtacatatccaagagaaataaaaacatgttcacacaaaacttgaatatgattgctcccagcagcattattcataatagccaaaagatggaaacaatggctaaacataatatagtatatccatacaatggaatattatttggtaataaaaaaggcaaagtactgatacatgctgccacatggatgaaccttgaaaacattctaaataaaataagccagtcatgaaagaccacatattatgtgattccatttatatgaaatgtccagaataggcatatcaatggagacagaaagtagattagtagttactgggggctgggagtagcagtgagcaggaatggataattactgctaatggtttggggtttcttttgggggtgatgagaatattctaaacttagattgtggtagtggatacacagatctgaatataccaaaaaatcattacattttatacgtaaatgggtagattttatggtatatgaatttgatctcaatggtgatgttatgcaaaccaggttggcaggtcatagattgccaatcctttttatagatctaaccaaagaaatagtctatgtttatttctacaaaaaatgttatatgaatttttttgttataccaatactataagcttatttataaatgagagctgcacacagtgaatatgattaatttgatatattttctcccagtctcttactgtgtatggttttgtaatatttttccacagttgtgaaatatttaacattacttgctgtgttaaactcatttttatatgtaacaataataattattgttaatgtgatttattttgttagaagtaagtttttcattagtttttttggtttttttgttttgttttgttttgttttgagatggagtcctactgtgttgcccaggctggagtgcagtggcatgatctcggcccactgcagcctctgcctcccaggttcaaggattctcccacctcagcctcccaagtagctggaaccacaggcacacgccaccacacccggctgatctttgtatttttagtagaggtggggtttcaccacattggccaggctggtctcgaactcctggcctctggtaatccacccgccttggcctcccaaagtgctgggattacaggcatgagccaccatgcctggcctttttgttaagttttaatctgtggctgtgataaggaaatagggatgaattttagaatgtcaggtctggagcattatattatcaaaccaataatgttgatggtaacttttaaatgttagatatctagtaaacaaaaaagggactcactcggggtctgaaagtagggcagaagtgatggacagccataggaaggcttgtggtcgcacctgtgccaggtctttggcctgcagtgcttacaggtgagggacacatacttgaccactctgtgtagtttgtgcttgagtcagctgctgtctcttcttccctttggaaatgagatgaagagaattcattcagttgtatgttttttaccttcaaaatgtttctcattatggaactaatggattgcttttctaataaaaaatttagatactatacgaagtttatataatatatataacctggaaagattatctctaaagcttgtgcatatatatatatatgtgtgtgtgtgtatatatatatatatatatatatatatatatatatatacacatatatatatatatatatacacacacatatatatatatatgtaaactttgtatttataaatatattttctggtatttttggaagcgccatagcattccattttgtcaatgtttcattcccctactgagtggcttttaggctgtggccagccttttgctaatataatacagctgcaggggacatctttgttgtgtccatctttacatatgtaacttccttgagataagttcttacagctctaatcacacatgaccttccctcctgttcccagggctgcgatcctgatgcccaccccaagagcacaggtgtcttccaggatgaagagctgcttttcagccacaagctccaaaaggacaatgacccagatgttgacctttttgctggcaccaaaaaaaccaaggtcagttccaaatggttccccacagtatgacttgttattgtattgggtgctgtctcaacagctcacctagttctctttgtaaattgttttgcttttggatattgaacttgggtcttgtttattctagctgttagagccaagtgttgggagcctgtttggggatgatgaagatgatgatcttttcagctctgccaagtcccagcctttggtaccagccttttgttctcaatactgggttgtgtgggaaagattctgggaaaggaaactaacgtccagttagatgattaaggaaaatcctaggagagtcgtgctgcttcctgctaaatgaatggcaaataacatgccgaggggagcgtgtgtggaggatgcaatgcttagtttctgttgttcctcatcttatgttccctatactaacattaaaacattaataatccaggctctctgactgtactacacatctgtgtgatgtttaaatggttgattgaaagaccattgcatacactggggtggctaaatattcgtgcctttcaggtgcaaagctttgaatctgagttttagcctttctatgtcattttctcccccagccccagtaggtttttgtaagtactctgttttctttttatcatagagaggactcctgtgacagccacagtcttcagaatgctatttctgaaatgctacctttgagttggttcagccctcatttgagaaagtatttttaagactcagaagccaggattgttttttgcattatgatttttccttaaaacttctaagatatttgatgcctttttggtattttttttcttttgaaggtacaagagaaaaagagagtagtgaaaaaagaccactctgttaactctttcaaaaaccagaaacatcctgaatccattcaaggtagtaaagaaaaaggcatatggaagccggaaacacctcaggttagaaatcctctttaaggattttcagctcttgtttgcatcccagtacagagaaattccattatgcagacccacagttatttagacttgtctgcattaaggaggaaacagcaaccagggctacagctttgtcttcactgcacttcccccgagtcatctcccctctcctcactccacacgccagagtttcatgaatctatactttaatagttagtgttttttgatgccatgccagatttgactctgaagtggagttaaggtaggatgaagaatcttcttcccactaaagaatttatttctccctctggatttccttggaatagaattaaaatagaaataaatataaattacatctgatttcctgcctgctctcagtgttgcctctcccgaggtcattgctgttgggccgtactctgcagcagtcttctcagaacgctgtggagctcctcctgggaacagcccaggactggagagcgagtgacagttccacgtgcaggtgtcccagggtgtctcactgaagccttagtgtcctgagccgtaaacctgaggcacttggacgaacacatcaccactgacccttcctggggctcagatcttttgcttttagagccagtgcattaggctatggttgaatttttgtgtgctccttgaaatttctatttgataaccaacatggtaattttgcctgctggtcagttttaggtgctctgataaactgtgactcttgggaatcttactcatcttgtattccttgactccatatctgatctggcagctttccacttatgtgacagaggaggaggcatacgtgaagtagtgctagtgaaacatcaggccccaggagagatttgaatgcctttcccattaaagagctacagaaagtgacagttttgctccatcacagatttatttacaggcataagaaacacttgtctttctgtttcccaaatggatttttaactggatgtaatcttacacaggactcatcaggtctcgctccatttaaaaccaaagaaccatccactcggatcgggaagatacaagtaattaaaacactggaatcttcattgcctgccctgtggcatctataaacttttttgggtttcctactcttgtcagctgctgccaaacatcttctcatctcttcccccgcctcccctcccctgcacctagttgttgtctcctgtgtgctgcgtctttaacatctattctttgagcccagtggtgggcataggtgtaagacgctctgttttaattctgagactagattgggcgattttcctacgtttctctactcctctcgtattatacattatgtgtaccgaatcttgtcatgtgtcacaataaagataatagactgctgtgttgaagaacaaatacagagtttcatttttcttctttaggcaaatttagcgatcaacccagcggccttgctgcccacagcggcttcccagatctctgaagtaaagcctgttttgccagaattggcttttccttcatctgaacacagaaggagccacggtctggaaagtgtgcctgtccttcccgggagtggggaggccggtgtgagttttgatcttccagctcaggcagacaccttacacagtgcaaacaaggtgatgaaaccatctttgcttccttgctctcttcttttaaccagaacatgcatatgcttctttctagtttatcagttgcatacacagcagtctttgactctccttttgaaggaggtgcctcatccttccttcagccgctcccccctccattctccccacccccctcatcctgcacctgcttttccatggcctgcatttggtacatttgcattctgctcagtagccacagtaacgtctcaccactttggctggtgtctgacacctgcaggtttccagcactgccacctgggggtcttctaaccacagagcagatcatgcccctcctgctggcgcttcctcactactccaaggagagcattcgggctcctgggtttggtatgaaacccctttgcaatcggtgccagcccatgtgtgcagcttcctcactagtcacttcacactttccagcctgactccaggcacaccaggtgccactccctgaacacacatggtctgttctgctgctgcccaaggctcctgctgcctcctcaccaggaatgcccctctctgtccacagctgtgcttccacatccccacttctgtcactgtgccctgcactccctgcaccaagttcccacagcagcgacactgtttcatgggatctcctcaatggactgtgaactctttgaagttttcctttcattgtagttgggtttcttgtttctatccagtctcccttctctagaaagctttaactgatctgcaagtaagtgacaggacacagaatgacctaccctgacaaatagattcatttcaaatgtttgcaaacctgtttccttgtgcaaaacaaaacagccttccttttaacgacaattttcattggctttttttttattaagtttaaattggcaactaaaattgtgacattcccctgaagttgacaacacaatcatactttgcccagagtagattgtagcttctcaaaattctacttgattgtatattttggaaactatcataaactgcatcattgctactaagtgattcatgttttgagattatatgaaaagttctgatttctaagccatatttcttatgtggaatatttaacatttgaattcaatgtttattgacttgaagaaaacagcaccttagattacctctctttattgtgtcatgtttctccccgctcctggagcctgaatttagactagccccctaacaaaggttagtaccagaattccccgattctttcttgttttgaaagatacccacgtttctgttgagggtagagtaggggccaagggaggggttgtgagacacagagagccaacatgcctactttccaggtttccagcaacagatgaaactttttgtgtgaaactgaactgaaactgccctgaaaagattaaaaaatggagaactctaaaggattaagaatgacttagtcttggagtactaggagctattaaactccttccttggaaatcattaagaaataacctcttctatgttcttagataatatcttcattgaagtagaccagataaccttacaatattttgagtcactgattctttgccatggtagctttgaacactttattttatcgtcagatcaatgtatgtttttttgccgttgcagagccgtgtcaagatgagagggaagcgtagaccgcagacccgtgcagctaggcggctggctgctcaggagtccagcgaggctgaggacatgagcgtccccagaggacccattgcacagtgggctgatggcgccatttccccaaatggccatcggccacagctcagagcagccagtggagaagacagcactgaggaggccctggcagctgccgctgcaccttgggaaggtggtcctgtgcctggagtggacacaagcccctttgcaaagtctctgggtcattccagaggggaggctgacctttttgattctggggacattttttccacgggcactggatctcagtccgtggagagaacaaaacccaaggcaaagatagcagagaatcctgccaacccaccagtgggtggtaaagcaaagagccccatgtttcctgctctaggcgaggccagcagtgatgatgatctctttcagtctgctaaaccaaaaccagcaaagaaaacaaatccctttcctctcctggaagatgaggatgacctctttacagatcagaaagtcaagaagaatgagacaaaatccagtagtcagcaggatgtcatattaacaacacaagatatttttgaggtaataggacttaacacgtttttgtgtctgttctaagttaaggaaggtatctgattggcttatttgagccatagattatgtctagcttgttgcgtgcataccccatagccacttgcttagtaattataattaggctcttttattaataagtctaacattgattcagaagtggttttttgttttgttgcatgtagaatgtatttcttggctggccatgatcattgatactgatcttggtttctctagtttttacagtttttttatttttatagaatattgttgtaatcagcttcctgggcatgccactcggtgacatggcatacagctccactggtccagcttgggagtttaacctctggttctggggacattggccctggctggagctgacaatgtagtgcatgcaggcaataagactttcagtggcatttgctcagcagatgtttattgagcacctggggactgcaggcacaaggtgaactcagagaagtgctaggctcctcagagctctctgggaagataatcaaatacaaacagggcaatggataattaagatgttttcaaatagtactaagtgtcatgaagaaagtaacctggggcagagtggtgggtagggctgggaggtgctcctttaggcaggactggtagagaaggtgtcactgcagtggcggcatttgagccggggtgagatgcgcgggccaagctgtgcagagatctggggtagtgcatcccaggcagagtgggcagtctcgaggccgttccacacaccctggccaattgcatttccatagcttgttgacgtgtttgagtttaaaaagaaaaattgatttaacattgttttgtatgtatttttggcttaacaaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatgggtaagtttggttttctacatctgacctagagaattcttacctttccatcacttggtatttttcctgctaccttttcttggcccttttctggaaaatgcaccccagcgggttcacttcagtgtaatcctgagttaggctgaagataggtaagagatggactaattattttagtgaagtaactctttcctatgatagtcatcaaagaatttgaaggcacccagagtttgatgtttaagtataatttaactttgatctcagtgcacctcaccaatcatctgtgacacaccctgatgttatgtaaggaggtttgatcagaaatgacctcacgtgctaaagtaggctgaggggactgccttgggtgtgatgtggttggttgagtcagagctccagatggacagggagtgtccatggttctgtgcgagaagagagcaagtctagacctgggtgtaggctctacctcaggcgttgcatttcactgaggtctttggtgtttgggaacaagcttgtcttccttatatggcacaacttctgctttattagtagacaaggcaaatgcccgagaaccctaaatattggacttttgataaatcctgtgggctgagccacatacacatttcctactccccccgtcaatctagacctttagactaactgggagacagctggtgctgcagagccacacactggctctgtgcctccagcaagccgtatgctctgtctcccctgcttcccaccacatggaatgcagaagggaactcattcattattttaaatacaaaaaaagtaatacatgcttattgtaatagattcatgcaattcagaaaatgtaaaaagtgaataacccctagaggtaatagtaacagtttggtatgtatcctttcagacacagtgatattaatatatgtttgtgtacacatcaatatatacccacctttttaaaaagtaagaatatatttccctattctgctctgtcttttagttacttaatgtcttttcatgtcagtacgcagagatctccttccttgttttcagtgctgtgcacgatttctttatatttagccattagcctgttgacggcaatctcgattgtttctgttttctttattacaaataatgctgtggtctttaccatttgtgtacacctaactttatgtatacatgctaaaatcatggttggataaaaccctagcagtaacattactgggtaattaccataattagataagacaagcttttgagtcagtgaaacactaaacgaatgcagtgacggaggcttacagtcttacatcgagatgcctcaaatcagtgcatttattctgaaagaaaacaggtgggtcctatattggatttccctttgcatatttttattgctcttttaaaacccagtatgaaaagaatatctaaataagtccattgtccctgatggtaggggcgtgggctggtttggagatcaagttacccttcccttttttctgtcctgcacacgcacatacatacacttttgtagctgaagaaattgtgctccaagagaaacctgtgtgtgatcataaaatttaatgagtaacaaacacagaaccagaatctaagaggcttgagttctaggttagtgttttagggtactccatgctgttacgagagctgggtctttggtggtttgcttgcatgtgtcttaaaagtacctttctccacccctcttcagcaactgtttttcttttttctttctaaagatgacatcttctccactggtatccaggctaagacaaccaaaccaaaaagccgatctgcacaggccgcacctgaaccaagatttgaacacaaggtgtccaacatctttgatgatcccctgaatgcctttggaggccagtagagcacacagggtatccacatgttaccctgcagctacattgttgagttagtgatgatattgtatatgctcatggtcttaactggattacaaaaagcaaatactagaacagctagctcatcttttacccaatgtacttagtatttttctgcactggtttaatcatgcttaatactacaaaacaaaaataaatatttcacagtggttggtttgttttgtttttaaaccacagtttgatttagttagccttgctggggccataatatgcttcagggtgtgtaaaagaagaaatctctttgtggctttcatgggcagggaatctcagagatagcaaatgccacctgaccagaagtctttgttatatggatgggaaccctaacttagggcttgggcaggggaaagagaaagaagatgagagattatacttcatgagtcttagcaatatgggagcaggttttcactgaattctgagggtgcctctgcatgtcctccaaggcaaagtttggcaaactgtggcccccccactgtcatattttgttaataaaattttattggaacacaatcaca

SEQ ID NO: 2182 - DNA, 65766 bp, Homo sapiens; identical to SEQ ID NO: 2181

SEQ ID NO: 2183 - DNA, 65766 bp, Homo sapiens; identical to SEQ ID NO: 2181

SEQ ID NO: 2184 - DNA, 21873 bp, Homo sapiens
atcaatgcatatttatgaactttatttcaaatatattttcacacattttatctaaatacataatacagaagcctgtgtgacttgggcaatgtggccaggagggcctgagactaacaaatccaccttggcaaaaggacataaaatacgtcttatggtcagaaaaatcaacattttgtgtatttacttagtttacgaaaagtactgaaaatgctattattagctgaatttgtgatttccttttgaaattctgagttatccttatttttcccattttgtttttgcaccaaggagactgcagtcaaataaaacagatactacacacacttgtcggggcagccgtactgcagaagcacgttgatgcactcctggctggaggcctgccgggcgtaggtcagcgctgtgttcccgtgggcatctcgggccatgacgtccaccccgtaccagatcaggagctgcgccaggaccacattccccttgcggcaggccagatggagcgccgtgcagccgtctccctccccacaggtctcgttcacctcctcacgggagccatgtgccagcagcaggatggctgtctgcaggtcctcatcagcggtggcccgcagcagctgctggcccagggacagctcagtgcagggtagtggggccagaaagagcttctcctcatatttggaacggatccaccgttccttctcttccctcgtggacttttctgagggttttgtctgcccctggctgctcccttcccagatgctgttggctaggtcattgccaatagatgacataaccttcctgagctcaactggccagtcatccagctccagagatcgcacacgggaaaggcgggtgccaagactgcggtggattcctgagcattcaatacacatgaggactcccaagttcaaactggcccacttaggattctgggtctcacagtccacacagtgggcgttcccacgcatgttttggatcgactgcagggccatggccttgctctggctggtcagctgggacttgcttttactgctctcgcatgactgcaggctggccaggatctggctctggatggcttggacccaggcatcccgctcctcatacgtcgtggcttcaaagtgccacgtttggccagtggcagacacaatcataaagttgttggtgcttttcttctttaggtgtttctttttattggcatgaggagaggggggcgggttgagcttggggctggtggtgctggagatactggggctgaagcatatggagtcacccagcccggtgtccatgtccttggataggccattgcttttagaggtggagatgggtgtgcaggccgatgtggctagggatggccactttcctgggactttgatggtagatgtctgaaggtcaatctcttttttatgaatattcttcatataatcacctaagcttgaataataggtgagcacgccattggaacacagggtgacgtatttctttttccatgtcttcagccatttcccacttcgctttaagagcatgccctgtttaatggggatggctctgccgctcccgatggtgtcagcatgattctccggggctttcctctctttgtctgggtcactccctttctcagatgtaaacaggttggaccagcgcatggaccgcttgcaaacgggggtgggtgtgttggcagtgggaggaacactgaactgagggtcctcctggctggtgctgggagtcgatggaatggaggaggaatagttatttaaactcccacctccatttcttttcttcataatgtgcacggtggaaacctgtgtggaacagaaggaggaatggcttcaaaaattgggtagtggcttgcagggtcctatagacagctcacaattaccttttaaaaagatacattttctgggccaggcatggtggctcacacctgtaatcacagcactttgggaggccaacgtgggtggatcacgaggtcaggagttcaagaccatcctggccaacatggtgaaaccctgtctttacaaaaaaaaaaaaagaaaaaaaaattagctgggcatggtggcacatgcctgtaattccagttactcaagaggctgaggcaggagaattgcttgaacagggacctgggaggcagagcctgcagtgagccaagatcgcgcgattgcactccagcctgggctacagaaagagagtccataaaaaaaaaaaaaaaaaaaaaaaagatacattttctgttgtttggatagtatatttactcatactagctcactaactaaacagagctgcagatcagttcttactccagcacattctttttacaacacttaagatgactaaatgcaacatgaaatggggaagatttaaaaaaagatggctttgacttcagcatgaaacagatacaagtgtacgatgaaaatacaacctcaataaaagtgccacttaccgcaaatgagtgtaactgttcatcaggtatgctcaaagatctatctgcatctctataaaataagaaagcgcattacttcaaaaactgttaatatcttagtataatatttgtttagtaaaatactgcctcctgtgtgctttggtgtttactttaccaaagcagtttttacgaattcttctcttggatcctgacttgcagagggtttcctgacttcttctttctcagcacatcatggcctgtaccgtgaagtcttttatatgataaccagtcagaaatgcccgtgagtattgactctccctaacaggccatggcaataaaccaaacatattttcactcttctaaccacacattgaaacacaagaatgttctacaaagcagttgtagtaaactttaataaatgtaaatgtgattcagatttcctagcttcctttctctttagttctctgtagtatactctcatgatgtatttatgtactttctgttgtttgaatgacaaactcatctgcctttttaagacgccagtctttgatgaactttaaactttgtaaaactaatgcattgtgcctgtgtataaaccagtggttctccaaatgtgctctgtggacctctcgggatcccgaagaccccttccagaaggcctaagaggtcataactgttctttttttttttttttttttttttttttgagaccaagttttactcttgttgcccaggctggagtgcaatggtgtgatctcggctcatggcaaccttcgcctcccaggttcaagtgattctcctaccccagcctcccaagtagcagggattacaggcacctgccaccactcctggctaagttttgtatttttagtagagatgtggtttcaccatgttggccaggctggtcttgaactcctaacctcaggtgatccgcttgcctcggcctcccaaagtgctgggattacaggcctgagccactgtgcctggccaacactgttctgaatcatactaattaaacctgagaaagctgatgaaaaattttaaaaatttgtgaaagtaatacaaagtcattgcctgctttttcattgacacttgccatgattatataaaagcaaaagtgggtacaatggctggtttctcagcataaatcaaggcagtggtaccaattacattagtagtcattctattcttcactgtcccctacaggtaaaaaacatagcctgaatttcttaagaatgtctttgatgaagcagtaaaaattaatgttgttaaatcttgacatgtctctaatattctgaataagtggaaagttaaccagaagcgctttttttttttttgtttttaaagaatccgtgatttaactgtgaactgaaaaatcacttttttcacagaacatcatttttatttaaaagtacaactgggccagcgcagtggctcacgcctgtaaaatcccagcactttgagaggccaaagcaggcagatggcttgagctccttcaggagttcgagaccagcctaggcaacataacgaaaccctgtcactgtcaaacatataagaaaattagcctggcgtggtgccacacatctgtggtcccagctacaaaggagcctgaggtgagaggattgcttgagctgagatcatgccaatgcactccagccaagtgacagagtgaaactcggtctaaaaaaccagttcaactatcattctcaaaaataaatgaagtgagaggttgtcacttcaagggaaatacgtatttgttcccaatgataaaatttaagctttcctgtggactttgaaaaacttgttccttctactgtaggcttggcagcttttcaatacttaaaggcgtgttaaagaaagattggtggttaaactaaaagtgatttttgacacaataaaacataaaccaatatattccaagtaactaatgcatgatattataaatgcaagtatggagcaaaagatccatttactgtgcaagaaagatcaatgagtactgatggaataaatttattaatatgtaaaatgccaccgtaactaatttaagaaaccaccacttgtgaagttttgatttagtgttaacaaatacccacaactgtctgaaaactttaaaaatacaccttctaccaactacatatttgcatgaggttaggtcatcttattgcttctttttttctttttttgagacagagtcgctctctgtcacccaggctggggtgcaatggcgagatctcggctcactgcaacctccacctcccaggctcaagcgattctcctgcctcagcctcccaagtaactgggactacaggcatgcaccaccacgcccagccattttttgtactttcagtagaggcgggttttaccatgttggtcgggctggtctcaaactcctgacctcaagtgatccacccacctcggcctcccaaaatgctgggattacaggtgtgaaccactgcgccccaccagcttattgctttttttgtttgtttgtttgtttaggcagagtcttgctctgtcacccaggctgcagtgcaatggcaccatctcagctctctgcaacctccgcctcccaagttcaagcggttctcctgcctcagcctccagaataggtgggactacaggtgcgtgccatcatgcccagccaagtttttgtatttttagtagagacggggcttcgctgtgttagccaggatggtctcgatctcctgaccttgtgatccgcccgcctcagcctcccaaagtgctgggattacaggcgtgagccaccgtgcccaacctcttattgctgctttaaagcaaattgcaaagaaagctctagagaatccatttgtctcctattaagctcaacatgagagactttaaataatataaatacatgacgcactttttactcaactttttgttgtagaaaagttatttttcaatgaaaaaattctgttaacaatactgttctcaaggaatattttctgttgttataacctgggtcatgggttactactgatatctagttggtagaggccatgaatactgctaaactctctgcaatgcacaagacagtcctcacaacaaagcattatctagcccataatatcaacagtggtaaggctgtgaaatcgaaactaaaaatagattttgaaaaaatttcaattgtataattctaccacactaaatatcaatataatcaatataaacacatactctttgagattctcaatcatttaagaattatgagagtcttaaggaacaaagaaaatacaaataatttgcttcaatattttagtaggcacaatacagcttatgatgtctagagctgtgacctaacactgagcttgatatcttgcaaagtacttagctagaataacaagacaggtttctaaaaagctcacctttgtgtgatatgatgaggtatctccaaggtcacactgtggaaggaaaaaaattcataacaatagatgttaacatttgttaggcctgaagacattttttaaaaggggggcagaggaaactctcctagtggccctgaaattcaaatcttctagttcagaacagtaccataagggcactttgttttcatttctttgttttttacaaaaatatgagaaccaaaatgcaaggaaatatgccgttagaagacgcgtttctgttggtgattacaatatataaataataacagatttccttgttatatgcttttctacccacgaaacctttcgtcccatgcgatttattttatgtatttatttattttttgacccagagtctgtctctcttgctcagactggattgcagtggtgccatcttgactcctcacaacctccaccacccaggttcaagcgattctcatgcctcagcctcccaagaagctgggactacaagtttgtgccactatgcccagataatgtttttttggggggtggggtggatggagtttcgctcttgttgcccaggctggagtgcaatggtgtgatctcggctcaccacaacctctgcctcccaggttcaagagattctcctgcctcagcctcccaagtggctgggattacaggcatgtgccaccacacccagctaattttgtagagtgaggctcaaaacaactgagggaaggcaaatctcaattctactaataggtctacacaatattagcactttttaaaaagcctgtaacattagcaggtaagatggatatgtctatagtgcttcaagtagttttcatctctgaaataattttaaaatcacagaatttaaagttacatgctggaaaggaccaatgaccttatgtgacatttaattcaacactcgttttacagatcagggaaacagaccttaaaactgacttgcccaaggtcccaccaaattggagcagtttctcgtcctaaactcaaattaagcagtggctgtcaaactttgctgcacattaaaatcgcctgagaagctttaatatctgcctcatcttccacatgagacattttaatttaattagtattgggtatggctttgggcatcaaggttcttggtaaacatttcccaggtgatttcaatcagcagcaaagtttggaatgattgagttggggtgaaaatcagaatcttctgggatgcttttcttcacagaaagatgcctcacatccatcccgattttcctaaaaggcttctcagtgcctagagatagagggaaagtggagatgggaagatacatgtgtttgcagacttgtattttgaaaaaaaccttgcataagtgatctcagcgagttccacctatcccactgacaacagtgcactactgattcatgataaaacatttttcaaaatatcttcttgaagccaatttgccctattaatttgttcaataactttatttcaccaatagtgaatacaccaaatgatcatttctcaaacttgctggtggcaaattaaaacttactatactctcaaaagtagacttctaaaaagtagaataatgaggaaaaaagcacgaaatttgtttcagcaaaattaatcttcaaagctgcttttgaattatatgctaacatatcaaaatctttggaactcagaagaagccagggactctagtcaaagtaatttttgtgtatgtgtgctcagagatttaagagacttagctgactacagacatttagtgattactcaataggtcccaaagctcaggacttgagacagagtttgagtccagtttttgttcgaaacacaatttcctctcaactattgttaaaagggagggaggaaagtgacattattatgagtgtaaactttccacttttaattgaagtaaaagttattgacaattgaattagttaaaaaggctagtgcatttgaaacaaaattgtttataagctagttatgtgtacagaatgaaaagttaaattaaagataaagacattaatattctaaattagcactttccaaactgtgttctaaaaatcaagactaataacccaagaagatgagaataatgtacactggacagcccctgtggagctggtggtggtgttggttgttgttccttttaaaataaacttcatctcagggtgctctcaaagcgcatctttgtggcccacgaggtgctcatgcacaatgggagaaattcaaatgcagatacactgtggtgccagaagaagaaaagctgttccttcttccaaggataatgtccaaagtagtgcacactgatttaggcctatgatgcattgaaaaactaagtttccacaaaaaacattcaataaagggaacctatccttctcactgtgttcaacattgtctaaaggcataaaggcatcaaaaagatacactgtttctgggattgcttctttgctaactgatttttccttccaccacgacgtctaagattaaaagagaaactgatacttaatattcagaatctggatatcaatatatggttgactccaatttcttaaactgattgctgaaaaggacaaccaaatgactgaaataattttagaataaaggaatctgtccctcggcagcatagttgtactcacgatattattgtcattgtaagataatgctggatggctgtgctgtcatcaaggaatattgtcgaacacaagctgtattgttgactgaaacgcacagtagatacctgaaggggaagggaagtgtaagtcaaacttatcaaagtgtattattttctcagttaaaatgtcaaatgacaaagcactaagatatgtcttacactccatgaaatgcctgagtgtggtatcatgtgcactctatagaaaacccattggaggctctcaacttccagagatgatgtttaagatatgggttataaaatgctgcccttaatatggtacctgtcatcaaacctaacaaggattttatgaattaccgttaaaaataatgggaaaagtcggcttcgcggggcacggtggctcacacctgtaatcctagcactttgggaggtggaggcgggcggatcacgaggtcaagagatcgagaccatcctggctaacatggtgaaaccccgtctctactaaaaatacaaaaaattagccgggcgtggtagcaggcccctgtagtcccagctacttgagaggctgaaacaggagaatggggtgaacccaggaggcggagcttgcagtgagccgagttcgcgccactgcactccaggccggcagacaaagtgagactccgcctcaaaaaaaaaaaaaaaaaaaaaaaagaaaagtttaaaataagatttcatttttttttctgcagcaataaaaagcagctgagaatttctattaattaattaatttatttatttatttttgagacggagtctcgctctgtcgcccagactggagtgcagtggcgcgatctcggctcactgcaagctccgcctcccgggttcacgccattctcctgactcagcctcctgagtagctgggactacaggcgcccaccaccgtgcccggctaactttttgtgtttttagtagagacggggtttcaccgtgttagccaggatggtctcgatctcctcacctcgcgatctgcctgcctcagcctcccaaagtactgggattacaggcgtgagccacggcgcccagcccttctattatttatttactacgataaaatgtaatgtattaaataatcctgctacaagagcattttattgcagtgaatacaagactaatgcatttactaaattactaatcctaaatgtattatttcaggtgatattgttacaaaagaagtgtttcagattcagaggctctgtgtgtcagggctgctaggccaccaacaagtgaggaagccataggtttctctagtcctattttcttatgtggaggataaaaagagtatcacttacatattctctcacaccctgaaaacaaatgacaacttaaaaaatctaactttcacttcatgtttaaataagactgccaagacatgactcaaatgagactctcggagaatactttgcattcacttcaaaacttgatcaattgcattctataaatcatctgacctgcacctagccattttcctgctctacccctgctctctgcctagaatactgcttttctctttccttgcttcagcaagctcgactccatctaccctcttggatctctttgtcggcagccacaccaaaaaatgtatttttatacactaattagttgaattcaccactgcttacaagatgctaattcctgcagagtattccccttgtgagaaagtatgcctctccataagagtaagggagggcccttactcttcctacctccagctgctgagcatagaattttgagtaaatccaaaacttcgacaagtgtttgacaattcagttatcatttggaaggtaagtcttactacatttaattacagcaaaaacactactaacagtttactctttataggtattatttaaggtagtcacaaaatagaaacaaacactctaacgtcaggcagcataaatgagagtatgaaattttacaatatttaacaagaaatggaaggggttacttagtagttttaaggtttaatgacaaaaactagaaaataatcgtacctagtaatttagtaagtcaaaaccaaagccttaccatcaaaggtgcagtacccattggatgcggatgcccacgcactgacttcttctgctgtacctgctgcctctcattttaacccattaaaaatactaaagttgttttccttgtagacatctttcacctccttggttaggtctattcccaagtattttattttagtttagtttagttttgcagctatcagaaaaggggttgagttcttggtttgattctaagcttggtcgcttctggggtataacagagctactgatttgtgtacattaattttgtctcctgaaactttgctgaattcatttatcagttctaggagctttttggaggagtctttagggtttcctaggtatatgatcatatcatcatcaaacagcaacagtttgacttcctctttactgatctgcatgccttttattgttttctcttgtgtgattgctctggctaggccttccagtagtatgttgaatacaagtggtgagagtgggcatccttgtcttgttccagttctcggggggaatgctttcaacttttccccctttcagtatcatgttggttgtgggtttgtcatagatggcttttattatattgagctgtgacccttgtatgctgattttgctgagggttttaatcataaaaggatgctgcattttgtcaaatgctttttctgcatctgtttagatgatcatgtgattttttgtttttaattctgtttatgtggtgtatcacatttattgacttgtgtatgttaatccatccctgcatccctggtatgaaacccatttgatcatggtggattatcttttttttttttttgagatggagtctcgctctgttgcccaggctggaatatgcagtgtggtgatcttggctcactgcaacctctgcctccgaggttcaagcgattctcctgcctcagccacctgagtagatgggattacaggtgagcgccaccacacccggctaacttttgtatttttagtagagatgggatttcaccatgttggccaggctggtctcgaactcctgacctcatgatccgtccgcctcagcctcccaaagtgctgggattacaggtgtgagccaccgtgcctggcccgattattttttgatatgccgttgggaactacaaaacgttgctgaatgaagtcatggacacaaacaaatggaaagacaccccatgctcatgaatgggtagaatgaatattgtgaaaatgaccatactgccaaaagcaatctacaaattcaatgcaactcccatcaaaataccaccatccttcttcacagaactagaaaaaacaatcctgaaatttatatggaccaaacaagaaccggcacagccaaaacaaaactaagcaaaaacaacaaatctggaggcatgacattacctgatttcaaactatactataaggccatagtcgccaaaatagcatggtactgatataaaaataggcacatacaccaatggaacagaatagagaacccagaaataaactcaaatacctatagccaactgattttcaacaaagccacctaaaacataaagtgaagaaggtaaaccctattcaacaaatggtgctgggataattggcaagccacatgcgggagaatgaaactggatcctcaactctcagcttacacaaaaatcaactcaagatggatcaaggacataaatctatgacctgaaaccataaaagttctagaagataacattggaaaaacccgtctagacgctggcttaggcaaagacttcatgaccaagaacacaaaagcaaatgcaacagaaacaaataggtgagacttaactaaagagcttctgcacaggaaaaggaacaatcagcagagtatacagacaaccacagagtgggaggaaatcttcacagtctatacatctgacaaagggctattatccagaatctatgaggaactcaaacaaattacaattacaaaaatatggaaccagctcaaatgcccgtcaatcaatgagtggataaagaaaccgtgatatacatacatatatatatatatatgaggaataccacctcagccataataaggaataaattcatggcattcccagcaacctggatggaagtaagactattattctaagtgaaataactcagcatggaaaaccaaatatcatgttctctttcatacgtgggagctgagctatgaggatgcaaagccataagaatgatacaatggactttggggacttgggggaaaggctgggaggagggtgagggataaaagactacaaattgggttcagcggatactgctcaggtgacgggtgcacctaaatctcacaaatcatcactaaagaacttagtcatgtcaccaaatgccacctgttcccccagaaacctatggaaataataaataaataaataaagtacagcatttttctcagcaaacataaaataaaacaaagactaaagttcatatttttcactctccttttgggcaggacaaattttagataggtttttaaagaattagtaacttttttcctttttccgagacagggtctccctttgttgcccaggctggagtgcagtggtgcaattatagttaactgcagcctcaaactcctgagctcaagcgatcctctgcctcagcctcctgagtaggtaatacgaaaggcgcatgccaccaggcctggctaatttgttatttaacctttttgtagatatgaggacttgcgatgttgaccaggctaaaaatgaacaaatcttaattaacttaaatatttctaacactttgggcattcaggaaaacagctccatctatgttgtgaagtaatgggaagtatatggcagtggataaactttgaatgaaaatattaaacaaggccttaggagaaaagtgtaatatgcttattatagatacattaatttaaaaaattctctggcttaatatcattaattatactcaaattagactttgatttaaacacaggtcctaaatttggattaaatataatagattgaccacaaatttatttcgtctccctccggaagcctcatcagtcataaaataaaggttacacccatgaccagcacagaaggttgacagagataatttttaataaatgctgagacataaaaagtagataaaggagtggtaaataacacagaaacacaactttggtgcctacagaaagtgactggaacagaagcgagccagtttgtcttgcagaactaaaggcaggttgtgaacttacaggcaaatggcactttggaaagtagggtaaaatgtgaaaaaaaaaaaaaagccagcaaggtcagttgcaaatctctaactagagccccaagtccacctgtccttccatctgacaagaaacttagatgtgtgttctctggatatatcaaacctgagaatttctggctcagagataccatggcttaaacctgagatataaagaaaactgtacaccaaaaatggaactccaactttcttcgctaactctgcttttcctttccaggcctgcttttactttccaggcagaaaactgggagatccttctcagaagaaactgaaatgtcttcaaaaaagatccccagataatacactgaggtctcccaaatgaaaagctagtcaggcttctaaggcctcacactgagtgctatcagttaacagaaatcctgcttccaaataaagcaggccaggaaccaccacacattggagggaagcctccaagaaaagagatcaaaacaatagaaaaaaggaattgataggaccagtcaaaatcaggagcaaaactttaaaaaaaaatcttaaaacactctcaaaaaatataaaattcaatagaaatagtagaggataaagtcacagaatatcccagaactagaataaaaagacaaactgaaaaaaatacaaggggaaaaattaaaaatcaatgcaggcgtactggtctaagcagcctagcatctgaataacaagactatcagtaaaaaagtaacagagaaaataaaaaaaaaaattctcaagaagagatagtctgcaggtttagtagcctcaataaaatgaaaagatccccaacaagctgttataaaatttcagaaccttagagagagagattctaaaaagcttccgcagataactaaaacctggttgtaaataacatatcacacactggcaatagattcaagaacaacactgtaataagagcacaactgcaaaatgtcttcagaaccatacaatttagattcaacctagaggtgtactctctatcaaagaggagggattttaacatctccacacaggaaaatgtgttcaagtacaactagagacgataacaggacagaaggaaacacagaatctaggactcaggcgatcccacacaagacagcagttacatgagataccaaaagactttaaagagttagcccagaaaagcagacattgagcatatctagggaaacccacgctatattgaactaggatgacaaaaggccaaagaaagttgccccccacacaaacataaaaaggaacagatgtgttttcgcagatggaaaatatctttgaaaggcatgtgataaatgctacaatacttgggggaaaacagctgttagaaaacaggcaaatgaatatagtcagaaaattagcttcatgctaaaaaataatggatgtgaaagcaaacagagcacccagaggctacttaacgatatttggatagataaactaacgtaggctaggaaaaaagaagatccaggagaattgcagaagtgctcagatttcagaactgtttcagagacaggatgaaggacatggaatgcagaggcacagtgaaaacaccatatgacttagcagtgaataatatttgcagagtcataatcatgtaaatattactgatttaattaaaaagtgtgctacaattggaagaaacacagggagaaacataagatcatggtgtagcggggaaggtatgcttttacctgctgtgacagaaagtcaatagacagtgctggcaattaacttagctattctatttttgttctttcattaaaaataagattaaatatttaaggcaattttttttttttttttgagacagagttttgctctgtcgtccaggctggagtgcaatggcgcgatcttggctcactgcaacctccgcctcctgggttcaagtgattctcctgcctcagcctcctgagtagctgagattacaggcatgcaccaccacgcccagctacttttgtatttttagtagatacagaatttcaccatgttggtcagggttgtctcaaattcctgacctcagatgatcagcctgcctcggcctcctaaagtgttgtgattacagacgttagccaccatgcccagccttaaggcagatcttttgaaccggactattgaaatttaacttaaatgtcagaaatctttaaaaggtggacacgctaaactaagcacttttctggataaatttaatactcaggaaaatagaagagatttagaaaatccacaaaaagaggtccatgctaccaccaccaggtccacattgtaatttaaagaaatcaagagagacatccttttatgtcaaactatcaatttcttaactatttgagtgtttacttacatggtttgtacagttgcttcttcttatttctacaactaagaataaaaaaaaaaaaactggtcacttctgatacaaataccataaaataaaagtagttgttaacatcttactgattactcctatgaaaaatgagacaaaattccattaaaaaaaaaattttcaataacatataatttaaattatctggcatgattaatttcataagtcaaatctaaaaacttagattttcatttagtttactttttgtttctattacacacaaatgaaagaatcctcatgtacaaaagaaaagggcaaaaaaattaggccagatgaaaaatttagctaataaaaagtttaactgttgcatatatgagccatgatccattagtattctctcattctgcatttacacatagcttactttaattatcagactctaagagctaacagttctaaaaactacttcctgaccagacacctatctctagatgcaacagaatccctgtaagcatcttgaaccacacttagtggttatctactaatatgtcactaaaaacaaaacaaaattaaaaaatggtctttacacaactggaaagtaacctatcttaaatttgttttcttttttgagatggagtctcactctgtcacctaggctcgagtgcagtggcgggatctcagcgcactgcaacctctgcctcccaggttcaagcaattcttcagccttagcctccggactagctgggaccacaggcacgtgccaccatgcctagctaattgttttttgtatttttagtagagacagagttacactgtgttagccaggatggtcttgatctcctaacctcgtgatccacccacctcaacctcccaaagagttgggattacaggtgtaagccacagagcctggcctaaattttgatgttaaaataagtatacaaacctaattggacatggtgtctgcagcacaaaaaatcattttttttccctaaaaagaggccagaataataaaagccccaagagggacttgggccatgctttgtttcctacactgcctctgcctttgatgctgggagggccttgtaggcaaaagttactaccactgaagagtgagggacatggaatagcttttcttttactgcttccatgctctctaggtgtgagaagcccatgcctctggaaggaactgggaaatacaattctgatatgttttggatatgttgcccctccaagtctcatgttaacatgtgacccttaatgttggagacagggcctagtgggaggcgtttgggtaatggcagtggattccttatgaatggcttggtcccatccccatggtaataagcacattctcattatggtaatttaaaagactgtggtactggccaggtgcggtggctgaagcctgtaatcccagcactttgggaggctgaagcgggtagatcacttgaggtcaggagtttcagaccagtctggctaacatggtgaaaccctgtctctaccaaaaatacagaaattagccaggtgttatggtgcccacctatagtcccaactactcgggaggctgaggcaggagaattgcttgaacctgggagatggaggttgtagtgagccaagatcgtgccattgcactccagcctgggcaacagagtgagactccatttcaaaaaaaaaaaaaaagagtgtggtaccttcccccttcccctctctcctccctctttcacggtgtggaaccacctgcttcccctttgccttttatcatgattgtaagtttgctgaggccctcaccagaagcagatgttaaagccatgtttgtacagcctgaaaatctttgagccaattaaacctctttttgttataaattacccagccttaggtatctctttatagtaatgtaaaaaatgaagacaaattctaaccagaaataactgactcaagatgggcaaagtctactcaaactataaaaacaaaggttacaaactcccgtgttttactgtgctgcattacttcgcacattataatagaaccctcacttgtgttcttgctgtttaagtcaactggaaaacttggctgtgtatggcttgttggcaaataaatgaggatttaatataacattaagggaaataagcaggagtaaggcatgtttaaatttacattatatcaaatgaaaaagttaataacctaaaacttttgagtagcgtaaacttggatgtggtaaatgaatgtggtcagaggactgtgtaagaggaggcccaaatcacagattcaatccctgatgataaacgactatgttttttaatttgtttaaatgaaaaccaagctgaagttctatcattcatctttaaaatgtactttttggagcaagggaaaagggattgtaaataaagatgaatccattaattataaataaagataaatccaagaattataaagagaaatccatgactcctccatcacatcacaaattaattgtgttgataaaaagatggcaaaatgtataaacaaaaaggttacacgttttcactaacatcataacaactaaaggaaagtatatcacatattaaaataagacaagggaacatgtgaaaagatgaaaattttaaaccaatatgagtttttctaaatactttctataacctgatcaaacaagagcttttattctttctcttggtggaaaaaacaatgtcgtctcaccatctgtttgagagttcctctggaatattgtgcttgcctctggattggcagaagggttaaactccaaagctatatgcatagaggaagaaaagaaaaaaagatgtaatcattgataaaaatttatcaactcgtttattcgactgctgcatttaggctatttcactatctctactttgattcttatccattgaaatgaatgtatagacataagagagagccaggcaagatggcacatgcttgtagtcccagctactcaggaggctgagatgggaaaatcacttgaacccaggtcaggaagttgaggccagcatgagtaacataatgacaccctcctttatttaaaaaaaaaaaaaaaaagaagaggtaaattttggctttgagttgtgtaaaatcaactttgcataaaataaatcaagatggcagtaagttttaaaagacaggtctattttataggcaaaatataagatgtattctagagtttttaaaatttttaaaaagtaaattcatcatatctgtcacttccatttcattctgaggacacagaaccttagttctcttgagtagctgtcttccatagtcatgtgatatctctaagttttcatttcttcgttagcaacacatagggagaacatacacaggccttatttgtattggaaagggccaagtgagacatacataaactgtgttgtaatcctaaagaatgacaataaagagccatttttgggctctcatccaacactacccatctactaactggtgtgtaacatccatcaggctttccgaacatcaccaagcagagtataagtttacacaagtacttacatgctttgtgtataaaggtacaatcaattaattcacataatacatttgtttattctaaagcaatccttaaatatcttgaaatgtgaagatagtacttccaagttacaaagtcacactcataatgagtcttaattatcctacctctttaaaaattaagagcgcaaccaaagtttaaatagaagagctataagacatttcctctacagtgatgaaatctctggcatttaaatgaaaacaataagcctactggatgtaatatgtttatgatgcaatgttttctattttgaaaatttcagtttttattcaagaaccatattattacccagaattacttttacttagattcatctctttgcaaaattttagaggcaaacgaactaattgttttctcttttctaccggctcccatcccctgcctctgccagcagtgtagagactaaaaaactccaactttctttcctttttttttttgtgagacggagtctcgctctgtcacccaggctggagtgcattggcgtgatctctgctcactgcaacctccacctcccaggtccaagcaattctcctgcctcagccttgtgagtagctggaactacagtcatgtgccactacgcccagctaatttttgtattttttttttagtagagacagcgtttcaccatgttggccaggctggtctggaactcctgacctcaggtgatccgcctgccacggcctcccaaagtgctgggattacaggcgtgagccaccaagcccagccaaaactgtaactttcttatctttgaacaagatgctattgtcaggaggggaagggacaaagggggagccatggcaacaaacactcttacagggaaggtctgacattttaacctgcaatctttatattacacattgaaagtctacattgacgtttcatgtcttttgaaagttttgaccatgaaccaatccccacctctcttttagaacaaggaggtaaataaagtctgttaagtcaccagaataaatctggagacacattttctgttaaagtaagaactttaacagaaaagagcttcataggtaaactcctttgagaaaccccaaacacacacacacaaccatttttctgcagccccggctgtgacatttcacacctttcacaattattttaagcactctccttttttctttttccttctgtgttcaaattacagttagaagaaactaagcagcttctatcaaggtgacttaaagcagcccattaagaataccatatagcctctcccatggcaaactccattctgattttaaataagaaatccccaaatatttgaataggaactgtcttgagatttggctactttaacaaaggaaacaattaggcacttacctggttccttcacttaggtaccatctggataggtacaaagaaaaaataagatgggtactgaaaagttgggatatttgagtttttattgagaaaaggaagagaatagctcaaagaagcctaaacaaagtcccacaggataataaacagagctacagacactgttgtctcaccatctgtttgagagttcctctggaatattgtgcttgcctctggattggcagaaaggttaaactccaaagctatatgtatagagggagaaaagaaaaaagatgtaatcatttataaaaatttatcaactcatttattcaactgctgcttattcgacaagagccataaataaatggtcccatgccagcctgggagaatgagatgagagagcaagaactgggcgattgggaggggaggcgaaaagaaactgactggactcggtggggaaatactaaggggtgggaattcaaggcagagccagcttttgttcctggccagctcccgggaaagctggctacaagcagaaaggagctcgaagtgggggatgcctcaaagggaaccttggggacagtagcagccagaggcaaaccgagggtagatggcacctatcacctcctcaccttcaggcatctcccggtcacgaacgtggtgcatgtggaggtcctcaccaacttcaacagtcacctcagcaggctgtacagcagcagccatgggcgctcctgccatcctgtccccagctcctgcctcatagatctcagattcagagggacacaccgacccctgctgctggtcaaactcgaggctgacgctagggtgcacacgacaggtcagtatgttccccatggggcgcctctactgtctgccaccacctgtgcctctgctcacagctttggccacgcactcccgctgtcctaggccgaggctatgctgcacttgcagagatggtcttcccgctcctcgcctgcccac

SEQ ID NO: 2185 - DNA, 18655 bp, Homo sapiens
ctggctttgaggagcccccaatttaatgagaagttggagcagtaaagaaatgttacagtccatgtaggaagtgctatggtagaggcagctggagcaccttaccgagctcaggagaccaggggggtgggggggcttgccagagggcacagcattgcaagcagggcaatgacccagttctaagacagactcgtcacatggcaagcagagtcggtcagactttggacaagtttattgacttctttggaacctcagttttctcatttgacaaaactagatggtcaagaagcatctaggattattgggacacgtaaattacataattctgacacagcccccccaactctgggttcctggtatggggtaagtttttagtaaatgtgagatgctgtgattagtactgtgaatatgatggctatttcaacagaagaattataaagaaagggcttcaggaagggattgggagtgactcaagcaggcaaccatcaaagcactttgtgcaaagatcaggtccttttctgagcactgaaaatttgcctatttagagatgcggcaagctgaagtgacatttactccccgcggaaggacacaggaggcagacaagtggtgaagctcattatctggtgatgcagccgcagacgtaatggtcaaagaacaagacttccaggggctgccccaagttcgccacacacgcctcttgattagaaagaatagtccatgcaaaggtagggcattttacacagcactgcagacatgcagagaaggtgctcagaaaatatctgtcgaaagtctggttagaggagatgagaaggaatatctaagagaaaagcacaaagatttagcaaatacatggatcctcatttctcagcctccttacccccacccaaatcaatgggttggctttgttatgtgctgctgctctccttctcctttcctgcattgcctctttctcttaaaattggctctggtgcaccccaatagctacaaacccttagatacccagagagcacgtcctcctccccagtagagccggaagcatctgtcccaaactgagcttcactgtgaaagagacattatttccactcatgagagctacaaggtatgtgaaatagtgaatttcatgtaaatatatgcacactcaagtgtataaaaaagaaattattctacaaagactgaagaggaacactcactgtcaaaagacatttttaattcttgagcatttgcagggaaaattgactttaagcttggctaaatcatgtagaaactgtgttttcttataaacatgggaaagaaacattcaagaagttttatcaaagaatgggaaatctagcctattgcccaggcctaggctcaccactgtccccaccacctcaagcagcacccccttccctcctttctgagctcactaagccttgttgaggagtggaagatggcagctgtatgtgtccattggccactgcagctgcctcagtgtccacacctcacctcccacccatagactccctccacctcttctaataagctccttgccctctggttttgattctgagctccagctactggctctgcctggacagagacctagagaagccatcagcctgagaggcaagaggcaaggcttcatctgaggttcaaccaaagaaaaagcgatttgctccccacttgtccagggggacttggtggtcccaagggtgaaatcgtggccatcatcccaccacaagttgggagaacgactgcctttccttctatccttttgcacgtgccatcaggctgcccttggagatttgacctggggctcaactgtggacatagggaaagggtgaatagggaataaagaggcaccagaagcctgtatgcctatttcacagaaagggcaagacttggaaatttggagaatttcattaagatagagacattctttcacagcaagcctcatgttttgcatgtggacatgatgggtaaagaggtggagttcttcacccagggttcaaggccggccagctcatggctaatgtagcaggactttcagcaagaccctgatgctgtcggagtacacggggctctctgctcaccccctgattctgtgtaatgatctcagcttcttcctgccctcactctctgcccaccaagctgtccaacagaaggaggcttttatagacagatgataactagaggagaatctggagatttcacttgggcttcctggccagccatgtctcccatacaaaccagcaggaccccagaaccagggtccccaccaagtcctgaaactcttcagtgggtatttttaagaggaatcccagttcagctctgaagtcagtgaaaccattctgaaggctctgcttgctacagaatgtttactgagaaaagacactgtgcccaacttttctggacagctgtcctttaaagacttgggccaccaaattcatctctgcctttcaggaggaaattcatagaagcagattgggcatttcaggcttgaaatatgaaggtattataattgtcctatttacttacggttaaactcacaacaaagtttggggtttgtgtcccttcatgtctccagttctccaacatcaggccccatactgatgtctccattagccctgatgacacagctgggagccccaggtctctgctcctgacaactgcatttagttttggcaggttggatttacagtatctctaagacatcaaagtaaacaagttcaacggactgccagatttgaagctcagatgataaatctgagctgaagtacaatacttaggatttgtcacagtagtgtggacagatacccctgggtatctggggatacccaaggatagccctgggagcctgtaaggtgtaaagagaatcctgctagaggcagcatccaggatctagcccaggctctgccgcctccctcactcccctcagccacactccaacccaagagcaggcatgacatctccctcacctggcaactgcatccctccctaactactctgacatcacacctggcctggcccctgcagttgagtgagatctctggcctcctaattatcttttgctattccaggcagtgcccttccccagaaggtatatcataactttaggttcatttccaggagtcctgcttcattttgctttcttaaataaatgaccatcaagatttataccatcactttcacaaagtgatgcttgtggaacttacgtgcattttacttacatgagtttaatgatatgtgctaggcaaaaagagaaagagaaagataaccttaaacattctgcaaagaccaactttccaaccgataagtgtaagccttgaagtgcacatgagtgggagaactaaatctttcatcctgtcaatctgtctctgtttctattgggccagcatttaaagacaaacattttgcatacagcatggcccataaatgcaagcctcctaacttcatctgaggctcgaccaaacaaaaagtgatttgctcccacaccaaggggcaaataacatcactccttccaaagtgatgtttcaagggtaatgagacttgatgtgattgttgccttctgcctacctttaggaactaaccttataaaaaacatgtctccagccaagctttccctctgataggcacgtaatccaactctccttcataaaaatgtactgtactgctttattacaagatatttttataaagatctactactagatggtaaaatctctagatatagagtgtgagaaaagagaacagggaaagaaagtgaaatcgaatcttgtccatgaacactttgggtttgctgtggtgctggcagccatctggctgtaggaaattgccacctggcagatggtaagttccggcaatttgctgggaatttcaattgaagggacctgttctttagctggaaatagctcaggaaagggaaggaaaacagacttgcattgagttcttaccgcatgccaggcactgtgacagcaccctgagcgtgctatttcttttgacctgcacagtaccctgtggaactgtcatggtccccatttacatttgggaagcctccagcttagggaaggcaacgctccaggcatactagtaagtggcaacgctgaaaccacataataggatacagaaatccatgctctttttgttgaagagtttaactcacagatgccagacacttaagaggcagtggcctgcgacagtcacctcagaactgagctgcaaacacttctaaggcttctgcagagtcacaatcccactttggaatcctgattcagaccctatccaggagctgggggaactgtgtccaggggtcgctgggcatgcgtccctcttttcttcctgtagggggcagccactatgtgtgcattaaatgcaaactgacgtcctattggaggagaggtggacttggtttgagttctttcagaggggaggaaaggttcctaagtgagggagggaaaacgaagtaaaaataaagccaggaaatgtgatgaggcagaaagcattcatcaacagaactaccacagggaggcaagagaaaaagggggtgcggttggccattgagagagccaggataccgagaacagtaaagctgcctgcccacagttcatccatgggtacatggaccatgtgggcccggcagtgagtatgatggttgatgggcgttcacaacagactgaagataggagactcccctggaatgctctggacaagcccttgggactctcgtgtggctctaaaaggagcagtccctccaagaatgacagattttggacatctggtatacccttgcaaatagggccactaagccaaatttaatttggttcagaaaaacagaataatgtgatgtttgatgaaaaaaaaaaaaaaaacagcaaatgctaacagataggcagaaataggtatccggacttggaagtagaagacataaagaggcataaagatgtggaagatgtgggagcaaatcactttttctttggttgagcttcagatgaagttaggaggcttgaatttatgagccatgctgtatgcaaaatgtgtaactttaaatgctggccctataagaacagcataacagcataaagatttcaccttaatgtaaggaagaaccttctgatcagtaactagatgatgataaaatgggtcattcaagaggtagcaagttccgcatccctgcagatattcaagcaaaagctgggaccccttcttcaggaatgttatggagcagattccagcatggagtttgaggctagactagatcatttttatattgaacaggctgattttctgtagtttaatgaatgaaacagtgactgcctatactaatagtttaaaataccattttaaataactattggctatattaaattaaaggcacttggcaagtcaaattcccagcttgtacctatacccagggtcactttataattcagctctcagggtccctgttcattatcccaagctatctggcagcaaaacctttcaatatccaaacaagtgcctcctccctacaggaaagtaccgttcctgtaatatatcctttaagatcatggtaatagttgtccttggacaagtctctgtaggttactttctttattattttatcaagtatgtcaattactgcctagactgcaattgtaaagaactataaatacacttatgttatacattatcagacaacgaaagtgaatatcattgatgaatgtgcttgttcaccctgttctactttgcaaaccagttagcttttgtttggctgacacagcattcttcaaaaaattgtagcagggtacttttagggaatgcatgcctggctcctgcttgtcacagctctcatcgggtccaacggtattacacgactgcttcacacttcacagagactatcatttcctatggatctacctttgacagtcgtctaggatggctaccaaatgagagccatttaatctcagtgggtttatagagtgtcaaacacaaacaattgccccttgttatttacctgctttgtgcccatgcctctggctggcaaatgctagaagcaggtcttaccctacatgtgcagccctctgtctgctctcaacaggtttccaagcaccttgtgtaataagtacttgtcaaactgaatcaaagactatgtgttccctcagcataggactgagaatcggaaatacttacagatggatggacacaaaaatgcagactaaatttaaaatgactgtgaaaatgaatgttgcagggtggtcttgaagatatagatgtgttcagaaaacaaaagctggtgtagccaggcatgatggctggtgcctgtagacccagctattgaccggctgaggtgggaggatcacttgagcccaggattttgaattcagcctgggcaacatagtaagaccccatctttaaaaaaaaaaaaaaaagctgatgttgataatgaagcattatactagcaatagaaacgaggatgcatgtaggaacttccttcttactacaaagctttaacaggccatggaagatacaagagaaaggtttgtgtgccaggagaaaacctgaggcctgccacctatagcttccaagacatattggggacaattgtggtctgggtagggtttgctttcccaaaagctcacaggtggtcacagcagcaccagaccttatgcttctcttgttgcaacctctcttctaaatgcctggaacagtgctgggcacaaaatcatccaagcatagttattgatggcttgattacaatttcctagcaatgagatgcacatagtttacaaaatgtctgcaaatgtggtgattcttaccttccaagtctcatgatatcacaaactgaatagcagttttgcctcacatccttttccaaagaggtcgccaatgttgattcatccctttcttggtgaagtttgcataaatgagggtgggactcaggagaatgtgtcaaggaactggcccaaggtctctctctgttttggccccattgtgcctctctgatggccttttgggaagactctggcctgagacccaggccttcccctgcatctggggaggcactgtccctccagctgtcctcttgatccaggatggggctggtacatgagtcagtacatgttgccctggtgaattctttgtcagctgagagttcaggtgtctattaaaagaaatgctactaattactggctgcgggatgcacattgtttttttaaaaatacaaagcttttttcccccatgtgattatagatcagagtagttacaagatgggctttgaggtctgtctatcaccatagcatcccagctcctccacatgctcccagctggacactgggcaacacactcaggcaccttagcttagggggctttggaagctctccataaatgtgagccttatttttaaataaaaaatatttgcaaaatttagacaaagataaaaatggaagataaatatgcaaaacaatgactctattccactttccgataagaaatgtttctttttaagtttttcatcttcatctgtcatctcagggcttgtctccctgtctccacccccatcaaggtgatgttctttcctgggtctcctcctcactttcccagacatgacttgcttcgtctcaactgctcacctccctgtcagccttttaggttctggttttgatgatgtgctatgtcttgctgccactgcttgaccttctacagaaaaacaatctgtgtttcagtagaaaactgtttttatctacagcagaacttgctgggttctctgattctggctgtctccactgtctttgagctattttacaactctataaataaacaggtcctttgaaatctcttttgagccagttttaacatctgcctggttccctcactgaatgagttaaataaaatctttaacgtgttcatttttatatctgtaggaatcatgattttaccttttcctgaaaattatcttccagcacttccaccccatgatctccatacctgatgtaatagagcccatgcctgggttcccacccctgccctcacctacaaaagaagaaccaccccaatgagtggtctccccacatttctgattgtacatccctaacaatgagagggatacacctccaaatgtgcacatttatttaattataaatcataaacatttactactcttctgatagactggacattataaaggatacaccaaaaatcaaaattttaagaagaccatattttgtcacattttcatactctttggagagacctccaaaatctgttttctaacctatcctctccttctagctcattatccctggacatgctctccagcaatccttccccactccaagacctccagtctgtggagctgctgcttttcatcattacccccactccccttccctgtcacacatgtcctcggtgtgcctcttattctgcttagattccatggctctgcccctagatgctcacttacagacaaggaagaccctgagctcccacctccttgcccctctcttcctccatcacgtgtcacttgcagattctgagtttccattttaattcctactcaaactgtgtgaacctcacccctgcttctgagcctctgactagattagcttcaagtgtgtgactgcagatgtcaaatgggcagtcaagacttccacataatctttgtctgtgtccttaatcaattcagttttctacctctgctctctaaattatttctcatcttgtctctctcttcaagtttctaacaactccaccctgaccttgcctgtgacctcacagtgagaatggacacgttcagatgagaactcttcatcttcccacagcaaattccactgagcagcctgtgcccctaccccaacttcagcttccacctctcaccacccatttctgtgctctacttcatggcagcctcttagatgagtgtctcttctcaccgtttccacgcctccctccttctttcttgcacccactagcaccagccttctgtccttaccacccaagggaaggagcccacatcagggtccccagcgacctctatctttctaaagctgaagaacaatattttgtcctttcactctctctctcagcaacgttcaacaaagtgtgtccctccctccttcctgagagcttccttgctcattagccctacttacatggagttgaccatgagccccacccttgcttggtttttccaccaattcccaggccccatcttaatctcatatgttgtcccatctctgtaccaggcctctcaatgttgttatgctctgtgctgacttctcagtcctctccttgaacttatctgcactctttcccaaggtgatctcaaccatttcatggctttacacgacctctatatatgctgacaactcccaaattcacttttcccagccccgatctcatgcctattctccacaactgcctaatagactcttcactggatagcctataaacatctcagttttaaatgataccaagaactattgtttctcttccatgcaccccagatggccttccccagcccctgtaagcagtccctctcttgggaactggtaccaagagagatgaagtggaaaataggatctatgattaccctcctaaagcatgaaataggtatatgtgatctagtgcaaagaagagaggtattggaatcaggaaaatcaggctttttaccttcttacccctccttcaccctgcattggtggtagcaccatttccccaaggcttcctcgtgccaaagcttgattgctctctttcctcatgcctgtttctaatcccaaagtagtctcctgaactccgcctcccagatgtatcccaaatctggctgcttcttaacacttcagctacagcctgagtccaagccacatcatgtttgacctgaatgactgctgcttgacctcctttagtccctgtgcaccagtaacccgagtggcccctctgaagaacggaggagggcatttcctgcttaaccctccatgccagcccagtggcttcccactgcatgcaggatggtggcatcatgctcctctgatccccaaggccctccagggtccctgccacctccacaacttcctccacttctgcttcattaacgatggcccaagcacacttgtatttttgtccctcaaacatccaagtgggttcccatctcagggcctttgttcatgctgttccttctgcctggaatgcccttaccccaaatgtgggcatggctgcctccttctcagaggtgctttactttatggactaaatgcttgctccccagagctgctgacccttgttctgcaatctgaccactggagccacccaagcaaatcacaatcctcccacttggccttcgggtatgaggagggaaagctcacccccacacctcacctggacccttcctgctagatctttatgggctctcctgggaggagctattctccaggatggaaataccacttttttccctgggatttcctagatatttcaacaaaaacacagggtcccagcaccttggcctgaatttgtgtgtgtgaaatttggccctctctcacctggttcggtttcttaacacaattgctgctgtctaccttcttttccaacccagcaacttttggatatctttcccatagctcttccctccctagaggctatgtcaaatgacctcttggagtctaagcatcaacaggatctgggacatcaagtcctttatgttgtcctagtgatggtgtcaccctcaggcacaataagtgatcacttttatccacatcctagagatgaggaatcatggggcctagagaggacaggcaactgcccaaggcccatgcagcacagcaggtacaggtgatccaggtacccgcccagatccccctccaggactgagattcgcatcctactgcctcatctcccctcccctggggcagcccacaccccagcgctggttagggcaacaagcaaaggcacaggttctcttgtcccaattcatggcagctccaaggggccatctctgctccagggctccctccagaatcagctgaggccctgtttatagctgcacattgatctctccttctgccccaccccacctcagtcaccctcacaggggatgttctcaagcgcaggccccataaaacctcccacgctcacatctctgctgcaaaatctgtttcctaggaaccccacagaaggcatggcaatgggtaattgtatctgtcaacttggctaggccatggtacacagataggcggtcacataccatctagatgtcactgtgaaggtatttttttttagatgtgatttgacatttaaatcagcaaactttgagtaaaacagattgtcttccataatgtagtgggcctcatgctgtcagctgaagcccttaagaggaaagactgacctctctgaggaggagggagttctgcctccagaccacctttgggcttgatctccatcaattattctctgggtctccagcctgctggcctcccctgtagaattggactggccagccctcaaaatcacatgaaccaattcctataataaatctctttctctcactctcttcatatataaacacacacataaacacacacacacacacacacactcattctatctgttctatttctctgagaacctgactaatatatgtgtcaaggtaaaaatccctattttcctgattccaatggctctcttctttgaaccagactgcacgtgcctatttcatgctttaggagggtaatcatatatcctattttccacatcatctctcagaatggaaattcttattggaaattcccttggtctgcttctgtgtctactctccttcttcccaggcttccctctctgatgcctgagcttccagagagcctggccctaaaagtttcacagccaaagtctaaacatgtaaacatctacaagaagacccaaatgtcagaagaggcagaatcagggagaggaaggagacctactgaggtttgggggccagctattttcctacccctgtgaaaggaggtggcactgaacctatctacaaccctcttaggaccctagagtctggaaaaggggggcccaaccagagccaggtagagagagtagaagacactgcagcctacctgccattcctgctccatctcaggcagcgcacctggagggggtcggcaaaggaggagcgtgacttcctgtggggcccctctcagtaaatgcagcacctcctgcgagaaaccaagattcactgttagatttgggcttgcattgctggggatgcagtgatgttctccccactgcgtcccaggcactagctcctcctccctgcaccttgatctatttctcactccagagaactccggagaaccctgctgtgggcctgacttttcaaagtgcaaggaaccaaggtcagtggcctgcagcttccacaaagttgatgcaagatgctgggctgtgcatcacctttgtgcagcttgggttctgggaacctctcatctgtaatattgcagtaacctcctctccgctccctgccttcaccagtgtcacccacctgcctccttccacattgctcaagggaatggcaatatctgccaataccaatgccttttcttcagagagagaaagaatgactccaacaaatagctgttcatctcaattgccctttcctcccaacctgccctcatcttgggccaccaattttgcagcctccaccatctgaatctctaaagcctgacccttggctctgagcttcctatcagggctcggcttgggctctgggaacctctcacctgtagtattgcagtgacctcctcactgcttgctgccttctccagtgtcacccacctgcctccctctgcaatgctcaagggtagttttccacagtgcagatataactgagtccttcccccactgcacaccctggctgactcacttttccctcaatgtaagctccaaggcatagcacatagaccccgtttctgcctgcctctgcctctcaccacagttccctctctcccatctactcccctctgcacccacgtcctaagcccctgccatgctgaatctgttgctccaagccaccctctcaatgtccagggttcaaggttgcctcgatagctcctatttcctatttagaccaggatttctcaaactcttggcactgttgacctctcaggctggacaattccttatgcgaatgcctgtcctgtgcattgtagggtgtttagcagcatctctgatctctactcactagatgccagaagcactcatcagttgtgacaatcacaaatgtctctggacttaatcaaatatcccatgagaaggaaataatctctgcttaagaactgctgatcaagacactccccagtccctgcttcagccacgcaggacttccaaggggtgcacttctttcctggctcactggtgtgagcactgcagcatgggctttcatctctcaggatacatatctcctgccatcaccgctgttttctgtccatgagctctgaaactgcatgagctgtcttcctctgtgtcttcagtctctcatagagttgccagcccagcagtggttctcagagaagggttcttggatcaggagatggatggatgaaggcatgccctcccacccaagcatatggtgttctagagacctccccccagccctgcccagagccactgtccccctttgtccatcttgctttgtgtttctggagctgacttataaaggctgcatgaggcttcctgttgggctcagctaggggaacacggcaagagaccagagacagggaggagcggaggtcattgctccttccaaattcctcccttcaggttgccatgggacgactacaacctcagccaaagtgagagctcatgccagcgagtcccctccaacagctctccattcctggggtggaataactgctctttcccttcccctttggcctcaggataggggtaactgcatcccactcttcctatcctagccctaggccacaacatgctcccttgagcttcctaacaacctgcccacacctttattaaatgttcctcaaatgactccattttcttccaggactctgtctaatatatacagtatttcattactctctcttcttaaattgcattttttatcatagacaggacaatcagtgtaataatgtatgaaaagctgtaaatgtgttgagaaatgggaaggagagcagaaagggacccactctagtcccttcagccccacgcccacctcccaggatgtgtgtgaagagacgtcagccagcacaaaggccagggctttatcttcagcttctctcatgaacccagtgagaagcaaggctgactcaaggtcagatatttaaaaacagagattttaaattaaatgtgagcatgtaccactaattactctctttgtgtgattaaaatccgggctgctggtgtgatttttgagagcccagagttttccccacggcagcaggctagtaagaggcaaagctggggccagcctgcacagagagctgcattgcccatgacccccggcacctggaagatgaggccttccgtggaccttccattcacggccaggataatgtcaccagctgcaatggccccattctcctcagctggctgccccggaaagagcctcttaatcctcacaagatcacttttgagatggctgcagctctctttctccatctgcacgaaactgaatcccaaaccattggcattcttttttagtttgacttcaaacttaggacctgtagtgtgggatgttgataaaaataaattcttcagtagattacaagtgaaattgaccagtctcaaaatgcagattgtcaagtagatgaattatttcttttacgttcaaataattcctttgctaattttatgacagagtacattatgtatgttatagattagtgctgtccaataaaatataatgtgagctataaatacaaaccacaaatgtcattttgaagttttcaaatagctacattaaaataaaaggaaaaagcaaacaaaaaataaataaaacaatttaaaaagtaaaaggaaacaggttaaatacgctataatcgtacatctaatttaatcccatatatctaaaatattaccacttcaacatgtcatcaatatgaaaaaattattaacgagatattttttattcttcttacgaactaagctttcaaaatccaatacatattttatccatttagattggtcacatttcaagtcctcaataaccacatgtggcaagtggctaccatattgaatagcacaattatagataactcaactatgtttatacataaagatatagctgctaggcatacacaacatgctcttggcatttaataaaacttgtatcacatacattcctattactcctttagaactctagtcatttgtagtatacttgaaactaaattttgaataattagaccatggagaaaattatggccaattctatggacaatgctttagctgccattttgtttacccatgtaggctgaccataagacaaaacagttgcctctgggcaccaaggatgaacagagctggcaacctacatggtctgtccaccaaagaggcctctgggctgccccgctggcatcaatgcacagagggacagagcacagcttgcaaacttcaccagggcaagaatggaagcatgtgaagcaattatgtgaagcaattatgtgaaggtgtgtcacacgaccagttctaccatcgccctaaggcctcctccactctttggagtccatttctcaaaggccccaagggagtgagcaaaggggtgaggacagaggagacttgatttaaacagaagcatgcccctttgccccacccctaccctatggctggcttgagtcttctgcagcaaaatcagaaaatctctatgaagggactaaaacatggctaaggtccaaatcgttcttactgaggaaatcagcgtgttcctggcaaataccaaaatcacaagggaattgcagatgggcagcccatcggaaaacgtgcagttttgtccctctaaatgatcgttcgtttgccttttaaaatgatgctaataacaaggctagattcctgaaccttctctcccaacctgcctagtcattcctcaaataactttgttacaaatgacttggctggactgtgaagccaaatgtatctgaaagtgtatgaccctttcagtcaatttcatcctaaatattcacacaaacattaacattctggcagctgatcaaaggactgaggaaggctgggggcagaaagatgcctagaaatcatttggggaaaatgcatttgtttccagaaacctattccatgagatgggcttccatggcatgaaaaagccgatctcagcatgatcaccatggctcgctttcttttcaggacccagaggaagccttcctgcctttcccttttgacttgacaattcaaaagcggcacacaataacatgacaatagtaacactcaattctctcccctctcaccatctgtcaccgagacacagctcgaaggcctgccaggcaaggctgttaccaaggaaacagccgtgcgttcatctcccatgctgtcattagcagaaggacactgctgtgtactcctggggactcttctctctaagaccagtcttgcaacctagaaggaaaggtgaacaaactcagtttacacttcatatggcaaccaggaggcactcccttgactctgcaaatgcttcttaattttcgaatccttcctataagcagactcatttgaatctctcaactagcctatatattgggatctagacccagatttctcagtgcttattagacaagtgcacctgaaagcaacacatgtacctccacttcacacatgcagtgccacactcatcttcctcccctcactcaccctcacttcccctcctcattcttcctaaaacactcctcccctcgcattggctcaccccaccattaacctgccaagggccacatttggagtggtccagctctcccccatctggtttctaagatgtgaacattccccatcaagaacagctcctcagtgccccctcccctccacctcctctctcactgccagtgacccgctgggccgtggcaagctctggttaccttggctcgctggaccctgtctgcaaccttcttggtccaccccatcatggctgccagtgaattggtctaagacaaaaactgaacatgcaacattcttgatttgaagtctccaatgcttcccatcacctaagacccaaacccatggcaccccaggtctgtaccacctgccctcccctttctttccaatgtgatttcccacatttctccccacaacaccatatacccttgtcgccctaagtgtgattcaagaaccagcagatagacatcacctggaagcttctcagaaatgccaagctcccattcagggcatgtggccctgccttcatcttcctgttgcacctgtcactcagcacctggcccaggatcccagagggacaattcctacctgcttaagctgccaggaggccagccaagtaccctctctacccatgctcattagcaaaggtctaaatatcagaaggtgccaataaattatggctctgttctcaagataggtcaaccaaagtcactaatataagcaaatttcaccagacaccagaaaaacgctttgggaaagaaagcgaaaagtggccagaacattgccccaagcttgctggaagggccttcaggaatccctcctgtctctgttgactttttagttgccaaaagagggtgatgccagctctgtggctcaggacacagaggcagttagaggctcctaacctcaggcagaggactcggcacagtgggataacatcgagtcactgcggggcagggaataaaggggacataaaggatgaatggctctgctcttggcaccctgaattcctacctcattgtgaggaaaagaatcccaggacactctgacccacgccccggtgggtacaacacagggtgagggggaatggcatgaacagggaatggagtggggtcatcccatgcaaacgtagggaggtaagaaggcccatggtcacagggccagcggggctggggcagccagagccaggctagagcagtctcttcactccatcttctccattccgctgtctgattccagaattcaggcaagccaccagtaagtttctaaggctatctatggggggtgagattttttttactcagaaacatctatctgctatctcctgggtttcacatccccatagaaaagtgagggtaagaagaaatggaagagaaaaaaaaaactaacaaagaaaaagtcttgtttcctgcctgcctccctcccacccagaggcgatttcagcttctgatgttgttcaggaaagttccggaaggaggggaagctggtcagcaacagtccactcacctgcccaggacccttcaggcactgcacagcctgcttgtgggtgaggccgcacagaatcactccatccacctgcaggagtcggtcacctgggaaagggatagatgtcatgtcatgacctggtgcttgaggctgcaggaggttcccttccaggaggaccctgcccggcacccctccatgcagcctggagaagtgggaaaggaagctgaggtgccaggtgtccccctggagtcagcaggaatcctgcctctctgagcagtctcactcccttcttctcaggcacatcacagatcagggatataaaagcctttctattattggctcacagaat

SEQ ID NO: 2186 - DNA, 25281 bp, Homo sapiens
tttaggaaaatatcttttgatgacctttattttaacataatttttttttttttttttttgagatggagtcttgctctgtcacccaggctggagtgcagtggcacgatctcggctcactgcaacctctgcctcctgggttcataccattctcctgcctcagcctcctgattagctgggactacaggcacccgttaccatgtccagctaattttttgtatttttagtaaagacggggtttcaacgtgttagccaggatggtctccatctcttgacttcgtgatccgccggcctcggcctcccaaagtctgggattacaggcgtgagccactgcacccggctagactttaaaaaaaaaaaaaaatactgtgggaaaaaggatattatgtatagaaaagtctacacttcttgatacaactaactaaaaaaagcctgatacactaaacaaaacccaaataatgtcttccctaaaagtgggtaacttgaaaagcaattcgagcaaaaatcaaggagttcaattataaataagtatatcaacaaagtgaaagatgggtttaatttttcccacaaaaagttaaaagaaataacagcagttttagaggaagaggaaaaaataataagaaaattatatgcagttgcaaaatgtgtgactatttacaaactctaacatataactacaaaacggaccagaagaatcattatcataggaagcaaagggtcatttcaaaaatcagaggagggatgattcatatttaatttaattctgtggaaaacatttaagtaacctttgaggacaaaaataggtgatatgttgaaatgcgggaaaccacagtggaaggaaaaagaattcaagaaagctcagtttcagtaaccagtatctagtaaaatcttcaggacctagaggctacaatctgcattaatagtgtctgaagacctagaaatgtcattaaataccattttggataattcttgtagacttgagatgatgtctatttaaagttacaagacagtgcctgtatttctgtattcataacagaaaacaattggatatggaaaagaaactaacatgctatgccacaatctctaaagaaagattagggaagtttcagcttaaagcaagaataatcacaataaagttttacaaccctttgcaagcatatatgaaaaacttacaaaaagtttgtaatgatcttttcttaagctaagagaatggaaaaaatgagaaaaattaaattataaaatgaaactttggtttagaggtaagaaacatttgatgacagtcaagagatcagggttgtacagtgtattatgtgaatgttgtgactcattggtttcatcttggatatcataacttgacattttgtaaaagtgatttttcatgggagttttttcaggtgccctataaagtcctgtcccatgagaagcgaataatagtcttccatattcttgagatatcttaatgaatagcatcttctacagtcttccattgtttagtccttggagagacactcattagtgactgttaaggtacctgagttattaggtgcctgtagactatgcccagtgatatgtgcattaggtacatgctccctagctgcgttgacactgactgaagctgtgaggtttcacaatgacatgtcagccaaatacatatgctcagatttaccatttatcaagaggtcttcacactatcaattgtgcaattatcattctacacacaggcagcgataaagggagtaaaaaaacacagccatggatcgggagactaaggtacctccagaggagtccagtgggtccagaagccctttggatgttggtcagaggctcctcttgggcagagatcacagcagcagccaacaggtctggtgaaatccttaagagttctcatggacaaagtttgtgaaggcatcttagacaagatcttgtctttgctggttttatgatcctctgcagatgggtctattctcattatctcagccacctttcacttcctatcagttcagttcaggtctctcatgatcccaggcagcagtagttgttatcacgtgagttcattcatatatgtttatctctttggggatggggggacaacttcactgtggacttaattctactggagatgagtgaccccattttaagacaacatgatcacaaattattatcacatatcagcagggcagacaatagctatgacctggggctgaaagcaggtaactccatttattctgcaaacattgtcttgattatggtgccagttgctgtgagggatttcctttccaccacctgtttttcacaaggtttgagtctgaactgctaacattctactgatttctgggtgaagggactgactgcaccatcctagcctgtcagagcattcgccccaatacttccactttaagagttttccaccttgtccagaactacagtccattaatcccctcattttctctcttaagagaataaacaggccaggcgcggtggctcacgcctgtaatcccagcactttgggaggctgaggcgggtggatcatctgaggtcaggagttcgagaccagcttcacttacatagtgaaacctcgtctccactaaaaaaaataatcacaaaaattagccgggcatggtggcaggcacctgtaatcccagctactcgggaggctgaggcaggagaatcccttgaactcgggaggcagaggttgcagtgagccaagactgtgccacagcactccagcctgggcgacagagtgagactccctctcaaaaaaaaaaaaaagagagagagcgagaataaacaacccatgtcaagtacacacccacatccctcttatcccaaataccaaacacacaaaaatccaatctgtctccttctacctaagcaattttagatagtcactttctcataattaccttaagctccctgacttgctgctcgtcctttctctggcaaaatctcatccttggatgagcccgactttgtgtttgctcaatgacaccactcacctgaaccagaaaaaatatcaaaaagtggtcagagatatcatcataaattcaaattacttacacaaaaaaattggccctaaatgtttccagaaatcaataaaagttttgtttctccaatgacatcatttcttcagaaacccaacgtgtataacctattttttctatgttcttctaacatttattcaacttctctcatctgatatcttgccaaatcattcaaagagaaaatatatcccattaggcaagagccgaccatattcccatcacctgagaaaatcatatgcacaggatgcacccacctcacctttctctgcctcatcatgtcagaaaaagtacccctccttttgccacaaggcaaatctgagataaaagatttagatggcctgtaattccagcacttggggagaccaatgcaggcagattatttgagtctaagagttcaaaagaagcctaagcaacttagggaaactgcatctctcaaacaaatacaaaccattagcctagcatggtggtgtggtggcacatgcctgtagtcccagctactcagggtggggagcactgaggtgggaggatcacctgagctggaaggttgtggctgcagtgagccgtgatcacgtcactgcactccagccagggtaacagatattttttaaaggatcttctctgttaaaaataatccaataaacaggtggccatgaggctgaggtggctgccgtgcactcaattcctccttaaataaaccaaaacttgactcagtgtaaataataaaaggaaacttaagcttaaccaatcagaaaccaccaactaacatctaactagagaccttccactgtaatgttccaaatgaggccactgctccacttcacccaatcaagtattttctttttcttccacattcaccatataaaattcttcccccaccctccctaagcctctctgtgggacctctgagctgcttgcagtctggggctgcctagtttatacatttctgaatgctcaaatatattttctaatgtttcaaagtggctctggtgtaggaggttgttggtggagtgacccgagagtatacaggaattgagggcatatgagatctctggactctgcactccattttgctgtacactcaaaactactctaaaataataatatatctttaaaaatctataactagcacgtagcccttttcaagcctccaactggttggagccagttcgattaaagctcagaagaaaaactggttaataagctagttctgacccaactggcaagaagcagcaggaaagacccaggccaggggagcatattgcacatgcatgcaccaggaaactggaggaagcttggaggccctttagcctggtcctgagcccgctgaaactgcagttacaggcacagatgcctggggcaccaatctgaatctgccaacatccaaggccacatgaacacaaatgcgcagtctcctctgcgatcggtagctaaggatgttaggccatgattggactaggatgggagatgaactgagaactctggattctgtaggttgttgttgtctcttcccacccccaagcaacaagtgatgaacacacacacacacacacacacacacacatcctgtagtgactaacaggatctccctccaggggatttgcagaaaggggagcagaaaacatcccaggggcctttcacagctacttccttgagccccctttcagactgctgtctagacctgtcgcagcccaaacatcatcaccctgatatgcagaagctggcatccttacctgaaattcaacaccaagaaatgatctcttctactcaacactgatagaaatacctctaagcaacgtcctcattggcaggggtggagtgggggagtttcttaaaaagggaggcctctgcctaccacctagagaacctggaaatttccatctgtgccacaaagtccaaatcactagccactgccccagtgtatggcagattagaacatctctccattagatctgggtttctattccattgagtgaaatggcttttctattacaggaacagaataagggttcaaaagggtcttacaactgaactccagtgtacagtctgcacagacactaggcttgtgcaaatatgacacagcgaggccccaggacccttaagccagctgaatgtactgagtttcaggaaacagtgagatacattcagcaaaacagtgggcttcatgctgaaagaagtcactccaagtaaacacacatcacacacacacacacacacacacacacacacacatacacacacccgcagacaccctagtggccaataggtcctctcaccaaaaacctgtgatcaggagagcagaaagcctcccaggggtccatcactgccctttctggagccccttatcagatggccagccccaggacagcactgtctgatcctggtccagtccaaaccgccatcaccctgtgatgtgggagctggccacttcaccagaacctctgtgtcagaaaaatttctcttccttttaaaatgatgagggggaaccttcagacagtgtctgattagggtgggtggagagaggggcttcctagaaagtcaggcagggcagggctgaagccctctgggttaactgtgtgcttttgatatgaagtcaggtaagactggacaggtgggcgtgttagtgaggggatggtgtagggtgtgctgaagaactccacttgagctctgcacaccagggaaaatgaccataaaacatcccatcttcactgctcagagaaggctagatctgctgtgagctagaaagccatgtgggggcagctgatgagtcatcaaatgggagaaatctgagagccatgtgttccacaggcctctggtccttgttcaggcagcagggcactgtgacatgtggctccttggccccttccagccaccaccttgattgcatgctgcagggaaagagactgaagaccaagaatggggtcttgctcaccatgggatgatggctcagtacagagctgagctatgtatggcccaagaggcagaatgtggggatgacccaggctgagctgggggatccaactgaacatgcacttgctaagaagctgtgggctatgatgccttgggaccccagtctgggtctagaattgtagcaaaacaggctactggtaaaagttcttgggaagccaactcacttttgctgtcatccatgggcaaacaaaccaagccccaccacttcccactccctctgaaagcctcctgcccctctgatcgaccacaccacaatggtgtcactctgtaaggcacaggtagacaaggcatccagccatgaacactccagggcgcacacatgtccagaatacactggttcttgttgagactccactcttccaactcagacagaagctccccaatctcctcagccactcccaacaactggaggtctgaaaactttcatgcatgccgctatggtctaaaccactcgtggcggttttcattttcattttcctgataatcagtgatgctgagcacctttccataatgccttttcaccaactggatgccttctatggctaaatgtctattcaaatccattgcccatttacaaatctgcttttttgtgggcttctttttttctctttttttttcctatttatttatacaagttccttaggtattttggatattttttaaaatgattttcaattccactgcccagttataattttttttttttttttttttttgagacggagttttgctgttattgcccaggctagagtgcaatggtgcgatcttggctcacagcaacctccacctcccagagtcaggcaattctcctgcctcagcctcctgagtagctgggattacaggcatgtgccaccatgcccggctaatttttgtatttttagtagagatgggttttttccatgttggtcaggctggtctcaaactcccagtctcaggtgatccatccacctcggcctcccaaagtgctgggattacaggcgtgagccactgtgcctggccaattatcccttttagtgtttttttggggggttgggggaagaacagagactcactctgtcacctaggctggagtgcactggtatgatctcggctcactgcagcctccgcctcccaggttccagcgattctccggactcagtctcccgggtagctaagatcatgggcacgcaacacatgcccagctaatttttgtatttttagtagagacagggtttcaccatgttggccaggctgttctcaaactcctgacctcaggtgatccgcccacctcggtctcccaaagtgttgggattacaggcgggagccaccactcccggccccattttgtgttttaacatcagtcgacactcgtattttaaaataacaacaatgaatggcggtaccttagaacaaaggaattatagatctttctcttgtcctagtgcagacattttgtctataaaatgttattcacagatgaattcatgagaacattactgtgaattttacatccatatacaagtgtatgctcattcatgaatatttcaataaaataaaactaatagcaaaaaagaattccagagttgaagcagtttcaggaaaaaggagttggcagtatgaagtaaaatagcaaaaaaaatgtttttttaaatgggtatatttgtgtctacaacttttttttaattatagcattagacaatgtgtatatatatacgtatataaagcaatggaagtagcattgttttcatactagtctagaatattaaaatatatgtaatatgtgatcagcaaaataatggccccccaaagatgtccacagattcctagaaccttacatgaaaacggtacatcatgcatgtgattcaggtaaagaccttgacatgaggagactaccctggtgctatggaatgaatgttgtgttccgtcaatgttcatgtgttaaaatcctaaccctcaaggtgatggtattaggaggttaagccttacgggagactctgccctcatgactgggattagtaccttattaaaggcacaagggagcttgtttgttcctctcaccatgcgaagacacagcaaggaggaagcctctatgagaaagcaggccttcaccagacaccaagactgccagcaccttgatcttgcacttctcagcctccaggactgtgagaaacaaagttctgttatttataagctacctggtctaatgcatttccttgtagcagcctgtacggattcggacagtgggctcatgtggatgatgacggtgtctccattcaggactaagtaagcacatgagtccttaacagtggaagagaagggggaaggaaagagccacagagacatgtggccatagaagaagggcccatgggatgcaaggttgctaatggtgagagtggagaagagcccaatgccaaaaaatgcaggcagactccagaatgtggaaaaggcgagaaaaaagatcccctagagcctctagagatgaaggtagcctttccaccacctagattttagcccagtgagatccacatcacactctgacatacaggagtgtaataaatttgttttatgccctgacatactggtagtttgttgtagcagcaatggactagtaatatataaatatatacacacacacacacacacacacacacacaaacactacccccccaccacacacaacataactatctatatatatcctgcccttcaaaactgaatcagataaactacacattagcattaacttagctgggtgtggtggcacatgcctgtagtcccagctacacaggacgctgagagggaggatcacttgagcccaggagtttaagatcagcctgggcaaacacactgaggccacatttcaaaaacaaacaaacaaaaaacacaacaaatctttgattaagctcatttcccaaatttgaagaggaaacaattattagataaagaggagaaaagagaaaggtagagctgctgacttctgtggtggaagcacagacacaggcccaaacatactcctgtcctcctggctttcctgtcccttctcataagggacacaggaacctctcaaactgaaccatggatcacagaaccatactcagaacgcaatacagttttgtctacaattttttatatatctgtgtccctgtctctgcctcccattcccaactcccttactcttgttagaaaaaaatggctattatcaaatatgagtacatccttatatactaatgccaactgatcaccagctggttttcttcttttacaaagtcataaatatttaggctttaacacatcttccaagcaatagaatgttattttccagttcattaacacaaattctatatctaaaatgaagacttcacaagttgatttaaataacatattaacgaaaatcgactggccatggttcaaactgacattttaattaaatgtgatgataggttgagcaacctagcagtactctaaaatgacttttggttatggctttttccatattatgtttaggctgaggcatccctaaatgattcaattgtaattccccttcttaaacatgagatttatctttacaaaataatttattttcttaaaattgcaagttaattctatagttcatgcatacataatctcagtagatatcagctgtatgtgtacacacatacatataggtatttgtatatacacacattacataattaaaaaaaaaacttattagcagggtacaaccacgaagacaaagaggctttgtgtaatgtgatggaaacacaattgcaggacaaacaacaggctgctgtgagggctgtatttaccctttctgatgtaagacttggaaaaacatggatactggatatttaatccccataacagaaaatttagggtgcagacaacttcccacaatttttacagacaatgtcaatagaaatgcattcaatgcagggaatacacagtgtgacagtatacaaaaataagcaggttgatggtttagatttatgagacaagagaaagaaatagtagatgatgtcataattctccttttatggagttatgaaagttcttcattttatataaggtcaggtgctttcaaatgtcaatgagaaaaatatttaaaggaagaatcaaatctaagatgtagagagatctttataaacgtgaacttcaggccaggcacggtggctcatacctgtaatcccagcattttgggaggcctaggtgggccgatcacgaggtcaggggatcaagaccatcctggcccacatggtgaaaccccgtatctactaaaatacaaaaaatcagccaggagtggtgacgtgtgcctgtagtcccagctactcaggaggctgaggcaggagaatcgcttgaacccaggaggcagaggttgcagtgagccgagatagcgctactgcactccagtctggtgacagagcaagactccatctcaaaaaaaaaaaacaactttttttcatgctgagaagatataatcatcaacacattcttgagcacaactatgcacacaggcacttccgcattcacaagccatgctgtgtgcacacactgatgcccctagattccttttttgaagagatggtctcttggtgtgtcacccaggctggagaggagtgttaggatcatagctcactgcagcctcaaactcctgggttcaagtgatcctcctacctcaggctcctgagtagcctgaactataggaatgagccaccatgcccagccaatgttttcattttattgtagagatgaaatcttgctatgttccccaggtgggtcttgaactcttggcctcaaggaatcctcctgccttgccctcccaacatgctgagattacaggtgtgaaccattgtgcccagccaccggattctttattaagaagaaaacttgtttgctgacatgtaggcaatgaattgatgaatagtagttcataaattactaatttacaagtcaatataaatgagttgagtaaacacaaaataacagcataaattaatgaacagtttacgacctcaagtttctttttttcctttaaaacattgctctgacagagactactacttgtccattccatggaaaagtcagaggtggttaaaatgtcagaggtacacttattaacaccttgctgccttttgtgtagcttcctctcagtacttcaccagttgggattgacacacctctccagctgggttcaggagccagacaggagcacacagaacagggaatccaaagccatctctgacaccaaaagcaatgaaaacaaaaataaccaaacatattatcaagaaatgaacaagagatcgatatcaagtacagcaaaaagagaagaaatcacttaatctgccaggctttcattctgacaaaataatttacaacacgcatgtctctatctgacatgtgtgaatagaaaaagaagaggtgacaatagagtagaggattcgtcttccaattgtctctgatctatccaacctttgttacacatcagagagttctccaatttataaataaacaacagagatatgtggcaaccaggacacagagacatactgagagtactgctcagctctctgcctaggcctgattctgatgatccctgacaatgagcactgtgaaatttacagcaaatcagtacacatacacacaaacacacaaaagagatacttcatgggcaaaaagcaccaaagatataaaataaaatgcctgaaagaccataaaacaacttctgatgaaatgctgttttcattttgcagtagtaaaatattcaccaccaaatctacaattagcttaaaaattacaataagtacagtacttttggatcccatctccaattcacaccttatcaacatgtaataatcacactgcatctacaacaaagctggatggactttatgtgctgaatacaacttgcacactaagaaggaaatttgttgaaataatgagaatccaaaatttgtatgccatgctctacttcacaagttaaaagaaaatacaatcatttctatttttaaaatgcattgaaataaaatacagaaaatacagtattctaataccagttaacattaagagaatatatctctaaaccaaagatcttggatcttctagaaacaaaatcagctggtatatatttggataagaaaaaaaaattaagagatcaagaaaggagagaagacgttcgcacagaatcatctccaaaaatggctttctgacgcattcgaccagttttcaagtctatttgtttttcctcctttggcatcaacagcctatatcaccaaggatatgcaaaataattcaatttgtacattaatcagctaatctagaagtggcaatatagtcaatgaaaatacaaagaaacagaaaatgtcaatgaattgcttaagatgtttaagatgacatagcgtagggaaaaaatgatctgataaacaccggaagagttaataaggaaactgaggcatggttccctaacaccacacttcaaaagaacttatagagagaataaaggaataacccttaaaaaaaaaaatctaattttagaaaaaaattgctcaaaagggaagttagggttttatagatcttctggaaagctgattaatttctaagctaaaaaaactatatgaagctttttaacgtagcacaatagataaaagtatgaaaacataaattagaaaaaactaaaaatcataccataagggatggataagttagaatacaggaataacaggccaggcatagtggctcacatatgtaatcccaggattttgggaggccaagtcgggaggattgcttgagcccaggagttcgagaccagcctaggcaacatagtgagaactcgtccctagaacagaacaaaaaaaattagccgggagtggcggtgcactcctgtagtcctagctacttgcggggctgaagcaggaggatcacttgagcctgggagttcaaggctgcagtgagccaagatcacgccactgcactccagcctgggagacaaagtgagaccttatctcaaaacaaaaacaaaaacaaaaacaaagaaaccacaataacaaaaaaacactggtaacaataaaatcatgattacataaagactgtatagaaaaaaaatcctcagaatatagaaataaaattacgtattttacctgtagctatattagaagagagtattcttgtagacaaggatgtctagaaggatacgcaaaaatgaaaacagctaataacactcattatgtcaggcactgtggtaggtagtttatgcacattgtaacaaattatatactacactatctcaaaattttcagataaattttactggaagtcataaatcaatacaacaaaatcagtgttttgcaaacatccactaagcataaaggtatacaaattcccaacccagactgaaaaataattcacataagccacacattagtggaaacctacccatgggagataatacaacataatctaaataaaactttcagagacaaggcatgtggcttctggacagccacaaactccctgactctgctctagtgtttcggccatcaaaagaaagccaagtggcctcaggtctctgaaaaaccaaaaaagcaacctatggaagatggcgtggtatttgaggaatatttgaagtctgttgaaaaatgcatcctgtatttttttcaagataagactcccttgtaatgtcaggtaagtgaagagccctcagagacacatgcacacacaaagaaaaacaaaacgacatagaatgaatcccaccaaaatgtgttatgatggcagaattatgggtgatatgatcttctgtaatatatctttttattaaaaatagaaaaaaagcagacttacccttgattatctatagcctctgacccaagtggtttggaattggaaagcagcatcactcgacttgaagccatcttggcatcaatggtggagtaggtggagatgagactctggaccagctcatgggtgagccccaccttgtcctatcaaggccaccaagaaagggcacgtgaggaaagcacaaagatcctggagagacactggtttcactcagtttctcaaaattatcttagacacatttcctgagaacctttcttaatgccgcaaacaccagagaagaaaatccttataacaaagcttgaaatggatccccatctccattaaacttttccaaagctcagtgagtatataacctgataacctaaacacctagctagaaaaacctcagttccagtgctacaacagtgctagcttttctaacatttttaagtaaccctgcttttaacccaataaaattcaactacagaactaagaaataaatattggaaatccactttaaaacaatgaggagaccactgtgattgagaaaaagaaaaagacaaacgagagctggaaagcacactgattttgtagaaacggaaataagccgtgcaggtgccacactggcagcagtgcccgcgctggggccacggatcaaggaggcatggaggacaggactcttctgcttggtacaatgaaaaaatggtattatttttattctacatattgacaatatgcatttgggcctttattataagtacaagagaaaaatcttcaataaataaaagctgagtacattactttttttgattaagaaatagattaggaaagaataatgagagttcagagcaaagactcctgcctcactgatgcctgaaaaccgtggctgccaccaaggtcaacacagacagcgtctttgtcatacagcacaccctcaactccagaaacaggcgcataaaccagctgctccttcttatttaaacagcacttcttttgttattcaggaagaacacaagggtctgggaggaaactgatgtcactcatggcaaaatgttctacccctggaagacaggacccaaaaagccagcttcaactgacaagaagtcagtaagtatctactgttgactggggggttaaaaacgatccacagtccaagggcttaacccatgaccctaaagaagggcattgtgccacactggaacagtgaccctctagctacaagaggtcagagaagagggattcggtaacacctttgcaggcctacacatagctggcttacttttaaaacctccagcaaggccatcttcccttgtttggtcatttttcacttttcctgagaaatgaagccatcccaagaatcctatgtgcaattctcgtatgttctacagcaagagaatacctggcatgtgaatttggcttttatttttcaagtgtgctcctcttaaataaccataaagtgacacctgcaggtcacatttgatgtttgtttggatatcctccgggtttgtcaaatcttccatcctagaaaaataaactcaatcatacagcagaaatgaatgccaaagttcctatacctcctttcatgtgtcaatgactcatcacactcttgtccattaagcacatcacttaggaactagaaaatgcagaaataaggaagcaccgttcaccatccagaagaggaaaaggggcaggcacacaactgtgtctctaggctgaaagtgacattcattccataagacaccagatgggagatggcgtccacctggggtcagggaagagtgaagaacacattcagaaaatccatttctcgaagagggtgagcctgtgctctgggatttgtactgtggcttggattctggcaggtggaaaaagggtattccaggctgagaaaatcacagcacaaagaagagcacaaaggaaggaaactgaaggcatgcacgaaggactccagcacccgggcacgaaggcagcatcactgaaaactgaggctgaacgtaggatggggccacatcctgtagtcttaaatgcttccaagtcctcccattttcctaaacatctcataattaatttactcccaaaggcacagcatctttgagcaatgatataagtagacattttccatcaactacacttctacccccactattcaaataggcacaaaataaatcctatcactgttctttttctagcctttttagctttgaaatatatggcccaggaagaaaaagtttacaatcaccttttaactgtctgccaggatataagggtgaaaagtttgccatgagaggcctaaacttcataactgtaataaaatggcccagattgtggatttcttggttttgatattctccatgcaccattccagaaaggtagaacagtttggcaacctaaacattaaaggaaaattaaaaattaaatttcaattaaattctcgtcaatactgcaacaaaataaaagctctaaacaagaagcaatcctaagaagggagacttccagcaaagccactgtcctgaggcttccagagccttgctggattctttcaggacttattagaaccacacagaggcagactgctctgcaaccaagccggggcatccatctaagtatggtgaggagagggaggtgaggcctctgagcacagaaacggttctgtggccgatggaccacagcagtatggaaaggaaggggcagtgcctggtcctgtaactgggagaaacttctgatgtactctattaagtcccgactccaaaacacccagacattgcctggtgcagcaggtacggagacaaatgagatacaccaagaggcccagaataaccactctcttgagggaaaccttccagagactgggaacacatacacaaagggaattcaggaggcaattcctagagagacgtttagtaatgtctcttcagtctttttgtttgtttgtttgtttgagatggagtctcactctgtcacccaggctggagtgcagtggtgcactctcagctcactccaccctctgcctcccagctttgagcaattctcacgtctcagcctccctaatagctgggattacagatgcatgccaccacacccgactaatttttgccttttgagtagagacagggtttggccatattgccctgagctcaaaactcctggcctcaagtgatccacctgactctgcctcccaaagtgctgggattacaggcgtgagccactgtgcctggcctctttagtctgtttttaaaggattatactgttagtttctaacaattatttctcttcctacctggtaaacttctgtccagaacctgtgttttaatcacttctttgtcttcttcagttgcttgttatgcttgaaggagtcgaggtgggtgagaactcccagaattttaggaaagccatgtgcttgacagatgtttagaaactcaaacatttccatttcaaacccaaagctggcatctataagcatcagtacctacaagcacaacacattatttctcgaagaaactaccaaaacagaccacctacactaggggttggcaactggcccacgggccaaatccagcccatcacctgtgtttgtaactaaagttttattggaacatagccacattaattcatttacatattgtctatggccgcctgtgcactacaactgcagagctaagtagctgcagaagatatgatccacaaagctgaaaatattcactatctggccctcaacagaaaagtcccactccagactaaatcaaatgactacacaggcatcacccagacagagaaaccaccaccctctgacttgctctaaaaggcaaccataagacaaggccactaggatataaacatccattttaagaattctaatgcatgagaagtaactcagaaaaggctgggtctaacctggcccttacctaagaaatcctaatttaaagaaatgaagttttctgtaatgtatttttaagccaaataacaggtctctgacatccaaagaatgggaagaaagtgataatcaatgaaatatattaaatacgtacagaaaaccaacctcttctttcaatctcctcacagaaaaaaaaaaaaaaaaaatctgtttttttgctgggaagtatacaatggaaacctctaacttgtatgttaatttgtataactcaattgctcagaaatatttgaaatagctaccagtttagaattaagtaaaaaaacagaaagattatgatgaatggtagtctataagaaaatataagcagataagaccaatttttttttttttttttttttttgagacagagtctcgctctgttgcccaggctggagtgcagtggcttgatctcggctcagcgcaagctccgccccccggattcatgccattcttctgcctcagcctcctgagtagctgggactacaggcacccaccaccacacccggctagtttttttgtatttttttagtagagacggggtttcacagtgttcaccaggatggtctcgatctcctgaccccgtgatctgcctgccttggcctccgaagtgctgggattacaggcgtgagccaccgcacctggccaagaccaatttttaaaatttaagacacttcaaagatgcaaaataatttcagaactgattcctggaaacttgtaattttaatattaaagatagttctgtttgtatctttccatggataactaaaaataacacaaaatggaaacagaaatgcccatccttgattaaactaggaaacattcaaaacccaaaaccacagaatatatgaagttgggcttgtaggaaagcacagctgccactgcagaccaaggcagcaagcagagctctccagcaacactggaccagctcaaagaacaggtggaatatcctcacaccacatctgatgccagagtgccaagggacaagcagctggttgtagggtcaggaataaaagggagcaaacagtccctcagctgccaatctttgccatctaagccagtgtcactcccctaatccacacacgcacgtacacacccaaatccacgtattgtgtgtgcctctgctgtactcaggaggctttgacaacccagagcagagcaatcaacataagctagactaaataaattatggtgcatccacagaatggaatgttatattaaaaagaaggaggcagagctacagtacttactgattatataccttcaagtatattacatgaaaagagcaaagcatagaacagtgtataaaataagctaccgtttgtgtttttaaagggtggcatgtgtgtttatatgtatctggaaggatatacatatacatatacatatatataaaggtctgcagggacctgagagaccagaggttacagcaaggaaagagaaaatgcgcattgtgtgtaccgtgcattacagttagagtgctttaccaaatgtgtgtgctccttttgaaaatcttaagatttacataggcatctctctcaatgatggttaagaggctgggaaggggagcagggagggagggacaaagagggaaaggttaacaggcacaaaaacacagttagatagaataaattctagtgtccaacagcacaatagggtgactataatttattatataattcagaataactaaaagaatgaaattaaaatgttcctaacacaaataaatgataaatgtttgaagtgacagatctctgaattaccctgatttgatcatcacacattgtatgcttctatcaaaatactacatgtaccccataaatatgtacaactattatgtatccataataactaaaaataaaaaaatgtaaatgcatctcttaatatgtatgtatttaaaattagaaacttgctacattttaaataaaagagaaacaaatgacttctatgaactattcaatcatttcaagtatacaagtttagtaatcgttacacaactttacattaattacacttatttttactaatagtagcattacatgttcaaaatttgaatgttatttagttttctgacattacaatggcacaactttaaaatctgtattactttttcctttatattttaggagtcttcctaggccaaagtataaaatctgtagctctagaaaaaactaaataaaaatgaaaaaaacaaggtatctgtcaccccacacttcctaatcaatatggcttatttttttgctaattttttttttttttgagacagaatttcactcttgttgcccaggctagagtgcaatggcgtgatctcgcctcaccgcaacctccatctcctgggttgaagcgattctcctgcctcagcctcctaagtaactgggattacaggcatgcaccacctcacccggctaattttgtatttttagtagagacggggtttctgcatgttggtcaggctggtctcaaactcccgacctcaggtgattcgcccactacggtctcccaaagtgctgggattacaggcatgagccactgtgcctggcctttttttttttttttttttttgccaatgtaaaagatagttcatagaatatcagaaatagtgaacattatcatttccataaatgcaagagcatgtacattttccacacgctgagtactgcctgaattttctattgataaactctgaccacttcttcaggcaattcatgtacttactttagcattatcattaaggatgaaggttctagaaccatcaggaacaagggtcccatcttcacacaagttacttaactgctgggaggctctatttcatcttatgtaaactatagataatacctactcacctcaagggtgtatgtaagctaaatttgtagaaagcagttagcacagtgccaggaagggtccaagaagaaatggtacttactatgatatatttgtacatatatatgtatgcatgtaaatgagctcttattagctgtgttcattaaaggttttctccgtcctgtgatctgcttttagattttggaacacatttcattgtgcacattccatttgtattattaatatgacaacatttattactattattattatcatcatcaattcaatcacatctactatatccctgataatgaccatgatccttttaataatcacaaaactctcttcccttcatcacggggtaaataacctatcacaatgctgtaagtctccatcagcaccccaggctgcccctgctcacttaccagatctgctactttagccagatcaatcatcatgttaatgtcacacccacattcaataatggtgagtctgcgctttttacctataagtgaaaagatgaaaattttactttaaaaagaccctgaaaaaactctaaccatcaactcttaattttcattttttaactgcatccagtaaaacaccacatacgtttacaggagtgtaccagaagttcatttttataggcaaaaactggtaaaataaattccatcctgtttttcttcctgtgttctaaatttagataatatcaaaagcctacccagatgaataaaagtgctcaaaacagggaaaattctgactagacaggctccacgataaccatgatcttgctgttcagctgcaggccaatgtcttcacctctatcaaaatttcctgtattcccactatcgctaaaaacatcctcaaacataatgcaacagaatatttacaatgataattatttctaaattaaggtaataagaaaatgatcaagaaaatattggctgggcacagtggctcatgcctgtagtcctggcaccttgggagaccagggcaggtggatcccttgagcccaggagttttgagactagcctgggccacatggggaaatcccatctctacaaaaacataaaaattaaaaaaaaggaaaaaaaagaaaaattagccaggcatggtggcatacactactcacaggaggctaaggtaggaggattgcttgagcctgggaggttgaggctgcagtgagctgtaatcacaccactgcattccagcctgtgccacagagcaagactctgtctcaaaaaaaggaaaataaaatatggatgcgccaaagataaagaaaagcctcaatccaactatattactgcaataataagagatttcagagtgtacattgccattctaccactggatgtttgtttcatcttccctcaaacttggaaaggtcaccatctcccaaagcagacaaattctcataggaaaaagagaaaacgcgcacttccaccagcatgtggcttcataagggcaagcatgtgcacctggcacataggaggtacgtgctgtctgttaaatggtgtgttcgcagtgaccaggcctgtcaggcccttccaaggaacatgcttggcaaagccatagagcagtcaggataaggtatgtatcacatccttatctctgggaacttatccttttatgaagttatagctaacttagtaaaagtaagagagaggtaacatgatatgacaatatttaacatgttccactcaagaaaacaacaaacacacgcatgtccctcagatgacaacagccacgccaagtctgtgtctgtggcggcatctcctacctgacacgatcgtcacagggcctctgatctcggtgaacttctgccaggtgaagttccgaatgaggcattatatcaaagtgctctttccaactttggaggccccgtcaccactaccgctattggtggcggctctagtggagttccatcaaccactggaatatgatgcttttgtgtcttcaaatccagagtcctatttatttaaaaaagaaaaaaaaagtaaactcacttttaaaatagagtaaaaggtatcaaccttataagtagacttttttttagtataattacagatatgagtactttagtatattttatagagagtacaacagacaatataaaaatataagtaacttgtcaattattaacttctgacccctatccaaatcaattgctgttcaataaagatgtaacaagatgacttcaatagtatagagttgaaaattaaacactccttaaatctgactgttttatgagtgatttttatagttttttaaaaaccaaaaggtaaatactgaggcagcgcatcataacagataagagcagaggttctggagttaaatttggctctccgacttactggttgtatgattggaggtaacttgttttcttgacctcagttttcttgtccataaaatgagggcaagaatgattcctactctggtaaggctgctggaaggatttagttgaataacgtttaaagtacactgctaagaatatcataaggactcactaaataaaactatgttagtattacatattgtaatttttgtattttatattacaactttgtaaaacatatccagagggaaaaagcacacttatcaccatagaaacagtttaaagtttaggaagaatcaaattctataaattcttgtatcttgggcaagaaacaccaaccagtgtgcagatgctggaggcaaggcagcttctatggcaagtcttctcacgttttagtaaaagccacacagcatgcatctccatgtcctttggagctggactagacttgtgaatccaaatgtcacctgtgagaggctcctaactatttaaaaagattcaatggaagaaccatcagactgtagctaaacacacctgtgaaaggatcgagacatccacacagcagactgaactgcaaaagcattggcatttctcttctgggcattttcttcgtctcctagctggagatcctgcagatgccacttctttttctttgcagctttgggtccactgtttttctttctgtgtttcttctggtccttagtctccatagtggctatttaccaataacaagtaactctaacctacaaggaagaaggttggggtaaggaggtgggagaagcattttacaatccaggcaatacccagggaaaaacattaaatttcatttatttctttatgaagacatgatgtatttgttcactgaacaagggtagaaactgcttaaccatccccaatttcatttctctctgttatgctataaattagatgagttacctctgctaaggttacattctatggttaagttactttttactcgtctcaagtgtcaacatcaccagtacctatttctgcaaggatggaaatattctatatctgtacttttcagccatttagccattagccacatgtggttacttaaaatgtacttcagagaaactgaaaaaatgaattcttaattaatttcattctaactctaaatagtcacatgtggctaccatactggacagctcagacctagacatcgactggactaacgaagtggtttcctaacttaaactaaaacttaaatttcaataaaaaatttaaaacgtttttatgaacttccaataggatcgcagtattacttttagtacctgttgactctaaaacttctaaattacagctcatctacatacatttgaaaaatagcaatatctgtatgtgtgagatatgactggttctagatgatgcctggaggccccatggacttacagagacccttccagtgatttctgaggtacctgggaatctgtggccaataaattggtagtcactgaatctgtgagtttttttggaatatcgggctgcataaaatctgacagcttgattgagaaaaagcggggcagggtgccatttcattcagttaaggtcctgtattcattccgtttaataaacgtttgtgtctgtctatgatgtgctagccactgtgccagaaaatggatatagctatggtctgattgacagaggaaatccaaactagtatcttccgtgccatgcaataagagctacattgcaaggctgcagagggtgctactggagcacagaagtgagtcaaaggcttcccacagacacacacacgagcggaaacagaaagtctttatatatcaccatatgtcaaggaacactggccgggagttaggagagctgggcactaggaacgctttgaaactgaatagctgtgtgatttcagaggttatattgcttgtctactatattttactgccgaacttgtactgtttctctcccttttcttcttggtgggaaaagcacaatttggggtcaacagattcggctcaggtctaagtcgcctgccgggaccacgtcgccaggaaacgacgtctccccgacaccttccctcccagtccgggctctctgcagggattcatcccgtcactctcccaacgaccctcgggcacacctcaggcagatgcgaaatatgccgctcctggggagcaaagatgacccggaggaccgggggagtaccttcccacgcgcacgactcgcgatcttcccagtgccccagagccacggacccaaccgccgcctaccccagcccgcggcacctaacctgttcacaactgcgactccttaggtccgcttggacaccgccggaaacggaaattcaccctcgcgccgactcgccggaggtaaacaaaaaggcagaaaaaaagggaccgccgcctggacgacttgcaggggacagctggaagaaagactcgtcaacggccgag

SEQ ID NO: 2187 - DNA, 25281 bp, Homo sapiens; identical to SEQ ID NO: 2186

SEQ ID NO: 2188 - DNA, 3680 bp, Homo sapiens
tctgtgcctggttactccacttccctgttgcaattaacaattccctatgtacacttttcctgttcaaatgactgtgtggcttctctttcctaatcggactctgaccaatacgctatcatttgccaacaactcccaaagttttatcagtgactcagacctctaacctgaactccagctgcctccatgagatatccatttggatgtttaatggacatttccaaagtgatatgccctacagaactcagaatcttccctctcaaaccaactgctcagcagtcttatgatcttagttgatggcaattcagaagtgaattgcaggacacccggtttgtatctgcagagagaactggagaactgcttagtgtggaaaacccacacatttggtttcagaagtgtgtgagtagaaacagttttccttttatgtttgttggatggataatgatgaacctagcaggacacagaaagctaggcagcagtggaactgagaatgaagttatagttaatagcagagaatgaaaaagaaaagacagataaaacattttgaagaaaggacagtaatgtattcccaacaggtaggatttacaggatggagagaagaggcaaagataactacaaaatttctagcctgagagactggtagaaaaaaatggtggtatcaggaacagacaggggttattaagaaaaaggattggatttttaaaataaagaagatctggtgtaaaattatcctcaggaaaactggaaaactaggcatgtacttctctccatcatgcccttgcacagtgcagtccttctgcctgtccatgcctcgcctccccctccctaggattcctcttcctctcttaagacccatctcaaatatcacctagacttgtaagtaatttacatgaaactggatacctgaggtatccctttgaaagtttttaataacaagttactgttatcttttactaagtccaactttatattcgccattttaactagcatcatttctgtttccaagaggtatttggtgtgaaagtgcaactaagtttactgttaatcaagatcagaataaaagaatctaccaaaaaaattaacaagatcccccttttaatgcataatctttcatccatcaggctgtaagttaaatacctaacataaaagaaagctgtatgttttatggatatgtacatatataactgcagggaatatgatttggaaggatgtacacttagagaagactggagtcacaagtggtagtcaagggagtcttcagatttctttttgtatttcaattttgagagaaatacatacatatgtattataattttaaatttttaatgaaaaaaagtatttttccttttttttcttgatctgtcactacattatatttttccaatatcagctaaacatttgcttcccagaaagcttagttgtcttttcaaaatttattcaggttaaaataaaagatttagacaatgaattaaaaatctaagatggtatttgcctactttatacagaacagtacattgatgctgctaaagcaattaaagtataatttttctttttttttttttttttttttttgagatggagtctcactctgtcacccaggctgaagtgcagtggtgcaatctcagctcattgcaacctctgtctcctgggttcaagcaattctcctgcctcagcctccccagtagctgggatttcaggcgtgcaccaccacgcccagctaatttttttgtatgtttagtagagacagggtttcaccatgttggccaggctggtctcgaactcctgacctcaaatgatctgcccgcctcagcctcccaaagtgctgggattacaggcatgagccaccacacccagcctaaagtgtgtactttttcttagctcctatatgcagtgctccttccccatactgaatgtctgaatttttatctgagacatagtatttcagatggtcattacttacgggtggtcattaatagttcctccctgcttctaaccttcctctcctcattttaaattaaattacgctacattattgtggattagaaagtacattaatattaagtgaaaaaatatgatctgatgagtaagtggcaagagtgttaacgtatgaatattaagagttgttctgaggcctttttgcttttctgggggttctgtgcttgtggtagaactcttggttattttataaatagttcctgaaaagtgagagagtacagctggaaatcagatttctgatgaataaatcaaaccctattaagagaaacaggttcaagtaattttaaaaccatttgaattttcataaatgttttgttaatgattaattataaaaaaaaacagtgactctagctggaggcttttgtgtgtttgcttttgagtcagctaggaaaaggaagaaaaattcaagcttagtcaattgtggttttcactgaatcttttttaaagtaatgagctggtttgttttcttcatcactatagcaacttaagctagtttttgcttttgatttttatttctcctagagaaacttagcatgcactgctcattagacttgggcatactaaggaatatctgtggtaattaagttaaaaatcagatcagtgctttgtgctgtgtatagttgcagatgtctgcatttcactaatattctttggaaacatctggataccagttaacataaaataactgtttagttggtttctgttcagaatagaaggaatgacttaaaagttcccattgtagtacatacgtcattctatccctagcccttcctccagctttactgagattgataaataataaacatcatgggtggtgtgtctttagtttcctctggtgagctggatgcacagattactttgtcagcagggtggtcttgatttttaggccatgtgtctaatggcatcagctctgtggccgacacctgtgtaccaagcccattcactatctagcttagccagccgtggactcctgctctttgttaaaagtatttaccttcattcctactagcacagttgaccaaagacccagttgatcccaaacactagtaatgcatcaatggagtctaacagagttttaagatgtgtgtgtgtgtttgggggtggggggtgtagagatgggatctcactattgttgtccaggctggtcttgcacacctgagctcaagttctcctgcctcagcctcccaatgtgctaggactacaggcatgagccaccatgcctaaccctctaagactttgggatacaaaaacataatttactttccttcatttctggaataaaacatctcttcttcctccccctactttctgttctgtgcccctgtttgatctctgttggtcctgttcaccttcagccttctctgctgaaggaggaaaggcttggttttataaaaagtgacaatattcagaccacataagatccttcttgcttcattttggattaaatattttaagattttctgattttcttgtatgcatatgtatttacctattatttgactttattgaataacttcaaattgagtatatttgaatgggaatgggcattaaaaagtgctaagctttccctgcctttcagaactttgtatgtatatgtcacatcattttgtccttcacattctccagttgtgctaatttttcccaatccattaagtagagtaccttcctttttggagtcttactttttt

SEQ ID NO: 2189 - DNA, 12722 bp, Homo sapiens
attcataataacagtggcaggctttatcctctctcagtaatttatagaaaaacagacaaaaatatcagtaaagatgtagataatttgaccaacctgattaacaaacttgacccagttgaaatacacataacacctgcacacaactgcagaatgcacattctttcaagtgcaagaacattatgataagaatattataggaaagtctgtcataaacatagcttatataaaaatataacagcaaattaatctaaattttatttatttatttacttattttatttttttgtttatacttatgtcataaacatagtttatataaaaatataacagcaaattgatctaaattttatttatttatttatttacttattttatttttggagacagagtctcgctttgttatccaagctgtagtgcagtggcgtgaacatgactcacttcagccttaacctcccgggctcacgcaatactcctgccccagccctccaagtagctgggacaacaggcatgtgacaccatacctggctaatttttgtggtttttgtagagaccgagtttcaccacgttggtctcaaattcctgagcttagacaatctacctgccttggccttccaaagtgcggggataatagatgtgagccactgagctcgacttaaatctaaattttattttattttattttatggccatgctccctctaataaatctaaattttaaataaataagtccaagtattgttgtgtttatgtgtataaacctgcgcacacacacaaaagtgtacacaccctgctggtttctattacaagaatgttaagtttggtttgacattcaacagtcaattagtataagtcatcacatccaaagaataaaggagaaaaataaaattatttcaaaaggtgcagagtaagtatttgagagaaatttaaccttatttgtaattaaaaaaatctttttaacagcttgagaatatatgttaatgagtacattaaaaatcctataacaaccatcaaacttcatggtgaatattgacaactctccacatgccacacccaccacccctgagattgaggatgagacaagaatacccactatcactacttatagtcagcattctgctggaggtcctagccactgcaatttgtataccaattttatatcttgcaaccttgccaaacttattagctctagtagtttttttgtgtgtggattccttaggattttccatagacaagattatgtcatgtgcagatatagttttacttctttctttatgatctggatcacttttatttctttatcttgtccaattgctcagccactgcagtttggcaagagctaaataaggcataaagattaagaaaggaagaaataaaactgtcattcacagaggacatgattatacaaaaataatctgcaaattattacaatttaaatgaatgtcacaaagcctctcactggataacaaggtcaacatagttttgtagcaacagaatctgtatatactagccataaacaaatataaaacgtctaagaataaatctattgaaggatgtgcaagaacactttactgaaaaccacaaaaatagttctgagaaacatacaaaagacttaaagtgaagagatataccatgttaatgaataggaagattgaatattttaatgatgtcaaatggcccccaaattgttctacataatcaattaaatccaatcaaattctagcactttattttgtggaaattgactagctgattctaaagtgttttatggaaatgtaaagggcttctttcttctggagttgccttgtggacaggatttgagacaacccaggccaggtttctctggtccatgggaagcatgcgtatgctttttgccctgactatgtctgtagagaacagcccaaacaacaacctcctccccatcagagcagagagccagctagtctcttgccatttagatttttcagggatgagtcagagataccagtctactctgtcctgcagaaaaggatacttatcaacttttccaagcggccctagaaaagtcactgctagtcagaaatctcaccttggaatgtgggggtggctggcatctatccggatgtcagatgaaacagaaacagttccactgtagtagcctgctctataaacacacagagaacccctattacatgtgagctatgaagctattagaaactacagctttgcggactactttgaaaatgtgcaagtgggccgggcgtggtggctcacgcctgtaatcccagcactttgggaggccgaggcgggtagatcatgaggtcaggagatcgagaccatcctggctaacacagtgaaaccccgtctctacttgaaaatacaaaaaattagcagggcgtggtggcaggtgtctgtagtcccagctactccggaggctgaggcaggacagtggtgtaagtaaacccgggaggcggagcttgcagtaagcctagatcgcgccaccgcactccagcctgggcgacagagcaagactccatctcaaaaaacaaacaaacaaacaaacaaacaaacaaaaaatgtgcaagtgaaataagtgacaaaaagcaaacacaagatattctgttcatacgaaacactgcgaggcgacacttgtgtttgtagattgacagaaattggaggtggagttaaagaggtagaaactcagtataacattcattgcctcttttgctaaagttgtttcactgcataagaaaaagatactggtcgggctgggtgcggtgactcatgcctgtaatcccagcactttgggaggctgaggcaggtggatcacctgaggccaggaatttgagaccagcctagccaacatggtaaaattccgtctctactaaaaataaaaaaaattagccaggcatggtggcgggcgccagtaatcccagctacttgggaggctgaggcaggagaatcgcttgaacctgggaggtggagggtgcagtgagccgagatcacgccattgcactccagcctgggtgacaagagggaaactccgtctcaaaaaattaaaataaaaaaaaaaaaaagaaaaagaaggaaaaaagagaaagagatagtggttccatgtgctgttctagttacacaaaacaacgtgttgacgtgcaggctgcacgatgccaggtgcaaatacacactacctgttacagtaactgtgacaagcacaagggctgctcactagcttgagtgcaacttctggggagttgatggcagtgatctgtgggtacttccttcttaacaaattttacatcaatactgcaacacagcaatctcagccctgtgggctataccatagccacatgctttcaccatttcctgctcaaagggagagcccaggaactgaatgctcttaatcagggagagcacagaaacagcagcagaacagctggagaaccagggctgtgtggttttggactgtggggagggtgggccatgggcagacttgacacaatgtgggagggcatttgacacagccccgtggaggacctaatgctcggggaggccttcacccagcacagtgagccatgccgacacttggtgcctgagtgcgctggtcacagcgccctccctgtgattttccccatagcagtgtgttttctctgccaggcagaaggcagagaaaccctggctgaaaaagcagtgagggtcatcgactgcatgaacacatcatcagctttcccagatggaggcacccaagtttaccctgcaggtccattcagcaggtagagctgggtcatcactaaacaggatctttcttctgagcatctgagattctggtccaaatcagggctgtgaggaccaggagccgggattccgagcccaggcagccccgcagataaggaggagggagtgtgtcggaaggctgtatggccagagccgctgaccgggccagggcttctttgtcccctcttctctcctgcatatcagcactcacgtcctcctggctcgggctggctggcagctcggggagctgttggatgaaacgtccatgcgtgtggctgtggctgtcacatgcaactgcgaggatggtcggctcccaaagcggaaccgcggtgctgggcgaagggtcagggctccgtggtgcggcagagcgcatgccagcgcttcaccagctccttgggcttgctgagcatctcgtcccagtgctccagctctctgccgcgggtgtacatgtaggggcccaccaccactcggcccagctgctggctctctgcaggggagggagagcaccggtgtgctcctgagcacagaagccccgtccccagtgacctcctttcctccctcctcctccccaggaggaagtagcaactcccctcctctctgagtgggagctgacaggccccaaaggggccctgcctttgctctgcagctggaagggctgcttctccccctgggagattgggaggaaggagagccctgaaagactctctccttgagggccaccagctctgccccacacccttctgtggggccgtattaagtctaccttatgccaaagagctgagggaggaaagggcccctctagaaagaaggcctcggccatccgagagtacattcagcagtaacattcactggccaccgtggagaagggtcttaagtccaggccatgtggccagccacggcctgatggctctgtttccccagagtggcagtgggtgctggggtgtggggcagtgtgggagctggctgacagaactcgcccagaaccccaaagtctcatctggagggcacgaggaaggtcagagcaccaggtccctgggctggtggcaggcctggcccctcccactctctcgggtgatttgctccaggagagggcagcagaggccattgcttaacctctttctttttcttttcttttcttttttttttttttgacagagtctcgctctgtggacaggctggagtgcagttgcaagatcttggctcactgcaacctctgcctcccgggttcaagtgattcttctgcttcagcctcccgagtagttgggcctacaggcgtgcaccaccacgcctagctaacttttgtatttttagtacagacggaattttactatgttggccaggatggtcttgatctcttgacgtcgtgatccacccctctcggtctcccaaagtgctaggattataggcgtgagccaccgcacccagccaacctctttttttttttttgagacgaagtctcgctctgttgcccaggctggaatgcagtggtgcgatctcggctcactgcaagctccgcctcccaggctcatgccattctcctgcctcagcctcccaagtagctgggactacaggcaccagccaccacacccagctaattttttgtatttttagtagagacgtggtttcactgtgttagccaggacggtctcgatctcctgacctcgtgatctgcctacctcggccttccaaagtgctgggattacaggtgtgagccaccgtgcccggcccttttttttttttttttttttttgacagattcagcagcctcgcctcctgggttcaagagatcctcccacctcaacctcccaagtagctgggattacaggggtgtgccaccacgcccagctaattattgtatttttagtagagatgagcgtttcaccatgttggccaggctggtcttgaactcctgagctcaagtgatccacccaccttggcctcccaaggtgctgggattacagatgtgagccagcatgcccggctgcttaacctgtttctagggtgccacagacagagctcaactggactaaagctgggcctgaaacccaggccttgggcaatatttcagcctttctgagcactagtttccttaaccagggagggagctcgtacagctccttctgaggtcaggacaggaggcactcactctgcctgaacactcggcagcccctcgtggtccccatcccagcagcccagggtagggtgtggccttactgtccccttccatgttctgcaccacagtcaggctgaggctagcggtatccagctcggtggcatcggccttgaagctgaaggtctcattgtacacagggttgatggagcccagcacagctgaagtcttcttgcacttgacaaacttgttgtggttcatcagagacactttgacaaacacacctagggaacggtgagcactagtgggctggcagaggcaggtgggagcagagcccctgcctgtgggaggtccggctaggagggcacgtgcccaagctaggtgccagggccccacccctcacacagtgctgcggccccgccggcgtgaccagaggaagccggctgaggagtgcactgccctgcggcccaggcggggctccgctcccttccttttccttcctctttgcatcaggaaagtacccacggctcctgcaggccctggtttaccagagcctagcaccgcaagcctgtccctccctgttggggggctgctcactgggcccccaggccccctggggccccttaaacaccttgtacagagggctaagatttggtgggtgagggtcagagtcacagtggaaggtctggatcctgcctggcttacggtgaccccagatgtgaacacaaacaggtggctgaccaccacctcactgggatgggtgggatgtgtggggtgagcccaaatggggtgggacatgtggggtgaaccaaggcctccccttctgcagctcctgtattctgggaggccaagcatcagtgcccattgagtcgggggctcttcccctgtggggagggaggtgcgggcctcaccctggaggaactggacccatgccgctgatggaaaggtggaggtggaggcaggcaggacagttcaaagagccaagacgctgcctcgggaaacaggaggggcagggcctggtattgcggctgggttagaaccctccgtaggggaggccaaggagatgcagctttgggttcaacacaggaagaggcttcctgcaccagaactgtcgaccgagggacagcacgtcttgtgaggtagtgagcgctccatgataggtgtatgcaagcagaaactggatggtcagggatgaggttggactgtagccccaggctgtaagctcggtgggtgggaccttccccaggaggaaagggaggaactcactgacaatgcctctgtcctcctggagccggaggcccttggcacgcagcacaaccaccgtcaggcggctcaggtagtcgttgtagctgaggcagaactggaggtcgccaaactccgaggggggctggggaggccaagatggaagcaccccaccctgttactctggcaagtgctgaaggggtcacagaacccccagagagcctcccgcttcctcctagcggtccatgcgacacacccgcatggtcccctttgagttccactgccattttaaggatggggcaactgtggtctggagagtttaaggggcttgtgcagtcctgtggaccagagctaaggagtcacacccaggtctgagccagctggggccttcctgggggtggtgggctggaggaaacatttccctgggctggaccatttgtggtgtcatctctcacagctgtctaacctagataagaatccaaatgtggatatttcaggttgctccagggggtctgatggccagtgtgacaacaggacctcaagcaggccctccctgcccaggggcaggtccgttcccacctgtcccatgctgcttggggcctgggccctcctccctgagtcactgttgtagggtggtgtgcaggatgctgagggctgatgccgccagcaggtgctgggccctgtgcacacctgccagctgatgctcagtggcataggcatggtgaccttgaccatacctccaggctctcggcctccaggtctctccagatgacacgccggcagtcccccactagggtctcattcttcaaggggaagagcacctggcccaggagctggtgcttcctctgcctgtccacgtggtagacggagaacttcagcaccctctgggtgatggtcttgctggacacctgggggggacaaggacaccagccagagtcaggcgtgggggtaggggatgggatggtgtgacttgttattctggacatgggtgcttttgggaacgggtgtctcaaccagggacccacatcccccaaacctaggcattttcaggggacccttctcagcagcagagccgtgtacccctggaaagtgggggtaggtgccaggaccttggtacacagagtgtggtccgaggacctgtagcgtctaccaccacttggagccctgttagaaatgcaggatcttgggccccagcccagattcatgaattggaatctgccgtttaaccggagcaccaagtgacatggctgcacggtgagtgtggctccgccaccaccctgcactgtagcaaaggcccaggagcccagggcaccggcctgtctctgctgtcagagctgggcatgccagctctctcctccctgagatttggcctcctcgcctgtgaaatggggattatgggtcttcctctctggttgtaaaaccccaatcacagtgtctgacctccagcagatggcccattaatattgattttcttttctttccccttctcccttttccacagagggattggatcaagctggggcgagatagagtggggaagtgatgagctaagaaaaattagcctgcaagcatgacgtgtcgcacgtcagcaaggctgcagccttggattctgatgtcttgagaagagcgattcacctgtgaattctcacagccctggcctcagaaagacggcccgggaccaggcccgatggcacccctcttcccagctctcagccagggcggaaggcacaagtgatggccctggcctccgcagtcacactcctcctgaaagctgactggctgaacctcacctcttggctagcttgccacccagctcttgagaacatgtttgtccaaggcctcttggcaggtctcgatgactccttcccctaagggcccccagtcacctgctaaggctcccaggcccctgtgaaactggctcggtgccccaatagactctccacctccagaccctaagccggccagcccagagtgcagcaaggcaccacacctaccctgtgagggcactcgggccccgcgctggcctctgacagcacaggaagcttctgcattcacgctgaggcctgtcttttgccttccttagataaacttgccagaaaccccatagtgcttcaggcctttgggataattcccctgagccccataggccagggcctggcattcagtagttgctctaaaattgtgttttcacccactctcttccaggtagtcaggacagggaagcccaggcttctggtcaccactcaccaaatctctcccctgcccctctatcagggatcagctcctataggccttaacctagcagactaggtaaagcagagctggtggcatcaagggtcccgggggctgcagagccctggctggtacaggaggctgggctctcctgtaggtctgcaccttcccagcaacgcggagggcaccagaccctgcctgctccagaggctgtacctgaaagatgaagtgctcgtcaaactgcgggttggaggttttgcgtttggtcttggattggaggaagcgccgctcatcgggcagcaggtagagcttcaccagggggctgcaggtctccgagggggcttgcaggtgctgtgccttgatcaagcccaccagcagccgctcagcctcctgctcatattccaccgagaaccacagccgccccaggcagccgtcggggaagtcggtctcacttttgtcctccgggaacttgtacagctctgggttgatggcccccaccatacatgcatctcctatgacagagggtgggagggctggcaggccagaggaaggcaggggcatgggagacagtggcaagctctgggcacccatccccatcctggcccatccgtctctgctgagcctcagctagcctgaccacatctgccccactctcctcaccaggctaaacacatcccctctctctggtgcagctcctccaagaagccttctcaccatgaaggcattgcatggccaggctggggatccagcagagtcctgccccctgggattggcccccatccttggaggtcaggacctgtttcaaggacacagtgcccatcacctggcctagcccccttccatggcgtctagggaatgactcagcgataaaacattgcctttcttcttcctcttcaaattagaagggccaaggtgattattgggtggttcctgtgatggtctcttggtagatcttcagggcaaagaggtggcagaaagctgtgtttgcagcccctaccattctgtcctcttggtcaaccaacccatcatcctagagtgggacccagcacaagttctgtacatggcgtgcctgggttccaattccaatctgttgcttacagcctcagttaagactatgtaaaatggggtgataattcctccccctcagagtcatggtgaggtctcactccaaatcagcacccaaggccatatcttaccctcatggggtgcagcaagcacttcataaatgaaagcacccagaaagagtggtccctgggtggtccctggcatccctggctggttcaggttgtgttccggagccaagctggtgaaagcagatggggccacccgagcagaccctgacctctgggcagccctggcaaggacactcaccaaggccgccgctggaggtgtgaggcagcagctctgatgccgggcaggggtcccatggggcatcggcccactctccactgtgcaggggcacccaatctcggccttgaagggttgggggcaccacgaatggcacagctggtggcctgtccagagtcagggagacaacatgtaggtggcaagtcaatggtgtggtctcagagcgctcagccaggacggttgagcaccaggggctggaggaagaaaagccatcgggagccaggaggaggccagggcaccattttctgggcccataccaggcaacacacacacacacacacgcacacacacacacacacacacacacacacacacacacagcagtgggatttgaagaaggaacacagcacctgacagtgtcagccagtctgggtttggattcctgttctgccacttactaattgtgttctctggacctgttgcttatgtgcactgagcctcagattcctcacctggaacatgggtttcataacacctgcctaatagctgatgtgaggtttctggggtttctttgtgatagctcccagcaccgaagcagcatagaagaggcacccccataaacagaactttccttttcgaccccaccctgagggaaattccaggggcgcacttggccccacatcctgcctcacctgctcagttgggtcctagcatgcggctggcagggcctgtcccgctgcccactggaggcagctgtggtggccatggctggtgtcccaggcagctcctcataggtgagggtggcacagaaccttctccacagacagcagcttgccccgatcaacagcagcagcagcagccccccgatggtgcccccaatcaccagggccagctgctctgggggcagagaccaccagtactatgatgcctgcctgggaaagccactctccctcacagccctggcctgctggggcagaactagggcagcaaccctgcctctgggtttgatctcaggagtgataggagcaggcctgctggggatgggttccgggagggatgctgctggctaggttccgccagctctcagaggagaagccgtttaccccagggtctgagagccctgggcagaaccttctagttttccttggaaaacagctggccctgcccttgggattctggcttaaagaagccatttccttgcgcttctgagtagaaatcaaacctgccctcaccagaacctccatatcccctgggctcctgttgaggccaggaggggagctggggtgtggacgcagtcagttaaggaaagccctgaaaggtaccttccccctggtctgcaatcaaacctctaccctctggggccctggaacctgctgcaaggctggactcttctctaacacccgctccctcccctagccctctatcaaggtgagcacgcgcttaggggagttggtgcgacgcggtggacgaggtggggaggaaaagggggcaagaccccgttgctgctggccctcacacgtccgcatttgcgggacctaggaggcttcgccccgggggtgctcagacgctgggttccaaccgctggccacctggggcgggccaaaaaggtgcctcccttagggtgacgtgcggccgcggggcattcaggtctcagggatctgcactgggtggggtggtgagaaggccggaccccccacacctcctaagccgcaactgaccgcgaagagcgggcctcagcgtctactccatcccagtgcccctccaagagcgcgccgaggccgggcagggcaggcgctgcaccccagcgggggcggcggggcggaggcaagtgctggaagggtcgcagaggggccggggctgggctggggaggcgaggctcgcttacccgccatggggctgctcccgcaggctggtctcgccggtctgggcggctggggctgggctgccaggccgtctcttaaagcgccgcggggcgccgtcgggcgagcacaggggcggtccgtggtgctgctggtgcccagctgcggcgcggggagccgcgcagt

SEQ ID NO: 2190 - DNA, 41506 bp, Homo sapiens
cagaaatcatgagtggaggatctcaagtccacattttttggggtgctccagttgcttcactgaaaatgacagtatcagaagacacagcttctttaatgtctgttgctgacccctggaaaaaaattcagcttttatacagtcaacattctttatatctgaaggatgaaaaacagcacaaaaatcttgaaaactatgaagtcccagattctattggttctccagatctttgtggtcatttcttagcaaactgtatgaatagacatgttcatgtgaaagatgactttgtacattctgtttctgaaacacagaatatagaatcccagaagattcactcctctagactgagtgacataactagctctaatatgcaaatatgtggatttaaaagcacagttccgcatttaaccgaagaagaaaagtatcaaagcttctcagtgaaaataaaattagagatgaacagcctaaacatcagccagatatatgtggtcagaactttaacacaaatttgtttcagttgggccataaatgtgcagctgtgttggatttggtttgtagtactgaaaaaattaatatagggcctgaagtggtacaaagagagtgtgtgccaacagaatatcatgaaatacaaaaccagtgtttgggattattttcctcgaactcagtagataagtcaaggtctgaagcagcagttaagaaggtctcagaccttaaaatatcaactgataaagaatttctcagtataattacctccagccaggttgctttttttagctcaaaagaaagataaaaggcggagtcctgtaaataaagggaatgtaaacatggagactgaaccaaaggcaagttacggggagataagaatacctgaagagaattcgattcagcttgatggttttacagaagcatatgaaagtggacaaaaccaagcatattcccttgaactttttagtcctgtttgtcctaaaacagaaaatagccgcattcacataaactctgataaaggtcttgaagaacatacaggatctcaagaacttttcagttctgaagatgaactgccaccaaatgagatacatattgagttgtgtagctcaggaatactgtgttcccaactaaataccttccacaaaagtgctattaaaagaagctgtacctctgaagataaagtgggccagtctgaagctctatctggagtccttcaagtagctaagaaaatgaagttgatttctaatggaggagattctgctgtagaaatggatcggagaaatgtgtctgaatttaagagtattaaaaaaacatcattaataaaaaactgtgattctaaaagccagaagtataattgtttagtcatggtgctatctccatgccatgtgaaggaaataaacaaaattcggaccaaattctggctctaaagtgcctttagcaacagttacagtaagtgatcaatcagaaactaagaagaaggtttttctgtggaggactgcagcattttgggcatttacagtgtttcttggagatataattttactcacgggtgaggtcattatggtatagtggtagcttattttataaagctaagttttgtttgtttttgtttttctcccacttagtctttgaagactctttctttagtcatttgcctcttctgagctcagcataattgatccctttattgcatctgcattgctctcctttccattgtccactctcctgcccattgccacttctgggcctctgttctatccttctcagctctgccccttctttccacttatcccctcctttaataagccttccctagtcaggtggagtgggtcacacttgtaatcccagcactttgggaggctgaggcaggaagattgcttgaggccaggaatttgagaccagccttggcaacacagaacccgtctctacaaaaaataaattaagttttgcgtgcctgtagtcccagatacccaggaggctgacatgagaggattgcttgagcccaggaggttgaggctgcagtgagctttgattgggccactgcactctagcccgagcaacagagttagacctttctgcttctttacctaatgtctaataatgctgtgcacattgtgtttttactgtgggaacagttattgatttctgttgccttattttattatcaaaattatattaattacacttggaaatatggaaaggaaaaaactggtattataccaacttcatataaccaccaatagagttcgagagtgttgccttccagttattttctctgttctccttaaaatgtgtgtgcatgtgtgtatatatcacacatagaagctcatatttattgggagcttagtttgtgagaccctgttttagattttacatgcatatttcattacaacaagtatatgaggaaggtactgatttttatccccacttttcagttgaggaagctgaagcccagagaagtaaagtaacttgtccaatgtcatacatctaggaagtggcaaagctatagtttctcctagactccagaatttatactcttactatatagttgtaaccataaagaacattttgtttttttaatttttaatttatttatttttaagagacagagtcttgctatgttgccaagtgcagtgggtactcacgggcacaatcccattactgatcagcatgagaatttttgaattgttatttttaattttttgtttgtttgtttaataaggacaggatctcactgcattacccagtctgatctccaactcctgggctcaattgatcctcctgccgcagcctcccaaagtgctaggattacaggcgtgagctaccgtgcccatggtatttttaacatgcccttgtttccaacctggaccagttcacccctccttagggaacctgtggtcctccactcccaggaggtcactatattgatggcaagcttagtgcaaacacctgatcggctacaactctgaactcctgggctcaagtgagcctcctgcctcagtctcccaagtagccaggactacaggcacgcatgccgctgcacccagagagaatatttaatttttttttttttttttgagacagtcttgctctgtcacccaggctggagcgcagtggcacaatcttgactcactgcaacctccgcctcctgggtgcaggtgattctcctgcctcagcctttcgagtagctgagattacaggtgcaagccaccatgcctggctaatttttgtatttttatagagacggggtttcaccatgttggccgggctggtttcgaactcctgtcctcaggtgatccgcccacctcgccctcccaaaatgctaggattacaagtgtgagccaccgtgcctggccagaatatgttttcatcgaacacatctaacattgtgttacgtgttctttgttgatttaaaattgacacatggtgtattagagcaggaggaagttgattaagcttaataaaatatctaaagaaagaatgtgatacagaggcggtatttagaaaaagaaaacttcgaagcaatattgatagtcctaccaaatagtttacaggaggaatgagaaccttagctaatgtacttggtgttcctgtaggattgtcaagtacaatctttttttttttttttttgagacggagtctggctctggcacccaggctggagtgcagtggcgcgatgtctgctcactgcaagctccgcctcccgggttcacgccgttttcctgcctcagcctcccgaatagctgggactacaggcgcctgccaccgcgcgcggctaatttttttgtacttttagtagagacagggtttcactgtgttagccaggatggtctcgatatcctcacctcgtgatctgcccgcctcggcctcccaaagtgctgggattacaggcgtgagccaccgcgcccggccgagtacaatcttttataaagaagtaaacacaaaattgtaatgaacaggcttagcatagccacatcccactggcagtattagctaatattatttatatgtgattatattattggaggttcaattcacctaactccctctgttctgattcagtgcttgctgaatacctctttgcttgtgatttggctttctagttgtagagctgcccacagcatgagaacaggctgaaatactgtttttttggggcaattattgtaaatgaaaaaaaaatgtttttttttctttaatttgtttcattaattgatttagtatgagcttatgttgcagagctgaaatctagttttggagtgttaacaaaattaagtttcccagactgtaaaagagggctggatcctggaccatggtcattttaccgaggcaattaatgtcagcagggacctctcaggggccttttcctttttcctaggtaggtgtaaactcaactctgcaatctctgtattttttcctaacatctctatagttgttaacgactaggtaacattctctctggtggctgtaatgcaatttacttaaccattttcctattataagacatttagatgatttctatgaacatttttttaaaaaatcagattttttttgtctttttaagaaaaagaggatctagttcaccgatttctgaataagtttcttttgtgtggaacagatggaaatgttgggaaaaaaaagaaatctacacttttctgttgtcctaatgaggcagtgaacttagttggatagcttgggtagtttatactacctattgatatatacccccaaacagaaatcttcctttttttttttttttttttgagatggagtcttgctctgttgcccaggctggagtgcagtggcgtgatctcggctcactgcaacctctgcctcctgggttcaagtgattctcctgcctcagcctcccaagtagctgggactacaggagcccgccaccacgcctgactaatttttgtatttttagtagaggcagggtttcaccatattggccgggctggtctcgaactcctgaccttgtgatctgcccacctcggcctcccaaagttctgggattacaggtgtgagccagcgcgctcggcccatactgaaaaatttgaagtaacagatgtattccagaccttgttgaataccaacacagtagacagtttgctattataacttctagcaatagaatgaagagatgccaaaaataaggattacctaagggagactactgactagaattagaagaagatgggaggcttaacattgggaaaccacagtgtttaaaggacaaacagaataaggactaggagctggggcatgtcagtgagagggtaggaaggagccaggaggccagggtgggctacccatcccctccatgcaccactagtgattaccatgtcactaatccaacataggcttcacagtcctagctttcagaatgctctccttgaaatttcttgtctgttccttttttctgaagaacatgcatcctgaatgttggatcatgaaaagtcttgaatgctgtactagctcttcctggctaggcagtggggaaccactgttttttagtaagtcacctgaactcattaatgctctgatatatcactcgcctgaactcattactgctctgataaatgactcattagcattgtaagaaatgggttgcaggcgggacaagcacctgttgggagggaaaggaatgtgtaatgtaaaacagtagtagtggtggggcatgggcacatttaagcagcagaggggtaggtgggagctggtggcaaggagtgggaagggagaggcaagatgacttcagattttagtttacttgattagcagcatagcatcaataaatgagttgggcgctatgaaaggaaaagcagatttggacattgctgagtttggggagccaatggaatatccaggtgggaatttccattaggcagttgtagataaaaggttcaaaagctgaggaaagggtctggaatctaaatctgtaagtaatcacttggaatttatacatccttggttttctttcctattatctctaaattatttcactattgttaatatatgtttatacctctgacactgtatgctgattagatcctgccttagagatagctcccttcccctctttctctttacagctcacatgttttgctctacctacaattgtttctacctgttggtatgtttagttctacctgattctactctatccgtcttagatatacagctctctctttccaattggaaaatgttccctacctccaaagtctttcacttttaacttatgtggaagataattatcgtgctatttagggaaaaataatcaagtgtgttatattcagatatatttatagtagaagggaccagtgcatactgaatattattactctcctaggcactacggctttggaaccactactttgccttctggtcctaaaaaaaattatttttgatgtatcagaaatatacatgataacattttccttatgtaaataaaaactattaaaccttttttatatagagcagtggacttccatactgctatcatttgaatataaagaagaaattttgttaatttacctagatttagattttagatttgctgttttgtcatttcgtgcccttaggcaggttatttaacctatttgatctctagttgcttggtatatgggaggcatgcataatattttgctgtgactagtaggttaaccacattgtgaaggaatttatggcatgatcagaatgttttttctctctctagatgttgttattcatgaggaccaatggattggtgagacagtactacaatcaacatttagcagtcagttattaaatcttgggagttattcatctattcagcctgaagaatgtaaggcacattttaaatgaagtaatgtattagtgtttaaagtataaaaacatactaggaaagattagggttaaaatggttcttttacaaaatgttttctaaacagttggagagtattggtttcttttcattagtaagaatgaaaatagaattttaagaaatgaacttgtacattgtaaatcacatttattttaagaagtattgggtctcatgtttcgttttcttaggctgtcagtatagtggtggttcttcaccttttagggagtcagagacctctttgagaatctatagaccatttctccagaaaactggacttatgtagataggcacaaaattttgcttataattctaaagcattccgtggacctctgaagttcttctgtggaacttctgagcctctgattaagaatccttgaggtaataaaaatgtattggtctcgtattcagacagctgtggtttgaatccttattctcctgtctaccactgctaagaaaagctatttttcttctttaatgtccagttttctcttctttaaaagaagctgtttaatgaggaaactagcagctatctcctcctctaggaaataaaataacataaaaaaaaagaaagaaaacaaagtaagggaaacagtataaacttgtggttttggtcactggactcagatagaccaggatttgaatcctggccctcttacttccagtctttgtctttaggcaagttatttcacttcactatacctttatctccttttctttgaaatggagataaaaatacatatataccttatagggttgttatgaagattaagtgagaaaatgaatataagatgttgaacctgcacataatgtagtagtaacatagtaatattagagggagaaataataagctagcaaaatatatttgataaaatgctgaaatatcatacaagaaaatagctagagaaatatactgattatacaagaagataactggaataataggaaagttataggatgtatatggaagatagagcatggaattccaatctttgaattcttaaagaaaggcagagcaagtagaagggaagagcaacaattagaataacaagaactgtgtttgggatgggcaaggtttcattatatactagggtggcccatcagcagaaaaccaactctgacatatttcatagacaactcaaatagagttcttcatctatccaatatatatttattatgtgttgacattgtttcaggcactgtgtttactgtacactgggggtacaatggtgcctgtcctcctggagcttatgttctcatgtggaagacagaccaaaaaaaatgaatgaaacagacatataagtaaaatatttgcaggtgataatgagtgctatgaaggaaactaacaaagggttaagatacagaatgccatggttctagttgagaaggattgatcatggagtagaatcagggttaggaagttgttacaatagctgcagttgagagataatgggaggccagtggagctaaagagccgagatatatttgtaaatagagttaataggattttctgatgatgtgggtctggggatcaggtaagagggacaatctactgctactggattactggtttaagtaactaggtagcctttattgggaaagactgagagggaactggtttgtggggaaaagggctatgtttcaaggcatgttaagttttagatatctttgagatattcaagtggagatgtcatataagaactggaaacaaagttcaggactcagaagacaggtttaaaattaagaggcaaattttagagttattagcatacagataatatttcaaatttaaaagtttttaaaataaatattatctgtataattatagaatcacaggggattgcaaaaataatacataaagtcccatgaactcttcttctagcttctcccaatggtgatatcttatataactttagtacaatatcaacaacaggaaatcaacatttgtataatactgttaactagtaatatactaggatactttccctttcagtatcaataaatatagtatcagcctggcacagtggcttatgcctgtaatcccagcactctgggtggctgaggcaggaggattacttgggcccaggagctcgacaccagcctggatgatatggtgaaacctcatctctactacaaatatggaaaaattagccaggtgtagtggtgcacacctgtagttacagctactggggaggcttaagtgggaaagaaagttgaggctgcagtgagccatgatagtaccacagcacttctgcctgggtgaccagagtcagaccttgtctcaaaaaaaatttttttcttaaataaataaatatagcatcaatacagcattataatatgattaatactatatcaataaaatagatacttagtcctaatgccaatgtcttatttaatagaaaagcactcgaggcattgtcattaaaaccaggaaaaagataaggatgtccactatctctgcaactattcatcttatactagaattatcagctaatgcacttagacaagaagaggcatctggtctggtgcggtggctcacgcctgtaatcccagcactttgagaggccaaagtgggcggatcacttgaggccaggagtttgggaccagcctggccaacatagcaaaaccctgtctgtactaaaaagatgaaaaattagccaggtgtggtggtgcatgcctgtggtcccagctactcaggaggctgaggcatgagaattgcctgaacctaggaggtggaggttgcagtgagcacctgtacactgcactgcagcctgagggacagagcgagattctgtctctccaaaaaaaaaaaaaaaaaaaaaaaaaagaaagaagaggcatttgaacatttgaatggataaagaagaatgaaaattatctctatttacaaatgctctgataacatacctgaaaactccagggaatcaaagttaaaacaaatttaaacaataagataattcaatgatataacaggatgcaaaattaatgttaaaaaatatcattaggctgagtgcagtggtttgcgtctgtaattctagccctttgggagatgaaagtgggtggacagcttgagcccaggaattcaagaccagcctgggctacaaaaaagaaaaaggaaaggaaaaagaaaaagaaaaaaatgctgggtgtggtggcacacacctgtggtcccagctgtttgggaggctgaggtaaaaggattgcttgagcccaggctgggggatgaggttgcagtgagctgtgattgcaccactgtactccagcctgggcaacagagcaaggccctgtctcaaaaaaaaaataataataatagtaattagacaatatacacaaataataaacagagggcataatgatagtgaaaaactcatttactatagtaataaagaagatagttcaaaatacagttaacaagaaatatgcaaagcctatatgaggaaaaaatttaaacactccagaaagaaatgaagacatgaataaatggaaagacattccctgttcttggataggatgactcaacattataatgatgtcagttcttcctaagttaatatgtaaattcaatgtagttccaatgaaaatatatatgttgtggcatataaaagttgatactaaagctcatatgggaaaacagacatgcaagaatagctaggaaaagactgacaaaggaaaactacagaggaggggaactagctttaccagatgttaaaacatactataaagcctctgtaattaaaacagtgaagtactgatgcatgaatagacaagtagaccagtggaacagagtaagaagattagaattagacccacctacatatagcaatttaatatatgacaaagatagtatctggaatcagtgagataaaagctaacttcttaataaatggtgctgagacaactgggtagccatttggaaaaaagggaaaattggacacatatctcacaacaaacagtaataaacaccatatggattaatagtctaaatgtaaaaaataaaatcatgcaacaacaagaaggaaacctgaatgaatcctctgtaatcttggtgtagggaaaggctttttcttaatattactcagaatccaggggcagtagaagataaactgatacattttactacagaaaaataaattttgcataaccaaaacactataaacaaagtcaaaagacaactgacaaacttggagaaaatatttgtaacatacaacaaaaggctaatatccctaatatataaagaacttttaaaccttgagtgacaaagtctgggtgtggttgttcacactggtaatcatagcattttggaaagctgaggtgggagaatcacttgagctcaggagtttgagtccagcctgggcaacatagtgagaccctgtctctacaaaaagtcaaaaaattagccaggtgtggtggtgcatgcctatggtcccagctacgtaggaggctgaggcaggaggattgtttgagcccaggaggtcgaggctgcagtgagctgtattcatgccactgcactctagcctggcaaaagggaaaatgtgaaaaagagatgaacagtcaattttcaaaaaaagatataaaaatggctatcaaatataacttattagagaaattcaaattaaaactacatggagataccatttctcacctatcagattggcaaaattaaaaaaaaaaatcacattctgttggcgcaactgtgaggtaatgtgccctcttatacattggtggtaggaatgcaaattgctacaacccttttgaagggatatttggcaatatctaacaaaattacatatgtacttagctttcaacctagcaatcccacttctaggaatctaccctgaagctacacctccaacaatatgaaaatacatatcagaaggttattcattgcagtattgtttataattgcaaaatatataggagaatgattcactaagttatggtgcattcacatagtggaacactatgtactatgcagctgtacaaaaagaatgaaaaagatctctacaaactgatatggagtgattcccaggacatactgttatgtgaaaacataaaccccccaaaactatatgtagtatgctgtccctcctgtaagaaggaatggaggaataagaaaatacctctgtttatttgtggaaagaaaatgcaggaaggataaaccagaaactaaagagattggtcacctacagggggcacgtaggagaggggtggaagaaagtggggaatgggaacaggatagcaggggtcaggaggaagtgacactaacaaatgaatgtattattgttacaaatgaacctaatattgttacaaatgaataaaataactacatagaagggggtggggaagaaaagaacaaacctaagtagctgtggaaaagagtatattgactggattctataaggctaatgacagaaaggactgtacataaatgctgcaatctagttagaaatatgtttctcaaaggcgaatggcttagcaataaccttatgtacatactagaatgaacaaatgagtacatagattgcagataaggaaagctggatttctcactgttggagaaagaaattataaacaagggaaggttaaaacgaaccagaggtatcgttataaactgaggatttttaatatagataaatggatacagaaatataggcatgtgtatatgggtgggatagtacacatacataaacatctcctagttctgtccattgagcgagcacagcacagatgcagttactcctcagtaataatgagcatacctggtgcccagatcttcatctgtaaacattttcttttcttttcttttctttttttttttttttttttgagatggactcttgttctgtcacccaggctggagtgcagtggcgtgatcttggctcactgcaacctctgcctcctgggttcgagcaattctcctgcttcagcctcccaagtagctgggactacaggtacgtgccaccacgcccagataatttttgtatttttagtagagatggggtttcaccatgttggccaggctggtcttgaactcctgacctcaaatgatctgcccactttggcctcccaaagtgctgagattgcacgtgtgagccaccgtgcccggcctctcgttttttttgagacagggtctggctctgttgcccaggctagagtacagtggtgcgatctcggcttactccaacttccgcctcctgggctcaagccagcctcccacttcagccttccaagtagccggtaccataggtgtgcactaccacgcctggctaatttttgtatttcttgtagagactggatttcaccatgttgctctggctggtctcggactcctgggcttcagcagtccacccatcttggcctcccaaaatgctgggattacaggtgtgagccattgtgcctggccaacatagttctctaatgaaaggaaccagctctgctaaaagtggttgattacaggactgggtcagggcaaattcaggataagcctggaagtctagtggtgccagacaagacatgttgaaataatgcaagagccaacctgaaggaacacctactggctaaagctgaagcaatttgagtaagaaaataatgatagtattggattagaacccatagattaaaatctttacaaatccttattgatataaagatatatttatttcattaactaaccagaggggaagagaaagctcttccttccaatggaattccaattaataaatctgagagaaaagaaaaaaaaatagagaattactggccatgctcagtggttcatgcctataatcccagcactttgggaggctgaggcaggtggatggcttgagcccaggagttcgagaccagcctgggcaacatggcaaaaccccatctctacaaaaaatagaaaaattaaccaggtttggaggtgtgcccctatggtcccagctattcgggaggctgaggtgggaggattgattgatcccaggaggttgaggctgcagtgagccgtgatcatgccactgcacttcagcctgggcaacagagtgagactctgtctcaagaaaaaaaaaaaatacaaaacacaaaaatagagaattaccatcaggcagagatcacaatcataaatactgcacggacacaaatgcactgatagatgctaaaattagtaggtgaaagtctgaggagagagagcattgcatagtctcaaagtatctccccaggataccagcttactagagggaaaataataaatttataagaaaactcttcagacaccaagttaactgagtgattggggtaaatatcaccagtaataagatgtatggtatcataaattctttgatattatccattgagaaggatccaccatattttttgtggaattgccaaaaatgcataacttcattccaatcataaaacactggagaaacccaaagggaaggacgttctactaaataattgatcaggattcttcataagtgtcaaggtaatgaaaaagaaaagactgagaaactcttatagactagaggagaccaaagagaaataacaactaaatgtgaggtgggatcttggatgaaatcctacatagaaaaagcatattaataggagaattggtaaaatttaaataacatctacattttaattaacaatatttaattaacgttagtttcctgtttaagataacttataatatgtgagatgcccacattagttgacatagtgaggaatataagggaactctgtactatttttgcaacttttttgtaagtcttacattagttcaaaacagagtttttaaaagagctgtatacgatcatctcaataggtacaaagaaagcttttgataaaattcaacacctgttcattaggaatagaataaaattttccttaacttcataaagagtgtctttagaaaacccagaacaattatcatcctaattggaaaaatattagaagcattccttttaaaattcaggaatatgactaggatactactattactacttttcttcaacaccatattagagttattaaccagtgcaataaacatggaaaaatagatatgtaaagattggaaaggtagaaataaaactgccattattatagatggtttacataccttttccctctgaaaactacaaacaaattattagaaataatgtgaaaatttagcaaagtagctggatataagattaacatacaaaagtcaatcacatttctagagtagagcgactaacaataacaaaggaagctgccattgacaacaatattattttgtactaatagtaataaatgtagcaaagtatgtgcaagacctaaaaaaggaaaaatttttaaatgaagaaaaactaacaaagaatgaaataaacatatactttattcattaattggaagatttaacattgtgaagatttcagttcttttcaagttgatttgtaaattcagcgcatgttcaataaaaatcctcgtaagatttcaagggcgcagtggctcatgcctgtaatgccagcactttgggaggccaaggtaggaggatctcttgaggcaatgagttaaagaccaataagattttcatgtaatttgataagattgtatgatatttatgtagaagagtaagtggttgaaaacagcagggcattttaagaagaaaagcagggaagaataatttaccctatcagctatcaagacttagtatgaacctatagtaactgagatggtgtggttttgcccagttgaagtcagttaaattttaattttgagatttctgtaaaagatacaagtttagtcttttattatgtatatttgaaggtgttacattttggaaagtgtgtgtgtatgaatgatagctaaatggcttctaagtaaaattcagcatatcttgtagatgttgatagaatagaaggggaaggaatgttttgaaataatgaaaataacatggtatgcaaatgctttgcaagagatttgggaaatgtagatatctctggttttaaggatgatctagattcaagtaatagttcagtaatttcataaaactcttatgacaaaattctggatggagaatattctatgaatcccctagagagtttcaggtttttgtagaatgatgtgaaaaatcttgaactaattagataatctttagaagttacttcacaatctttgtttttacacatacacaggaatttatggtgctttattttttacaggttagtagctaaataaagtatattctaaagtttttttattgatgtagggaaatggctaccagtggacattttgagaatattgcagttgtttttcttctgaaagagtaaaccgggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcacgagctagcgagcgagaggcagccgcgcccgccgccgcccctgctctgtatgccgctctctcccggcgcggccgccgccgatcacagcagcaggagccgccgccgccgcggttgatgtggttgggccggggctgaggaggccgccaagatgccgcagtcaaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatctttaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttggaaataagaaagacctgcatatggaaagggtgatcagttatgaagaagggaaagctttggcagaatcttggaatgcagcttttttggaatcttctgctaaagaaaatcagactgctgttgatgtttttcgaaggatgattttggaggcagaaaaaatggacggggcagcttcacaaggcaagtcttcatgctcggtgatgtgattctgctgcaaagcccgaggacactgggaatatattctagctgaagaagcaaactgcccgttctccttggagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttattggcattaatttttcagtgtagtttgttgtttaaaataatgtaatcatcaaaatgatgcatattgttacactactattaactaggcttcaatatatcagtgtttatttcattgtgttaaatgtatacttgcaaataaaatagctgcaaacctcaaaaaaacaaaaaaacaaaacaaaaaaaaagagtaaaccaatttggttactcattttaccaatttggttttgattttgcaagtggttacaactcatgagaggattcttatttctgatcaatatattgtgtttttggaaaggacttctgggaaataattatgatgaagccctcgagcaattgcaacaaaaccaaaaattgaaaagtgggacctaataatacttttttaaaatttattttttagagacaggatctcactgttacccaggctggagtgcagtggtctgatcatagctcactgcagcctcaatctcccaggctcaagagattcttctacctcagcctcctgaatagctgggactacaggtgcatgcccccatgcccagctaatttttgtattttttgtagagaccaggttgtgtcatgttgcccaagctggccttgaattcctgagctcaagcgatcctcttgtcttagcctcccaaagtgctggaattacatgtgtgagccaccactcccagccccagaacaactattattaaaaagtcaaaaaacgacagatgttggtaggctgtgtagaaaaggaaatgcttgtacactgttggtgggaatgtaaattagttcagccgctgttgaaaacagtttggggttttctcaaagaagttaaaactgaactatgatttgacccagcaattccattactaggtatatatccaaaagaaaacaaattgttctaccaaaaagacataagcacttgaatattcattgtagcactattcacagtagcaaagtcatgcaatcaacctaggtggccatcagtggaggattgaataaagaaaatgtggtacatatacaccatggaattctacgcagccataaaaaggaatgaaatcaggatggtgcggtggctcatgcctgtaattcccacactttgacaggctgaggcaggcagattgcttgagtccaggagtttgagaccagcctgggcaaggtggcaaaaccctgtctctacaaaaaatacaaaaaaattagctaggtgtggtggtgcacacctgtggccccagctatttgggaggctgaagtgggaggatcacctgagcccaggaggtggagtttacagtgagctgagattgtgccactgcattccagcctgggcaacagagtgacaccttgtctcaaaaaaataaataaataaataaataaattgcagcaacacagatgcagttggaagcaattatcctaagtgaattgagggaggaacaggaaaccaaataacgtgtattctcacttataagtgggagctaaacactggctactcatggacatagaggtggcaacaatacacactggggactactagagggagagggttgaaaaactacctgttgggtactgtgctcagtacctgggtgacaggatcacttgtaccccaaagttcagtatcacgcagtattcccaggtaacagacctgcacatgtacacccgaatctaaagtaaaagttgaaaagaaaagacttctgtactttcatctttatagtgaggtgttacatgttttacaaacctagttctgataatgtgacaggaatataaatttatcttgaatattattaaatatataagtcaaagatcaacacagtgtttccatgaggtagactttttttggaatctaaataaccatgtgtttccacgtaaatttttatgaatcagggacaaatatataatttgatgtcagagatgtttttgttccccaaaagctctatcttgttcatgaaaaacgaagcccagagaagttatgtacaagttcacagagctcattattgacaaaaccagaatttgaatacaactcttctgattccagatttgctggaaatactgtgaaagaagaattcagtctggtagtattacgtgtggttttaattttttctttgtaactttagtttgaattttatgtgtgtgtgagcatctgcatttacttttaaaaacttttattgtaaaagccttcaaacatatacaaaagtagagaatacaaagcataatgaacttaagtacctattagccagcttattaaaacatggtcagtcttgtttcacctgttacatcccttttcttttactgtctaaaggaaggaaagaagaatcacaaatcagtttatgaagtctgctttctaaaaagtacttaagtgtttattgccaatatcttattttggtcggcaatcaatcacatactcaagcatacttctcttaccttcagagaaattaaaatttaatcagcaaaactcatcagcctgtacatttaaaatatatgcatgttattgtacagaaactataccttaataaaaagtgagaaaaaaaatgagacaggaaagagaaaaacatttaaaagacatagtaactgaagaattaaataaccaatccaacacttgaaaaatattacaatgtagcacatgcttaaaagctctctgagctcagggaaaaaagcagcactgtgaatctatagtggtcatcattctatgtggtattgggtaggacaagaagacagccttgcagctggaaattggtgaggacggaggcctcgtgtggaaagagtaaggcacactcagggagagaaccagtgaggtggctctgagcctgtttcagaaggggcttgaggaagaacggcagaggctaggatagttgggaaagcaggatcaaatcagactccagggattggggaaccaattggctgttacagggtggtggagtcaaaaaagaacagaaattttgtgtttggttaattgatagaaaatgatattattaacaaagtaaagaagtatgggaacagcacaagttttttggggatagtaaataattccatttccattgattaaaaatatcaagtttatttttacatctaaactgattcaagacttagctattgtacatgttttagagaaaacaaaactatattttatatctaatcatactttacaacataaaatacagttctaaaaaatattatttgtcaagaaaaatataatgttgccatcttttgtctgtatgcatgttttttttccttagattccagcgtagttagtgacgttgtacttcaagacttactggcatatgtgtcctcaaaacattcctacctcagagatcttcctccgagacagcctcagagggtgaacagtatagactttgtagaattggagcaccttcaacctgatgtgttagtccacgcagtactaagagttgttgatttcctatactgacaggtaaacattttgactgcctccttaattttagattatgaaaaaattaagatacaagaccatcttagtgtaccatttggttatcactatatatgtatcatcagctattaaagtatggtatcatgtgtgatagagtaatgccaactaagatactcattttccttttccagaggcagtatacagttatagaggacagaagcagaaaaaagttatgttaacagtggaacaggcccaagatcaacattatgcgcttgtattatggggtcctggagcagcctggtaccctcaacttcaaaggaaaaaaggtaaatacaccaaaaagcatttaacctatttatatttcggtaaatgattaatgtttatgagcccaagatggagaaaatcttaagagacgagacagcatttgaaatacaagtgatcatgattgaatattcttctgcaaatttcttctgttaaaattttgtacctcttgtagcaattcatttatctaataagtcttcattaattaatggtggtgaaataaaggcttaaatttattcccagatatactactttacctttttagtgaagatcttacctccttcaaataatgttctttaaacatttaattctggagaagcttctacaattttttttcagccagagtactctgataaataaatgctatgattataaggcagatgtcaagggagttaccttaactctttcaagtcacaattaatgttcaataaattacagtttcatatttttattatagttgttttaaaagcatgcactgttagccatccctagaatgttcagtgttaaaatatgacccatgattacatttttctttaaagcataaattatttctggtatattgaattaaatggaattgatgtttcattaaaatagtatagtgtcttccctttgctattgtgagatcctttagttgtaacaatcaaagacagtttcatttgtggcttatgagttatttttccctgctaaattaatttagagattgattcagtatattattattttttacctgaaagagttaatgtctctccaaacttctgccttccaaatagttatttgtagataggatctatcacattgtctctcttaatcattaatagctatgactaggatttgagataagtctaactttggacttttatgttaagatcaaacagggacagatgtttgtttggttgagcaagctgacaaacatgtatcagtgatagactaactatgatcattgaccaccatagcctggctgagaacatgagtctagtgcatgctacacaagaatgtaggtcacaggtatagtggagctgtaacagagcagattgctccatgtttaatgtgaatattcttttaaaattaatagttttttggttaatagaagagaaattacagttgtctctaggtgactctatggtgtttaggttagtattgaaaacgtatgaatccaggaattaagatgttgttgttctttgtacattcattcatccagccccccttatttgtaaccatcattttaaagttttaacatctacttcaatacctcacatcagtctttttaagataaaaataccaattttgaaggattacttaagtaattctattttcctgattttacttttcttttcaagagaccaaccccatttccaaattcccagcaaagagaatctgattgcccagagtaaatttgattcaaaaaactgtgatcaggaagacagggtcacgcaatacaaatatgagagcttgagcttatttcagtggatgggaaaacagttaagggaatcatttgtgatctgggtgaatacataaagatattcactaccaaaaatgtgtatgttcattagcttagaaagatatatgtaatgtattatttagtttaaaaagtagattataggccaggtgtggtggctcactcctgttaacccagtaccttgggaggctgaggtgggtggattgcttgagcccaggagtccaagttctcatcttaaaaaaaaataaaaaataaaaaaaattggattgtaaaacttcatgtatagaaaatatattatgttatcatataataaatatttttatgtttatataagttaatacacaaaaattttcaagaaaaccctttatatatgatagtatctcattttaataaaaatgtatctataagtacatatgtgcatttgaaaacctggaaatatgcatgtatagcaaaatgctagccgtagttatttctgtatagtagtattatatgtgctttaatttttttctttatacctttagtttgaatttcatatgtgtgtgagcatctgcatttacttttaaaaacttttattataaaagccttcaagcatatacaaaagtagagagaatactaagcataaggcactttttttttttgtttgtttgagacagagtttcattcttgtcacccaggctggaatgtagtggcatgatctctgctcactgcaacctccacctcctgggttcaagttattctcctgcctcagcctcccaagtaactggaattacaggcatgtgccatcatgcccagcttatttttgtatttttagtagagacgaggtttcaccatgttggccaggctggtctcaaactcctgatctcaggtgattcacccgcctcagcctcccaaagtgctgggattataggcatgagccagccaccgcacccggccagcataatgaacttcggtacctattagccagcttattaaaacatggtcagtcttgtttcacctgttacctccctcatctttactgtttaaatatttcacaataaatgtattttattttataattaaaaataaaattaaaaccttatgctttttaaaataaaagaatagttaatgtttggaaaatctagctaacaatgtgagaaaaaatagaattaaatttatactttatatttgtgccaatataaatttcagatacattagagattcaaatacaaaaataatgaaacaatgaatagtagaagaaaatataggcaaaattatttgtaatgcaaaggttggtagggtaaataaaatccaggaacaaaaactattatacataaaaaccaccatgtacaaaattgaaaggcaacaaaaaaaaaacagaaaaaaaattacattgtcagacaataatgcagtaagcaaaagacacatatctatagagttaaatggggaaaggatatgagtaggcaagtccccaaagaagaaataaaaatggccaataaatatatggaaaaattgttcttacaagtaattgaaaacacacaaagtaatgatgatagattatttttcttttaagaaattgattgagaagatatgggaaaacagctactgtcatcagctattggaaatgcaaactggcagaacctttcttgaggataactgacaattaatatgaacaaattgggggtacttttagcccaataattttagctctaggaacttatcataactatgtataaagatgtagctgaaaatgggtttatcatggtatcatgtataattgtgaaaaataaaaaacaaccagagtccctcaaaatagaggtttgctgtaataatttttaagattttggtgtatctggacaatggcatattatgtaatatttaaaagcaatgtagaataatacatacatataaaactatatttgacttattaagtcaatcccaataaataaaatcccaaacaactggttgtccgctaaaatgttaactgcttatttagggtgttgagattatggctgctatatgtttatttacttggcttctcttagcttacttttctaatcaggtattttgtaataagacaagaaagctattttagtgattggttttaagcagtaacttggaatatatgctttagttctagctagtgatgttctgtctttacagatttactgagatgtttgatgattttccaccaaaaaaaaaaaaaaaatctttagtgaaagaaactaaggagatgagcaggtgtagtaaattagatttatggcctgaagtgagaaactaaaaagacagctgatgttatcagaaaaatgagtgctaagaaaccctcttttgttttattatagttttgaagttgaatttactaatacagaatatgataatacagataagttgaatttactaatagagaatataacagtaacaaggtctgtgttactgtggctttaagtattagaattgtggccggcgcggtggctcccgcctgtaatcccagcactttgggaagccgaggcgggcggatcacgaggtcaggagatggagaccatcctggctaacacagtgaaaccccgtctctactaaaaatgcaaaaaaaattagccgggcgtggtggcaggcgcctgtagtcccagctactccggaggctgaggcaggagaatggcttgaacccgggacgtggagcttgcagtgagccgagattgcgccactgtgctccagcctgggcaacagagcgagactccgtctcaaaaaaaaaaaaaaattgttactgagagttaaaaataagtactattgtgtctaaatgctttttgttctagaaaagttaactaagataactaaagtattgaaatatgagtgaaatattagacttgggttcatttcagtgtcctttctttaacaaaacaaaacaaaactttgcctatagatagatacatgagaattttctttacagaaagcagttggttattataaatgatgaccgttcaggagggcaaggaatctttagaaaatattttattaaaattatctctggtggcccggcgcggaggcttatgcctgtaatcccagcactgtgggaggccgaggtgggcggatcatgaggtcaggagttcaagaccagcctgaccaacatggcgaaaccctgtctctactaaaaatacaaaaattagccgggagtggtggcacgcacctgtaatcccagctactcaggaggccgaggcaggagaatcacttgaacctgggaggtggaggtttcagtgagccgagatcacaccactgctctccagcctgggcaacagagcgagactctgtcttggaaaaaaaaaataataataataatctctagcatgcttctgttgtcttaatgcaccattcatattttgtctctgtttacccaaattctttagtgataaaagattagtattcaactgacttaatcagatcaatctatttaatctgatactaagcctagatttttttttcctttttggtgacttttgtttttactgtttttgtttaaggttatatttgggaatttaaatatctttttgttcagcgcaattacacactagaaaacctagaattgcatacaacgccttggtcatcctgtgagtgcttgtttgatgatgatataagggcaattacatttaaagcaaaatttcaaaaaagtgcaccctcctttgtgaagatatcagacttagcaacccacctagaggataagtgttcaggtaagatttttatatacataaattctgctatttttatttcttttgaaacagagtcttgctctgttgctcaggctggaatacagtggtgtgaacacagctcactgcagtctccacctcccaggtttaagtgattctccccgctcagcctttcgggtagctgaggagggaagggaaggctagtgcataccatcagtgcatgccaccacacccagctatttatttatttattattttggcagagacagagtctccctatgttgcccagtctggtctcaaactcctggactcaagtgatcctcttgccttggactcccaaagtgctggaattacaggcatgagccaccacacccagcccactgctagttttaatataagcaaaaaggctaccacttgtggtaaaaatgtataagtctatataaaagtgaaatataaatctttgcaaatatctgaactagattccagtagttttaggaactatgtgctaggaaccagggacaaagagcaaatacctattttttattatatgacaagtgggagcagaaattcagatccttactttatcttggccaaatgccagattaaaatgttactagttgggttaattcacatatatgtgtaaatatgttttccaatatatgattgaaggttagcattgttatatcataaaactatgctaaggagaatacaggcagaaaacaaagacaatacctctcaaaaaacccaacttttaattgaatacagagatttcattctcagagaagaactccttattcttagttctacactgaaacatttactaataccagcagatagtttaaattaataatatttctggaaggtaaacacagatgatagaaaatttataagcttttatactataaaaatttcatactattttcaaaaatggaagttgcctatggtcataaaagactctagatttatactaactggtaaaatcttggtaatgttatagcatcatgtaagttcctaagccagttttatatttatgtgcccctcccgtgctctgcttctccaacttcacagacatatagaggtggtcaccacaggaaggaatgccagacacagttgaggggctaccttactttgcagagacgtttagtttggtgccatggagaagtcaactctgttatttactgcttacacaaaacagttatctgctgggattgaagtctagaattaggtttaaaaataaaaataaataacatcatggacaacaacaaaataggaggccaccacgctgatgatgaaagattctcaggctatagccccacttgtttgaggacgcagccaggaattgtgcatgttcttggaagtcctggaggtgtgctcctcattagcaagccatgccaaaactgtgccattaaaatcagtccttcagaggctttgttcacagaggcctgtttagcctttttcattctctttatgttcagctatgagggctgaattcatagtttctgtcatagtgtatgtgtttttaagacaaaaatggagagagaatatgaaaacacaagcaacttttccctaacctattttatagttaaataaaaggagaaagagagatcagcatgggagcatttcctagaagggtctgcttgctcaacaaaagccagagggggatgaggctaggcctgagtccttgtaaagaaatgaagacgcttacccagtacctcatcttaccgccagcagaatttcagtgctcagccggagtgacccccttgaaagcaaagtccacattcagcgtgaccttttaattcttttcaagagttgtgtaaatttacaaaatgataggattatgtgaacattcttttaaaattattgaattattacgaattttttaggctgggcagggtggctcatgcctataattccagcactttgggaggccgaggtgggtggatcatttgaggtcaggagtttgagaccagcctggccaacgtggtgaaaccctgcctctactaaaaatacaaaacttagccaggcatgatgtcgggtgcctgtagtcccagctacttgggaggctgaggcaggaaaattgcttgaacgcaggaggcagaggttgcagtgagccgagattgcaccactgcagtgcagactgggtgacagagcaatactctgtctcaaaaaaaaaaaaaaaaaaaagactttttgagtggagggaggagagcaagggttgaaaaactaactgttgggtactctgcctactacaggagactacttgggtgatgatatgcccatgtaacaaacctgcacatctaccctctgaatctaaaataaaaatcgaaattttttttttacatatttttttaggccagacacattggctcaagcctgtaatcccagcattctgggaggccaagaagagtggatcacttgagcccaggagttggagaccagcctggtcaacatggcaaatccccatctccacaaaaaaatacaaaaattagccaggtgtggtggtgtgtgcctgtagtcccagctactcaggaagctgaggtgggaggatcacttgtgcccagggaggttgagactgcagtgagtcaagattgcaccactgcactctagcctggacgacagagtgagactgtctcaaaacaacaaaaaataataattttgtagtgatttaacatgtctttggaaagatgtggtattgaatcttctacagtttgttacatattcgatcgctacgcactcctgctaactcatgtagggatatgtgacacaattggaagagatgatgaaaccgtctttgggcattgaaagactaaagcaaatgaagttaagaacagaagactcatcattaactggactctgaaagagataaccagaaaacagtaggagactagagtgattagttcttgacctggagtgttcttacttctaagtggatgaagaagaacaaatttgaaggcttaaggcttaaagaagcctttaaattgactatggagaaagggagaataatgctcaagaaaactcatagacctcaccagtacacagtaagacaaaagtaaattaggaaaaaataatgtctgggagatagtagactttcagtatttgtttactggtgaatggatgagccattagcagtgaattatgaatatgcttgaggtttcttgtgagtcacctgagaaacgattaataaatgagaactttttataacccacagccagagtatatagatgataatggtgagcggaaagttggaaaaaagtttaaaagagaacaggctattgatatttttacgtagagagaagaagaaaagttcacctcctatttggcttttttttttttttttttttgagacggagtctcgctctttcgcccaggccggtgtgcagtggtgtgatcttggctcactataagctctgcctcctgggttcaagccattctcctgcctcagcctcccgagtagctgagactacaggcgccagccaccgcgcccggctaattttttgtatttttagtagagacagggtttcaccatgttagccaggatggtctcgatctcctgacctcgtgatctgcccgcgtcggcctcccaaagtgctgggattacaggtgtgagccactgtgcccggcccctatctggcttttcaccatgatcagtttaaaagaagacagggcaaggagagagggcatgttagctagtttcaagtattcgaagggatttcttctaaaggaggtattgaacttattttgcctgattccagaggatggggaaggaaggaaacatcacatgttcagccaaattagccaagtaaacctgctctcagttgcagccagacctccctgcccttagattctaggaaaatagtaaagaagacgaagaacaagacctcagtgtatccttttactacaagtgactgtaaatcaactataaaattagccatgtttgtaaattaaagttataattttggcccaataatttataacatatctgtttgttgtttgtaggagtggttctaattaaagcccagatttcagagctggcatttcctcttacagcagctcagaagatagctctaaatgctcacagttctctgaagagtattttttcttctcttcccaacatcatatatactggctgtgcaaaatgtggattggaactagaaacagatgagaacaggatctacaaacaatgttttagctgcttgccatttactatgaagaaaatatattataggtaaggcaactaagcaagccaatttgatggaaaataattattatagatctggaaaaactagtctgtaaactcttactttctaaaaagaattaactagagctagtcgaagagaacaaaattttccctgagtgatagatagctatttatggtagcaaaaattacccaggaatcgttataggaatttcttaaagataggaatttcttaaagcagtaattgggagattttattgtcttcaaacagctgtaccaaagaaacattttccttggtttactttttaaccaaaatctaaatgctcataaataactcattttcccaccttaacatataattagaatttaaaggctaaaagtaccatatgatgtcacctctgagttgttgtggaagctagtaagacatttaagctgttttcccacctttaccttagaaattaaagctagcaaataaatgttatatggtaaaactgctaatcagctcagtgaaaaacacattgttttttgaataataggtagtcaaaagctcagacatttttctctttaccttataaattacatgtgtttacaaaatagcactcagtgttttatgctccttatgattatttctaaatattgcggtatctaaaaactaaattcagatatattccacatgttatcatggcatacttcaagaaaagttatagaagcttaatttgtaaaccttatttctctttacagatattatgtttgttataaataagtgaatgaattttgctattactgtgaaagttgcttttgtggaaaagaagattgaattaagatgtatggtaggctgggtgtggtggctcatgcctgtaatcccagcactttgggaggctgtggtggggggatcgctggagcccaggggttcaagaccagcctgggaaacacagggaaaccccatctctaccaaaaaaaaaaaaaaaaagctgggcatggtgacataggcctgtagtcccagctacttgggaggctgaggcgggaggattgtttgagcccaggagatcgattgttacagtgagctatgtttgcaccactgcactctagcttgtgcaacagagtgagaccctgtctcaaaatcaaaacaaaaaatgcatggtatgtaacaaacaacattgatttattaatagttaaggcccctcaaaagtatgtataggtgacttatttatatcattccaaatgtttctattcaacataagcatttattggacaaaaatgttgctcaatactattccttatggggaggagggcctttgaatctttagtttacaaaatgactgttcaagagaaggacttcacagatcagtatcacctgattatggcataactagtatggggtatttaagatctcttcctaaactataccacattaaagatgtagtgctagtttgttgtcttactagaatgttgaatggtcatgttaaggcaagaattattattttttatttatttaaaagcctttttttttatttttttgagacagagtttcgctcttgttgcccaggctggagtgcactggtgcgatctcagctcatcgcaacctctgcctcccaggttcaagtgattcttctgtctcagcctcccaagtagctgggattacaggcatgtgccaccacgcctggctaattttgtatttttatagagacagggtttctccatgttggtcaggctggtctcgaactcctgacctcaggtgatccacccgtctcagcctcccaaagtgctggaattacaggtgtgagccaccaagcccagcctaaaagcctttaaattattagagtccagattatgtggtttccttggaaagaaaatattgaaattaacaaactcccttcaagttatcaagtatgtgactccaaaatcatctacataaatcaatcagcaaactgaataagagaaaactctcattgattatttttctaagactcagtcaaatatttattaggaatccacgtatgttcacatatcacatgtgtactgtggatgttatactagttgatctaagtagacttattgtgcccaagaagcttggtagtccatttaagaaacacttaatgaacatttgtgtggcacaacagtcccaaactatgagtgggttgatcatattttacattggttgtaacttggagctgattttccaatggaagcaacattagatattgcaatggagtctcatacgaggccacagacatttattaaattaacatgtagatagcatagttcctgctcttcaagctatcataaaactcaaataccatttttaacaatgtttctacagaatattcagatttacatttttggaatacaagaaatacatttatttttctgtactggaagcaaaaaaccccagcaggtcaaaccacaattaaggctcctatttaggcagcactaggaaatgtttgggtctctcaagaggttgtagtcaaggtgtaggctggggctgcagtcatctgaaggcttgactggggctggaggattcatttccaaagtggctcattcatatggctggcaagttgagttcctcttcacttgggtgtctccacgggctgcctgaatgttctcacaaagtggcagctcatttcctcagagcaggaaaggcaagaaagagagttccaggtggaagccagcctttttgtgacctagactcagaagtcatgtggcatcacttctaccaaattctgttcatcagaagtgagtttagctgtgcgttggagagtggattagaatgaagctagtgcagagaagcggtaagaggctgttgccttattttggagaggagatgatggtggcttgactagagaggaagcggtaggaataaaaagaagtggacagatttgagaatggtcagaaaatagtttgcaagatgtagtgattggtaggtaaagagagagcacaggtacattgcaaatcattgacagttgggtgaacaataagattatttattaaaacaagtaaccttgggagaaatcttgatcatattgagcttgagttcctgagaggtaacaagttggaaagtggttagatgtaaagaaatgcaatttgcaagagaagtctgggctaggcttataaggttatctgtggtgattgaacttttccttggtttctgcaccctgttttgtttttccttcttaatcttcagtgattacctctcataatggattattcttactagcctataaagacagtcccatatttctcttattaaaaaacaaacaaaatcatccattaacattacatctccctcttatcccttcgtttttctattctgttttatacccagccaaactttgttaaagagttgtaaatatactctctctcccctattatgtcttcagtttcacttcagttattccattctactcctaccatgctgcagaagctgcttttgtcaaagttacacttttgatgttgcctgaggcatggatacttctttcctcgctctaactgctctcagttatattcagcatgtcagtccacttcctccttcttgaaacagcctcctccttgctttctaacctgtctctcaggcccttctttctcagccttttctaccccctctttaaatgctctcgtctgtgtccttcctcttattctttctgtacattctgcctggatgatcacagctgttttcgtatttgtacttaacatcttcaccctgattttctcctccaggctccagtagtcaggtatcaaattctttgcttgatgtccatctcacatttaaacatacccacaatagactcttgtttttcctaaaaccacactcaaatctagttctcttcgtttttatactttctggaaaatggcacaccatctacccaattatttaggctggaaacctgggcacaatcgttgcatcattttctcttccctacctcccctatctaatctattagcaagtcctaggaattttcattcagaactatatcacaaattcatccacttttttccatctccactgctaacatcttagtccagtgtatcccagcaggggcattgttgacatttttctcaggacagtttctcattatgtaccatatcccacatgctgcggggcatgtggcatccctgtttaccttcccctagctgaacctcaattactgtgaaaccaaaatggaaagtcagtgcctgctggtctggaatcactcaggcctcatctgagtccctactacctgttgcgcaaaccagcacaccagcagtctcttggtggggctcctcctggccttgcctcctcccctttattctccacccgttggcagtgtgattaccctttgcttcacccatcagtcatctccttatgcttgtttcctctgcagtctcatctgctgccactcccctgttgtccagcactctagccacgtggccttctttcagttcttcagacattttgatttttctccttaggatgttctcgaatgtcttccctctgactccacaaggctggtttcttcatgtcttagattaaatgctgctttatcagagaggcctctcctaaccacccttctttattttctgttatagtagcctgggtgtgcttactgtaatttgtatttgcatactgtcttttctaaaaaacatttttactgaagttaaaattcatataccatcaaattaatcttctgaaatgtacaattcaatggcggtagtatattccaagggctgtgtagctatcaccacaaccagttaggacattttcattacccagccctttacaaagcctcatactcattagcagtcactctccattccccatgcccctcaacccatggcaactacgaatctgctttctgtctctatagatttgcctgttctagatattttatataaatattatataatatgtgatcttttgtgactggcttcacttagcatgatgttttcaaggtccatccatgttgtagcatgtatcactacttcattcctttttattgcaaaataatattttattgtatgcacataccacattttatttatccattcatcagttgatggacaattgggttgtttctactctttggctattatgaatgatgctgctgtgaacatttgtgtacaagtttttgtgtggatatgtgtgttcatttctcttgggtatatatctaggagtggtggaattgctgggtcatatggtaactgtctgtttaaccttttgaggaactaccaggctgttttccaaaattgctgcacaattttacattctcatcagcaatatgagggttgtaatttccccatattcttgccagtacttcttattccgtttttctttttgttgcatgtgctttcgggtcatatctaagaaaggtgtcatttctaagccaaggttatggagatttgctcccgtattttcttctaagagtttagtagttttacctcctacatttaggtttattatctactttgagttaagttttgtatatgggataaggaaggggtataattttattttttggcatgtggatatctagttgtcccagcgtgaatttttgaaaagactgttccatccctgtttagtcatcttggcaccactgttgaaaagcttattttctttcttcttctttttgtagagatgaggtctcgttgtgttgcccaggctggtctcaaactcctggcctcaagcagtcctcctcaccttggcatcccaaagcgctgggattacaggcatgagccaccgcgcatgcccaatttcttcctatccctctacagttttacgttccttgagtgacggaaccagatttgtctttttcactagtgggtacccagcacttaccacagtccatgatagatactcagtttgtatttgttgaaataaataatggagggagagagaggctgaggaaagagtgtagagtgaaaagaggaaggaacatagagtcatcgtgtgaataaagggggaagtgggtttttagggggaaaatcagtagttatgttttagctctgttacattaaattcccccgctaatgagcctgtttctgaattctgttctcaatttattttttaaaaatcaatgtagttataaaataggtaccacatgccatggttaaaatgcacactacataggaggttataaaacaaagagtgaaagtctccttcaccatccaaccctctcccaccagtgctgcttccatgctggtgagaaggttttttgtatgtccttccagtgatttattatgttcatcccagcacatgtgtatccctttctttagaagcatgtggacagaagaatattgttcatattgttgttccctagagtctatcctggtgctccttccctaatagcacttgcaaatgttcttcattctttttatcagctacatagcattaagatgtaggatgcactgaaaattgttaatccagttttattgatatgcaaaacagtttatttctgataggaaagaattcagttgaaaaaagtaacttgaaattgtgattgtgaaatatgtgattattatttttattttcatttctaaaaacaatttataaaacagtttaatatatttttatattagtatctgaaatttaaaaatggatatagaataaataaaatgtagtaatttatcatttgaagctcttggggaaaaaaaaacctttttttccttctaggatgtcacagaacatcctagagttgttttaagcattaaaattaatcctgcattaaaaaccaagtgctttttggaattatttttcatttaaacatttcttttatttgaaaatctttttgaaggtcgtgtgttgtttactcttctgtaggccagcgttaatgactgccgttgatggaagacataatgtttacatccgtgtagaatcaaaactgatagagaagattcttctcaacatttctgcacactgcctcaacagagtgataggcaatatatcagtgtgccatcaagaagttgttttattcaggagtataaatggtatatcggaacagaaagagcactctactttaaattaagagcttttctgtccatatgaaaacagaaggataatttagcttaagtgaaatataagcctatgtaagttagaaggttgacttgctttacacctgttagtacatgaacagtgggaggcacctaatttcttcttaacctacatttcctgttggtaagcaaaaactattttacttaactctagttttataagaatgaagtcaatgagtgtatgacataatatatatgaagatagtccagtgtcagtggaatggatttgcaagatcttcaaccatgatgtcttagttgtcagtggctaagaataaagcaaagataatatatttgtcaggtattcaaactccattcctgttctcattagcctcagatcctctaagctgatgagctaatctggttctgtgattgctttatctttcaatagtagattgtttttcgtgtttttttttagttgggggtgtctagtaattttgggttgaatgctgaacgttgcatatattaagtagaacagtacaaactgaggtaaatagtagttgtacctggaaacaggcatgcctcttctggtcctttactggaggtgaggggtgagcaggatggtcagccttgtcataagttgagttggattcaggttttgttgtttctctggttaccttcaggtcaccactggtttcaaattatcttgtgcttatggtgggaagtggttccccagtattcctgctccaccatcagcatagccctccactctgcacctgggcctcagagaaagtttctttccatattcttgcacctccccaagttgcacaagcttttgttggttgttatttggtgcatcctaacctggtgggtgggagcagggttgttcctctttgattctggtccagccccagtcttatacggatgttgcacatggcgctttcttggtagccctgtcccttatgtggcatggcagctgagctctgtcttgtgcctttagtgggtcttgtgtggtcctggccctgccccagcagtaggggaccactaatggtcttgacccagggtggtttttcagtcctcccccaggatggaggtttttttttttcttttttctttcccccatctgtactggttcctcacctgtaccctggggcaacaggatttggtgtccctcctccagcaattgaaggcttttgttccttaaaggggaggccagatggtgctttgtgttttgtagttggaagctttctctgatgtcttgccctgcccccagtcttatgagcacctggtggaggtgagacgtactatgtggaagagcctatgaggatgcagatgttccttatgttgctgacactggcagttcattggctttttgcaattaatttattaataaaaattaatcacattcttctttcctgcctgtatggaggacctgtcttcttcccaaggcctgccccaagggaacctgtgctcctgttccatctccctggaggcacctgtctccttatgtttcagtctttttggctgttttacaaccttggttctcatgtgtattcaagaaaatgatgattttatatttattcagttttttccagtaactgttagggtaggagccactttttccagctttctacatcttaattagaagcctctctccgttttttcccccattttctttatttcatttttattcttttggctattttcattccttttcttaatgttacttatatattttcagtgttatctcttctttttttttttgagatggagttttgctcttgttgcctagactggagtgctgtggcgcgatctcagttcaccataacctctgcctcctggattcaagcaagtctcctgcctcagtttcccaagtagctgggattacaggcttgtgccaccatgcccggctaattttgtatttttagtagatatggggtttctctatgttagtcaggctggtcttgaactcccaacctcaggtgatctgcctgcctcggtctcccaaagtgctgggattacaggcgtgagctgccgtgtccggcctatctcttcttttttgcataatgtaaattagtctttatctcttagagaagcataattctcatatcacatatacttcagtgttttgtccattcttgagacaattaaagttgtacttcttggcattaattagattgtgatcataagtcaaaatgtcattggtcataaagtggtcatcagaccatgcagactattactaatattggttatgttttagtttattgcagtgaaaatacaaaatttaaaagttattgtagagaattatcataccccccaaaatatgtcattggtcctccaggactctgtagtccccatccaagaaagactgtgataattgtcaaggggttagtacggtctgagcatggtcgatggtgctctgtcattctggtattgaacaacctcccaaatgtcttgattacatgtcctaaaaaagtgaggggaagagtgtaggacaaatgcaaaataaaataacacatttagctatacttttagtattttttattattgagattcaatatttaagtgaccgattcaagattcttttatataaaaaatgaatatatgcataagtaactgtgataagaactgtggatggataagagcactcgtctgatgtactgcagcataaccagaactgctgtcggtctgaacggtgtgttatctgggcctgtttcttgtgtcagggggatcacatgccgtcactctggagtgcctcaatagcttgtaactagaaagagaaggtatagaaagagtagtttacttacctgtttatttatttagaggcagagtcttgctctgttgcccaggctggagtgcagtggcacaatctcagctcattgcaacctctacctcctgggttcaagcaaatctcctgcctcagcttcccgagtagctgggattacaggcatgtgccaccactcccggctaatttttgtatttttagtagagacagggttttactgtgttggccaggcatgtctcgaactcctgacctcaagtaatccagccacctccgtctcccagagtgctgggattacaggtgtgagccaccgctactggccgggaggagaaatttaaaatgggtttgagacttgaggaaccaaaagaaacaatgaaaccattcaatgtgtgtgctcctgtcaagctagcagcgatcttgagagctctgtgttttcgtcttctgcagttccttcctcagagatcacctatgggatggttgtggcagacctgttccactccttgttggcagtcagcgcagaaccttgtgtattgaagattcagagcctttttgtgttagatgaaaacagctatccattacaacaagatttctccctcctggatttttatcctgacatggtaaagcatggagccaatgcccgtctctgaggccagaggaagaaattgcaggcatttcaaggaagaagtactgaaatgatttgtcttttgaaataaatgaatgacagggcttttgctttggattttttatgaaatatattttacaaagagaattgcactagataaattaaaacttttttctaagaaaatcctgtgaggtttaaaaagattgtttttgtcttttggtttcttcctttcttctggagaaatgatctaccagtcaaggcaatatgtagcagatccctgggaattaaaggtttgcccatttgttcactgtatttagtccctgctacattccaggcatcgtactaagtatggggaaccacagagaagacactccttcagaaactgctgcagtgctttcgcttatccctacctaaaaaaccgtcaatgtgaaatcatttccttgattataactataatgataatggattagtttatataaacctatgtttagacaagttcaagacaagcgtgtctttctataaaaagtattgaaagtgaaggaaatgagatcatgtttcaatttattaaagcagggaagagcgttctgtggttagttcgtgtctaggatttgagtgccttactgaatgtatttaccagcaaacatgtagcaatctgttctctcattgtgattgtggaagaagctcatgtaaaatgatagtcattaatgaggaagtatggcgtggtacttattctgtaagctcagagtatgctgagtgttaatagattgtcatattgcctgaaaataaattcatgatgacatgaa

SEQ ID NO: 2191 - DNA, 15158 bp, Homo sapiens
tttcctggagccactaaaatttattataatggttagcattcaacaataagtgatcaaacacaccacaaaacaggaaggaggggaaaacagacacaacaaaacggagccactaatgacccagatattggtgttatcagacacagacttgatgggtggaatagagactttcatcaaagaactggaatctataagaaagaatgaaatggaaatttaaaacttaaaaatacaataattgaaattaactacttagcatatgggttaactacaattagatttagcagaaggaacattctttgaactgtaatataggacagaataaaaactctaagctgaagaacagagacaaagagtatggaaaatacagcaaagaacataagatacttgtgggaggtggtgaacaggcctaacacatatgtaactggagtcttagaagggaggaagatggggcagaaggaacagttaaataaatatagcctgagaactttccaaaactgataaagctttatgatccccaagcaggataaataaaaacaaaactgcatccaggcacactatactttttttttattattattttttgagacggagtttttctttgtcacccaggctggagtacggtggcgcgcgatctcagctcactgcaacctccgcctccccaaggtcaagcgattctcctgcctcagtctcccgaatagctgggattacaggcacgcgccaccatgcctggctaatttttggattttttagtggagacggggtttcaccatgttggccaggttggtctcaaacttctgacctcaggtgatccactggccttggcctcccaaactgctgggattataggcgtgagccaccgcacccaacccaggcacactatacttaaactgctgcaaatgaaagacaaggaaaaaacagtaaaagcagctagaggcaggtaggagggacacatttcttcttttcttttttcttttcccctccctccctctctcctccttcctgcctccctcctgtcattttcttttgtagaggggggggatcttgctctgttgcctgggctggttttgaactcctgggctcaagggtgctgggatgacgggcgtgagccagtgcatgttactgacacattactctcaaaggagaaacaatagcactgaaaatcacttgtcaacagaaatgatggaagtgagaagataatggagtgccattctgaagttcctcaaagaaaaaagtgtcaacctgtaatcctatattcacaaaatatacttaaaaatgaatttgaaatagatgtttctattcaaaaactgagaaaggctgggtgaggtggcctgtaatcccagtcctttgggaggtcaaagcaggcagactgtttgagctctggagtttgagaccagcctgagcaacatggtgaaatcccttctctacaaaaaatacaaaagaattagccaggtatggtggtgcctgcctgtagtcccgctactcgggaggctgaggtgggaggactgcttgaacctaggaggttgaggctacagtgaaccatgatcatgccactgcactccagcctgggcgacagagtgagaccctgtctcaaaaacaagcaaacaaaaaaacacaaaaaaacctgagaaaatttgctgccagcagatgtgcatacacaaaaaatactaaagggaattcttcaggtagaagaaaactgatctatgatagaatcacagaaatgcaggaaataataaaaaaaaacagagtgaatatgtgggtgaatacaaatgaatattgactgcacatagcaataataataatgtctcgttaggtgtaaaatatatgtgaaattaaaatgagtaataataatatacatgcaagagtagaatggaggtaaatagagattgagtattgtgagatcatagcattgtctgggaaacaataaaaagtaaaatttgtattagattataataatgtacagaagttgtaatctgtggaggaaaccactaaagaaattataaaagaatgtgtaagtagaaccaatggtagggggggaaacggaattaaaaaaataatcagaaagaaagcaacagaaaagaaaaaataaaaacaaaaatgggtaagacaaatggaaacaagtagtaagatggtatttatgaacacaactatatcagtaattacaataaatgtaaattcacgaaatacacaaaagacaaaatttgacagacttgattaaaacaactctattcaagagacatgacatcattataagaacattgaaaattcaaaaataagggggaaagtgaaaaaaataccattgtgagtggtagagaaagccatttcacataataaaggttcactctaccagaaaacgtcaattttaaatgggtatgagcctaataacacaacctctaaatgcataaaacaaaaactaacaaaactcaaaggagaaataaacaaattcataataacagtggcaggctttatcctctctcagtaatttatagaaaaacagacaaaaatatcagtaaagatgtagataatttgaccaacctgattaacaaacttgacccagttgaaatacacataacacctgcacacaactgcagaatgcacattctttcaagtgcaagaacattatgataagaatattataggaaagtctgtcataaacatagcttatataaaaatataacagcaaattaatctaaattttatttatttatttacttattttatttttttgtttatacttatgtcataaacatagtttatataaaaatataacagcaaattgatctaaattttatttatttatttatttacttattttatttttggagacagagtctcgctttgttatccaagctgtagtgcagtggcgtgaacatgactcacttcagccttaacctcccgggctcacgcaatactcctgccccagccctccaagtagctgggacaacaggcatgtgacaccatacctggctaatttttgtggtttttgtagagaccgagtttcaccacgttggtctcaaattcctgagcttagacaatctacctgccttggccttccaaagtgcggggataatagatgtgagccactgagctcgacttaaatctaaattttattttattttattttatggccatgctccctctaataaatctaaattttaaataaataagtccaagtattgttgtgtttatgtgtataaacctgcgcacacacacaaaagtgtacacaccctgctggtttctattacaagaatgttaagtttggtttgacattcaacagtcaattagtataagtcatcacatccaaagaataaaggagaaaaataaaattatttcaaaaggtgcagagtaagtatttgagagaaatttaaccttatttgtaattaaaaaaatctttttaacagcttgagaatatatgttaatgagtacattaaaaatcctataacaaccatcaaacttcatggtgaatattgacaactctccacatgccacacccaccacccctgagattgaggatgagacaagaatacccactatcactacttatagtcagcattctgctggaggtcctagccactgcaatttgtataccaattttatatcttgcaaccttgccaaacttattagctctagtagtttttttgtgtgtggattccttaggattttccatagacaagattatgtcatgtgcagatatagttttacttctttctttatgatctggatcacttttatttctttatcttgtccaattgctcagccactgcagtttggcaagagctaaataaggcataaagattaagaaaggaagaaataaaactgtcattcacagaggacatgattatacaaaaataatctgcaaattattacaatttaaatgaatgtcacaaagcctctcactggataacaaggtcaacatagttttgtagcaacagaatctgtatatactagccataaacaaatataaaacgtctaagaataaatctattgaaggatgtgcaagaacactttactgaaaaccacaaaaatagttctgagaaacatacaaaagacttaaagtgaagagatataccatgttaatgaataggaagattgaatattttaatgatgtcaaatggcccccaaattgttctacataatcaattaaatccaatcaaattctagcactttattttgtggaaattgactagctgattctaaagtgttttatggaaatgtaaagggcttctttcttctggagttgccttgtggacaggatttgagacaacccaggccaggtttctctggtccatgggaagcatgcgtatgctttttgccctgactatgtctgtagagaacagcccaaacaacaacctcctccccatcagagcagagagccagctagtctcttgccatttagatttttcagggatgagtcagagataccagtctactctgtcctgcagaaaaggatacttatcaacttttccaagcggccctagaaaagtcactgctagtcagaaatctcaccttggaatgtgggggtggctggcatctatccggatgtcagatgaaacagaaacagttccactgtagtagcctgctctataaacacacagagaacccctattacatgtgagctatgaagctattagaaactacagctttgcggactactttgaaaatgtgcaagtgggccgggcgtggtggctcacgcctgtaatcccagcactttgggaggccgaggcgggtagatcatgaggtcaggagatcgagaccatcctggctaacacagtgaaaccccgtctctacttgaaaatacaaaaaattagcagggcgtggtggcaggtgtctgtagtcccagctactccggaggctgaggcaggacagtggtgtaagtaaacccgggaggcggagcttgcagtaagcctagatcgcgccaccgcactccagcctgggcgacagagcaagactccatctcaaaaaacaaacaaacaaacaaacaaacaaacaaaaaatgtgcaagtgaaataagtgacaaaaagcaaacacaagatattctgttcatacgaaacactgcgaggcgacacttgtgtttgtagattgacagaaattggaggtggagttaaagaggtagaaactcagtataacattcattgcctcttttgctaaagttgtttcactgcataagaaaaagatactggtcgggctgggtgcggtgactcatgcctgtaatcccagcactttgggaggctgaggcaggtggatcacctgaggccaggaatttgagaccagcctagccaacatggtaaaattccgtctctactaaaaataaaaaaaattagccaggcatggtggcgggcgccagtaatcccagctacttgggaggctgaggcaggagaatcgcttgaacctgggaggtggagggtgcagtgagccgagatcacgccattgcactccagcctgggtgacaagagggaaactccgtctcaaaaaattaaaataaaaaaaaaaaaaagaaaaagaaggaaaaaagagaaagagatagtggttccatgtgctgttctagttacacaaaacaacgtgttgacgtgcaggctgcacgatgccaggtgcaaatacacactacctgttacagtaactgtgacaagcacaagggctgctcactagcttgagtgcaacttctggggagttgatggcagtgatctgtgggtacttccttcttaacaaattttacatcaatactgcaacacagcaatctcagccctgtgggctataccatagccacatgctttcaccatttcctgctcaaagggagagcccaggaactgaatgctcttaatcagggagagcacagaaacagcagcagaacagctggagaaccagggctgtgtggttttggactgtggggagggtgggccatgggcagacttgacacaatgtgggagggcatttgacacagccccgtggaggacctaatgctcggggaggccttcacccagcacagtgagccatgccgacacttggtgcctgagtgcgctggtcacagcgccctccctgtgattttccccatagcagtgtgttttctctgccaggcagaaggcagagaaaccctggctgaaaaagcagtgagggtcatcgactgcatgaacacatcatcagctttcccagatggaggcacccaagtttaccctgcaggtccattcagcaggtagagctgggtcatcactaaacaggatctttcttctgagcatctgagattctggtccaaatcagggctgtgaggaccaggagccgggattccgagcccaggcagccccgcagataaggaggagggagtgtgtcggaaggctgtatggccagagccgctgaccgggccagggcttctttgtcccctcttctctcctgcatatcagcactcacgtcctcctggctcgggctggctggcagctcggggagctgttggatgaaacgtccatgcgtgtggctgtggctgtcacatgcaactgcgaggatggtcggctcccaaagcggaaccgcggtgctgggcgaagggtcagggctccgtggtgcggcagagcgcatgccagcgcttcaccagctccttgggcttgctgagcatctcgtcccagtgctccagctctctgccgcgggtgtacatgtaggggcccaccaccactcggcccagctgctggctctctgcaggggagggagagcaccggtgtgctcctgagcacagaagccccgtccccagtgacctcctttcctccctcctcctccccaggaggaagtagcaactcccctcctctctgagtgggagctgacaggccccaaaggggccctgcctttgctctgcagctggaagggctgcttctccccctgggagattgggaggaaggagagccctgaaagactctctccttgagggccaccagctctgccccacacccttctgtggggccgtattaagtctaccttatgccaaagagctgagggaggaaagggcccctctagaaagaaggcctcggccatccgagagtacattcagcagtaacattcactggccaccgtggagaagggtcttaagtccaggccatgtggccagccacggcctgatggctctgtttccccagagtggcagtgggtgctggggtgtggggcagtgtgggagctggctgacagaactcgcccagaaccccaaagtctcatctggagggcacgaggaaggtcagagcaccaggtccctgggctggtggcaggcctggcccctcccactctctcgggtgatttgctccaggagagggcagcagaggccattgcttaacctctttctttttcttttcttttcttttttttttttttgacagagtctcgctctgtggacaggctggagtgcagttgcaagatcttggctcactgcaacctctgcctcccgggttcaagtgattcttctgcttcagcctcccgagtagttgggcctacaggcgtgcaccaccacgcctagctaacttttgtatttttagtacagacggaattttactatgttggccaggatggtcttgatctcttgacgtcgtgatccacccctctcggtctcccaaagtgctaggattataggcgtgagccaccgcacccagccaacctctttttttttttttgagacgaagtctcgctctgttgcccaggctggaatgcagtggtgcgatctcggctcactgcaagctccgcctcccaggctcatgccattctcctgcctcagcctcccaagtagctgggactacaggcaccagccaccacacccagctaattttttgtatttttagtagagacgtggtttcactgtgttagccaggacggtctcgatctcctgacctcgtgatctgcctacctcggccttccaaagtgctgggattacaggtgtgagccaccgtgcccggcccttttttttttttttttttttttgacagattcagcagcctcgcctcctgggttcaagagatcctcccacctcaacctcccaagtagctgggattacaggggtgtgccaccacgcccagctaattattgtatttttagtagagatgagcgtttcaccatgttggccaggctggtcttgaactcctgagctcaagtgatccacccaccttggcctcccaaggtgctgggattacagatgtgagccagcatgcccggctgcttaacctgtttctagggtgccacagacagagctcaactggactaaagctgggcctgaaacccaggccttgggcaatatttcagcctttctgagcactagtttccttaaccagggagggagctcgtacagctccttctgaggtcaggacaggaggcactcactctgcctgaacactcggcagcccctcgtggtccccatcccagcagcccagggtagggtgtggccttactgtccccttccatgttctgcaccacagtcaggctgaggctagcggtatccagctcggtggcatcggccttgaagctgaaggtctcattgtacacagggttgatggagcccagcacagctgaagtcttcttgcacttgacaaacttgttgtggttcatcagagacactttgacaaacacacctagggaacggtgagcactagtgggctggcagaggcaggtgggagcagagcccctgcctgtgggaggtccggctaggagggcacgtgcccaagctaggtgccagggccccacccctcacacagtgctgcggccccgccggcgtgaccagaggaagccggctgaggagtgcactgccctgcggcccaggcggggctccgctcccttccttttccttcctctttgcatcaggaaagtacccacggctcctgcaggccctggtttaccagagcctagcaccgcaagcctgtccctccctgttggggggctgctcactgggcccccaggccccctggggccccttaaacaccttgtacagagggctaagatttggtgggtgagggtcagagtcacagtggaaggtctggatcctgcctggcttacggtgaccccagatgtgaacacaaacaggtggctgaccaccacctcactgggatgggtgggatgtgtggggtgagcccaaatggggtgggacatgtggggtgaaccaaggcctccccttctgcagctcctgtattctgggaggccaagcatcagtgcccattgagtcgggggctcttcccctgtggggagggaggtgcgggcctcaccctggaggaactggacccatgccgctgatggaaaggtggaggtggaggcaggcaggacagttcaaagagccaagacgctgcctcgggaaacaggaggggcagggcctggtattgcggctgggttagaaccctccgtaggggaggccaaggagatgcagctttgggttcaacacaggaagaggcttcctgcaccagaactgtcgaccgagggacagcacgtcttgtgaggtagtgagcgctccatgataggtgtatgcaagcagaaactggatggtcagggatgaggttggactgtagccccaggctgtaagctcggtgggtgggaccttccccaggaggaaagggaggaactcactgacaatgcctctgtcctcctggagccggaggcccttggcacgcagcacaaccaccgtcaggcggctcaggtagtcgttgtagctgaggcagaactggaggtcgccaaactccgaggggggctggggaggccaagatggaagcaccccaccctgttactctggcaagtgctgaaggggtcacagaacccccagagagcctcccgcttcctcctagcggtccatgcgacacacccgcatggtcccctttgagttccactgccattttaaggatggggcaactgtggtctggagagtttaaggggcttgtgcagtcctgtggaccagagctaaggagtcacacccaggtctgagccagctggggccttcctgggggtggtgggctggaggaaacatttccctgggctggaccatttgtggtgtcatctctcacagctgtctaacctagataagaatccaaatgtggatatttcaggttgctccagggggtctgatggccagtgtgacaacaggacctcaagcaggccctccctgcccaggggcaggtccgttcccacctgtcccatgctgcttggggcctgggccctcctccctgagtcactgttgtagggtggtgtgcaggatgctgagggctgatgccgccagcaggtgctgggccctgtgcacacctgccagctgatgctcagtggcataggcatggtgaccttgaccatacctccaggctctcggcctccaggtctctccagatgacacgccggcagtcccccactagggtctcattcttcaaggggaagagcacctggcccaggagctggtgcttcctctgcctgtccacgtggtagacggagaacttcagcaccctctgggtgatggtcttgctggacacctgggggggacaaggacaccagccagagtcaggcgtgggggtaggggatgggatggtgtgacttgttattctggacatgggtgcttttgggaacgggtgtctcaaccagggacccacatcccccaaacctaggcattttcaggggacccttctcagcagcagagccgtgtacccctggaaagtgggggtaggtgccaggaccttggtacacagagtgtggtccgaggacctgtagcgtctaccaccacttggagccctgttagaaatgcaggatcttgggccccagcccagattcatgaattggaatctgccgtttaaccggagcaccaagtgacatggctgcacggtgagtgtggctccgccaccaccctgcactgtagcaaaggcccaggagcccagggcaccggcctgtctctgctgtcagagctgggcatgccagctctctcctccctgagatttggcctcctcgcctgtgaaatggggattatgggtcttcctctctggttgtaaaaccccaatcacagtgtctgacctccagcagatggcccattaatattgattttcttttctttccccttctcccttttccacagagggattggatcaagctggggcgagatagagtggggaagtgatgagctaagaaaaattagcctgcaagcatgacgtgtcgcacgtcagcaaggctgcagccttggattctgatgtcttgagaagagcgattcacctgtgaattctcacagccctggcctcagaaagacggcccgggaccaggcccgatggcacccctcttcccagctctcagccagggcggaaggcacaagtgatggccctggcctccgcagtcacactcctcctgaaagctgactggctgaacctcacctcttggctagcttgccacccagctcttgagaacatgtttgtccaaggcctcttggcaggtctcgatgactccttcccctaagggcccccagtcacctgctaaggctcccaggcccctgtgaaactggctcggtgccccaatagactctccacctccagaccctaagccggccagcccagagtgcagcaaggcaccacacctaccctgtgagggcactcgggccccgcgctggcctctgacagcacaggaagcttctgcattcacgctgaggcctgtcttttgccttccttagataaacttgccagaaaccccatagtgcttcaggcctttgggataattcccctgagccccataggccagggcctggcattcagtagttgctctaaaattgtgttttcacccactctcttccaggtagtcaggacagggaagcccaggcttctggtcaccactcaccaaatctctcccctgcccctctatcagggatcagctcctataggccttaacctagcagactaggtaaagcagagctggtggcatcaagggtcccgggggctgcagagccctggctggtacaggaggctgggctctcctgtaggtctgcaccttcccagcaacgcggagggcaccagaccctgcctgctccagaggctgtacctgaaagatgaagtgctcgtcaaactgcgggttggaggttttgcgtttggtcttggattggaggaagcgccgctcatcgggcagcaggtagagcttcaccagggggctgcaggtctccgagggggcttgcaggtgctgtgccttgatcaagcccaccagcagccgctcagcctcctgctcatattccaccgagaaccacagccgccccaggcagccgtcggggaagtcggtctcacttttgtcctccgggaacttgtacagctctgggttgatggcccccaccatacatgcatctcctatgacagagggtgggagggctggcaggccagaggaaggcaggggcatgggagacagtggcaagctctgggcacccatccccatcctggcccatccgtctctgctgagcctcagctagcctgaccacatctgccccactctcctcaccaggctaaacacatcccctctctctggtgcagctcctccaagaagccttctcaccatgaaggcattgcatggccaggctggggatccagcagagtcctgccccctgggattggcccccatccttggaggtcaggacctgtttcaaggacacagtgcccatcacctggcctagcccccttccatggcgtctagggaatgactcagcgataaaacattgcctttcttcttcctcttcaaattagaagggccaaggtgattattgggtggttcctgtgatggtctcttggtagatcttcagggcaaagaggtggcagaaagctgtgtttgcagcccctaccattctgtcctcttggtcaaccaacccatcatcctagagtgggacccagcacaagttctgtacatggcgtgcctgggttccaattccaatctgttgcttacagcctcagttaagactatgtaaaatggggtgataattcctccccctcagagtcatggtgaggtctcactccaaatcagcacccaaggccatatcttaccctcatggggtgcagcaagcacttcataaatgaaagcacccagaaagagtggtccctgggtggtccctggcatccctggctggttcaggttgtgttccggagccaagctggtgaaagcagatggggccacccgagcagaccctgacctctgggcagccctggcaaggacactcaccaaggccgccgctggaggtgtgaggcagcagctctgatgccgggcaggggtcccatggggcatcggcccactctccactgtgcaggggcacccaatctcggccttgaagggttgggggcaccacgaatggcacagctggtggcctgtccagagtcagggagacaacatgtaggtggcaagtcaatggtgtggtctcagagcgctcagccaggacggttgagcaccaggggctggaggaagaaaagccatcgggagccaggaggaggccagggcaccattttctgggcccataccaggcaacacacacacacacacacgcacacacacacacacacacacacacacacacacacacagcagtgggatttgaagaaggaacacagcacctgacagtgtcagccagtctgggtttggattcctgttctgccacttactaattgtgttctctggacctgttgcttatgtgcactgagcctcagattcctcacctggaacatgggtttcataacacctgcctaatagctgatgtgaggtttctggggtttctttgtgatagctcccagcaccgaagcagcatagaagaggcacccccataaacagaactttccttttcgaccccaccctgagggaaattccaggggcgcacttggccccacatcctgcctcacctgctcagttgggtcctagcatgcggctggcagggcctgtcccgctgcccactggaggcagctgtggtggccatggctggtgtcccaggcagctcctcataggtgagggtggcacagaaccttctccacagacagcagcttgccccgatcaacagcagcagcagcagccccccgatggtgcccccaatcaccagggccagctgctctgggggcagagaccaccagtactatgatgcctgcctgggaaagccactctccctcacagccctggcctgctggggcagaactagggcagcaaccctgcctctgggtttgatctcaggagtgataggagcaggcctgctggggatgggttccgggagggatgctgctggctaggttccgccagctctcagaggagaagccgtttaccccagggtctgagagccctgggcagaaccttctagttttccttggaaaacagctggccctgcccttgggattctggcttaaagaagccatttccttgcgcttctgagtagaaatcaaacctgccctcaccagaacctccatatcccctgggctcctgttgaggccaggaggggagctggggtgtggacgcagtcagttaaggaaagccctgaaaggtaccttccccctggtctgcaatcaaacctctaccctctggggccctggaacctgctgcaaggctggactcttctctaacacccgctccctcccctagccctctatcaaggtgagcacgcgcttaggggagttggtgcgacgcggtggacgaggtggggaggaaaagggggcaagaccccgttgctgctggccctcacacgtccgcatttgcgggacctaggaggcttcgccccgggggtgctcagacgctgggttccaaccgctggccacctggggcgggccaaaaaggtgcctcccttagggtgacgtgcggccgcggggcattcaggtctcagggatctgcactgggtggggtggtgagaaggccggaccccccacacctcctaagccgcaactgaccgcgaagagcgggcctcagcgtctactccatcccagtgcccctccaagagcgcgccgaggccgggcagggcaggcgctgcaccccagcgggggcggcggggcggaggcaagtgctggaagggtcgcagaggggccggggctgggctggggaggcgaggctcgcttacccgccatggggctgctcccgcaggctggtctcgccggtctgggcggctggggctgggctgccaggccgtctcttaaagcgccgcggggcgccgtcgggcgagcacaggggcggtccgtggtgctgctggtgcccagctgcggcgcggggagccgcgcagt

SEQ ID NO: 2192 - DNA, 7024 bp, Homo sapiens
tgcctttgctcctgagaaggtctgtagcctcgtttcgggcccgtattgagcccccttctccctaagtccgggtgggctttgtgcaggaggggcgggaggggagctattctgggcgaggctgcgtggtgcggtgctttcaggcctttggccccgcagcaggggcggcctgtgcttggcgtgcagagtgcagctgggtagacgctgttactgcatacgggcctgtgtgtcccaggctggggcatgagtgcttgtgagcgtgcagatagggacacaccggccgcctaggctgcttctaggccggggcaccctctccacctaggtgccccccagggattgtgggcaaatcctccccaggggaggaagctcaggggctgttgggcgcctaggcctcttcctggtgagcagagcctcatccatggggccactgaccccacagttaccccagaaccctttcctggcacagcttgtgacccggggcatgtagcccttaaggcacgttcattgtgaagggcaggttttgtctcctccaaaccctccctttaggaatgctgcctgctgctttgcccagagttggccctgagtgttcctatcaggccccgttcactctggggtggattaaaccacctcctggagggtgctgtatccccactgtgcaatgggggtttgtgctgtgtgcattcctgcctggtccttgagaggtaaggtccatattttaacatagaaccagttttcctgcctgatcatataggtttgcttttcctgttttggttttgccggacacataagtcatcatccaaatgcttgccacttaactagaggggacttgggccaggcgctgtggctcatgcctgtaatcccagcactttgggaggccgaggcaggtggatcacctaaggtcaggagttcgagaccagcctggccaacatggcgaaaaccccatctctactaaaaatacaaaaattagctgggcgccgaggtgcacgcctgtaatcccagctgccgggagactaagacaagagaatcacgtgaacccaggaggcagaggttgcagtgagccgagactgagccattgtactcgagcctgggagacagagcgagactctgtctcacaaacaaacgaacgaacaaaaccaagaggggacttagatggatgccacagtgttgtctgagatggagcccacttgtggtggtcttggtagtcccctgggcatatcccaaaggcctgggctcctctgctgtggcagcatggcgggagctggactctgtacgttgactcaaaggtctctatgtttgggctagtctggaagtgtctgagaactgggggcttttactcaaaatgacattggttgattgctacataggtggttgatcttccagttgctgacaggtggaacctgaggcagcaggacagcctggcattggccacgggacatcggccacaaccatagcaacttcggcatcaaatggggcaggagagagaacattaaggtatcgttcaaagaatactagaggtcttggatacttctgtatgcctgttctttatcttgtcctaaaagatcttccgagggtccctttagggcaaaaccagaaccttctgtgttgttataaaggcagggtgggtgtgccattctgggcatttaaagtgcagactctagacttgtatgcatgcgtagcctcctaggttaacatttaaaataggctctgggaaacctagtttggtgatagggagactggggacactgatggtgacctggtcctaggatgggatgaaggtagcgaggatgggaagctagaggaggctaacctttggggtgtcttgatggcttctgaaaagggcctctctggcccccagtactaatacttgttataccatgaacttaagctgctcttgatgggaggggaaagagaagattattgttaacaaacactattgcagacagtgcacatgctgtcacatttggtcttcacaacaaccctgcagggtggggatttatttctgttttgcagattgaagaaactgaggctcaaagaagttaggggtccacctgtgagtacatgcacaggaaggggaagagcccccattggaagcagagccctgccccttcctcctcacccctggctccctgggaggcccctcctctggcccagtccacagcactgtgacaggcagtgtggaagcctctttcccccagtactcccctcagagcccttccttccttctgagctgggaaggccaggttgtagttagccaggccaatccattggggttctgaattagccactttcagctgtgtgttctttgacatttctgagctgctccaggcctcagttttgtcacctgccacttgtggagggggaatggggaagggaaccaatagatacatagcccacacgggggtctctgggtgatgactagccctgggtgctgggcagccctctggtgagacaggcacagtgggatgctcattgctcatggcttctcagtgggtcttggtgggggtctgaggacctcattccacctgtctcctcaggggccagaggctgctggcctggctgtttatggcccccctccctgggagggtggtggggtttggccagaggctgtgtggatgtccagatggggcctccctggggtcttggacctgcaactgagtggttgtctccctgccaggggctggcagtgaccacagctgtcccagtcaggaggaacacctcctgccctcctcattcttgcagcctcaggagctgctaagaagcatgttgggcaggtggagatccactcagtgacttgttccatggcatgtcatgagcacgattggcagggccaggccagatcagtaaaaagggtgagagctgcgaggcataggcctgctcagtgctcgaaggggagaggagctcagctgccccacaggtgtgtgcccttgggggtcactgagcctctctgagcttatggaattctcctgtctgtagaatggagataatgactgtctcaagaggttgcttgcacagttatatgagacaatgtatgcaaaggatgtggcacgtgtctggcccttggcgagtgatcaggccctggcagctgttattatcatcgctgttacgggctttattgccctcctttgtttgtatgtccatcttagagctcattgagggcagggtctgggtcagatttctctcttggctactcctcctcttcctgatcctcccagggacaagtctggcttcagccccgtgaagcagctgggatgggacatccttaccaggccggggctgtgttcagagctgcacagtcctgtacggtagccattagcctcatgtggccagttagattcaaataaaacttaaacattcagtgtctcagttgcagtagccccctgctgagtgcttggtacccacatgccattggtgcctacctattggacagcacagggtagaatctttccatcatcgcaggaagttgtgcagagctggagtctcagggactacagcaccagtatcatcctcactgtggctcagcagccaccagccatctcctgagtgctgggctgccaggacatttgtaattacacagaaaccgagtcccacagcccttcccgaatttcctctcgggtagccttgctcacctggtcggggaggttgttgcctggaagtctttatcagcctaggctgggagggcagggctgggattgcccaaatgcagctgctgcctcctgtccccaccctgtttctcccacctctcctgcctggcaaggagtcccagagtgatctccctaattcactgctgtggccagggccgaggtggcccagacactttgaccccactgctcccctcatatgctctggacacatggcctctttcctcctgcccactccgctctccacctgaacaccttcttgcttctctcactccaggcctgacttacgtggctggtcctccaggaagccttttctcatctctcaccctccgtgagctctcctgccttggtggtgccctccctcagaccccatttttggcactcagtgccctcctctgtgggtgtgttcttgtatttgcttgttctcttggtcaggcacacagcagataatcctctgagtgccgacgacacatcaggtcagtgctgggtgttggacagccagaggggagcaggccacaggccaggctttgccaacttcaggcctgtggggaggctgacagttggccaaactgttccatgcaggcccaatgctcagtcagggatgaaggctgcctggctggagggtcgggaaaggggccccaggaagagatgcagaagtggaaagggccagaactggctctaggctgcagctgccaggtccagggtggtctttatggctgggggaagtgacagcgatggtacggagggtgggggacaatgaggatgcaggtacactgggcaagaggggattaaatgtcaggcaggataggtctgattgatggtactgggtgggcatcttatctcactgctgcaccgtccccaggggtacagaaaggtctgaatgaatcccatgttccctagccctacagctgggcacgcagtaggggctcaggagatgctgtggaatcaatgaccagatgctgaatgagtccctcatggaaaaagctgatgcatggggcctctccttgcccctggagctagaggtaggagtcagggaaccccagagacatgccagctcagcaaggctaggccaaggaggatgggggtggttgtggaagcccagggtgattctcagtgtcctctggtcattgctccctcgtcctgtgaactttctctgagctcccactctgtaccaaggagaccctgtccacagtgagttggatactgccagtcccaggaggaagtagcccagtattggcctgtccagctgtgcccgttaagaggccatagtgcttccgtgctggttgaccaagagctgttatcccacagccccaccccctagggctgcagtttcacccccaaagccccagcagatttggctctctcccttcccctcccacacaaaccagccagtaaagagttgagagctgatagagtggcggcctccaggaccccaccctagggcagattctaactgcttgagactgatgatgagataatttgcagtgtcatccttgtgtctaatgtgagatgaccttgatttgaagtgtctggtgtcttgtcactcactgccttgcatatggttctgaccagtcaggcaggctgggactgaaggtggctccctggtgaacctagcactgtgggagttcatagtagaatcggcttaggtgctgccacccaactcaactccactccctccctttctctcttctgcaggcagccatgagctccagccgccccgagccgggtccctgggcacccctgagcccccgccttcagcccctgtcccagagctcttccagcctgctgggtgaaggccgggaacagaggccagagctccgcaagactgccagcagcaccgtgtggcaggcccagctgggcgaggccagcaccagaccccaggccccggaggaagaggggaacccgcctgagagcatgaagccagcacgggcctctggccccaaggcgcgacccagtgctggaggccactggtggagcagcactgtgggcaatgtgtccaccatgggcggcagtgacctgtgtcgcctgcgggcccctagtgctgctgctatgcagaggagccattcagacctggtccgtagcacccagatgcggggacacagtggtgctcggaaggccagtctcagctgctcagcccttggcagcagccctgtccacagggctcagctgcagccaggtggtacttctggccagggtggccaggcccctgcaggcctggaaagggacctggctcctgaggatgagacttctaactcagcctggatgctgggggcgagtcagttgtcagtgccaccactagacctgggggacacaactgcccacagcagcagtgcccaggctgagcccaaagctgctgaacagctggctaccaccacctgccatgctctgcccccagctgctctactctgtggcatgagggaggtgagggctggtggctgctgccatgccctacctgccacagggatcctggcctttcccaaactagtggcgtcagtgagcgagtctgggctgcaggctcagcatggggtgaagatccactgtaggttgtctggggggctccctgggcattcccattgctgtgcccacctttggggtcccgctgggttagtcccagagcctggctctaggaccaaagatgtgtggaccatgacctcagccaatgacttggcccctgcagaggcatccccgctgtcagcccaggatgctggtgtgcaggcggccccagtggcggcctgcaaggctgtggccaccagtccgtccctggaagcgcctgcagccctgcatgtgttcccagaggtaactctggggtccagcctggaggaggtgccgtcccctgtgcgggatgtgcgatgggatgctgagggcatgacatgggaggtgtacggagctgcggtggacctggaggtgctcggtgtggccatccagaagcacctggagatgcagtttgagcagctgcagcgggcgcccgccagcgaggacagcctgtctgtggagggccggagggggccactgcgggctgtcatgcagtccctgcggcgccccagctgctgcggctgctccggcgcggcccccgagtgaggagctgtggcccttggagctggcctgggcccactgacttagtcctagacctgggccagggacggtgggggctccgtgccccctggacccaccggcagctgggcacatctctcacctgaatattggctgcctccagaccacaggactgcagcctggggcttccggccctacacagctgggctgttttcttaagggcttgatttccaagggccacatctctgcaccttccgggctctgaactttgagacagggctttagcactgtgcagaggggagatcctgagttttctgtaaaaaatgaccttttgttca

SEQ ID NO: 2193 - DNA, 4788 bp, Homo sapiens
tgggcacaggagtgcggccgggggcggggccgagtgggccccggtacgaaccctccgggaagccgggcgcgctgcctgcccttggcccggggcgcagagcgtcacactggatctggggagcatcctacccccactgtggacctcagtctcctcacctgagacatgggcggccccatccgcaccctgtaagccgcaagccaaggaggtaaggggtgcatctgaggtgtctgggcgctatgggcattaggatatagtagcttttgctgagatttcaggagacaaagcaaagggccttccctattctaaccccactgggagattagcattttgtgtatgattcattaattttcctctgattgactgggaaggcaggctgcagggggtccctgttggggcttgcagctggttctagtttttgtatctggagagctgcctggggacaaaatgcagagacaccattttattgaccttgcgtaataatctaccctccccctcatacactcgccacccccttgggtgtgcctgagggacttgaggtcccctggtcctcactggtcagtgtaccccaagcccagcagccccaggcagatgcccaacaccaccttttcagtgctcctcctcctcctgtcttggccctctctgccaatccattttctatatccaagtgatcttactggaatggacctgaccttgctggtctggcccaccactccagcttcatcatctgccaccctggaacctcttattctgcttacttttcccagcaggctctgctccttcctgcctctgtgcctttgcacatgctgttccttgcacttcgagttccctcctctccctgtccctttggctggttgactcctcttcagcctttgagccctgtaccattgccacctcttctctcacctccctgctccctgctccttctctgatctctcaactcacaggcctctctttcatattggtgttggcaatggcaatgagttccatctgcattcgtgctggtcagcccctctgctctgggagggccatgactgtataagtcatctttgcagcccttgtttctagcccagggcttgacacacacttattgagtgggtgaatgaagcagtgagcattttctggagccctcccagcccagtccttccactctgatcctgctttaggtggttggtttgggatgaatggtgtttctccacaccactggccaagccttgctgatggtcacccagagccttgggttctggcccatttgctgcttctgagtgcagtgcctctgccacaggttcatgcagctgggactgctctttatcttatattgggccctgtgtttggctctggaatagtttattttgccatgttcagccccaaatggccctttttgccagaagaccatagtgctggagaaatcttcctgccttcgagatctggttcctaaataaccagactgtaaactatcaggtgaattcacagcttgatcttttaaatgaccaaatgagactcttttttttttttttttttgagacagagtctcgctctgttgcccaggctggagtgcagtggtgcactctctgctgactgcaacctccgcctcccaggttcaagtgattctcctgcttcagcctcccatgtagctgggactacaggcatgcaccaccacacttggctaatttttgtattttcagcggagacggggtttcaccatgttgaccaggcaggtgttgaagtcctgacctcagaaactcatctttataagtagatcagatgcacagcgagtgacattcatgacagccgacaaatagagtttactgagctctggttgattttggccttgtgctctgcaaaaactgccttaacatagcaattgatcatgtaaaaaatacatatggccatgatatgagacttaaagaatatctcgaatagggttttctgctatagtgttttacaagatggggtccaagggccatgtgcatcagaatcacatagtctacttgttaaatacagattcctggcccccatcctggattcacttaactacatctcctggtggaagggccctgggatctgcactttcaacatgcttctagaatgattctgatgtttactgaaggttgagaactgcaaccctgtgggattaataatgactagagaatctgagaggtgagtcacaatgatgtatgtagtggtatggtgcttcccatgcaaaacatccatcattggcactaacacgggggaactctggagtctaaattccaactcagtcttggcagggggtccgttgtgctgaggaggtcctcggagaagggacagcctgtaccagggcatagagatgtggaagagtctggtgtgcttgtgagctgcacactgcatcaagtgacttgaacatagtcatggagtaggttctgtggagggcactgggcacctgtgactttggccaggtatgtctgtgcacatggtgggtagtaggaagaagctggtgtgctgatgagccaggctttgcatactgggcagtcttcagttttgccaggtatcacctaaaaaacaaggctaccagggcagggaggggctgagaccaggagggtgcactgattgtggatccccgaggctttagctctatcttgaagggaatggggtgccgtggaaggacacaagcaatcctgtgcagagtggcatttattgctgtctccattcagataaaatgtgacaaggggcattctacccatgttccctgaacaattccgtcactaaagtctgcatacagcactccaacttttttatcatcagaacagcctcatcctgaggccggagggaattagtagaacaagttctggcattagatgacctgagtttgtaactgggccctgttactaattagctgtgtgactatgggcaagttgctttccatctcagggtcttagattcctcatctatgaaacggattgataatatctacctctaggaataaactagctaatagacgaaagtgctgagcacagtacccagcatgcaacaagtgcttctaacaaggtagcaatcattggatgccaatgtctcaccatgagccttaggtaatagcccctccagataccagccttgggttggaagcagctgagagcctttctacccggccctgctcctctctggattctaccctgggcatgatccctgagtattgtttgtctgtttgccttgtaggcgtcatccctcaagtgtatcacttagttcaagagtcctggaatcttttcacatccactatgaacacctctcacctcctggccttgctgctcccaaaatctccacaaggtgaaaacagaagcaaacccctgggcaccccatacaacttctctgaacattgccaggattccgtggacgtgatggtcttcatcgtcacttcctacagcattgagactgtcgtgggggtcctgggtaacctctgcctgatgtgtgtgactgtgaggcagaaggagaaagccaacgtgaccaacctgcttatcgccaacctggccttctctgacttcctcatgtgcctcctctgccagccgctgaccgccgtctacaccatcatggactactggatctttggagagaccctctgcaagatgtcggccttcatccagtgcatgtcggtgacggtctccatcctctcgctcgtcctcgtggccctggagaggcatcagctcatcatcaacccaacaggctggaagcccagcatctcacaggcctacctggggattgtgctcatctgggtcattgcctgtgtcctctccctgcccttcctggccaacagcatcctggagaatgtcttccacaagaaccactccaaggctctggagttcctggcggataaggtggtctgtaccgagtcctggccactggctcaccaccgcaccatctacaccaccttcctgctcctcttccagtactgcctcccactgggcttcatcctggtctgttatgcacgcatctaccggcgcctgcagaggcaggggcgcgtgtttcacaagggcacctacagcttgcgagctgggcacatgaagcaggtcaatgtggtgctggtggtgatggtggtggcctttgctgtgctctggctgcctctgcatgtgttcaacagcctggaagactggcaccatgaggccatccccatctgccacgggaacctcatcttcttagtgtgccacttgcttgccatggcctccacctgcgtcaacccattcatctatggctttctcaacaccaacttcaagaaggagatcaaggccctggtgctgacttgccagcagagcgcccccctggaggagtcggagcatctgcccctgtccacagtacatacggaagtctccaaagggtccctgaggctaagtggcaggtccaatcccatttaaccaggtctaggtcttctccctgccatgtcccttgccaggctcttccacttagctaagtgggcacactgcaagctggggtggcaccccagcattcctggctttctggggtccagataggctggcaagagctgtttttgcatccatttgcatcgtgaagactggcattttgatacttcagctgtttgttcctgggagaattctgagcacagattccagaggtcacagtaagccttgcagcttgagctgaaagatgccagagccggagatgtctgctggcagcaggcagggttcattctggtgacacagcaacagatgcctggcctgggaacccagggatttcacctccaccagtgagaccacggggccactgtggggtgagggaaggagcgcttggagtcagagctctaga

SEQ ID NO: 2194 - DNA, 543 bp, Homo sapiens
tttctctggctctcctctcctgctaagctttgtttcctaattaaaatctgccactgccatagctactgctgctgctggaaccgccaatagccaccttggtttcatggttttgcaaagtataggcctccattgccacaggggccagagcttctgcctccaaaatttcctcccttcatgggtccaaaatttgaagactcattgttgtaattgccaaaatcattgtagcttccaccacctccaaaattgcttccatcattaccaaatccattacagccatccccactgccaccatatccaccaccaccacgactgccaccaaagccaccaagaccactgaagtttcctccaataccaaagttgtcattcccactgaaaccacctccacgaccaccaccaaagtttccagaaccacttcgacctctttggctggatgaagcactagccatctcttgctttgacagggctttcctaacttcacagttgtggtcattcacagtatggtatttctgaatgacaatcttatcgacggagtcatggtcatca

SEQ ID NO: 2195 - DNA, 227034 bp, Homo sapiens
gacattgagaaaatctaccacagctgcccattaagatgttgacactgataaggtctaagatgctggtaagatggtatctacaatgtcttgaggcttatgtaacatgtaacaccaaggacatttcactctggataacctccaaagtaagacaacttaggagaggaacataaacttgcactatttttaataagatgccttattcctctttgatacttcagaaatctttatctacatccaagacttcacaattctttggtttaattctgactttgatttttttttgattaatgatctacaggctttcatgcaaccacagattttttgtttgctctgttttgttttttgtctaagttatcaatatttaatatacaatctctgaaagatttgagggctagaaaaggtaaaaatgctttcataatcatattgcacttcttttatttcaaatataaataatatcttcctttagaaatttttacacctaaggaaaagatgcctagagatggagattttacatttaattcaaattgattaagaagagagagaaagctgggagaattcctattgagaggtgaagccagctggacttcctgggtccagtgggacttggagaacttttcttacaagaggattgtaaaatgcaccaatcagcactctgtaactaggattgtaaaatgcatcaatcagtgctctgtaaaaacataccaatcagcactctgtaaaatgcacaaatcagtgctctgtaaaacgcacgaatcagcagggtcctaaaagtagccaatcacagggaggattgaaaaaagggcactctgataggacaaaaacagaatatgggaggggacaataagggaataaaagctggccaccccaaccagcagtggcaacctgctggggtccctttccatgctgtggaagctttgttctttcgctcttcggaataaatcttgctgctgctcactctttgggtccttgccacatttaagagctgtaacactcactgcgaaggtccacggcttcattctcgaagtcagcgagaccatgaacccctgggcaggaaccaattccagacacactatatctccaaatcatatagtagtcatagccacacattggcaaaaaggctcgtgaagggctgtaggttctggccttcgcattccattagtgttcagtttgttcagttcatacttttagtggcacaaaaataatttaacatgaacaactcaagagacgatttggggcttttatgctgttaaaagtcccaaatgttcattttatttagaatgatggcattgaagtgctggcacgctttgtggtcagccactccctttgccctttcggaactctgtattgctgaaattttggaacattgagtctggaccactgtttttagcatgagatacattttttttttcttcataggtagaaggaatttttaagggttccagtctccagttgactgctaaagatgaatttcagtgaggtctacttgagaacacataaaagcaagcttttcagctgatatttcaaacagaaaatggagatgtaggagtagagtgtcatcaaacacagaagaatgaatttcagtaactgcaaactacattttagtgatgatgatttcagacagaatgccatccagtaacacctccatttttctcattatgactgcttggaaacaatactgtcttgagggtgacagaaaaaaagaaggcgtggttacaaaagggttacctgaggaatcctggtggtgatgtcactgttttgcatcttgactgtggtggtggatacatgaacctccatacatgacaaaattgtacagaactaaatacaacacacacatagaagtaaaactggaaaaacttgaataggattggtagattgtgtctgtgtcagtatgctggttgtgttatcatactatagttttgcaacatgcaaaacaggtgaaactggataaagggtacacaagacctctctgtattatttcttacaactacatgtgaatctacatttctgtcaaaatgaaaagtttaaggaaaaaaatcaagaaaggtaacacatactcataattctatcttagtgtaatttttgttattaccagaaaataatctcctgagacccaaataaatgtccaggctttccagaggccaaaccagagaaagtttttccaaaactttcaagtgatcacattgatattgatgtgcttattgataattgagttgtactacatgactaatacaagatatcttggagttaattatgtattaaaataatttttaagtgactataagaaaactaggaatttcatcttaatatctcctgatacatttaatgtatataaaaatttccatgacatgcatgcttgccagtgttctaaaaagtataaaatatgcaaataaaaaaggttattttataatttaaatgcagttttcaccatggacagatgtttttaaaactttcattataattctaaaaccaaattagtgatacatttaagcagtaaataaacattttaactatatttgtatatttaaccagtaaagtaggcatacttatatagttggcataatttttaccttgatggtaggaataggccttttggggataaaacagtttctcttaagtggtgaaaaagctacattttgttctttcagtctaatcttgttttctgctatgattttcttgcgctgttccagataaggtccaaaacttggcagtttctaaaaggaaaacacacaaataaggaagcatgttagctcagagaagagaaaaatgggaagatataaacatataaatattatcaacaaacaaatgtgtgtctagggattgtttcatgtatactgtaactaggtcttcactcattgttttggaccactagtcttctcggtatcaggttccgttaattattaaaaagaacacaacagtacaatacttttaccaaatatgtatgtattacatatacaaatgttaattaaaatacatttctaaatggaagaaagttcacaatggcaaaccaaacccattcacataaaacaacagctattagttaaaccatttgtttggtttgtatagacagaaggtgaaacctattgatgcttttttccccttcatcaggtttttagcatgatatagacacagttgtagtccctgacaaatgcttttgtcaatagcaaaggtacttcgccaaagttctcatctgtatctctattttattgtgttcaaattcttactacatctctttaaagattgtaactaatgttgattgcaacttactggaatagctgaaaaacaaaaatggtaaaaatattgatttctctgtacagaaaacaaattttattttgcatggaggcaaaaatagaaatgaaaaggagaggaaatattacagtgcttaaacaaactccatcagtattcaaaatcacatcacggagctttaaatttcaaggttatccaattgtactttacaaagttcatttagaaagatacctgggcgtcatggaaaaatgctaagtggtttcaagttaacacgaaaatgccctcataccattcattatcccacaattattttctcttcactttgtccttcccctcttctagaaactttgatcttcacttttactgacacatactgctggtgatagacatcactgaattccaaatgttttgtgtcggcctgtaacctggaattggtaggtctctttcataagactgcaaaaataccctctctctcctgcagaataaagtccatttatctagctgatggaggtttggaaaactacagcactcgaaggtcatcctgatctctgacctagcaagtattttggtgaaaaatcacacttgtttcaaaacactggcctccacatttcagcttgcataacgccccaggaaaatgagttctctggtcctctagagacctcagtagagtaggtaagctaaacttaaaccatgttccaattaagccgaactgcaaactgcaactgtaattcatgttagcaaagaacatacttatgtagaaatatctaagattgttacttccattatcaattcattataattatgtcaacaagtcaagtaaatggaaacaatgttatgaatgccaaactaatttatatacaatgagactagaactgagtacttcatctctacaccttaatgctttcttaatttgtaatatttaattgttgcagtaatatgaaatgataggatggagggagatagtattttgtatccattttgctataaaacaagtgatactgacttgctaaaagcataaaataaataagagtataaaacaagtccttatcacatatataagcatccttaaaagacaatgcttttatgaaatggctttttcttggggcatatgaggtatatgaggtgttagggattacacttggtgccaaaaaaatgcctttggggtcagataacaccacataaggtggcgagcacacgtccacatgatataaatcttcagaatgtcaccccctgcgtgcttctcttatacctcaggggcatctcaatcctaatctaatatactcaaagactatcaagaacggttaagtgttgaaacatatgacctctggttctagcagatgcctcaggttagcaggctccatgaaaatcggaaccattattttccctgttggggtttacatggttctctgtttggactttaccttactcaacatcatctaatttcacctaagagttttgtaaaggccattcaaaagaaatcattcttgcaaccttttaatctatcttcctttaaatgtacatcagaggatagtatattttttcatttagattattatttatccaaatgcagacaatgaatgtagttaaatttaaaccataatgatttcaaattatttcaacaatggtaataagaacaataaatttttgaaaatcttttgatgctgaatataatacagcctgtgtaaatatccaacagcctgatattttctgtcattttttgcaatgattgaccacatttgccatacataaattatgttacacagccttcccctggctaacatgctaagtttctaatgtgctaattggttttataattagtcctaaagagagaatctcaatttaacataaagattcctacaggattttctttgtgcattggttagaagaattaatggactaaaaggaaaacttgccaattttttttaattgaaagcaaaaaaaaaaataccaaatatcagtgactgctccttccaccttccaccaagcatctccacatcaaattgggttcatttttgtttaattcctcactgctacatggagctctcagagactaaggtatagtaccagcttccaaaacttcaaggctgctgtagacattttgctttccttattagtttgaaaatttaagtgctttaaaaaatatgttgtatatattaaagtggtcctaaggctatttaagtactgaacattttaaaagtaaagttttccgaaaacaaaaaaacatcaattctctcccgcaacaaaggatcaaccgatcacctttacacatactacatttaggcatacatttgtgttttgatcttgcaaaaaaaaaaaaaaaaaaaaaaaggaagaaggataaagcaagcaagcaagcaaaacaaagctaagaaagagtgaagatgaatgcatagttggccactgtgtgtgtgtgcaatcagtgatgattaataaagcatttagttcaaatctctgcctgaacatatagttaattgatttcctattgcaggaggagaagcagcaggacctgacagtgccagcagcaggagcttttcctcttcattcattattttcttacagaaaagttgtagcctgcggtaactcaaagtgagaggttttgagcgtcatgctatatttcttaaacaaaggaaaaagttctttaggactatcaaaagctgctttgtaactgatgaactgaacaaagctcagaaatggtgtgagttttgtttcaatagtttctccagggattcatcattgatgaatttgttctcaccagaaaggctaaatcctactcatttaaagataacagtatcttacactaaaactgtctctatccagatataaaaaaagcattacattgccgatagaaaagtgacaacataatgaatcaacaatgataccttaagccagcaaagctttaaggtaaagaagtctatttggattataatttattcatggatcaatctaaagttaattgagcatattatgaagtagaaaagcgttcttgtttgtaatagaagcaagcacttgtatcttccagtttaaactgcataatttttatgagaatggcagcaagttgcctaatagcactagtctgtagtactgtaatggatcaactttattttcttaatcacactctcttatctaattggaaaccataacaagaagacaagtaattactttgatatctaaattgtaatatgtgaaagatgaaaatatttccggcttatatcagaatatatcactcagtatcatatatatatatatatatatatatgtatatatgtatcttattcagtataaacctgaaatctattatctatctatctatctatctatctatctatctatctcctttatacctatttcgtgtgtgtgtgtgtgtgtgtctatacaactgacagactaaaggataagttacatgtaaaggatatctaaaagttgacttttttttcccaaaagacatgtttgcatatgacatagctctattatttatcagtcttttgacatttattcaacaaatacagtattgaatatccactctgggccaggaactgtcctgtgctacactaaaggctaaacaatttccagacagtgtagtacaaattatcattgttattaattttgtaagtatcttttgctattcattaagggctagtgtcagattgaattatatgtcaaatatacctggttgttgcagttatctcaaggaataatatgccagactccttggaaaactgtttgaactcaataaaatgaccaataattgcagagaaaaatgaagaaaataaatgttcaaagagttgatctttaaaaacctcaaaaagctaattgaagtagttcttggatacctaaaataaaaaatatgggagcagtgtggtataatggttgagagcatgggttctctgagtctgtttcattatctataaaatggccattgtgaggtttaaataaagtaatccaggtaaagttcctaactcaccctaatttcaatctctgctcagcatgattcaaggtagcacaggagatagagatgagaagtatcttttctgttctgtagtttctgaattcagttacttttcttctttcctcttttcaattatgaaagtaatcagttacttacatttgatgctgatttttatttcaaaatcagttttagcatggtttagaatcagaagctcagattttcccatatgtaagtggcatgtaatgcttaatcaccgatataacagtaagcaatgtttcatgatattatcaaatttggacagtggaacacaataaaaagacagagacagaaagtccatctacatattacacgttaccatagtgctatgtgatggctaatgatgcaaatcagtacactggcattggacatgtaaaatatatgaaatatgagtattagtttaacctgataaatgtaagctacaacttttgatcaaatatgtgatatctaaattggtcaaaagcagagatagttcatgtttcatagtgaaagtagaaagtcaacattcacatagtgatgagggaaataatttagaagtcaaatttgcattaaaatcagttttgcactcattagctgtgtgactatgagccaattactttactattctgctactaattttccttatcaatgaaatgagaatgacagtatcaaactcacgatgttggtataagcattaaatggaataatatttgcaaaatgcatgcctgccaatttattcccataagccttaactgcttctattgcattgtgtactgtgctctgtgtttccatgtttgctcatgcatcccctctgccagaataccccatcttgtctttttcacctggtacatgccaattaggctatttagtttcagctcagtcttcataacacctaagtaatctcctttaccgattaccctccctgcccagtggtttagaatatcctgggcatattttaatctctgtgcctactgcactgccttatcatcattagcttatgtgtccatctgcccagcttgagatcctagacaggtaactttgatccagcacataataggtgctgaatataatttttcaaagcttaatgaatgaatgaataaatgaatgaatgaatatcttgaatatatttacaaaatctttctggttgtttgaattgtcaaacaatcccaaacaattactttcagaaacaaattaaagtatataaataggttttcaaatatgacatgaagtaaaaaatcgtacttacagaaaagctgtgattcatacattcagaaaacatttataaggagccagacacttgaaatttatatagaaaggatagtgtgtgaccttaaagagactatattaataacaattgcaataccctgtgggctgtggcagaagtgacacaaactgttatatgagcagtgacaatgtgtatctaacgcaggctgaggggtcagagattttctagaagaggtgtcatccgagctaaactctgaaggataaggtgaaggtaggatggcaagtggtgcagtggaggcgtgaggtcaggaaaggtgaagagaatcctccaggtggaataaacagcagagggagaagggtgacaatttggaaaaggcaccggggagccaatggactgctaaccctctgttccatcgttcataagctacaagagggtgaggcacttcacctgtgaaaagcaggcagaacacattttgttgtgaagtgatgaagtcggatcatgaattaggaataatgtcaatcaagagaagaaagtctaacattcatggaatgccagcaaaggatgatggaaataagacttgctttctgctaagtgctgtgcaggtgctggggcccaggccacaaagaggaccaggaggctgttccttccaaaagcagtttatagccttatgaagaggattgagtcatattcaaaggaactcagataagaacattattattttcatattgaaacaatttaaataactcatatcaggtctctctttaaaaactgtcattttttaaagtaagtatttttgaagaaatacctctaggttgggatttaggaaatgtggtattgatggcatgttttaggagaaaccagaacaaagagatggtccaagcattatgcatggagaaatgtagaattttgaaggagagggggaatagaaaagagaggagagggtaaaaggaagtgtgaaaagagagggcaagagagaaggagcacagcctgttggtatgaggctgaaggacttttataaacagggagagccactatttaattttaagatgtttgcattgctccaatctaaatcctcctccatagtctttatctaagaacatctgctacacacttacatgtcttggtgagacatttggaggaaaatcagggaaacagggttgagtttcatggttgggttggcatatagctgaaaagaatagaaaccaacaggagggaggtttgagggagattcagaattcaatgacagctggaatttatagccagaagcaacctagagaacagaatctctggggatttggtagcaatttccagaaggacaggactgggtaaagtcagctgacatgtggcttacatacgtcattgtaaggagaaataagtagaggacgacatgcacaaacaatctgatgtaacccagatccaatgagcaattaattccaactcagaggttaatacaatctttacagtgaaggaggaatttaaactatgctgaaaaattctgaaaggggaaagcagtgcctagttgtaggaggagaagagaagtaaggaaatgaagtgaaggaactacaggatgagcttatccttatatggctaaaatatactaaatgtcagggagatagtgggggatgaagctggaatatctatagatagggctctgaattctgggcaaagtgtttggattttattctttagggtgtatgggaacaccagatatttgaaaatgtgtgaccagatcctcatagtggcagaaggaagggtggactgtaggatgatggcggtagcaaaaagggagaatcatccagaatgttggagatgggattctggtagtggtaggaaagtgaactagatgagttctaaggtcatcattattttcaaagctgttatagtagaaaattaaaaaagggttctatggtgtaacggttaattttatatatcatcttgactgggttaagagatgatgcccagggagctggtaaaacattatttgtgggtgtgtttgtcagagtgtttccagaagcagttagcatttggatcagtagaccaagtaaagaaaatacgccctgagtaaagagaatgtgggcgggcatcccccaattggttgatggactgcatagaacagaaaggtggaggaaaggcaaattattctttcttctggagtgagagctaggacatccatcttcgcatgctcttggatatcagagctctaggttcttgggcctttggactgtaggccttatagcactcgcccagccatctcctccaccatctgctgcccccctcatctcccagtcctgaggcctgcagattcaggcatagagttaagtatgccattggctcccccagtttttaggccttcagagtcaggctgaattacactacaagctttccttgttctccagcttgcagatggcacgtcatgggacttcctggcctctataacaacgtgagccaattcccatattaaattcccttttacatacctatatataaccaatgggttacatacagatataacctataacctgttggctataataatataaccaattggctgcatatagatatatgagggaattgaatatataacctattagttatgtatggatatataagagggaatctaatatgttaaattggctctgtttctctggagaactctaatacacgtagtattcgggaaacagagaaccaacactgactacctgtccccacaccaaggctccaatattgatcttcactcccacactgcctgctgactgcctcaccctgactcacaatggcttctgccttgaaactcctgcatgctgtcattcttcctgacagacttctatttccacctctttgttggtcatctttctgcagatgacccctcctttatcaccatcccctgctcaatcagattcttgacttttaaaattacataggaactttgttaactggggcctgcatagtctatgagctgccaaagacttacttcttagtcaaaaggaacataaagcaatgttggtggacaacctgggaagggtaaaatgacttagttttactttccttgcattctaaaggacctttgcttatattttgtagagatgatgaggtaggggaggtgacatggggaaaatcaatttcctcaaaaatggctgagaggggattataaatttaacaagggagagggaaggaactgcaccatcatcatcaccttcacgaatatatcagcttattaactgatcatggctatataccagacactttgcaaagcacatgagtacattatctcttccttattgcaaagaagataaagaatatccatgagttgggtattctagtgtccatttatacacaacaacactgaggggcataaagactaagtaacttgctacaattaattcaaatccaagtctgcctgatagactctgtgctatcctgccactcatacttctttgtagtcctcacaaagttttgtataaggtaggtgtttaatatgctctttatttatttaaagaagcatactacctacatactccattccttgaaatctatgcttcctgttttacttattccacaaattttgaagggaaaatgtttcacacagtagaaaccattaaaaaaaatgctgaacacataccaagcaaaatatctgaattagtttggtcctgtttattactggcctcaagtttaatgagctcaagttaatacaggtgaaaggccagggtgttacatgcagaagttaatgaaataccatagagctgctgagaaaacgattagcagccaaatgtgaatttaatatacttcatcttcaagaagcaatgccccatgggaggcatcttgctgggggaggtaatgtggcatattggaaacagcactcacttgggaattaggagatggggctctgatcttcactttgctgtcagctggttttgtgacctatggcagcctgatgactccctctgtgtctcagttttctcaccggtaacatgagggggtttgactacatgatctatgaggtccctcccagtgatatgatctgttttgttttcaaattcacaattagaattccttagggtttatgcctaggtggcatcacattgtctgtgaatgaaacatcagattgagtcataaattataactctttccatcctacttaactatagaacattctgagtctattaggctataacatatggatatcatggatcatgtttatcaaacttccaaggttggatgggttcataaactgttttagacttcattagtaaaaggtaaaactaaagatattgtagctattttacctcattactaaataatgaaatctgtatagaaaattaatagaactaaaaatatttttttaatgaaagctattataaatctgtatgaattgggaaattcatacagttcataactaacattacactgtaattatcttgacaaagtttgatgtctagttacaaactcatctgagacacactctatagaaaatcaaccacaaatattagaagtgaatataaatgataacaggcatgaaattactaaagaggtaagaataaaatatagatacacatgtggatgcatttggtacatattagagttttaggatttgggagaaaaaatagaaccttctactaaagcaatgcaatatgcagaatgatcattgatcttagaacgcagaaactagctgaatgacctggggcaagccacttgccctctgtaagcctcaattttcatctgtataaaacagaaataacaatgatcaccttgcccatttgttcttcaccacaactatttaaaataggaaaagcattaatagatgattaaaatacagacagctgttactattttgaaaactctaaagcattatagaaccaaagtattattacattgtgcataaatctcatttatgcacaatataataaataatgtaaagatgtgagtgctctgaattataaaaatgtcacagagtattaacaatacataaagaaagattttctcagcaacagtccttccagtgccttaggagtacttggatgaaataatttgcttttgaaacccaccttcaaaatgctactgctttcatggctaaatgttgcatagaatgtcaagggcaaaaaccaatgagggaaaatggaataaaaattgccttacacaatggaatggaagcaaaggaaaacagaaaaatgaggtgatgaggaaaatgggactgctataaatatggagtaaaaaagcatacaggattcaggctatatttggagcaagactaggttaatcaattttcttccatatttatgcaatatgatacctaatatcctcctatgcagaaacacctgttttaatcccttttacagcacaggacataaaatattacattttgatccatctaaaaccctatttagagttacagttcagagcatactggaatgaaatgatcatcattttgaaagtcaatttttagtagttctatgctaagcagcagatttatattggaaagaaaataaaaggaagtataagttttttaatataaaaaatatctttctaatataattaattagcatacatgtatgaaatattaaacatgggaaaatatattttatacatttggcagagtgctccacaaataatagcttctccatgcagctacagaatacagtaacaaacatccataaatcagaattcatctcaaatctaggtctcccaactccaagcctagtgccactccctctacattggccatgaacttcctgaagtttttgggctactgttttgcccaacaatacttaaagtttttggtgttttaggaaaagatactgagggaaggacctaataaactacatccttgggaaagactccttctttcagatgtatttgttgagtatttacaatttgtctagtacatgctatgcgctgaccattgaagacataatggagaataaaacagatatgatctccttcctcagggaatatgtaatcacttttagtgcaatagaattaaacataaacaatcccactcacctgcactttcaccctctgtcttctcttccactactaagagaggtatcctatgtcctttaaaagactccactcatggactccacctcacgtaccctgtgatcatctgaaggaatttgcttctgtcatttttatctttgactattcaacaattcaccctcatttttacattattttcattagcacacagatatactttagcgtctgtcatcctaaaaacaaatatgctaagcataacaaaacaatttctgtgaccctacagccactttcaggcatcattaatttacttcccttcaaacttcttttaagcatttttaatagtgtctgtcttcacaccttcacctcctattcactcctcaacatatccttttcaggaatttgtcctccattccaaacaattgaaatgcttccataatgaagctaacaacaatctttattgtgcaaatcctgtggccacatttttgtttgtgctcatctaactttatctctcagcatcattaaacttagttgacccttctttctttcttaaaacactatcctatggctgggcacagtgatttattcctgtaatcccagcacttcataggctgaggcgggaggataacttgagcctaggggtttgagaccagcctgggcaacatagagagaccccatctctatttaaaaaaaataaacaaaacccccactattctgtttttcatcctacgtcacttctaagtgtctcctttgctgggtagtacatacaccccaaatctctctacttttcaccatttccattgatatggctctagtccaaggctcaattgcctcatccttgggctactgcaatagcctcctaaccaatctacctgctttctcttttgacttggtataacgtatcctccttatagtagcctgagaagttgtcttaaatagaaactatgacagatgattcctctgcttaaaatccttcaatgatttcattgctcttagaataaaattggaaaacatcaccatgactgtaggtttatctggcccctgcccacctcttcaatatattttaaccactgtcccctttattcactacactccagccatattgttcttgctattcttgacaagtcttataagatcatatgaccttagggcctttacatttactgggtttttttttttggtctgcatccagatctttgcatagttggatccttcacatgttttaggactcagataaaatgtcacctcctcagagaggcactctcggaccacccaatctagagtaggcctttcaaatcacactcttcacatctcctttttaaaaatattcacatcgtttatttgcttacttttaaaaatctccaacccctctaaaaggtactagattaaaatgttcactaatcttatttactaatttccagaaccttgagcaatgcctggctcattgcacactcttgaatgaatgaaggtactgggtaattgtacatttatacacagtacagtcttgaacttagcttggcttccaattctggctccatttttactaggtttttgacttagtcgtgttttacttaacttttgtaagatctcagtttcctcactcataaaatgggaataatattttataaggttgtaaagattatataatttatataaattgtatagagtgaagccagagcttcatacacaataggcacttaataggcctctttgccatcattatagaaattcttatcatcaacattatttttattatagaaattctagcaatgtctcatagctttttattaactttgtgaattacttatgtacacagtgacactatattaatgtatttattttttaaaaatgtgcttttaaaatattttgccttgtgcttaatattacgatatagtaaacatttcccatcccttcagcaaaccatttctccagcatttataagggaagtcaatggattaagcatgttgtacgtgatggagaactgcttatttcacatttagactgcatacactgtataaagtcaggattgctcatacagttatgtaattttgtgctccacatgtttaaataagtaaaattaagaaaatgaagatttgatagttgacaagtaaatgtaaacactagtgcttaaagaatgaaagcaagaccattctgtagcctaaactagatgctgtcatctgtgggggttagggaagatgctaagatctgagcctgctaccatgctacttcacgaacatctggcagtgtgtcacttcacaggcaacaacatcttctctaaacagaagagacttgaattcatcagggattcctgtagtacagtatatgcttaagttaagtacctgctttcccgtgatttccatagattatcatattcatgacactgtggagtgaaagcattcttctcactctctaactagaacatgaaaaagaaattaaaacattggcaggcactttgtctccagtttgttggacaagtaagaaaaggactttccatccattaatgtaaatgaaattcggtcaacttagagcatttaaacaaagatgacatcagcctgtctattaataaattcttgacaggataacaattacatttgtagttgactgtttttctttcaataaatgtaggtcagtgggtatttttaaggaatgtatttaaaataaattcgcaaaccccaataacttttctcctcatctctgttaacccagaaagtaactttaacatgcacattcttgcttcttaagagtggttttcagaacattgtggtcaaagcctttttaacacatgtgactgtgtaattaaatatgtgtgtgcctactgtgcatatacacacatatacatacaatgcatatccataatacatatatggtatctatattctaccccaatattttgaactgaatcctatagaaagatttaaagctacagcgggctctctgttatctagggatggtttttccatttagggataatctgggcccttgtgttactgcttctttctgacttgtgcatttctttcattattgactatcagaaaggaaaggtaagaaaaggtaataaattgatctagctggttagtcctctagccttaggaatccatttcgtagaggaagaagaagtgaatttaatgaataaattgagtttggggggattatgtgtggaattcactaatctacctggcccaataccccattagttagatttgagaaagtaagtttctaaacagaatcaggatgagattttcaatttcattttgtggaacgtctttccaagacaatgtgttttctttgtctaggggagttttggagatggtatatgttgatatatttgaatatcagttataagtactaccaaaacagtgaataattttaccttcatttattacaaattaaaagcacagctctatatttcatcacatttaagatgctatcatacattgtttattaatacaataaacaagaaaatataaggaaaatatgttgtttaaaatattactaaaactttttcacattcagcatctggtaacttgacgatataatcaattgtaagacaaactgattcagaggtattaaaaatgaaaaaatgcatgtcttagatttggtaaaatgcattgtgttttctaaatacttactggctcagttctaagtctccttctcatcattgttagtagccataatacagtaatggcatctcattactcctagggcgatgctacatggaaattacatcatcattcctaaaaccctatttatgaatgaaagtccacattttggattataaaacttcaaaatttgccatcatagaaaagcaaagaataaaccttgttctacttccagcattatcccagaaaacgatgagtgactatcacaaagaaagagaggtgagggtggacattaccgtatgttcttgagtcgggttaagtccatacctgaaaacttctgagacaggtgtctttattgtttcttgactccattttcctatccatatctcttctactcttctagaggtatgtggtgctaaagaattttttaggttaaagactatgtacattatatatttgtatttgtgtcttctaatgtgaattcaaggagaaaatagcataagcaatatttgttccttcaaagaaactcaggatgtcctaaccattttataagagaatgatttccctcttgtatttctccatgaatgtctttgcatgagttaaatatttgaaaggttgacagacttagttatttctagaagaagtttctgttgatcagtgtgcaggggttaattctggcactgccccttagagatatttttctagggcagaatgagccacaaagagaaagatacacaggacagtgtcaatacagcatcactacgtcatttaatggctgatggtggttatggcagccaatagtctgaggaaagcagattttccctgaatgatgaaaaaaaacccatcatattcaataaaatcacaaacaaataccatatattcctgttaaccatccaatgatgaaactgtatatgtgaatacactaatgcattccttaaatgcaaattactgctaaatttctaagtaaactgtcttccacttcagagccattgtaatccatctcttatgtcagatgaactgtgagacttatccttctgatcgcataggatttactgctttttgtcattcatctctcacacttggtaatccttttacctcttccttccaagtttgtaatttaaatgcactctattcacaactgaaaaaaggaccatagtgtaaataggatgtctttaagttacggccaaagaagtcattactgcttatacaatggtgtgggttctattacacagaggacaatatgaggaggctcactcttcacttgctttcatcaatgttttgtgtcaacacacagaataaagggtgggtgctgaatttggggtcttcccttgctttgacttgtttcttatggtattgcaacattttgtgtttgagagaaaagtccttgactaccagcattggcccccatgagttcttcagtttgtcatcaacatggattctgattttattgtttgaaagttctaaaatagcaaattgacaaaattggtatttactcctgaaaatcctacgtggccatttcaaagagaagcacgtttagaagaattaaaaggtgcatgtaaaatgcttccataatatatttttaagtgaaagagaaagcaggattacagcagcacatacagtatgatcctaatatagtttttattatacttatgtattttcctaattttctacagtgagcacacactacttttataatgaggaaaatgttcttaaaagtattgtcttaaaagtcacactaacagaaatggttataaaaacctatgcaggaagaaaattacaatcattattatggtcacaattgttaccttatatgtttttaaaatatgaatctcaaatcgtaatttagaatggtagatatcaaagaaatgtatgctgtgggaggatgcatatgtaatgactacacagatggaaatatgataagtagacctgaggcccacttctaaaatatggttaaatacataataagtaagaaatgctcattcagttcagcaaagcactgcatatgtttgaggatatagattttttttattcctgagaatatgaaactcctacattttaggtctatatggggtgttggcaaattaatatcctccaagaattaaactgtgatgctaactttccaagaattaaaactataatgttagcttttattagagtgagttcttttctatttgcagctctcaaagaagaaatacatttaggaggatatacatatgagaatatttatatacaaaaacacagattaaaagtttgtcttcccaaataagttaaacatttaacttaaaccaatgtttgctgagcacctacaattttttaggtattgatccctctagctggctccctattcaatgagcacacccaaactgcctgcaccacgactgccttttaacgggggggctatagtgcatcttaccaagacacaagcttaggaggtccagatataaactatagctgatgtaaaatgacaaattggtcatgcacagtggcacacacctatagtcccagaacttcggggggccaaggaaggcagattacttgagcccaggagttgaaaaccagcctgggcaacatggtgaaacctgtctctacaaaaaatacaaaacttagctgggtgtggtggcatgcacctgtagttccagctactcggaaggctgaggtggaaggattgcttgagcccaggaggtcaaggctgcagggagccaggattgtgtcactgcaccccagcctgggcagcagaggaagaccctgtctcaaaataaataaataaataaaagatacaaatatataaatatacaaataaaatgacaaatcatggatttactatggaaatgggtagtttttctcacaggattaatttttgtacacaatctcctttctgcagtgttttatatacagataaatttgagttgtctttagatatctacctcagaaaatgctcaaaaaggcaactccaggccagtgactcacacctgtaattctagcacttcgggaggccgaggtgggtggatcacctgaggtcaggagttcgagaccagcctagccaacatggcgaaaccccatgtctactaaaaatacaaaaaaaaaaaaaaaaaaaattagccaggcatagtggtgtgtatctgtaatcccagctactcaggaggctgaggtaagagaatcgcttgaaccctggaggcagaggttgcagtgagcagagatcacaccactgcattccagcctggacaacagagcaggactccataaaaaaaaaatgcaactccagacccctggaataaaagcatatgacaggttgaatgtgctaacactacaaagtttccaaaataaaatctttattgattgattgactgaatgccttgtaattatcaagtgtcgctcatttatctgctgctttcaactatatgtgaacgtatggatgaagaaagacttcctgaacaatcttcactagaagatcgtttcagaaccatatgctaaagcaaagcttttttattgctatataactgcagaggacatttacaggaagctgggtcaagcactcttatcatgtttcttatgtactaattcaacctatttcctaaggtttacccacattcattctataaagttaatacagagacaattaggagaaagacaatccattgtatacatattgcaagaaacttttagtgtcgctagaatgtcgaagatgcaatttatcatactttctttagaacttttgcatctttattcataagtgaaaatggtctataattttggtctacaattttctgggttgtactattgtcaggatttagtattaaagttggtcaaggttcataaatttattagggagttttctgtacctttctataagttgtaattgttgaaataacatagaaactctgataaaacaattagctagtcagatgtgaaatcacttgtgcctgatatctttttaataataaattttaaaatttgcttccaattctatggatgattattgactacataatcaattttagtagtttttatttgacaagaaattactcctctctctagattttctgaccaaataattatatataacaccttttcactatttaattctctcctgcgtttgaggtaacagtagagaattaaaggattctgttttcattcttatagaatacatttttgcttcctttttgcttgagatttcattgtaattgtatatatctattgatcttttcttttcaaatgtcaccttttgttttatttttccttttctttcggttcttcctaagactgaccttgctgatgcaagggggaagtgacatcccttagaggccagcacatcgtctcccagtccaggcgggtcttccacccagactctgggcaccctgagctctcttgataatcttcagattttattgtgataacaccttctttttcccccttttgtttcccaccctgtcgttaaccttctgcttaaactctctttccatttctctttctttttaacatttttttttctaagccagaaacttttccaacatacaaagccatttaaaaacacacaggtagaaagcaagagataactataaagtagattccatgcttcctggcttctgcatggggcaggaactgaggagggcatcaaaaaaacatggttcaacaatataagctgcattgctgtttaagtgcctggaaacagcagtgcccattgaagagtactgaacgtggaatcaatactcaataaggagattcaggttctagggctttgttttaaatattttttctgccagattcaaaaattaactcttatctaaggaatcagtcaccaaatttcccttttactgtcgactcagaagtttagataactacatagaaccaaatggaagaaaaatattctaagttttataatcacatttatttgcttcaaaactttcaaaaaacttgtttgtttgtctttaataactcacattttggtggtttagcgcatatcatctgaggattgatgttgaatgagtaaattactgtgccagttgcaaacaggaaagaaaaaaaataatggaagaggatacaataatataataatatttagtgacaacgggagaaaatccctcattttttttcacagactttggggacagaaggttctttccttcaggtattgggaattttgaacaacaagcattcattagaaagcatactaagtgtgtgatttattgtgacttccagtgacataacagagctcaaacagaacaatatttatttgaaaaaaaagccatatggcagtgcattctataattctggcttatgaacattgagaagtgaatttttaggccatctacaatgggtctcagcactttagtatgtctccagaagtcaggtaacagctctccatgctagaaaaccattcaaagcaatgacatggaaattagcacacgagtgtcccgctttgcagcccagtcccttgatttctgtgatttgacaggaagatgatatcaaagactgcagaaaagtgttaagggacagctcaaatgctggtgtgtgtgtgtggtggagcaggtgagcagttaggattgtgtgtcatgggctgacaggagagggagtgtcaggctaccacgtgggtgaacatgggccctatcatagaaaatatgctttttgttaggattctcaatatctagaaggaggggcaacctttctggcatgaatgtgcaactgctgtgaggatccagtaaaaggtcttctcaggatttgtttaaaaaggtcagctcaggaactactgacccctctgacttcatcctgacagtttcagccctctcacaaaatcactcttgtcacttctagcctcctgtgcttttctgaaaacaaaaccctctaccacctgccatccattattccaccagcaagcaacatgcgctctcttcagctgatatttcaatttattcgtggttagatgtgcagtaatcctctgactgaagctgagggagcagtttaaagatttaaaacaaaacaaagccagtgcttcaaacatctcttcatgcaaagcttaccagatgcagaaatgtggctaattctcatccacacaaaagctaaacgaagacccgcagatggtcagtgcctgccctctgcagagggagaggcagggttggctccaagtaacaaataattatccaggccctttgtaaatcaagttgtaccacttctcctgtgagcatccacaaagacggctgcatatatttgctattagctccttctttgtctggggattttgttaatgccctttcttcatataagtttgtgtcgccttgttctcacatttgacaccaactgaaatagccttgcagaacctttgtttctattttcttcaaaatgtgtattcctcaatgaggtttcatcttaatctcttcttttcaaaaggatatgaattgaacatgcagagaatcagcctaacaggaccgattatcaatttccatttcctttcagcgcctttgccacccatgggccacctagacagctttccttgaagacaaagggtgtctgaaatggacaactttattttatataccagtctcttagcggacgacagagcctcatcgccagtaataaatccttctcctgacccttttatataatgcacagctgagctaaaaaggaaatcaatgttgcaattttaatttagcactttcattctgttaatttatctaaaaaatcctatgccacgactttaccttgtcaaaacagccaatttgtgtcaataggaaaatgtgaaaatgctctgagtctctcctctgcacccccaaccacgtttttagtagtatggctgtaaaaaccatggggcacatactaagccctccatgttttcctgtaagtacaaagcttcttttgcaaatggtgtgagctcagcaagttgaagaaatatggagggtctttagcgagaaaataatctgggaccacagtgttagttagctttgctaaagatgtttgtgaaactactaaaatggaatgccaagtgtctaagtatgtattaatggtgatgcctgagcatattagtcaactagggatattaaatcttgattaatctctggggagagttctaagtaataaataacactgtgttttctgtcaggggatcataaaataactctggttttactcttttctctctgtatttcacaactctagaataagccagggatagaaacttaatttactctgggaatgatgctgccacaggagaatgaggtcaactccacaccacactgcactagtgccatggtggagatgcagaggggtggagcccctgagcaggtgaggacctgctacctttccagtaggaatcttgtgtcaagaaattgtttcttcaagcctttattcaaatatcacattctcagtgggaactttcctaatcatcccattgacattaaaattcttccctgcctcctgccactcattggccttcactatatcccttccatgactttttcccctcttggcacttctgactttcaatatcactttataatttacttattttattatctatccccattccaatgatatgtaagtatactgctgtttactaaataatcctcagggtatgggactgtttttaacatactgcaggtgctcaaaaacatgtttcccaaagaattatcatgaggtcacttctggccagttgtttcttgggtgcaggaatggctgcattatataggttgatgcatgtaacaactctgttggaaagaaaaccacctcttgctttcagggtgcttttgaactctacaagagctgaacttggtacgggagaaggagccaaactccaaatccagggtaaggaattagcccaaaggtgggcttataaacagagtcagatcctgggacttatgtgtggctgaaataaaaaataaacctagttggtttgggctcgaaaaaaggcttcagctattagtccagcatgctgtaagcaaagtaattcaatgagggccattatagcataggtaccatgcttggcactgtaagacagacaacatcctggcctgggtctgcaagtagattatgatctagggaagtttacatacatgtttcagtctagagcagggcatggaatgtattatcatgggaaatcaaggagggtttgtccaagattcttgaatcttgaaggatggaaatgttttcagtaccagagatgagataaatggcattcaaggcaatgagaatgctgttaagggaagcagaatgcatttgaggagtagcaattagcctcatgtagcctacttcctttgtagatgtttgctggagtacggatgaaaagagagataattctagaaagataggtgactatcatatagaggctgggttttacatgttgtattattttattgggtaaccaggaatagctcttaaagaggagacagacttcattcagaagcctgtgctgtaggaaggatgctctattttggttttgtggcagtgatggggctagggataaatatgcttagtcaagtaaataagtatttagaagtactaggctataaagcttaagaactatggaatctatccaacttataactgtaaagcagtaaatgtagaatattctagaataaagagtcatacacttacatttcaaagacttcccatcagagactttgcaattttgctccttattctttctagtattcttaatctgaatggttaagaattcttcaaatgaaatctctttaacttaattataaccaatttcatcttatttcctcatatatgtacgcagataattaccacatggcattgcgaaaagtcagcctgttacatgcctgatgatactaagcaagtctactgttctttaaaaaaatgttgctttaatctttccttatatcacttactctatcccttcagttaaaaaaagaaactcttctctttactccttgctatctttatttttttttcctgaatattgacaataaaactgtatgtggacctgagaagaatgtgactactggagagactagtggatgatcatttcttgactcttttatgcaattgactttttagttctcaattgcactgctctgattagtcaaattaaatataaggttgcctatactctcagatatttttcttctatacttggatctcgttagatcagaccatcctctattatctttaaagtaaaggttaactaccatgtggccagggaatagtaaaacatgatgctgacacatttatttcagttttaaaggaaaaacctcagttttcagctgatgaaacataggctgaaaatcctaatgctaaccataacattgtaggttctcatttgaattccaaaaattgggtatctttacatagaagaaacatatttactctatatgtcggtcagtactaagatatacacacaaacagtttaccacacttcctgtagacaaaatttatttttttctaataaactctgcttctaacattaaggttaaatttaactagttcattgagactttgttctttattgtcctctgaaattggtattatgctatcaaataaatataagaaaaacagtaaaaattcatctgagtagggtttgaaatatagtaccttcaatagcccagaggactcacttacttttgaatctgataaacaaagtaaatatatgaagaaaaatatatatgctccttggcatcacatttatacactagcttatttacaaaatttttctttattggtcctttgaatgtaagaaaatccacaatctagatgcttaaaaaatggatgagaacatttattaagtaagaaaatatacatggacacatatatatgaatgcatatcaacatttacttttggttttaattctctcatttatctttcccaaatttattttatagtctatctaatctttaacagattttttgttgttgttgttagcttcattacaacatctgaaatatccaatttcctctatagttgctgctgtgtttcggcagacacctttattgagttatcagaggactgtgcaggttctgagccctgcagcatacagagtagcctgggtgattcaggtcaatgtgcaataatgaatctgggtccctgccaaatatggtctgccattgtgaagttctatctctctgcattttaaatcatgatggttttttgcatttcacttttccatggattttgcttcattaaacaactttggaaggagtattttgcactctcaatttttgcgtgaaagtcactgattaactggtgaatttatggtttgaaatgatgcaaggcctgatctgtaggaaccagaggaaaatttcctaatggacttcttcctgattttaccaaagcaaatgccctccacccccgccctgctctaaatagcacagatttctggtattttaatgtgtcattagtttgaccagacagattttagtccctaataaaataattctcctaactcttaggttatttatttcttaatactttgttgtgagataaggcagaaagacatgctaactgagctgcaatgcttcaacattatgactttagtaacttttctgagtaattttaaaaacatggagagctacagttacccaaaaaaacagttcaaggaaacaaaaggactagatttattccaagcacaggttcagtaggtcagtgtccacataataatctgtgctttgtattttccattatttcttttaacatgctttagtgtctacaaaggatgaaagaatatagactccattgtccacttggaatttaaccttcctatttggccagctactaggcacaaaatgtttgggttcagtggatataagtccactgaggaaagttagatgctactaaaattttcctgcatctttgcacaccccggatgatctatcccaccccaaatatttgtgcatccacacagtgaatagtttatctgatctcctcatagtgattttctggattacctttgctttatgaatttaagaaagtcacttacttctttttatctgctaaccaagaggttcataaatattctctaaaaacctgtgggctctaacatgggaagttagagagtacgtacttttcctagtgggtatgaaagaaaaactctaggttcaccctgaatagcatctggagggactgaattaatacagtaaaactgcaacttcaaaactctttttttagaatgttaatttaattttgaaacctttttaaaaggcttaaaggattctttttagataaactaacaagtggggaagaaataagccacttcttttgggaagttatcagtggtttcaggaccttgcagtggcaactggattttcagaaaagaagaaatattttaaaataatcccccatttttgactaagataagactgtttgcttgtgaatggagactcaacatgtataacatgtctcctatttatgtggatgaatcttgttttcaaaagactatcttgatcacatgagatcgtttttctcaacaaaaaaacagaaaaagtattacaccatagatgttctgatgcattttttctcactcatatccaacatctcatttgttatagaaaattaagtagatttgagtaaaaaggtataaaaaagaaattccagttttatgactttctagtacttataattattgtaactatgctgaatacttgcaaaggcctggagaatgagactcagtttactcaacaggccagaataagccagagaagcaattgctatggtctgactgtgtcctcccccaattcatatattgaaaccccaacctccaaagtgatggtagtaggaggtagggactttgggaagtgattaggtcatgagggtgaagtcctaaaaactgaaattaatgccttcataaaaaagatcttagaaagaccccttcctctttctaccatgtgaagttatagtgaaaagatggctgtttaggaaccagataataggccctcaccagacaccaaacctgctagcacctatattttggaataaatttctgtggtttataagcctgatttataatattttgacatagcagtctaaactactaagcaaaaaattatttttatatgaataggtacttttaagatagtttaaaatggttaattcggtttagtttagaaataatttatatcattcctttcttttgagatcattactggctaagtacaaaaagtaatttcaaaagtaaaacttttgagattaatagtacaatgataaacttcagccatgctcttgtctgacttgtcagaaattcccaatttttaaaaacaagtgagatttgctgtgcgtgtgaggctctttccagaactgctcttttggccctcattcttatggatgtggtattcagtggtgaatccaacctccacacatgagtatttgataaatttgctcaagtagaacttctagatgtatctgacacttgttcccatcctacttgttttttaattacctatagattataaggcatttttatatacatgttttattgaaagctctggatcttaacaaagcaagcacttgcttggatttgcctccctggcccctttctccacttgttcacactcaagcttgtaccaaatcaaattccttgcaggcccctaatgttccattacatatcatgcccctcagtctatgcacgtgcatgctgggtctcatatacccttcctccaacataatctaataggtgaatccttactatgtcctaggtcccaccttgatatggccttctccaggaagcactccctgatgacactcacttctatcacatctgagattaactcattcttagtatttactacactatactgagtacctgactttccctcaggcctaggacagaatcttgtaatattaatagcatgctgtctgtcacagacaactgttcaaatacattcgttgagtaaatgaacaggtgaatggtagctaaaacttcattttctctttagcgtgtcttttgcacatgatttccacatttcagtttttcttaaaattccctgggaacagcatcttgaaattttctcaaattttatattttctttaggacttttgtaccttgctctgcctgggcagtcctttattcattcaacaaatatttttgagttgtgtttatgtacaaagtactttacaaggttttctaaggaacccaaagataaatagtacttggatgttgctcacaaagggcttacagtctaattgaaaagggaagacaagtataaacgtagcaaatggcaagcttcatacaagggaagtgacacattcaattggaggataaggcaggccttcttggacacgaacaaggcctgacagcatatgcaaagtctggacattacagcataaagagaaaagacattccaagccgtgagatgatgtttgtgacaaagaggaaaacagaacatggaaactacagatcaaagcctgactggacctcagtgtttatgaagaagggtagcaatgctgatggtatgttgaaaagggagcctgggttggtccaggtaggggagggtcttggaagttacatttttgtaggcaaaggagactagtaaaagcttctgtgcagagttgtacatctctcattggctgactcttgcttcatcttcctacgcagcatttctgtacctaactcctttttctatgaagctacagaaacccctcgtatcccattccacctccttttcctattattttatgacattctaaataattctagaaattccaacttgaaggttgctagaaaggtattcatcaactcattttcccccatcctcattaagctctattacttacatcaggctcaaaatcccaacaattagtttctgcagtagtcccctactggcatctttccagtactaatttacttgctacagattatatatttttttagttattttgagacctttgacatcaacatttccatttctggagccatttccttgtcttacagctcctgtattgtttcttttttgaaacaccaactcatggctaaactccactgagcatcttcttggattatgggaagagtatattaaacagaggccattatcttccacacacggttccatgtactgcaataacaaaccatgtatgtattgctaatcttgcacagaccaagtacatagcagtcggcactcaataaatttgttgagtgcttaataaatgtgtgaatgaataagtgttggttcatgctggagtgcaggttcctcagtatcaagtattagtatttctattctgtatccttgaacactctcactgaaacaggcactaaataattctgattaaatgaatgcattaatcccttcagaaaaaggatgcctgcagaaaaatcccaaggaattgcaaacaagatgcaatgcaataagttttctcaccccaaaatatgtagagcatcatatatattatttaggctattacagaaacatacatattcttgagttctcatttactgatgcctggcatatatgctttcaataaagtatagccattgctgatttttttttaagcctgactcaaaggcttcatgtctttgaactaaacaagagttccgggtttttatgacttatacaaacaaacaagctgagtgtggttagagttatccgtgcctaatattttaattccattgttcaataattccaattcctttgcattagttttgctttagtatacccttataatactttcaaatatatctataaaactttacagcccttttccaatggcatatggtgtgtgttctgaagagaaacatgtttatgagctgaaagatgggaagaaaatgtaaaatgctcttacgggactcggggagggattgctgcctgcctgtgtagcaggaacactgcagtatatcaagactcttgcagactgaacagaagcccttctatttcaacaatgagcagaagtctggaattgtgctatgctaactttgatgctattagggtatttttgttttttgcttttttctctcctaaagattaaagtaaatatttcctgaaacaatatttgaatactgtatgttgtaggatagtatcaactgagatggagggaaggagagaaaagtagagtgtggatggaggagtgacaaaaaataccatttttctgtcctctcccactgaagcccacccaaactttgtccaagccggagcttgcaacattgttccttacagagcttatctgtagttattcttggaaacatgcaaatactcattctaaaaggtcctgctgtattcttttttttttttttttatggagtcttgctctgtcacccaggatggagtgcaatggcatgattttggatcactgcaacctccacctcccagttcaagagattctcctgcctcagccttgcaagtagctgggactacaggcacgtgccaccacacccagctaattttttgtattttttagtatagacagggtttcaccatgttggccaggctggtctcgaactcctaacctcaggtgatcctcctgccttggcctcccaaagtgctgggattacaggtgtgagccaccacacccggtcctgctgtattcttaaaatggtcatttgctgagtgctagattcaaattttcagttgcctcatatattccatcttggtcttccttgtcacgatcattgatatatagtaacacagctgcagagactagaaagcttcgtgtgacctctgacttctttgctgttgcccctagttggtcaccaagcacagtcattttcctctcccatctctctcactcactcttccccttcatttccgtggctcttccgcaggtttcaggcccttgaactgatctcacatggcctattccaatagtttcttagtcagtctcttttaatgctaggcttcctcactcaaattaccctctaacatgccaccacaagatggttatttcttttagaaagtctactgtcattgcatcctattgtagcatttttattctgctttttattatactttgcagttttaactcctgtttgcacccagtgactgtaaactgcatcttcatgtcatcttcaacatctccgttacccatttcacagtgtgttttaaatagactcaggattatctttacacagaatgttggttttgctcacgaggattctcctggtccataccctgacatttctaaatgtccagcctttcctgttgatattctattagaaggtaaaataaaaaggcactcactgcctttaaatagcaatacaggaaaatttcactgctactctcatgttgtccaccaccgagtcttgagcaaacatagatgtgaaaataaaatatttaaggagaatactttgaaggatccacttttctgaattctctaaattttatttctaggtgttctaaatttaagctagatctttagagatctggttagctggagagtcctttgcaaaattctttccatggttacgagtgagaaaagaaagtataaaatgctacattatggaacctgttgttgcatttgtatcagagatgtggttctagaacaaagtatcttctttgtatggacacatcagacatttcttgagggaatcctaccagaaggagatgctctttacctcttctattggtttatacctgtaggtcctgtggtctgcatgtgatctatatgtgattgctccactttttgcattagttactaggctgctcagagtattatttttaaactccctttattagggatatcatccctactactgataatatttagcttatgacttacatacacatagatactaactctattccatctccattttatctttttcactctaattcctaccatctgatcttttcctttcctttcctctcctctatccttttcttttttccttccttccttcctttccttccctccttccctctctccctctctctttctttctttcttcctttctttcttctttctcccttccttccttccttccttccttcctttccttccctccttccctctctccctctttctttctttcttcctttctttcttctttctccttccttccttccttccttccttccttccttccttccttccttccttctttcctccctccctccctcactccctccctccctctttctctctctctatctatctatctatctatctaacttctgcatgcccagttattacttaattactgaaaatcattatgacaagttttaagtatgaacagtgtttgggaataaatgaatatgctagtaagttctatttcctgtaaaggcagcactttacacatagaagatgctcaagaatttcctgattggattcccaaaatttcaaagcactaaaatatatcaaaaagaaaaaaaaaaggaacgctacaggtcagaggtaactagtcatttgaaataacctaaattggcttttggtcaaagttgagcacaacaatatggtactcatccttattggctttcatctattcttagtgagttatattccctaacttgaggtaaaaagtgaggtaatgtgtggtatttttccctgctataatcctcatacagaatatctgaaagagaatggtacttttcatgcatgtaataatacccaggcaccactatatcagctaactttgctagatagcagtcacaaaaaggccattaatatctctcttacctccacctgagaaaggttagtgctatgggatgtgcacaagaagaagatcaaagagcatgcattgctggtccctgctatatgtcagagcaagacaactgaaatacactgagaaggtcaagagcagtggaagctgaagagataactatttgtgtgtgtgtgtgaatgtttataggatctgaagaaacctgagcacaaacgtcagtcttcatgacctgatcacatatgactcaatacagaggtgaaatcaaggtgctcctactgaggagttcaaagtagagactccgaagaatgaagagtgcaatacgccaaggcatccaggtcctaacaggaagaaaatccatgaacaaaaccagcaatgaagaaaaaaagatcattcaaaatggaataattttagtttctagggttacctttttttgtatttttcacataacaaaaacttttttgtcacttattttcctttacttaaatgattttgaaatgaagacaaatggttgccagggtgcctacaatttaaaatatgtctgaaaaggtttctgtggcagtcccaattactgagctattaaaagtaaacacaactaaaaatttgaagaatatgcagaaagaagcctaggaaaatgttgattttgaaaaagcaaaaacaaaccacaaacatatttttaaaaacacacatacacaatgtaattcctttatgatcctcatcagactttcctacatctcagcattctttaggtcagtcagtcaaatcatcgctaaagctttcaccaacaggaacatcgttcctggcgttaatacttcagtgtaagaactgttactaataataaaattttatatactaagaattttttcctcaagtgatatacaaatgcctctacagataaatacaatgttgtatcttatcactaatctattctaccccacattcattaacatagctacggtacagtgtattgggttaggaaatgaatcagatggaggaaatcttcacagctccatatttctaatataaaataggaattgtgcataaacattttgtctttatatttttcaaatataacaataataactatagaacatttgacaaatggagaaatgtaaacaacaactactacataaatttagcactctaaaaattctatcataaattctatcattcttataggtccttcttccatctttttcatgtgcaaatcatcaagatgaaaaatgacttgcatatgtttgatcattttgcattttatcattaaaacacctgatccaataaatttactgtaatttaatcaattattttctatattgctcccaagtttttataatgactactatttcattagtaagcaatgatgaagagaacttctatatgcacattaaaatatattttggattatttacttagagttaattcaaatactttaaagaatttcttttccaaagagctgaacctatttctaaagtcatcaatatttatgacatcaacagtttcaaaccaatacttgatatttcttaatataacatgaatattattttttttgctccgttggtatgtgatgaaaaagtaaggccttagttttcctttcaattttttaaaaaactagttagcttgaacattttctaggttcttttttagatgtatttcttgttttgtaaactgactatagagtactaagatattttttaaaaaaatttagcttagccttttataaaataaaagcattaattctgccacacttattatatttttcccgaaatctgttgctagcctttttggatttgggttatatattacatacataaattttacaatttattaaagcagataaatatatttttggtcttctccttttttaattgctttctgatagtgataacatacaatggtatcatagctttattttattctactttttttatttgaaaaaataacttttttctctaacttatgcaggggaatctgcttgttagtgtctttttcctttttgttgcttttaaaaattgattacctatagaagcttggtaaatattcagttttattttcttctacatgtactttggtttgtttttatatctaactatctaatcctttgaaatttgttttggtatatggtatgagacacttttgatctttttcttctgtaattgctataccatatcacagagcacactgcaatttaaaaaatcctttcccattgttgtatgaaaacttctatgatacacattgacctattaggttacattttttatttaaaattatattgtaggcctggtgcggtggttcacacctgtaatctcagcactttgggaagctgaggtgggcagatcacttgaagtcaggagttcgagaccagcctggccaacatggtgaaatcccgtctctactaaaaatacaaaaaattagccaggtgttacggcatgcgcctgtagtcccagctactcaggaggctgaggtgggggaatcgctgaaacccgggaggtggaggttgcagtgagctgagatcacgccactgtactccagcctgggtcacagagccagactctgtttcaaaaaaaaaaaaaaaaatatatatatatatatatatatatatatatatatatatatatatatatatatattctaattatattaggtagagactgttaaggtgtaagtgtgagcagcaataataagctgataataatgtctttatcttttaggtaaagacttatggccaagctagggttttatatagctggctctaggctgaccataagttttcaaaaaatgggaagaacatcactttcaacatttaaattgagttattaatgtatttccatagcgaaaataaccctattaaacctgagtataaatatttgctttcctctgaaaaatgatcagattaaaataagccagaatttggtattctcacatcgtatgtatgagcatgagttctgaaacagattgcctgagtctagctctctggtctgctaccgacaggctggatagtttggcaaattatataccacctttgtatgctactttcctcatacgtgacaggatggtaataatagtcatgatttcttgcagttgtgataagaattaaatgaattgaattaacatttatgccattttaccaagtttggggaggaagaggaggaaacgtgtcaacaaaggcttccttaaagagggtgaccatttggttaaatcttaaaatatcagtagattttcactatttgaatgttctattttgacacgactttctgaagttggtggtggcccagttagcagagaatttttactacatacttttaaaggttcagcgcagctctgcagggccacgtgagatgttgcttcttattagtagccctcggcataatgatgaagtaagttaacgttgcctttgacacttaacctcctctcagtgaaaccaaggtatggatttgaaagtacctcagtgttgggagtttaaatagaaaaagatctgataaaataatttacgcaaaggtgaacagtacctagtgggttactctttccaggtggggtcttatatatatatattttttttatttaaaaagtgttttggagataattgatattttaaaaaatcagcctaaaagacagcttaatccaccatttttctgagtttccctaagcattaagtttggtcaccaagaagcaacgttcttagattttattagcttaggttcactcgagcatacttcttttgagttgatttagctaatccttagctttcactaaaaattgatatggtataggtatttgaaagacacttttgtatttttcacaaaaccccggctataggcattgtacagtaaattattaagtgttcattaaatatggatccatgtaacaaaattttcccaatatttactgccaggagcaaagtgttgtctcttaagacaaacctagacatccccttttatcagaccatgagagctataaaactcatgaatttctttagtttcttggctaccaataagtttacagcaaaacatgatgtcctgttttaataatatagcttatcttttgtttcccatacaagcacttcttgctttctaaataatttctgctgtgtcttaaattttaaaaattttattacctttaatgttttaaattggtaaactactttaaaagacatgtaggaacatgagtggaatagttgttgcctgtgttcctcatttgacccttactaaatattaatttttaaaaaatagtgtcttttttctttccaagtagatttcaaggttttatggtagaacaggatttcttgttttctatcctctatactcaccccacatgggtactcaatagctaaattgattgattgatagctgtcttttaaaagcagatgtctagacaggatttttaatgatggaccttgttaaaaaatgatggactaatagtggaaatactaggctgagagagtgtttctgttatttttcaaaattcctctacaatggactatggccattttctgcatgcaaggaagaacacagccaggatcaccgttctttaaatcagaaaggactttgatagagtccagttccctcagttcaaatgaggaaaccaaggcccgaggagttactatcattcccagaagtagcgagctgagtcaatataacgttaagactgaaatttaggcctccctgttgccagtctgatgttgtttgatgccaatccatttattcactttctgcttccacacaagaatgacttgcataattttaaaggttggaaatccagcatgatcctaaatcagagtctccattcataaaactctaagctttaaaaatgctaggaatcattacacaaataaaatcctgagcactcattgtgctatgctttgtgctaaacatgtttcttttttccatatagtcttcgcaatcaccctatgaggtcagtactgttattattcctgttttaaagacgagaaaatgagaggcatgtctcatgtttagcactgggattcagtggcactctcctacactgtgtggactgcctcgcgaatccagtcatgtatacacatgtgtgtgtttttccttttggacacgtaatgagattttttttcccatgccagactggggtatcttagtatctctctcatggaattctcaattcctacccacctaggtttttccctggaaacttcctgccatcaaagcaggaatgatatttagtgcttcagtattagaaggtcacaaattgtgctggaatccaagggagaatcacgtatttggatgaatcacgaacgaatagtctgaacttccccaaaaacactgtcagtaaaaataaggtgctgccattaaatgacacctttaaagaaggcaagaacgcaaatttatgacaagaagaaagaacttctgagccaaaatcagctagatcttttttgtttttttcaatgccatccttgacactggtaaagagtagtcagctaggtatttgtcgactagaaagaatcgttaaaatggacaactaaaaccatcatatttacaagtgacacaaatcagaaattgttggctaacaaatctccttattccatcactgtgatatttgctaaagctgaccacctattaatttttccagtggagcctaaggatatagcaaatgccaagtaaatagttcaatctgaaccaggtttattgttcatcggctggtgctgtggtactgtgccgtgcttgtgtcttttgttgctgtggaacagcaggccttccgggaatgctaagaatacagtgtcttcccagagctgattacaccagacacgggcctcaatgatgcatggaccagctaacacagtgccacacaaccccacaatgctttcagcatattcagtcatctgcctcggagagactgaaaatattactattgatttggcttggtgtttaatgtggttgttaaattttaaatccctgtacaatgaccaatactttgggtagtaatgtaattcttccaggtttatcatctctcttgaaacctgactatttagtacattgtgtagcattaaatttcagacaggggaataggttttaataacacaaacacttaataaaataactttccatgagctttctcataatggtattaacagggaaagacaatttctctcattgcgcttctctgcagacattctgtcggctctgtatctccatcagttttttcataatgtgctcttggcacacttactttaatattgctggtttgagagcactgtcttttttatccttgtcactaaatgtgatattttgagcactcaagatgcgctgcaagcaggcctaaagtatttatattgaaactacaatggcaaagcatgtaggatgatctacctctctgaaatgagcctttaggaaacaacttcatcttgggaacatctctggctacacaattgtaaaaatgggctgataattaaagtaccagggaacactccttccatattcactgtttataagcagagtggtcttggtgggtgcacaccttaacataaaggaagtaatacttacatcttgcttttgtcacaccgaggctgatatctccactaagtacacatccctaatccaagacgttagcaaacatatctcttatcagcagtacggctttcacaggcttttttcagtgtccaccaaccactttccattctggataaaggatgttagctaggtaagaggataagcacagttgtaatctggatattcaagctgacctaatggtagatgctggatgcacactgaacctggcctggcggaaacctgtttctatatgagaatggcatgtggaaacagggacagatggtggggtcagtaataaagaacttgtttgttgttgctgattggaggccatttcttctgccagcatgactccacagatttatcctggcattggtgaccaaggggagacaaacaatgttgttcaacaagcattctgaaagctaccatatggccagaaggaaatctctggagaatactaggatgtgctgtgttgtgctacactgtggtagtattgctcttaagcagtagggggcatggtgagttcatccggttagaagtataaatagaagtaactgaaaacagcaggaaatataatccggtgagcttgcgagctggtgagcagttgtgttgtgggctgcttttaagattatttgcttaataaactgcattagtttcattcttttgcatttttctcgcaaaaaatgttcataaaggttgggttctagggtgacaaagtgttgggaaattttgttgatttaaaaaacataaatatgaactaataagagagaagaattcatgttagtctagaagcttagttaattgggagtctctagaggagtcactcaagatagtgtttgctaattaaggcaatgcattttccagggatttggagaaggaagagctctcctctggctttctgtctgcttatgagttactgtgcagcaccagtgacgagctttcactgattccagtcacatgactgacttgggtagatgtattccaccctcataacaaaggcttgtgggtagtaaatattacctatcaaataaaacaccaaggtaattccagttaactcttttcaggaattctaaaattttgtcattgagtttggtcctttcgaaaaagaagtctgccagaattggatatttcttttttaagtttttggattagtaaatcttatccaaaatgtaaattaatttcctataatagctccaaattaagaattctacaattctgttgatcctattctgatcgatgccagattcggttcatcggtgatgaacaagtcagtcatggtgcctcagattccttccatctcatttctgatgctgtagctggatttctctaattataattggatcacgccagtgggatttttagaaaactgcaaagtgttttttgttcttctgagaaacaagttataaaaataaaaaaaaatttatgtattctgaaaatggcttcacaagatgaatcttttaaagaaaaatcaaaacattatgaaaaacctaataacactcataagtttagatatgcaaaagaaaatgaaacagtattaaaccccaagactgggttctattcatggatttaaaaaatcttggacctgtctttacaaaacttgagtttaaccaactgaagtatcattacatccttggttttaaacgtcattaccacactaccagatatttctagactgaaaagattttttatgtttacgaacaacagattaaaggcaaaggcagcattattgtaataggatgtcataagatgtttctcagtcttagatgaggccccaactatgaaaggaatgttggcaaatctccttctttctaaaggtggatcaggcaggacttggtgagatgtgattcaaatttactctgtaggtctgggatctttccctgtcacccatagctctaaggagaggcagagaagacactggagaaaagattatgtattgatagcccagaaaaagtgctgtaattttctctgctctctcctgtagaatgttctgtttccgctacctcaagccaagtgacagaagacactctaaatacaatcaagagtggggtacttgcccaaagaggcaactgacatttttttttttttttactctgggctacctatttgctacttggaaaaaatctgcctttatgggacacttgctgactgtagtgataccagtcttagcaacctgaacatggacatgcccctgggtgcttgggtgggtagctgtggagggttaaagtaaggaggctggtgtctgactactgctgagaaaggcctgtatgtcagaggttggttgtgagggttccctgatagtagggccagtagaggtgtttgcttatgatgacagagacaggagttttttttggggacactctggaaagctgctgcaatataactacattgaaagccctgccaaggagaggtaatcccagtagaaagagacttcaggggtgaaatgccgaagcataggaaatcataatgggcagagcagaaggtatcaccagggagacagaatgggaggctctgaagatcccacagaggtatcctttaagaaaaagagttggcacctgccctgattgcatcaatatcacaaccatgccataagagcactacacaatcatcttttagcctcatatgcttcatcctttcccagcacaatggaggaatcacaggtgacatggagaagtggagaagaaggatgggagagggaggcagaagataatcacagacgacctaagcatccggccttttctctactgatgctatagggcctagtgcaggttaaagcagagattgtttaaataagaggagagccacaagtttcctggctggactctttattatctgagggtgttctaatgtctggaagtgatcagaaaaactctgggattttatccatagccaagaagaggagcttagtgggttttaagagaataaagatgtttctggcttgttttgaaagtgcagctcatttggtacactataatactgttttttcccaataatcaagtaattaatttttgtgtgatgacatgaagccaaatgtaagtgtgagctgagtggatcatacgtctaatagatctgtaaacatgaggaggtagggaaagttcacttctgagtacatatcacatctgcaaaccttgtcatagtgatccaaaatggaatgggaagtactgaagatgtatagtgatctcgcttcatgtaggattgtgcttgcattttctaacacagtccctggcatataatggaagcttaataagtgtatgccagaccgaactgggaagctgggaagaccaagcgaggcacgaggtgcatagaaggtgactaacaggttcttgaattagaagggaactaagttagagcatgagcatggccactattcctctactctaccttacttacctccctgactttgtctcttattactccccctatctactctactccagacaccctactcttggctgatccttaaggcttttttactcgctattccttctgcctggaaatctcttctcacagacatccacgaggcttatttctcatttccttcacattttgctcatatgagactttctctaaaaggtccatactcactgctgtctaacctttaaaatgcaacctgtctcctgacttccatacttttgagctcccttgccttctccacccttcctgtttacatagcccttatcaccgaatatactatcatttattatctttactgtttgttcatttttatctcttttacttaaatataagttctacaagggtaggttccttttttaaatggataaatcccaagtgtctagaacagtggctgacacatggtaggaatttcagtcatcttagctgaatgaatggatggcaatagatgcccagaggcctctgtgtcgtgttaactggattccatttgaggcattacagaaccctccggggtcaggggaggagttactgactcctttgccaagtagccgcagtacatatccacagcctcctaccaaaatcagcattctgggtattctagaaccacacacgaaaactgcttaggaactctcaaatcaagtagcaggtcaaagaactcctttgattgactctttgttaggctgtttggagtaggatgtactaattagatttggaagcactcaaggtttatactttgagctttatccccatagaatgcagagagaatagaaatgtaaaccctagtaaaaattaaaataaattaacagaatcaatctagatagttcttcaagtcaacttgcactcaaagagtattgggccttttatggtgcaaataatcatattgtacattagggataagtaaatctatcttcagttagactttggcaagcatttctgcttttaaatgtgaaaagccaacttgaaaattctgacaaatatattttatagaaaacttcatgtaacattagaaaagaaaaagaaactagtttccttcatatggttctactacacatatagaattataaatacatgcgaatctctctttttctcaaggaccaaagaagagaaatgaaaagaaaaacaagaaaaaagaaacaaaagattccagagatgttgtcagtctctttcaaacagctcattctttggaaagcatatctccgtcagatttcattcttcatacttgtttcactttccttcatcagtagtagacttaaaacactgttactctctttataaaactttacataataatctgttatttttttttacagaaaaatagcaattcctcctcagccattctttgttggctaaactaatttaatttattctgtaagctaaataatgccagctctttatgcccttcctgactttcctgcttggcacttgaatagtcttgattcttttaaatttggttcttctaagattttctgatgaaatttgatgaaatattttgatgaaatatttgatcaataattctttagagacttatagaaaactttcaaaagctattgctttcatttttagtttttctcagtataaaatacatgttccttaaagaaaactgaggaaatatagaaaagaaaaagaaagaaaaattaccaagaatttctgctttcagaaatgtctggtaatatatgggtattatcatagcttttttttcctgtccacaaatgcatgctttttttaaataacaaaaacaggaattatatttagatatagcaaggtttcttgtttttttaacttaataacatgagcatttctaagggccataatatactatttttaatattattatgattattttgaaaataagtcactttcattctaccagggatgtttggaacaaggtgtgttttggaattccttcttgctagaatggctatattggaatcctgtagggcatcttgacatctgctttaggcacactgaaatgttcaatggcaagagtatttaggactgagaacatctgaccactcagagcaaattatttgaacttctaagtgaattaacccacaaaaatgacttgataaccactatctaatgctgattgagatatcgaaaccacttgtccacaggtggaaagagcctccaagataagtgaatctagattcctgagtaaggaaatttagtattacccagtgactgtaccaattagatagacccttctacctacagactcagtgtcaacctctataaaatagtaaatataatcctcacctcttttcacacaggagtttcttagaatttaagtttggcaaacactataaaaaatagctctgagtcacaagaaattgccatattgccaggctacttagctatttattacctcacacttttagtgtctgaggtgagtcaactttaaacaaaaaagcattttgaaaatggattttacagcccatcttcgtaaggccatttcttatatctcatctttcaaatttcatttgaccagaatttgggcaaagagaattattcttaatacatttgtaacggctgcttttatgtgtcatcaagaagagttgttcaccagccaatggtaactgactcttctgactctttatccccagttacagaccttccgaacaaggaaattattattcttgccatgattctctggtcatcaaaccctgctatgcatcaccatgaaacaaatatcaaataaaggataagtctcaggaaaaccccagaactggatttcaatgctcagatcctgaaaaagtattctctgattttaagacatttgctgattcaagtgactttttaaagcaaaaagacaacaaatgggtacgcttccttaatgcagagacataggcaaatgcctttctttcagctttacgcaaagatagaagaagaatctcttacattctgggcaaccatctggaactctattaattggtgtatgaagcaagctaaactataagctcagatgtaacatgaaacaaatatactcaattaatggaaggtaaaattacagtccccaaatggaaagaactacaagttctctggtcattctacacgaaaagttcattttgacatttcagttatattaacaatctgttcctgctttggtggtctggaaagaatgaacagcaatattcataatctctactatcaactttgctaaattttttccccaaagaccatctttattaccctgtaactttcactacttgaagtgttcccatttctacaataaatagattaaaatcaacagagaaaagcttcaaaaagtgacagggttgttggaatttttcttgggattgttatgactccttctttatacacaggtcatctgagtcataatgaaacaccaactattcagagtcacatgctgtgctttgtgcttttggttgatcagaaaagcagtgaacttgatcccatcactataatctgatgcagcaaggaagagtgataacaattattcttagctgatttatttttttcttacaaatcactttcttatgcacacagaactgccaaaatggcatcagttctctcactaaatcttgcaaataaaacagtatacctttcaacgtggtggctgagattgtgtgatgtggagaaaaggaagatatgcagagatgttagcatggccacagggtgatggtggtggtggtgctggggcaagtgtgcactactaataggagaagatgtcaaaaaaaatgaagcataataatagtgcaatttatccttgctaaacgtactgcagtgtgctataattaaatatgaaaacctaaatttatctctatgttcggttgtcattaatttaacagggagtgcacatgttctaatctaatggttgattttttttctccatgtgcagcatattaaaatgtatattagcctcaaggtgcataaacacaaaataatagaccaaaggttttggcctgtggagaaaaaaaatccatgctcaaaggccgtcaagtagctgtgatgcaggggagacactcacttagcctcattaagccaaagctctcttttgcttgtcttttgttctgcatgacagcagcctctttgttgtataataattcattccaagttcgttccaagctaccgaaactggtgaactgtggccattttaatgagaagtattggtggtatgcataatctggaagccacgtgggccagacaatcacagagcactgcagccagcaaaatgagatattgtcgaaatcacaaatttgtcaagttgtttttggacagggtattataataagcactaaaatatgcatcctattactctgcatctgccagtcaaagatcactgtaatgaatgcgtgctgcagggtataaccaggccgttttcctaagtaaaacaaaccacagagtacagaaaagaattgtgtgggtttttttttttttttttggcattgtttgacttttttttttttcctaatccttttgcaccaggagtcaggttctcctggcatggtgtccactgctagcagtgaatacacaggccctgctggtgccagggagttaacatgaatacattgcttttttaataggtgtgcttaccatctgagaatacaaaacctcaaactcaaggcttcaattgagtctactgaagaattcctgggagagaaaagggaaaaaggaggagaaaaaaatatctctcccaatgatcctaagccttatgttttatccttttctacttcaaatggcttagcctttgggacttgttttgttgtttgtttttctgtttgtttatttttgcttttttgtctgtctgttgatttatttgctttttagatgaacctaaagctttgggaagaaatgggtgagatgctaatctatcccagttctataatattaatagtttgtataagaaaactaatacaatgttgacaagtagagagagtattttcacttgcccataaaaatggtccttagggagagtgaccatatactttctcatctaaaccagaactcttttgagagtgaagggaagatattatcgataattacaggcacaaaaagcaagactgtcagagacaaactggcctatatgatcatcccaaccataagctcttgaattggcaaatgtaaaggaagcacaccatgtccaaaggccatacaatacatcctgttattctgggcagtctctatgaaacattcagggttatttgtttgtttgtttgtctgttctgttttcagccaatggactttccataaggtctggatggaaataaaatgattgttaaatctaagaatacggagaatactcttccattcttttctagccattttttaaaccttacggaaccttttttgtgtgtgtgatcaggaggcatgatgtgagacagagacatataaaagtatggtccatatggtatttataattggggctgcagtagaaagatgggtaaaaccaagtacaattactcaaataaatgtggatttggatggtaaatatgaatatatgtataaaatagatgctttcttagtttagaggagataaatatatccagtgggaaaaataaacaaagcttcctggggtaggtgagaattagtagaatttcaatggcaaggaaaataaagagtcagaagaactgcatgccatgagccaatgtattgaggctgttataggaaggaggagagcatgtttgaaaaccactttactgaaagataatttacatggaaggaagtaacaaaagtaagactgacaaaataggccaggtgcagtggctcacgcctgtaatcccagcactttgggaggccgaggccagtggaccatgaggtcaagagatggagaccatcctggccaacatggtgaaacgctgtctcttctgaaactacaaaaattagctgggcatgggggcatgctcgtagtcccagctactcaggaggctgaggcaggagaagaatcgcctgaactcaggaggcagagattgcagtgagctgagatcgcgccactgactccagcctggtgacagagtgagactctgtctcaaaaaacaaacaaacaaacaaacgaacaaacaaacaaaaaactggcaaaataggttgcagggagatcacaaacagccttgaatgccagatgaaagaatcccttacatttgttggtcaagaagtatcactgaatgctctgaatcagaaaataagctttggaaaaaataaactggcagtgatatgtaaagggtctggagaaggagaagctgggagaagaaagtctacagttatagcgcagaagagtggtcctaaaagcctaaaccaggatattgatatttgagataaagataagactatccaaaatgctccttccttttcctaaatatcccaactgtaagacttacacatatttctcaagttgtataaaatcttctcaatgtcctctacgtccttagcccatcagtccatcttattttcatgttaaactcttctgtgcatcatgtcaggctcagtgattgtggagcgagtaatagctctcttttactgtactttgagaatgggtagaatcaagagggtgagtgcaatattggtttatacaacttggtatagcctaagttggtaagcattttcttttaccctaagttacaaagtgtgtgcactttggatagatacatgactactttattgtagaggcacaggtttgagaagggagataagtgcaaggcaaaccagatccctgagtaggtctcgggagatataagctagaaactctgcccacagcctgaattatggaagcctgcaactgtaacaaatgtcctgggatgaaatgtctggagccttaagctgtcatgcatgacaagaacagctctttagtgccagaggtctctgtctctggggcactggtatatccctccattgcccatgtgttcttctgtttggtgtatgtgtagggtgtgtgtgtgtgtgtggggggggtgtgtgtgttcttttgggatatctgctttgaaatttcatcatcaaactaggcttttccctgatgaaagttccatactatagagaaaacatccacatttgcttgcagtttgtgcagcttaaactgaagacagatgtcttgtgcagcaaccacaatattttcatttatctcttaatagatttccatctaggaatcaaaagtctgattttatttttcaactctgatgatgaatactaagaattattttaattatagatctatttcattctgcaggaaataaggagaggcattttgaagtttttttctttaaagacctcaataatatttatcttctaaatgggattttcatacataccatgacaatcttatggattactacatattgggagatacctactatggaatccctggcaatatctagttttaattaaaatgaaatgtcataataatgtcatcccacattctggtgtcacgacaaacatctttgaactcctgtgattaaataagcagaaacacttgataaaacttctaatgattcttctaaagaaacgaaaaatcttacagttcattgtttgtatctcctttacaagtatatcctttcttgtattatagctatttagatcttaactttcaactcagttataagctcttaatagaaaatacctgcatcactctaagtttacaacagagtcttttgtacgctttgggcttgatagatattaatgaaatggaaaggtaaaggtaaatgtttcacgccctttggaattaatctctattgtacatacataacatgcagatgcactaacagaagatgacaaaaattagcaatcttttgaaaactagtatttactaaatggatgtaatatgtgttgattatcataagttaggattgagtaaacaattaaaatgctctacttggaccaaattgaaagcccatattactggcaatctgatacagaattatagctgtgtttcacttgtgaaatagagataactttttttatttttttgtaacagagtctcgctctgtcacccacgctggagtgcagtggcatgatcttggctcactgcaaactctgcctcctgggttcaagtggattctcctgcctcaacatcccaagtagctgggattacaggcatgcactgccacgcccagctaatttttgtatttttagtagagacagggtttcaccatgttggccaggctggcctcaaactcctgacctcaggtgatctgcccatctcagcctcccaaagtgctaggattacaagcctgactcaccgcgtccagctgataacttttgtctttctccagtgtcattatcctagtttataacatcatcttgcaactcgatttctatagtagacagtattagctacataatttggggacccaatgaaaagtaaaaatccaagcctcccagtttaaaaattattatgaatttcaagatggagttgtcagagcattaatccaagagcaggaccttctgagagggaagctttgtgctatggcacagattgcatacccacaaagccaattctgctaaccacctcataatgatgtctgtaacttcattgcatcacatttcctatatattttcacatagtaacattacgatgtatttgtatattttcaccatttctgtgtaaaaccatttggcagtttccctttgcacatttaataaaatccaaattctttgtcatggtcaacgagcctccacataatgtggccattgtcaacctttctaataccatgtggcgttacttcctctttttttctctaacttgtgccacaaaggccgtccttcaggtttttgcacaccttcacaaatgctactctcaccagtggaacgctgttccctggctcctcatccttcacatatcattccaaatatctctttctcacagaacgcttccctgatacccaaattaaagtagctccacattctctatttttcttctaagcatgccttttcctcctgcaaatgtttagtacacactgtatcttaaaaaaaaaaaactaaaatagtttctgtccatgattagcttgtaatctccaagagaacaaggaccagtctctcttcttcgctacagtatgacaatgtttagcacattgcctacttcacagtaggtgcttaataaacatttgctggatggatgaataaatgaatgaatgaaagcaccattcaaatgttcaagaacatttttctcactattactattattttcacgtaggtaaaatataatttgcttgggcaaccagaactataataagctcacccaggcattttcttgtgggcactgggctctctctgggttctcctctgaagaagccctcttctcagatatactgtatatatgaatatttatttctcttatacaaaagaggacctcagagctaggtacatcactgcatcatctgctttcatgacttctggatggagtgagacatgcttctttctaggtccttctcttttccattttctattttacttaaagagaaggagctgttaacatattgaaactaaccatcctgttcttctttagcttcaaatagaactaaggctgtttataagaaactacacacaaatagaatatattgcatcttcctggaattctagtacattataatgacaaatgtttttcattgcaatattcattgcattatgttcaattgtttttgttgttggtctggaaacaccagaagtgtaattactagctttgataaagtaataaagtcaatggaataaactatgcttggattatggcctcttgttataagataagcaaagctaagtcaatacccaataaaaattaatactgatatcaaatccagctatcttatgttcaaaatgagaaatcattaccttctcgtaacattcttctatgaaatgtgttccttttaaaacattaaaactgtagaaacattaaaatactttacatatatttacatataccttactgtatttgagaacatatatagagattatacagatataatcgtacatatatatgagctcttttgattctttacaacagtgctgtgaagtcaactgggaagactgaattatctccagtctctagatgagaaaatcaagaatcagaaagattatctggggctgggtgcagtggggctgggtgcagtggctcatgcctgtaatcccagcactttgggaggccgaggcaggcagatcacctgaggtcaggagttcgagaccaacctggtcaacatggtgaaatccccgtctctactaaaaatacaaaaattagccaggcatggtggtgggcgcctgtaatcccagctactcggcaggctgaggcaggacaatcgattgaacctgggaggcggaatttgcagtgagccgagattgtgccattgcactccagcctgggctacaagagtgaaagtctgtctcaaaaataaaaaaataaaaaaataaaaaaattaaaaaatgaaagaaaagaagagaaaaagaaagattatctggtactatgcaatcagctattaatacagacagaatccaaatcttcaaatccctgttctttcaattttactgttaatatgttccaaaatgcattttaaattaaaaacatactaatggtcatactctactattccatagaagaatttaaaaatggaaagttattcatggaacagttttgaagtagtatattatctgaatttgtctagtatattttattaagctctcttcagcctgtcctcatcaaaaataagtattacattaacattacagttatttaaaaattaaccttttctaggctggtttaattttatggataatgtattaatcaacatggcttgaagtttcctatcaaaatgcagtcaaggccatttacactactattttcaggaatctccttctgctacctttgtaaagcatttacttcataggaagcatttcaaacactactagtggaaaaatacactaggcaattatagccaaagtttctacggatgtggctaatttatttcctggtttaaaccatatctaaacgagatttaagagttcaagagctgggaatgaatggacaattgggttattttgtattctgtggagtgagatttgcagtcaatgtcagtattaaatctaggtgtaaaatgcaaaggtgcgaagtttgaatgatgcctccactttgttaggtgatggctgaatcacatacacacacacacacacacacacacacacacacttacataaacacattgaatatatacacaaatacatgcagatatagttaatatctataaatatatctattaaattataatattaatgtcacgtaaaaatacacagatacccatatttaataatttttaaaatataccatatatagtacttatatctattgtatataacatatatatgcaaggcacacatgtagatattgctgtatatattctgtagactaatatattgatatatataattatcatatttatacaatattatcatcatcaatgttttcatcaagttgtcactctctcaggtatagcatacctgagaactgaatacttttcaagtttatgtttagatggttttcatggttgcgttttcccactgataaagtagaattttaaatataacttgtcttatttttatctgtcctcaatttgagtgtgtcctagttcattaaatttagaaatcccttctcattgcccctctgccatgtagttaatggtctgtaaaacacttaaaaacactagaggagttcatttttttaaaaggggctctatggagaagccttctaaaatgtaagagtcttttgtaatcacctatttatttacttgtactttaagttctgattttcatctagtagaggcattctttggtcaaggcaaaactgcagtattctctgtagcttaatatgagtatagctgataacatcatacttttttccattactactatactgaaactagtctagaacctaatgagctgaattgctatccaaaggaacaggatttaggttcagatggggaaaaagagaataacagctgcatccacactcccttccacatgatcttgttcatgagcaatatgatgacctggcatgacgtgcaactttaggtctggctctatagccccaggagaacatggcgaggacagtattaaaaacgtgtctatcctattcaacaaatggtgctgggataattggcaagccacatgtagaagaaggaaactggatcttcatctctcaccttacacaaaaatcaactcaagatggatcaaagacttaaatctaagacctgaagccatataagttctagaaggtgacattaaaaaaaaccttctagacattggcttaggcaaagacttcatgaccaagcacccaaaagcaaatgcaacaaaaacaaagataatagatgagacttaattagactaaaaacttcctgtatagcaaaagaaataatcagcagagttaacagacaacccacagaatgggagaaaatcttcatgatctatacatccaacgaaggactaatgtccagaagctacaaagaactgaaacaaatcatcaagaaaaaaataaacaatcccatccaaaagtgggctaaggacatgaaaagacaattctgaaaacaaatggccaacaagcatatggaaaaatgctcagcatcattaattatcagggaaatgcaaatcaaaaccataacacaaaaccacctcactcctgcaagaatggccatgatcaaaaaaaaaaaaaaaagatgttggcgtggatatcgtgatgtgatgaaaagggaacacttttgcactgttggtaggaatgtaaactagtacaacgactatggaaaacagtgtgtagattccttaaagaactaaaagtagatctaccatttgatccagcaatcccactaatgggtatctacccagaagaaaagaagtcatcatacgaaaaagatacttgcacaaccatgtttatagcagcagaatttgcaattgcaaaaatacagagccagcccaaatgcccatcaatcaatgagtggataaagaaaacgtggtaaatatacatcatggaatactactcagccataaaaaggaatgaaataatggcatttgtagcaagccagatggaactgactattattctaagtgaaataattcaggaatggaaaaccaaacatcttatgttctcactgataattgggggctaagctatgatgatgcaaaggaataagaatgatacagtggggccaggcacagtggctcacgactgtaatcccagcactttgggaggttgaggtgggtacattactggaggccagggttgaagaccagcctggtcaacaggcgaaaccattagccatgttattagccaggcatagtagcgcactcctgtagtcccagctactgaggggttgatgttgcagtcagcaaagattgcgccactgccctcctgggcaacaaagtgagactccatctcaaaaaaaaaaaaaaaagattgatataatgtgggcttaggggaaggggtgagaggggggtgagggataaatgactacacgttgggtacacattggtaagtgtacactgcttgggtgatggacacaccaacatctcagaaatcaccactaaagaacttattcttgtaaccaaacaccacctgtcctcccaaaacctattgaaataaaaaataaattaaaaataaaaacaaaaacacgtgtctaggtagcatacatgataggtgtactcaccctaagtaagttaatgtgttttacttgtgtcattgcaaaaatgaagcaaggtagagctataaaggctgtctgaacttttctcaagacccggtggtggggtgaggagtcagttacaactggttatttcctctttgcagggaacgtatatgtggcctgaatagttgagcagacagacttgggcttgctgctattaaatatgtggaatgtgtgttaatattcaggacatattttttctatttgatttcactactatacttcaaatttcatgcctcctaaaatcaaaggcttttcacatttcatatttccaagtgttgtcataagtctgactttggaatcatcatttacactattcatagttcttttcatctatcaaatgttataacctgttgttccctggattctgtatgaaaccagagctcttctgcttttgtgtccaaatattctctctgaattttcactcgagtcattaaaaaagaactattatctgactcttccatgatttgtctctggataggaagccccaaattgcattagttgtttttattatcctaatacactgaaagcctgattttactataatttgttcttcactttcatcccagccctaggtctcctgataatactgctttctaaattgtgtctattaaatgccttatttgatattattatttcacagattcatatcttacatttacccaagtttcatttcatttcttctttcttctttgtaacctctttagattcttttgtgctagttatcttttttctgagaattgaaagtagttcccaaattatagccaactacaaatttccttagtgttcttttgatctcactttccaacggtctcactaaataagacagatgagatgcttcttacattgagattttattttattgtattatctgttctagtacttctcaaacttaaacctacatatcaatcacctggggatctttttaaaatgcagattgtgattccatagctgtggagttgggcctgagattctgcatttttcaacaacctctggtgatgatgctgatgttgctggtttgggtaccatgttgtgagtagcattgatctagataattccagttggtacaaataaataacttgattgatttcaaataatgttttaaataaaatgtttatatttttagtgatggaaaatttttaaatctgtagttatttgaaatgaataaattttttttaccttggattagagaatctcactttaataatacctaagaaggagacaggagcttgattttcccttctttagcctccagggttccattctgatagaaaaatacaaactgcattctttaaagaaactaccatcagagtaaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaagcacatgaaaaaatgctcaccatcactggccatcggagaaatgcaaatcaaaaccacaatgagataccatcccacaccagttagaatggcaatcattaaaaagtcagtaaacaacaggtgctggagaggatgtggacaaataggtacacttttacactgttggtgggactgtaaactagttcaaccactgtggaagtcagtgtggctattcctcagggacctagaactagaaataccatttgacccagccatcccattactgggtatatacccaaaggactataaatcatgctgctataaagacacatgcacacgtatgtttattgtggctctattcacaatagcaaagacttggaaccaacccaaatgtccaacaatgatagactggattaaaaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggaggatagcattaggagatatacctaatgctaaatgacgagttaatgggtgcagcacaccagcatggcacatgtatacatatgtaactaacctgcacattgtgcacatgtaccctaaaacttaaagtataataataataaaataaaattaaaaaaaccccttcttggtaataagttatatcacctagtgtttgcacacactcatacacacatcaccttttctgcccatgcacacagttttagagatcccttttcagtgtattaccatcatcttgcctttttcttattgggaagacttatctacttatgtgggattttattcctcaaataagatgggttttattaccgacccctgaggaacacaaatgcccagttatccctatatggagtttcctattattaagtcagttctctatccaagacaacaaagtccttctcatttccatggtgactgaatggggaagcaatgattataaggcatcagccagaacatatgcgacagaaaaaaggaggcttgaaatttctctagactcaggaaatatgtattccatggcacacaatagagtattgcttctgaaatatttcaatttctgtggaatacaactcttgatggatatattttcaagttgtaccgacattcccatacctgtaatatgtgtataagctctcctttacttttgacacttttattcacccttaatggtacatggagctaaaagtgatatattttccagatgtggcttgatttcaggtgatatatatctgcaactaaagaataagattctttacaatgagcaatgctgaataggtacttctataataatcaggcatcacatatttggacttgactgcttagggtaaccatatatattcttgttgaagtactgggtgcttaaaaatgttttacttcattcctcagttaacaaaaatgaccctgaaaagtacactgatagcaagtagtattgcaccaattatacccttcactgcatttgattgtagggttttctctttattagcttaaaagtgagcagtaccaagtccaattccccagggctttttgtgcttctacaaatcatgtcaagttgctcacaaccagtgaattcattactctgatttagcgatggcagtacacaggatgggaatttaaaaacaacagcaaaaaacatttaagtcttcaaattttactagtttgcaatatgaaaaagttttatatctaggtgaatgctctttctagaaggattcttcatatttttatttatgatagatgatttttgaagatttcaacttctggtaatggcagaatacctcctttgggcttctcctgcagataactcaccagacacacacacacacacacacacacacacacacacacacacacacacacacactctatccaaatgcactgaagaatgtccaaaagagggcagaaactaaaggggaattggcacctggaagaagggaatgacactattctttttgcctgagaacaggctcagggggtggtaccaagcagggaggttaaaattcagagagaaattcgtcttctaactggctgagaaatcagagttggggccatcaaaacatctagaaactggggagatatccaagaaagaaagctacagagagggagcaccagattctgcatatgtattctacccaaatcactggctgacatctgagctatgcatgtgcttggcagatgccaagcagcacagctaagattgaaataactgtacagatatttcagtcagttgctaactgcagaaggggcagagttttggggtttgcattaagataagttaattgtctgctaaagcaaacaaaaatcgggactcttaggtgtggagagtccagagtctctgtataatgtatcatttacacagtccagatacaatataaaattgtcagacataggaaagagcattttgactgctctcaaaatgaagggcaatcaacagggatcagtcctgagatgatccagatattagaattagaggtcaaggattttaagtcagttattataactgtgctcagaatataaagtaaaatactctgataatgaatgatgagataataaatatggcaaagtaataaatgagaaaaatgaagcaaaaagaaattctagatttaaaagatgtgatactaaaataaaaagttcattaggtaggcttaacagcataatggagatggtatgagaggaaagactcagtgaacttgaacatggataaatagaaattgtccaatctgaaaaacagagaaactattaaaaaaattaaaagaacatctgggacttgtggaacaatctttgaagttctaatatatattcatttggagtctcagaaaagaggaagaaagaatgaaacagaaaaactatttagagaaataatgactaaatatttcctaaacttggtaaaaaaataaacccacaaaccatacatttaccagtttaagaaacccacagaagcttaaggtagataaataaaggtttctaacattttaataatatgtaggaagtaagttgcagaaactattcagggggcaattttgagactgaatttgtggtatgtttgtagaaaactgtagctaaggagatatgaaaaaatgggaaaataacaaaaattaattagaaatacattctgttccttttaatcttattattagaatgttaaataggaatattaaaggaataaatttatccattaaataacaaaacagacatatgattattcagttactatgccgctaaataaatcctatgatttcatcttcctcccttatctccctccttccttgtcttcttctctccctccttccctctctcctgtccttcttttcttttatcgtagagaaagatgaaggataaaatctttcttactgatactattatcattaggatacaatcatcattaggaagacatagtgttttactgtttgggtcaagagtcattgtaataaccaatagttttatatttacagtgttatatattcaactaattcaccaacaatttctatatagtgttgtggtgggccttccaagataattttagaacaattcttatttaaaggacatggaattaaagcagaaaattattttataaaaataggtgaaaaagaaaaacaacaacaaagacaacttttctttcttatcctttcagaatatttcagtagaatgggaagctacacttgaaatgcaagatggaatattttcccctaagctctccataatagaatgttggttataccatccttaactaaactaacactgtatcttttctgtagtactgataagaaaattgaaaatgaacaactcgttaatatactacctgaaaaatgtgagattagagagtccagcagaattttgaaggccaagtaagggggtgttcgatgatgagagataagcaactctttgaatagaaggattgtaagagatttaccctctgctattagcccccctctagttcccagggtttaaaatcaattacaatttcattggtacttaaaatttctcttattgtcacatagattgaatttcaaagagaacaggacagccttacacatagaactagtcagtggggagcagaaagtgtacaacctaaattgtttacttcatccacaagagactgtactatgactgggattccataatgtgatatctgaataaaagccttactttacttactgatttatttttcaaagttcagttcttaacaaattttgaaaacagaaattcaggcctggtcactatttattcttgagttaatttttcaagtagtttcaggatagccttagttaacttggcaaaatgccctgaaaagtgaattagcatgtttaaaacttggctaatcactccctcatccccaaccatagcaaagcctgcttaattttgagccggcgttttagcatacagtggtctaactccatcctgcacacatatcttgaattggctgatttggaagcaggcagacttccttctggatctcattcaatttagaaacaacagcagattagcgattaaatcggccaaacaacttctggctcataccaattaatttcttcaaggatttttcccttaaataaagtgtcttacacagttacagggaatgtctcaaacagcctgactatatataccactattgttgaatgttttcatttttaatgttaaaagctctgtcacagaaaacagcctggaaactctgtggggcaatgcaacccatcattctaccatactgatacaagtaaaacaacaatatcaatgttctaatacattaggaccctttataaagagttctcaccgtctaaaagcatcagcaatcataacggagctgtgggtatttctaagccaatcaacaaacagccataaatatacttggaatatacagagacattatcctacttcacttttaattcaacatgaagtcttttttaaatttaatttaattttattattattatactttaagttttagggtacatgtgcacaatgtacaggttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccatgtgttctcattgttcaattcccacctatgagtgagaacatggggtgtttggttttttgtccttgcgatagtttactgagaatgatgatttccaatttcatccatgtccctacaaaggacatgaactcaccattttttatggctacatagtattccatggtgtatatgtgccacatttttttaatccagtctatcattgttggacatttgggttggttccaagtctttgctattgtgaatagagccgcaataaacatacgtgtgcatgtgtctttatagcagcatgatttatagtcctttgggtatatacccagtaatgggatggctgggtcaaatggtatttctagttctaggtccctgaggaatcgccacactgacttccacagtggttgaactagtttacagtcccaccaacagtgtaaaagtgttcctatttgtccacatcctctccagcacctgttgtttactgactttttaatgattgccattctaactggtgtgagatggtatctcattgtggttttgatttgcatttctctgatgcattcttatacaccaataacagacaaacagagagccaaatcatgagtgaactcccattcacaattgcttcaaagagaaaaaaatacctaggaatccaacttacaagggacgtgaaggacctcttcaaggagaactacaaaccactgctcaatgaaataaaagaggatacaaagagatggaagaacattccatgctcatgggtaggaagaattagtatcatgaaaatggccatactgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcatgctacctgacttcaaactatagtacaaggctacagtaaccaaaacagcatggtactggtaccaaaacagagatatagatcaatggaacagaacagaaccctcagaaataacgccacatatctacaactatctgatctttgacaaacctgagaaaaacaagcaatggggaaaggattccctatttaataaatggtgctgggaaaactggctagccatatgtagaaagctgaaactggatctcttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtaaacaggcgacctacaaaatgggagaaaattttcgcaacctacttatctgacaaagggctaatatccagaatctacaatgaactccaacaaatttacaagaaaaaaacaaacaaccccatcaaaaagtgggtgaaggacatgaacagacacttttcaacatgaagtttaaactatatgtagttgaggtgcttttccaaatggaaagaaaacaatctactacccaaatcaacacatagtttcctgtgaacaatatcagaaactaataggatgatcctctgtcttagtccatttgtgctgctataaaaaatggtacagactgggtaatttctaaacaacagaatgtttttgtctcagttctggaggctgtgaagtccaagatcaaagtgctggcaggtttggtattgggagtttggtttctgctttctagatagcgccttgttgctgcatcctccagagaaatgaatgctctgtcctcactttgtggaagggtcagaagggcaagaaagtgttcccttcaccctcaaaccctttcataagggtgctaatctcattcatgagtttggagccctcatgacttaattaccttccaaagaccacatctcttactactgatgctctggggattaagttttgacatcagttttacaggggatgtggtcattcaaaccacagcaccctcttttagaaacaagattgagagacaactttctggtattcacttatttttggttcatagagttcaatcattaaggaaaaatggcaagttgaaaagttgtgtagtaaaaaataaagaaaacttcaggccaatatccttgatgaacactgatgctaaattcttcaacaaaatactggcaaaccaaattcagaagtgcatcaagaagttaattcaccatgaccaagtaggctttatccctggggtgcaaggttgtttcaacatatgtaaatcaataaatgtgattcatcacataaacagaactaaagataaaaaccacatgattatctcaatagatgcagaaaaggtctttgataaaattctacttccctttatgtttaaaactctcaataaactaggtattgaaggaacacagctcaaaataataagatccatatatgacaaacccacagccaatatcatactgaaagggcaaaagctgacagcattccccttgaaaaccagcacaagtcaaggatgccccctctcaccactcctattcaacatggtactggaatacccggccagagcaattaggcaagagaaagaaatactgggcacccagatgggaagagaggaagtgaaactatcactgtttgcagatgacatgattctatatctagaaaacctcatagtcttgccccaaaagttccttcagctgataaacctcttctgcaaagttttggaatacaaaattaatgcacaaaaatcacaagcattcctacacaccaacaacagccaagccaagagccatatcaggaaggcaatcccattcacaattgtcacaaaaagaataaaatacctaggaatagctaaccatggacgtgaaagatcgctacaatgaggattataaaacactgctcaaataaatcagagatgacacaaacaaacgggaaaacattccatgctcgtggacaggaggaatcaatgttattaaaatgaccaagtgcccaaaacaacgtacagattctttttttttttttgtatttttagtagagatgcggtttcaccatgttagccaggatggtctcgatctgctgacctcgtgatccacctgcctaggcctcccaaagtgctgggattacaggtgtgagccactgcgcccagccacaatgtacagattcaatgctattcctattaaattatcaatgatattcttcacagaactagagaaaactatttcaaagttcatatggaactgaaaaagagcccaattagccaaggcaatcctaagcaaaaagaacaaagctggaagcatcaagttacctgactctaaactatactacaggggctacagtaaccaaaacagcatggtactggtacaaaaacagacacacagaccaataaaatggaatataagcccagaaataaggctgcacacctacaaccaactaatcatcaacaaagctgacaaaaacaagcaatggggaaaagactccctgttcgataaatgatgctgagataaatggctagccatatgcagaagattaaaattggaccccttccttaccatatacaaaaatcaacttaagatggattgaagacttaaatgtaaaactctataaaaacgctggatgacaacctagacaacaccattctagatacaggaatgggcaaagatttcatgacgaagcttccaaaagcaattgcaacaaaagcaagaactgacaaatgggaactaattaaacttaagagcttctgcacagaaaaagagaatgtcaacagagtaaacagaaaacctacagaatgggagaaaatatttgcaaactatgtatcgaacaaagatctaatatcctgaatcaataaggaacttaaacaaattacaagaaagaagtaacaaccccttaataagtgggcaaaatacatgaacaaacacttcacaaaagaagacacacatgtggccaacaagtatatgaaaacaaagctcaatatttctgatcattagataaatgcaaatcaaaaccacattgagaaaccatctcacatcagtcagaatgactactattaaaaagttaaaaaaaaaatagcagacactggccaagttgcagagaaaagagaacacttatacactgttggtgtgagtgtcaattagtttaaccattgtggaaagcaatgtggaaattcttcaaagggcttaaaaaagaactaccattcaacccagcaatcccattactgggtttatacccaaaagaatataaattattctacctaccataaagatacgtgtccacataaggtatgttcattacaacactatttacaatagcaaagtcattaaatcaacctaaatgcccatcaatggcagattagataaagaaaatatggtacatatacaccatggaatactatgtagccataacaaagaatgagatcatgtcctgtgcaggaacatggatggagctggaggccgttatctttagaaaactaaacactgcatgttctcactcataagtgggagctaaagaatgagaacacaggaacacaaagaagggaacagacacactgggacctactgagagtgaggggtgggagaaaacagataatcagaaaaaataactattgggtactaggactagtacctgtgtgacaaaataatctgtaaaaggggcccccatgacatgagtttacctatatgacaaacctgcacatgtactaaaataaaagttttaaaaacattaacatgaaaaaagtaacactgtacagtaaagcttaggtgtcatacaaatgggaaaaattaacttttcttttaagatttccttaagacaactaatggtttatctttaccttcccttcagcccttggcagctgaccgacacagctacctattccttccacacttccccttctcttaattcagaggtataaatgcttttatgtgccagaaattatattttatgttatgagttctccagacataagcaagaattgccaaacttgccagatggccctatacttatatttcaaagtttaaaaaagcagaatttaatgcagatacaggaatattatcaaagtaccatattatttgagcattttggaaaatatttttattttattttcaatagtttgtattaccactaatgttgttaatcacttcagagagtatattaatgctaaattcagaaataggaattttttttatagccaaagtttagatttataaaaaatatgagattctgctttagaagagattcttcatgaatagatttatatttcagttttcctggtgggaaatcttgttctttcaaagcctttcagaagatatcccattaaaagtgtacatttttcaaaagttttagtgtagtttaaaattattttggacataggaagagcacaatatatacttccatggaatagctacctcatattcatatactctctcgattttatttagtgtgctggcattagatttaaaaattaaagcacatatcactccttttcctgaaagttaccacttcttgacactgtacaattcttggacataattactttgagtctctagagtaagatcagtaagcaactaatgaaaaattcctggtagaggcagacagaatgagaaaatgactatataactgagatcaaattatatccacagggagtaggatgctttctatattctacaaaagtctacagcaaaaatgcactaacgtggatgaattgtgtgaagagtcattttgaattggtgaaaagactgaattacagattattgggaaagaaatgcatttttttcaggtacatccaatgggaagaattgctaacaaacattcatttaaaacagcatattcattgttgattttcatgtgagttttgatagcgtacttgaaagctgttaattatcttaagtaggttaaacaatttcttgaaatgtgtttatattaataattcacttagtaaagtagggctttttgtctgatagcataaaggtatattatagcctagaaagagtaaagagcctgcattttaaagtagttatttctaaaattcacaagtttgtagctctttattaccaatcttgggaaaacttctagacctttctttcagaggtcaactactctcatttaatagtcataagtacattatttttaataaaataacatatcctgatggagtaatgttttctagtttggatgacagatttctatagtggatgataaacctaaagtttttattccagtcatatattcacagattctaattataaatctgaggaactctaagaacataaaatctttttttaagcgtgatattctccaaacaagttaagcttttcttagggaaatcagaatattatgaggctttctagctctgtgatccaagtaacaatcttctccacaatgtgtaacaggctatcatactcagctgtcaaatgccttccagaaagcaagatatgccttgctggcagcagctcttcactctattgagggatgtagaatggtttggaatttgggctttcatttcctgttgtctgggttcaaatctcagctgagccacttgttttatcatcagttaaagcacaggtatcaggaagacctacttcacagattgctctgagggttaaatgaggtaactgaagtaaagcccactgcaaggtattaatatttagtaagagttgggtgaaaattgttatccattgcctggaaacatattaaaagaggacagtatgttcatctggtatgagttattctcattgaattttcattctccctatccctattcacatacattgctttagacaaatcttgcttccagaggaacactgctacttttccttatttagatttttttaaccaatgagtttagatatattctagatgaccaaattgaactttaatattcagaaattttcagaattcacattttcaccctttgataaaaatgaatttaacgtgattaggcactacacctgactatgcttgctcatatagagaaggggcttcaattcccacttagtaattttttttttttttttgagacagagtctcactctgtcacccaggctgcagtgcattggcatgatcgcagctcactgcaacctccacctcacaggttcaagcaattctcctgcctcagtctcttgggtagctgggattacaggcacccaccaccatgcccagttaatttttgtatttttttgtagagatggggtttcaccatgctggccaggctagtctcgaactcctgacctcaagtgatccacccacctcagcctctcaaagtgttgggattacaggcatgagccactacacccagcagtgattctgttttgctcaagaagaataatcaaactgatgattcttcttggtgaaatattaatagttctacctactttgtgttacctataaacattttacagttttacatttacttctctatggaatggtctaatcattaccattttcttcagagtgttctaaaaagtcaatatttactgatgatatcagtaatccataatgtattcttttctttccaactccaaatgtttacaaattggcattctctttacattttgtcttagaaggagcatttctttccaaggcgaaatacttgagagaaaatgcccttagtaggaagatgtgcttccagatgcctatgataattgattagatttttttgatatattgggttaatttttattttattttattttattttattttattttatttgttatggagttttgctcttgttgcccagggtggagtgcaatggtgcgatctcagctcactgcaaaaatacttccacactttcctcttttaatagactctactagcaacctgtcacatttaatcactactgaactagccatgttgttttaatctgcattctatacatatttagcataataaatgaaaacttcaaaaatcctccctgttgatgactggtagtgtaactcttgctgtatgcacacttatgctctgccttggattgttgacattctatgctcatgacactggaatcactcagaaacatccttggagctctccatctccacctgcatcccttctactgcctcatctcacttcaccccaaccatggtatttataccttgtgacactcaataaataactaaggaatagataaatatttagatcattatcctgggaattcttctttggtgcaagagtatgaggctaggtatcctctagggaacttccagggagaaatatgcaggcatacatacagaaaatatattagcatcacaaaggcaggggaaataacccacatacagatctagaatactttcagatggccctcataagttttctcttggtcctctgcagaactgcatacattacaatgcttgagtaaggactgtatgaatggaaacttcacctgcagttgtgatgaggacactctaaggtccttggcaggtatatctagggttttccttgctattaagtgtaaatcagtcattgcctggtaccctggacagtaataagaattataagccaattgaaggttgcttaccacaggggaatctgaagcccattcgagtactcagttactgcctagatagctgattttatatgaaattgacacgactgaagagacacagaaggcaatgttcacatcaacagtttgctgggcatgcagccaggcaaccatacacatctacataggcaatgcagctgatgaagggaaggcccaaagctggggagaacaaggcaatttgcagggatctatgcagacctcaggatcaggtttctccccattccctgaaggtcttctcttcttcattattctctggctgtctctatcttaaatactttcttctttccatttcttttttttttttttgagatagagtcccgctctgtcacccaggctggagtgcagtggcgtgatcttggctcactgcaacctccgcctcctgggttcaagctattctcctgcctcagcctcctgagtagctgggattacaggctcaagccaccacacccagttaatttttgtatttttagtagagatggggtttcaccatgttggtcaggctggttcgagctcctgacctcatgatccacaaacctcggcctcccagagtgctgggattacaggcatgagccaccgtgcatggcctatcttaaatactttcaaagacataatcaacagactagaaaaactagtttaattaaggcattggtagggaaaatatatgcatgtaaataaatacatggagtcataacccaagttggatttgttgtagaaaagctaaaagtcaagtaatataacatacatgggcagaatagaaggaggaagagttggacctgtgatctttgccaataaacggaaggtccatggtaaggatcagcccacgatggcaatgtggcttgatgccaatgatgaaaggttgaggaaagaaggtggcatgcctgcaaaagcaataatttatcctaagttcactgaatacaggtgagtaagtattgtattatttctactacaactgactgccacaggtcactgggaaagaggtaaaacgttcaacaatcttgcccacagattagcaaaatcttaatctgctctctgccaactcagaatcaaatcccaagcattaaaaacaatgattctctctggacaggataacaagtagaggtggtagaatgtagtaggcaagtgcggaggttttgtgagcacacagaccaggaccagaatgctgcctctgctctttccagcatgggacctaggacaacttcctaatccctccaagccttccttttctcaacaggatagagaataataattcataccttacataaatcattgtaagattaaagtagataacacaaaaagccctcaaaatgttaaataacaaccattgaaggtttttaatttgtattgtcattatcatgattatcaattctacttttccttgggcaaataaccttgtactcataaactgattctaacagttgtgtctgttttataggatgaacacatacatcattgcatggaaaaagcagaacttagcctggctgtgcatttcatgggtgcagtttataggcatcacctgcaactagaatagcaatattaattgtaatgctaacatatggaaagataaagataaaggtgtaagataaagctcactaaaacaaagggatcttgatgtggaaatgttagtatttagacaaagtataaggacgcaaatgagcaaaaagaatttttgtgtttacgaccatgatacaaacagttaagaaatccaggtgaaagtgggttttccatcccacagaatttgaaccgccctcattgtcacaactgtaggcatcggtgatggtgttatctttcttcgtaggctctctggtctctagccagtggggagaaggagatttcgattttataaactccaggacacatacattaatgagtaaaaaatgcttcataagctgatcaacagtattttttgtcatccttcaagtaataaaatacttaaaactcatattaggttctgacgagcccaaaaatgctaagaggagggaaagacatgatttgatacaaagtatagatctgatttctgtgtatgggaattcatatgaatttgtttttattgcactgattttgataacctgccataaaacttttgttaatgctaagaagaaagacatagctaatgctataaattcacttagatatctctgccttccatattttggtatcaaattaaatttatcacttcattatcccttcctggcagttggaagttgtagactttaatggaaggtgccagggttgctaatagaatcttctcgtcacagatgaaggaaatgtaaaagcgaaactcacaaagatttgataggatttatgctaaatgacaacgacacccaaaagcacaaactaagaatgaagcctgtgccctatcgggagaaggaattaattatccaacagatttgtaactctttctctactataaataaaaatgtagcaattttcacaaatgatcatttagccagagccagccattgcctatagaatggaattaatgaggacatttacataaaccttacagtgttttcatccctcaagactcagttcatctgttgcctcccaactgctcctgatgccctaggttgagatggacacttgtttccttctaattccataactccgatagcataatagcagttatgttgaggagtggtaattgaatggttacgggcacaatgtttgtaataaacagaattgggtttgcgtccggcttccactaataaatatctaaacctctttaacctcagttttcacctttgtaaaatgagtatatatacacatatgtacgtatatatgtacacatgtatacatatatatgtgtatatatgtgtacatatatacacatatacgtacatatatgcgcacacatatatgtacatatatgcacacatatgtacatatatatgcacacatatatgtacacatatgtacatatatatgcacacatatatacacatatatgtgtatatatgcacacatatatgtacatatatacatatatgtgtgtatatacgtacatatatgtgtgtatatacgtacgtacatatatgtgtgtatatacgtacatatatatgtaaaatgagtatatatatacacacataatgtgtatatatatacacgcatatataaaatacacacacaaaaggtatatacaattatgtgaagtatttagagtttattactattttttttttaacaattgatcatcaatgataaagagtttatcttattaatcactcaatctcaattaactactgcagtgcctggcatggaatactcaatatatgttaaatgcatagatgtttatttaaatgattaaaatccaaacactaaagtttctgaggcagggatatgtaaaataaattctaattagtaccaaaaatcaaaatctgtcagaattatgtgagttcagaaaagatgtgcgatacttgtttccagtcacaattttctaggagaggcatcctagataataggaagtacaaaggcagaaatcctgaatgcaaaaatagcagaatgaaagtacagttttgactcttttccaatttgcaatactaatgccctacaaaatgcacaaagtgtacccagagtgaatggaaattcaacctcaagtgttttgttttcagttctataaatgttataattttattatccattaataataatgctattacaagacaaaatgtcaatgcatatattaaaacactagaaatgtatttgatttaaagtttccagacaaatttcccactgggtttgtttgtataagggtaggtaggacgttagggcaaaagagtccagccctgcatgtaatatcctatcggcaatcaatttaaggttctgttctggaagctttggcctcaggcaaggccagcttttgttaacggaggctgcaggcactggctgatcctacaaagcaaagcacatggaaggcctaccaaaagacctaatcaaattttccatctttaagaagcagcttctcctttgagttgtgacaccacatccactacctactccactcctcaaggagcagatgtgccccttctctgtttctaagtcctagccagcctccctgatgtgaaaggccggaagtcttccaactccacacccagctgctggcaagttggcagagtgaaatgcatttgtttatgcccctagccattcattttctttaagctggtttccagccaagatttttatctaggtaccagctattcttttccagtggttaacttcataaggtttttagttcccaaaggctacctgattaaaagtaatttgggcataaaaaatgtctttagtatttcttatatgatatatcttattttgtcatagaaatattaccaaatgcttatcctatagtttctttcagagtgagtttgcatttcttaaaaaaattaacaatgtatttataatatgtaggatttataatatacacacattttaagtatacagttacactttagacaaatatacacattcacaaaactaccaccccagttgagatataggataaaaatattactggagaaaatttctgtcttgatttcaaataatatggatttgttactcccattttaaactccacataaatgaaatcatttggtaactgctcttttgtgtctggtttcttttccttatatgtttgtgagattcaattacctcaaaaccttatggatatgtgctttcatttctcctggaaagatacctagaagtagaattgttgggtcttacaagaaattgctggagagttttccaaagtagttgtaccattttatatactcattagcaatgtatgaattttcaagctgctcaatatctttgccaacatttatgttttcagtattttgaacattagctattctagggggtgtgaagtaatatctcattgtagtgttctactgtactttctaatctcacctaagcatttttctctcttttacctaggttgtcagttcttgttcagtgctttcctttatgtaagagaatactattcccaatcaaaggacagactaccaaaattatggtgatgtgcaaggtcacctgtgtgatgacatataagttgattatgacaacagatgcatctgccaaaacatttccttgatctcctcctgtaagcttcctttgggtttctcaggaggggcagaatgattcactatcaacatagtatcacagatagacttatcagaatcttggtgaattcattcaacagaagtcttctccattttggtgccaaagcgataaaggaagaataagggcaagggagtgggtctagagaatgtctgtttctcaactataccttatttcccttattcaactgccacgttctataagccttagctcctacctaaaccacctaatgcatacctcttagtccaaaaaatcatccttgaagctcattagaatcaagtgcatctcttattaattgattcaaaagtgggaaaaaccatttcatataatttaggctacataaaatttttaaatacagtgcaaatcaattgaactgtcctttcgtgttgcatctttcaacagctgaatattctatatggcatttcacagaaataagatttgatttgagaacatctgcagcagtctggaacacattttcccctgtacttgacttttagctcattatagctctcagatgttctctcggcaatcctgtgacatattggagtgttactgaacaaacatcagtgaagcctatgtcttgagtagtgtcaatctcagttgaaaatgtttcagctttcttagcatcaacactagaagaatttaattaacccactgaaactttcaaagtggtagttaatgcatggaagaaatgagaaatcagaaaagtggggggagagtggataagtgcttaacctcccacaagctgatgcctgccatcatcagcctctgcttaggcaggccatgagaagccttgctgctctgtgtagcctcctgcattctgccatgaaatctctggcttgctctattgcccctatggagatggagaaggtgtggaggtggcaactactgctgtcatgctcccctggtccccacacaaggtcagcttccaggctctaatcagctctcatccagatgctctcatgtttttagtaggtggggctgggagaccaaggtcagaaaagagctgtcgggagtgacacggttttttgcccactgctgctattacattaaggaagcagctggtgagataatgtatgccaaagtgctttctaaattataaagtgcttatataattgtcagggataatcactactgttgttttattctgaggttgcagaaaaagcactgaactgggatgttgggtatcaaagtccaccagaaagctgaatataggaatgtgtagggtccacagggaggtctttggtgagagtacagatttggaagataacaataaagagaggaatattggcttcaggggtcaaatgaccatacaacaatatgagagccagagatggaacaagggaataccagtattcaagggacaaaaaaatgtgtgtgtgtgtgtgtgtgtgtgtgtgtagggggggtgtcctaaaagattaactctaagaagtttctcttcacacacagaaatattgtttatctccaggcctttgccacgctttatgccttatcctagagtatttttcccactcctactagactttgtttcaggttatctaggaaaacattctgaaactcatcccctgttgtctgtgtatatctctataattgcaattatcacactatattattaataactgtttaagcgttctatttccacacagtctgtgatccttttaagggcacaattatattactgttaatgtttgcatctataatgaccagcaaatactaggtacgaacggttgtttccttgaaagaaataatagagaaatatgagaaaaatgtgtttaaaagtcaaagaatacatttcaagtatgaaggagtagtcagttgttgaatgtcacacagattttgcaaaataaagactgggaagtatctactggattgagtgatcagtagtaaataactcaactttagtgagagcatgtttagtgattttggaggttgccagtgggtagaaatctaaccttgagtagctgaagacagaaaagcaagtaagaaacgaagggcagtgagtacggatgacattttctagaacctgaactgtgaagggataaagaaattcagaccattctttctttctttttttttttttttgacattcctataagatatatatatcctaactttttggatcaggaaataggggctaagagaaagtatgtatattgtccaaggcttactgcttacaagacagaaaccatgagtaaggtgcacactcttcttggttccacagttggaggaggccaattgctggatatcctcctaacttatttaaagtcaggctgtcttagtctgttcaggctgctataataaaataccataaacttggtggcttataaacaacatacatttatttctcaccattctggacgctgggaagttcaagattgagacgctgggagatttggtatctgggggcggcctgcttccatacagatggcaacttctcactgtatcttcacatggtggaaggggcaagggatctctctggggtcccttttataaggacgctaattttattgccttccaaaggccccacctcctaatagcatcaccttggcagttaagattttaacatatgaattttgaagggacacaaacattcagaccatagcataggcacaatggggaaataaacatcttagctgtatgttatggaaagaaaggctatgtggtagcctggagcactctgacaggagaggtcagactactagtggagtgatataatgggaaactgcactacagcactagctacttgcagatgggaaggagtgcagaaaaggaagtgaagaacacaaaaaatgagtgtattagtccattctcagactgctataaagacataacagagactgggtaatttacaaaagaggtttagttgactcacaattctgcactgctgaggagggctcaggaaacttacaatcgtggcaaaaggcgagagggaagcaaaggcataccttacatggtggcaggcaagagatgagtgaagagggaagagccccttatgaaactatcagatctcgtgagaactcactcattctcatgaggacagcacagaggaaactgcccccatgatccagtcacctctcaccaggttccacccttgacacatagggattttggggattacaattcaagatgagatttgggtgggggcacaaaatctaaccatataaatgaacttttccatttcataatttttcacagggctaaagagccagctacccctttggaaacagttacaagttatctggaattctatattaatcctcataggctggttgtactgtggtaataatagacccttaaatcttagtggcttaacaaaataaaagttcctttcttactcagaaaaagtctgctgtgtctctagctgtgctaatacgtggtatctgaccatctaggccatccattttatgttgccactatctcagcatgagacttcagtgttcatcgtggcagagaaagggagtagggagaattgagtgctagtgcttaaacgcttccagccaaaagagtcatacaccacactttgctcacatttcattgactaaagtaagtcgctcactcatatggaacatccaaggggcagggaggtttgcctcttataaaaccagaggggacaaagaatagaaaatattagcgagcactagcaatatctaccacaaatgccaaaagcacgcaaagtcagatggcattccagccttactctgtatctcaataaagattatatacagtagcacaggaataattttattttcctaggaggactggattaccacaaatgctatgtgtttgcttttgtttgtttcacttgggacctacattaagtggaaataaagacttggtaacatttagggtttgaaaggtgcccagattgatagcctgatgatgggtgggtgacattcttcagctcagctgggctgggctgagcaaatgaagagactaacagccagcacaggacctagaaaaggctctatagtttgagatgaaatggtataaaattgataagtagggaagacaaacgaaatgctttaaagatgtatggcaacaaatcttcaaaaggcatggtcttgacagtgaaacaatccacagcagactggccagcatggtgtaaggggctgggagtgaaggcttcagggcacttccagtctataaggcacttcataaacagtgcctgaagctgcaaatcaaaggcttctcagtgcagcattagtcacattttctgtgcgcattgtagtcacatcttctcagacacatttcgaggggtcacctgtgactatgaagcacagaactattatagggcatggatttgagctaccaataacattgctttttaagattatacagcataaaatagagtggatatttgataattaggtggttaactagatcaatatgggtaaccaaacagagtaaccaggtttctaagaagaaaaggaaaggagatggatatttcatctgaatgtctaaactgatttggttaagtgtgagactgccaattattcagggcaactgaagatatcctcacctatccttcctaagctcccagggttttggtaacgctgttcaatatccatatcatcttgaagctaaaaataaatttaattatggtttgttttgtttgacttttttttttggtaaattaaatcccccttttattattccaaacagcagacatttcaattttttcccctgaaatcttagatgaggacaaattggcataaagctcaatataattataatttctgttgactctttacattatcaaaatgactcctttgtctcctataattaccagaaaattgtatcttcaaactaatattccctttattcaagtgagcagatgggcttaacgggagatataacaaatacatgtttttctcaggaagagtatcaggggcatagctcaaaattgcagagaggtattttctttactccataaaatgaggattgggaacaaagctaactggtttgctataaatgtccactgattgtgtagagatcatagaaggaaaggtagggcatgaattcaaggctagaatttgaattcaagttttaacttacatggatatagtaatgatttcattttaaatcctcaatctccacccagaacaagaacaatcctcattttttttcatggtttaaaagcaacatcagaattaatctggacaacttgtgttgaatatgaaaagcattattatacaagttttaagtatataattaaataaggtgcattctgattagttatatttgatgaagtatgaggaattatacttaaccactcccatgaatgtgacaaaagaagtaactgcatttgtgtttggcaatttgatgtagtaaggagaaatggggaatcataatctgtataagcacgatggacaagagaaaggaacttatgggagaatgacaacacaatgaaaatgtagtatagtttacattttatttcaggcatgcaatggtggattgtgataaggcagttgtagcagctacagattcaaaaagcacattgctgcccaaattcctagaattggtgacctgttggtactccacactcagacatggaagtggaaatccatgttctgtactatctcatcctatatctcaatgtccatgcaggcactgacaattgatcacacacctctgctgggctaggctttgaatcacgagcttcctctatacagggctcccagcaggtactaccaaatgattagagttgccttgtaaaatgaaccaacttacctctgggatgagagaaaccaagttggggaggcttacaggacttcacaaactactctggttacaagcaatgcaaaactacctcttcccataacttgagggactcttatcagcccctcccctaatggttcacgttaaattcagatgttaacttttggcaacagcagtagacacctcccttctgcctattttaggaagaatgatggactactcatgacaatttactgcccaaacttgaagttaattaatttatctccattttacctggaaagtgaacacttctcaattatttagaagctttttgggataggaggtgcttcaaaagacaaagatgctagcttttgaccagatcaaacaaaactaagctagtaaaatcatggtgtcaataggttaaggtaacttctaaaaacaatttgtaagtaccatctgaaaaatctgcacaaagcagagaaggaatcaactcataaagtattgctcaaatgtttctatctaccccaatattacccatatattttggaaatggatatatcacatattcagtattatcccaaattgcctatctatctatgcctctccatgttacgaatagttataataacaaccaccatgtattgattgcttacaactacatgctatacactttagatagaggatttctcttttttatcacagaagacttctgtgtacatatatgatttctaatctttacaaagtactgcaaaatagctatcatcatctcagtttgcctttacataaatggaggattgtgggatccatgtagctgttccaagctcacccagtagtaaggcatcatgcctggatttaaactcagaccttctgggtttcaagcactctctcttctgtggtaagcttttgactacagcacattgacttatttgtgggatcatcacacactgatgagatgatcagaagctcagaacaagatggggctaacaaattttatccaacattttttgcttctaaggaggaataatcacaatttataaaacaggtgtctgtcttatttttacaggatacttgacactccagcattctacttaagatatcactcaaaccatctgacgatattcagatgtagattaagtcttcataacatttatgcagtacattctgatctgataattttgaacctttgaactttcagggactggtgttttgttttttattttccttcctcatgccctatgaaatgaactaaaacaataaaaaatatttagcctcatgtgatctgactacaatcatagaaagtgacctcaataatatattttatatcaatcattacccaagtgactgatagaaatgcaaatatcatctggaacttttctaacaacataatgtaactgtctggcagtcccagggagaataactgtggggacaaagctgtaatgggagaagataacatggacaagaagtacagggccatacaatgaacttgaagaaaaatggctttcattcccttcccttctcctcttttctgggttagctccaagaatggtcattacagtataaaaaagtcccccaaaaatgttatcatagatggacaggagtaagctgcaagagcctaccagcaggtccttattatagattttccattttaagattctatatactcatcaataaaattaaattttctaattattacagtttacattttgaaaatattatatacatttattctgggcacaagttcttcatgagatacaagtataggaatattttctcccaatctgtgacttgagtttttattttcttaattgtatcttttgatgagtatgttaattgcgatgaagcataattcatctattttttcttgtatggttagtgtttttttggtatcctgtccaagacatttttcctttccccaaggttataaagatatttacttaatgtttgcttttaaaaatgtacagtttgaaggcaaggagtatatgccttctgttcaattttgctgtgaatctaaaactctaaaaagaaagtcttatagtcttaccttactgtttacttttttatatcacatatttaaaattacttttttgtcctgtgtgaggtagacatgaggtttattttttaatataggtatccaataattccagtactatttgttgaaagggctttcttttctccattggattgcttttgcacccctgtcaaaaatcaattgagtgtatatgtgtgggtctatttctggactttctatccattacattgatctatttgtctaccctgacacccaaacacacttgcttgattactgcagatttatagaaaatcttgaaggcagatagtacaaattctcccacttcccactttgttctcctttttcaagattgttttggctattctagtttgtctgaattccagtgtaaattttagcatagcttgccaacttctaaaaaacacatgttgggagtttgattgggattatgatgtatatacagatcaatccagggagaaataacatcttaatatatcttaccattattttaagtcttctttaatttttcttcagcagttcttcttaacttttattttagatgcaagggtacatatgcaggtttgtaataaaggtaaactcgtgtcatgggggttcattatacaggttattttgtcactcaggtattaagcatagtgcccagtagttatttttttcctgatcctctccctccttgcaccttccatcctcaagtaggccccagtgtttgttgttccctattttgtgtccttgtattctcattatttagctcccacttatgagtgacaaaatggagtgtttagttttctgttcctgcattagtttgctaaaaataatggcctccagctccatccatgtttccataaaagacacatctcgttcctttttatggttgcatagtattccatagtgtatatgtaccacattttctttatccaatctgtcactgatggccatttaggttgatttaatgtctttgctattgtgaatagtgctgcaataaacatatgtgttcatgtgtcttcatggtagaatgatttatgttcctttgggtatatatttggcaatgggattgctgggtagaatagcagttcttttttttgctctttgaggaatcaacacactgctttccacaatggttgaactaatttgcacttccattgacagtgtacaagcattctgttttctctgcaacctcaccagcatctattattttttgagtttttattaataaccattctgattggtgagagatggtattttagtgtgcttttatttgcatttctctaatgatcagtgacactgagctttttttcatacgcttgttggctgcatgtatccacgtcgctgtgaaagcaattctttcagtgcagatactacatatattttaatttgttcctaagtattttatagtttttacatgccattgtaaatgacattttaaaattttaatttccagttcattgttccaattgttcatgtagaaacagaactattattgtacattgtttttgtattatgaaactttgttaaattcacttattattttaatagtgtatttataggttctttaggattttctatgcacacaatcttaccatctgcaaataaagacagtgcaagcccatttttttccaatgtaaatatcatttatttatttttatgaccttattgcgctggttaggacttccagtacaatattgaatagaagtagaaagaatggacattcttgcccagctcttgatcttaagagaaaataatttatcctttcaacattaagtatgatactaggtataggatttttgtagacgtttccttctattaatgaattgctgaaggccattattatgattggatgttggattttgtcaaatgcttttgctgatctaaggacttataactagaatgattaagaactccaagaaatcaattaaaaaattaaaaaatggacaaaatatttgaatagacagttcacagagtaagatacatggaaggccaataagaacataaagaagagttaacatcttcttattagggagaagaaaattaaaatcacaatgagatatcaacacatatgtactagaatagctgaaactaaaaagactgagaatatcaaaaggtggctggaacatagaagaaccaaacacccacccacagctggtaggactgtgaaagagtaaagccactttggaactctgtttggaagtttcttgtaaaacttatgcatccaccttatgactgagaaattatacttctatgtactagccaagagaaatgaaaacatgttcacaaaaggagttatgcaagtatgtttatagcaaaaatatttataacaccaaaaaagtgaaaacagcctaaatacaacttagagtaaataaattgtggtattttaataaaatatagtattatttaccaacaaaaatgaactaatacctacaataatatgaaaaaatctctgtaatattatagtgagtgaaagttgcaacacatacaaaaatacatattctgtagaattccatttatgtgaatgctaaaaaacatgaacaaactaatctatggtggcaggtgctagatggtgtttgcttctggtggtggtaaaggaagatgtaatggctggaaaagtgcacaaggcagcttctaaggtgttggcaatgttgcatgctttggcagaggtgaggatttcacggatatatgtgtttgtcacaacttgtcaaatggttcatttaagacctctgtatttttcctccaagtaatttatatttcaataagggaaaataagtggcatagaagatacaaaacttttaaagttgtaaataggaaattatagtatcctcttttgaaactgtcattatgcttttggtaagggtcttgctgttgacatttacacatttctttggacactgctttattctctgtgttgaataactttccagaaaggaaaaaaatagataattagacatctacatataatattaccacaaccaaatagcaatagttttatgaaattgtgttatttcagttttttttattagtataaaattaaggggtacaagtgcagttttgttacatggatatattgcatagtggtgaagtttgagcttttagtgtaaccatcacacgagtaatgtacattgtacccgttaagcaattcctcatcccatatcctgcttctacccaattcctcatcctacaccctgcttctaccctcccaccgttttgagactccaatgactattattccacactctatgtgcatgtgtacacattaattaacttccactcacaagtgggaacatgcagtatttgactttctttttctgagttgtttcacttaaaataatggcctccagagggcacagtggctcatgcttgtaagcccagaactctgggaggctgaggtgggtggatcacttgaggtgaggagttcgagaacagcctggacaacatggaggaacgctgtctctactaaaaatacaaaaattagctgggcgtggtggcagacgcctgtaatcccagctactggggaggctcagccatgagaatcgcttgaatctgagaggcagggttgcagtgagccgagaacgtgccactgcactccagcctgggtgacagagcaagactgtgtctcaaataaataaataaaaataaattaaaaaaataaaaaagaaaatggcttccagatccatcgatgttgctataaaatacatgatttcattctttttttatggctgaatagtattctacattttctttattatctgtcaaagtacatttagctttattccatatctttgctatcgtgaatagtgctgccataaacatatgaatgtatttttttgatgtaatgatgtcttttcctttggatataaacccaatagtaggattgctgaggtgaatggtagttttattttcagttctctgagaaatctctatactcttttccacagggtttgaactatttacattcccaccaaaaatgtataagcattcccttttttttcccacatcctcacctacatctgttattttttgactttttagtaagagccattctgactggtataagataatatctcattgtggttttaatttacatttctctgatgattagtgatgttgaacagttttttatatgcttgatggggtttgtcttcttttgaaaaatgtctgttcacgtcctttgcgtactttttaataggggttacttgtttgttgttgttgttgagttgtttgagttctttgtaaattctgggtgacagtccctgttggatacgtagtttgaatatattttctcctattctgtaggccttctgttatctcgattatttcatttgctgtgcagaagctttttattttaagtcccatttgtctatttttggttttgttgcatttgtttttgaggtctttgtcataattatttttgcctagactcatgtccagaagagttttccttagatttttttctagtacttttatagtttcagatcttacatttaagtctttgatgggttttgaggggatttttaaatatggttagaggtagaagtataattcaatttttatgcatatggcaatccaatcatcccagcactatttattgaaaaaggtgtccttgtcctagtgtatactttttgtcaactttgtcaaaggtcagttgactgtagatatgtggctttctttctgggttctttattctgttccattgatccatgtgtctatttttgtaccagtaccatgctgtttttattaccacagcctaattgtataatttgaggtcaggtaatgtgatgactccagctttgaactttttgtcaaatttgctttggctatttggactcttttttggttgcatatgaattttagaattgttttatcaataactgagaatgatgtatctggtcatatggatacaattttggtttctattatcaaaacaaatccttgttttcagagttgctgtacaaccaccatgacagaatttctgattttatcctaatgagagccttttaatgagcacagattatgttcatttattaatatcaccaatatgtatttcatcatttttgaaacctactgaaagtacagtaatttggcaggtttattgttttcttctaaaatgactgctgctgttcttaaaaggatctagctggaattttaattatacattgactttcttttttcctcctaaataaggacacaacagataattcgtgcaatttaattctataaacatgtagcattgtgctaggtgcttgcaaactccagtatgaataagatattatctttccttcaaaatgcttgtaatgacctgcagcactggacaagaagatatacaattaaagaaaatgcagtacttgcaatactagttgtaggaaccatgggctgtaataaaataaaaaggagtgatttgactttcttggaggccaaggaagagggtcatagacagactcacaaaagaagtgacatttaagatagattctaaaaatatattaatgattgatcagtatgttcaattcagctaccatgccattactcctacatggtagacattgcattaggcactggcacacagtctgtgttctaggccgtcaagaagcttataatctaggcatattttgccaagtcaagaaggcataaaggttgctcacctgtctatctcactccttctattctggctttttccatgttatttttaccaaactcaattcacacataaaaaggaactttaagttcaaaggttatttctttacatattcttttcttttctgatgtaatggaaaaagtaatggcttggtaagtcaagtgattactaattcttaatgttaccaataagcttttttctttcaacattcatttagtcatcagttcacttcttcagtcaacatttattaaggcattaccatgttcagtgcatgtctagagaacttagatacaaagatgggtaagaaaagtgaggttattttctagtaaaggaagcagacttacaaaaatacaactgcgatgtgatactggttacagccaaggttcaaaaaggaaggagacattaattctatagcaaaggtcagggaatagctcaaaaagtgatgcttgagaactggaaggccattccagatgtcgggaacagcatgtggaaatgcatgcagatcccaagtgatcattagtttttggcctctactgtttttctttcatgactggtatttaggagtcctgttctcatcccaagcaccaaaaagtgaagacattttctttcatgcttttccagttgcaaaatttgttgttcaaatatcggactgtccaatttctttcatgtttcttaacgaagaatgtcaacataactcttatttcccataattaaaagtgccaaatagtaatgttttcttttctgaaatcactaaaatatatacattgcctccaactctatagatgaatttctggatgaagttatatttgcaattatattttcattttggtaatcttcacaagcccatagttaaaacctttggagccagatgtatggatttagaaatatcttttggattttagaaatgtaaaatggtacatacacctaattttaataaacactccctctccagccccagcaaggtgtggggtagcaacctggaatcaaacacgttaatctgatgttctctgagaggaataaagattatagcaagtctcacatcagttcaggccaggttttctgctgaatgaattatgtaaaaccatttggtttcagtatgttttggatttcagaattgttaatgagggattatggaactgtattgtaattattttcattgtacagttttataaaaaggtttacagagattaagtaacttgcccaagttgtctagctaacaaggaagcttcacataaatccagcagtcttactatttgctaataactgctgtcctacatgcagtttcttcattgggtatttccaacctctggccatttggaacctaatgtgatgcttctctggcattcctctcctgcctcttttatttcacttctttttcagctcaaaattatttattgtttactttctccatcaagagaagcttgtgttctgctcattgctgacttctcaatctctcactgttctattgctattctcttttttgtcccttttggcaatgcagatttttggatccctccatgagaattatgatgttaaaatgcagattctcaacacacctcttacccactgactcaggatcaatgctagtggggcctgggaacctacatttctcacaagcatgctgcatggtttttaagcaccaagagtttgacatcaacagctctgtgttgtgccaaagctgatgactgttcttctcaggaatttgctcttcttgcaggcacagattttaatggcttgcacagtaagtgtactaacacccaactacctgcccttcaacagccacctgaagaaatgctggttaggcagtttgatcagttaataagtaaggtaagcataaggaaagtatattaatatgctaattacttgaaagataacatgacatacttggccaaatccttgtttccatagcccaagtctcattttctctccattgtcaaacactgcactgtaatgggtttcttctaaatatctattctggtttattctagcctgacctatgagtgaatatcagagtagccattgtactttccaaacaaaattttcctgtgtaaagaagccagatacttctagagtgtctttctacaaagggtctacattttctctcatcttcctatagtatgcggacactgtgaggaccagcatactattctttggctaatgataggacaatgtgagttatatgcaaagacacacacacacatacacacacatacacacgtacatacaaacacacacacacacaaaagcagcagcaacattaagaaagaatgattagtttgctgagaatgatgcacatgtaccctagaacttaaagtataataaaaaatataaacataataaaaagaaaaataaaaaaattataggaccaaaaaaaagaacgattaggaaatcacctgtaccctagatccagagtactttgattcactactggggatataaatctaaagggataatcacctattgttttagtcatgtcagcctgcacaggagaatccagaagcacaaatctattaccagaccatctgcttattcctcaagttagtgttgagaaatgaatcactaatataatcacatagaaaaatcttcctttttttaaacgaatgataatgctgaaaattacacttacgattttgatgaaagctgagcttaacaaaataaagtctgaatcttgattcaaactattaccaaatcagtttccatttatgtcattgacacaagttgtcttcatcattacccatcttttatttgaatatgtaagttttgaaacgagtgtgaaaatcctttaaagacaaaacatgacagtgcaatgcagctacttccatttccgctcacatggcaaccacccaaatttgagacaatgattttatagatggtcataaactatcatgtcagagacaatttccttgagatatttacatcgaatgattgtaaagtcatttgtgaattttttttagttataagcaaccttaggatattgatagtcattgataaaggcaagaacactcactgtctaaatactgcagagtcagtttatgataatatgattagttacactaataatgctgcttaggcattatcttgctaattacaatattataaatattaatgtcacagtctttctgtttgattgccactcatggagtcattcatcatgacattttcctggaacccacattgtaagattttatttctttcctccttttcttttttcattactggacttgcaaccatacacattactcttgaagaagggttttttttggctatctattaggagagggacagtgatattttctactaaaactagccaaatataagtcaattatatgatgtttctcttattctttctgagtccctaacccagtcatccaaggcagagtacccagggcttttgttttccattctttttcatgtgacctgcttcaagttaagattcatttgaattattaaatgcttccttaaagaatctttttatactgcctctcttttttttaaagttaattattgatgtagtgacaagctgaaaagactaagaattataattttttcctcccctcattgagggctcaagaaatgtcttctgacaatggttatctatttagaataatacaaaggaaatacaaaggcaaaatgctgaatgttgttttagcagtgttgctaaaatcactgtattatagaaaacgtaaatgtagtgtatatttcttggaaaatagcagttagtgagaaagctgggaccataaccgtttgagaccgggtttaaccacacagcagaagcagttacaaaagatactgattagattttaattttaaaaacttccttatattattcaagactacagtgatttgattgtcttgaaaatagaaaggtaatgttataatttccagaaagcataaagaaatctccagactcccactgggaagaatgccagtcatcaccacagtaagcaagaatttggaggcactttacactgcaaacatcggtcttttccttttatataatcttgtgttgtattggtttataaaaaggtaactcacagacccatcatatggctgtaatcaagtctccttcagaaagagtccactgaagaaatcacatccaggaggcactgtgtttcctttgttagtgagaatgtgagatggtaaataagatctgaaatagaaaccaaggctgagttctcaagaataacacaggagatttaagcacataccttgtccatgagttcagctatacgtggaactggtttccctttctggtgactcacagtagctggactctgtccatcccagtcttgtagttcttcaatgcttttcagataaagcagggctttgaggccagtgcagtagtcttcgatcacagtgaaatcctgattctgaatggcactgcatacctagaaaagacagagcagtcaaccaagtgtcaaaccaagagataattctccaaacaaattcacttttctttgagtcaacaaatatttattttatgtgccaggcactgtttgaggcatgatggatcagtagccgtctggagatgggggtggtggggaggaatggactgcaaagaacacaaggaaatttccagggacaatgaacatttttcataaacttgcaatggtaatggtgtcacaggtatatacatgttccaaaacttattaagttgtatagtttaaatagctacagtttattatatgtcaggcttaaggagtcgaatttggcacaacataataaaggacatttaaattctcattgtcactctattgggatgtgctgcctgcaggcagttctcacgtctgaaagtggtcaaactgaggttggagtgctgtttattacgttaactcaaccatcacttacccctgcctctgtctccctcctcatctgctattgttctccttgttgtcaactatgatccagttacccaggtctttcctttcttcctcaaaaaaaatgccatagtctttctttgccttaggatcttttcacaagaccttctcactggctagaaggcctttcttttccacacatggctaactaccaaccattcctcaggctcatggtaaatgtcccttcttcaaggaggcttccaggagcccagaataggttatggccttcttttaatcagacatttttaacttctaattattgcattattatttagttgacaactcacttcccaattagaccaaagtttcagaagggaagaactgcatttattttggtcactatattatctgcagtgactaggacactgtttgtctgttagtctgctctccacaaatataagatgaatgaataatgatgatatggtttggctgtgtccccacacaaatctcatcttgaattgtagttcccataatccccacgtgcagtaggagggacctggtgggggtaactgaatcatggggatggttatctccatgctgttctcgtgatgatgagtgagctctcacacaatctgatggttttataaggggcttttccccttttcctttgcacttctccttcctaccaccatgtgatgaaggatatgcctgcttccccttctgccatgattgtaagtttcccgaggcctcccccagaaatgttgaactgtgagtcaatcaaacctctttcctttataaattacccagtctcaggtatatctttttatttatttatttatttatttatttttggagtctcaccctgtcaccaggctggagtgcagcagcgcgatctcggctcactgtgacctccacctcccgggttcaagcaattctcctgcctctgcctctcgagtagctgggactacagggacacaccaccatgtccagctaatttttgtatttttagtaggaacggggtttcaccatgctggctaggatggcctcaatctcttgactttgtgatccacccgcctcagcctcccaaagtgctgggattacaggcgtgacccactgtgcccggcctcaggtatatctttattagcagcatgagaatggactattacaaaagattaaaaagaaaagagaactaaaataaaaaattctggagttaaggaagtttgaatcagagaaattaaagttcttccactaaaaaaaccctggggattctgtgagtgtggctgggatttgagttaaagcttgaagaatgtggatttagatactgcttctaggttgcttatttccaaagatatccctccaattttgatatcacatgtagactccagagagtcatttacaacttcctgtagaacctcttcaccaacatggcccaacattacatcaaattcaaaatttacaacatgaattcaacatacttcccaatttatatttcaacttcaaacaatgaaacaaccattaaaacaaaactgagcaaagaaaaactcatttctatcctgttttcccagatgttgaatacctagtatatcagggtgtctggcaatggcagccaacaaagaaaaatcatgtcatgcatgaatgaaaaagaaaatgaaggaaatgcctgaaaacagaataataagattctatttcaaagactcttaaagccttttgggtctttgattaaatacattttattgtaagcctcgtgcctagcatgctacctgatacctcattgttgctaggttggttgagagaatttattgaaaacatactaggaggttccagaatggggaatgggataaggagagagagagagagagagagagagagagagagagagagacagaactctcatatatatatatatatatatatatatgtgtgtgtgtgtatatatatgtatgtgtatatgtatgtgtatatatatatatatatatatatatatatatatatatatatatatatatatatatgcctaggagttctcagcaagcagtggtagtgattccatgatgtgtacctaaaaaaatgccaggtgtgaaattctgggaatgctagcacttaaaaggaaggctaaggaagatgatcgtgagggacaccgagcagaagagatccaagagagttaagtcaggcgctgcagaaaggtcaggaatatcagagctggaagcgatgactggatgtaacactcggcaatataccggataacatttgcctttataggagagatctgcaatggagtagatgccggtttttttggtaggttgaggaatggatgagggatgatgaactaaagatatgcagccaggtcacatttctaagaagtttggctcctgtaagaggaagaggcgagctggggttataggttatagggttttgcattttgctttttacttttatttttgagacagagtcttgctctgtcacccaggctggagtgcagtggcacaatcatagctcagtgtagcctcaacctcctgagctcaagcaatcctctcacctcagcttcccaagtagctaggactacaggcacacaccaccatgcttgggtaattgtttttggtatttatttatttatttttttatttattcttatagagatgaggttttgccatattgctcaaactcctgagctcaagcaatccgcccacctggcctcccacaaatgctgggattacaggcatggaccaccatgcttggcctgcattttatttttttaaagaatgaaaataattatgttttaaggagatacagttattttacatttcagaataggacagactgatttctgtgtatgagatttctgtcaaaattggctgaatgattatgcgatgagaataaaacaatgcaatatctaacatgatgcgggctcttcttaggggccaggcactttgttagcacttttaaatatattatcttctttagtcctcaagataaccctaaaagataggtttaattttcagccccattttacaggtgaggaaagtgagtcttaggaaagttaaatgacttgctccaggccccatggttagaaagtggtggcaccagaattcctggccatacaatagaatatgacctagatatagacattaacagaggaaaaacttttaatataactacaaatactttcctacaactattgcatggaccaaatgcatacgtttttaaaaatttaatcaagttatcttcaactgaaatatagctctggttttgaaaaaatccacacttttagacaaaaattgtcaatgttttcaatttaccttcttacttgtacagtatgagtaagaatagtaacaagccaaaaccaaaaagcagaaacaaaaaccccttcattttctattctgaagtgctgcatgttagtacaatgtagaaaagagtatagaataactactaaatatgaacaagaacattttctaggaagcccatttacatcagattaaaaaaatctgtttctcaggaggaacaatttgaacattaattaggcctgttataaccttcttagagttggtggtgtttttttctcacaacaattataaggaacatcattatcatttcctccacaggggtattttttttcttttgactataaaagtcaactgatgctttacttaatcctctttgctcactctgagattctatttttttgtagtatatgcttatgggtatactttactatagtcttaaaatagttcaccatgtgaacataagaaatcagattttgaaaatcacataatgtcatgtactttatgggattttcatgattattgtaaaatcctgctgctaaaatgaatctagaaatacactgcaagggatgaacagtaaagtataatctaaatcatccctgatgtttccaggaagaagatacaaaagctatgagttatctcaatcctcaaacatggcacaatttgtatacagtagactcagacaaggagtggagtgatcagaatgtagacttgggatcttttaactgtagaagaacatggtaggtcccaaggctaagaaaacttcctctttcccacccacttctagactctttatcatacagggttggtgtttcacataattgggagctatactgagaatgtgaactgaacacaaaaccttaagaggaaggagagactacaagatacttactgagcaagactgggatagtgtgcaatgctggaagccctggaatccaccatgagacacgagtgctggaggggaccacttcagatatacttaatcatatggcaaatgtcacaccacttacgtacctttacaaaatgagtagtttaatttttacttccaataagattaaacctactaattttcctgatagaatttttgatagtaggaactttgcacattgatattttcttttaaaattttgttgcacatacaaatcaggtggggatctttttaaaatgcagattctggttttgtagctttagagtgggatcctggagtgagatcctgcattggccaaattttcgggggatgctgctgctgctgctggaccacacttagaacagcaaagtcttaagcactggcaggggtgaatctcatctcaactgaaatgctgactgcaaaaaaaaatttcttctaaacaaataggtttcttcttaatttttactattagattatatcaacattttcctagcctttcaaagaatgcactacttataataagaagtcatgtttgaagaaacaagaataatttgctgattaaatactaataagactaaaaataaaacttaggatgcaagtgcaccattgagaacagctttgcccatggatttgatctcaggaaatggaattgcttagaaagatgccttgtccttgcctaacttatatactccattgagggccttatcgctatctcaaaggtaaatcgttcttgttaaaactccaaacatgtagctgctatgcctaaatgggtgcattttatatgacatctcttaattgtttgtttaacagctctgattaggactcttaatagctgttaacatgtttgcttagtataatttgtaagttctttatggtgaaggctggtttatctttcttcacagcagggcatcaggtgccattataaggatcgttgccaccattaattatttctatatgtgtgaatatccctatagtgagctattttaaagagaggcccctagattctcagcaggaccagccctacacaggagcagagtaggtggtggcccccgtgcagcgtgatttgacgtgttccataaagcaccaaatagcctcctccaggggtctgacacagtgccctgaatttttactttaggtgcagacgcatttaatagaggccgacctgtgcagaacaactgtacaaatacctggatggtaacagagggttgtggggagctattcttttctcattatttctcataaaatgagattaactagattatcagtaaattacctatttatggagatttacgtcttcaaaatcttctttacatacattatttctttcagtactcaaagctgacttagtcaggagagggagtaatattcttacttgtaaaatggaaagagcttggacttgaagtcctgtttcttaaagtcaatcttgtggtttctatgccatattaagttaagaggctgagagcatgcacacagaagtcaagcagaatagagttccaattacatcttagctgtgtaatcatgagcatttttttcacttaaaaatggagattaaatacttagcacataggaaactaaaaggcaacatacttaagtgcttaaaatagtagcttatactcagctacattggcaccaaaattaaatttcatactatgaataaatcattagggcatgaattaggcaggatataatttttttaatgtaatacatttttggtcaaatactgcagaggaaaggcatggaccttatttttatttgcattaaataatgatctccaaaaaaaaaaagctttggttttgttgtcagaagactcaggtctgagacccaactcttgtcatctggcagctgtgtaactagggctagtcatttagcttgttgattcccttctccctcctttacatctgaaaaaggaggatgataacatcttattgttgtgaagattaaattataccatgaaggtggaagtactgtggaaattataaagcttagacagaatggtactaaacctcataggtattgtagaatttcacgtaatctagaatttcaagtgcctggcagaggccaaaatgggaagttttgcctattaaaaaaaagctcacttcatctgaaaagtaaaataaatttacaaggaagctatcaaataaaatctaaattagattaaaaatatttatcccaggtaaataatttggcagagaagagttctacaaaagcaggaacaccctgagactggcacatgcttttgtgtaatcaaatagcacatttttcaaatgctattttaaaatataacaaagtttaaaaatagagatcttgatctattaaacacaactcagataaacccatgaccataattatcccttttcatttcttatcatacaggtggataaactacacttcaggacttagaagtatgtgcctccaggttatatgcaagtaaaatatatgcttacaatttaagtctaaagttgtctcaaatttactgtaaattcattagtaaaagttctattggagaattactacatttaagcaaaaacggaaattcttctgcaatggttatcacatcacaaattgcattaataactgagttatgtatctggaagaggttcaagaagcctcccatgaatgtggttcatatatgaaacactgaataagaagggttgttcatccaattcttaaagctttctcaggaaaaagaaggttatattatctcttcttactaacctattttgataagcacatattttgtttaaactatgcaaaacatctgcaatattttatatagcactttatagttttcaaagcatgctgtcaaaaagaaatatctatacaatgatttatagttttcaaagcatggtgacaaacaagattaaagggaatttagactttttttcagaccagcttcctcatttcagagatcaggagtccagactggctaaatgatctgtgcatggtacacagctagttggaggcagtgctggcagacccgcctggtttgaagctctttctgctacaacactgtctgtcaatatcatcgtacagcagttctaagagaaagacagagaaggtgctatgaattgttcagtaagtgaggaaattgaaaccaaacattgaatgcagtgcccaaaatcaagattagtaactgggagggccaacagtaagactcagaatttctgacctctgcagagctttttatcttttctttttattattatttccataaatttcaaagccttaaatgagatgaaagtcttacatatataaacaagcatatatgtataattttcataaaaagaagcgaagtgatttcacatttattagttaattattatgacagaaatccacagatttttaacatttaaggttttaatatttggatgacccacttaaaatttcttactttaactggaaactaaatttctcctgttttcggatgttatgcagtttctaattctatctgtccacacctactgattaaaaaaatcagattttctgaaggcatggaatcaataattactcacggaattgagttctgaccagtactaacaaacagatgtataaaactacattgtactttaaaaatggatgtacaatacatatagataaggtaagaattcagaataacaatatccgcctatgagcttttggtactacataaacatggcattgcttactggaattcatgaataaaacaccaaaattataattttataaaaatataggttaaaagacagcccctggagatacatagtaaatagggaactagatggggatgtatttgtatattcacataaaaccacaaatcttagttgttctatcatattagtttctatctgttggagctgtacaacatcaaagtcatgatgtccctatatattgcatttagcagtaatgtaacggactacgtgaagaaatcaaagtgagagtttctaagtagtttcctggcaattgagacagcaggctctctcatctgctctgtaactgtggcagtgcattgatttaaactccttctgagatctcaaatgcttttatattcttaggtctctcaagcagctttttttttttttttcccaaagtgataaaattccagcattcagcagaataccatcttgtttcccccaaaaggagagggcttatttcagctttgctacgaaactgcacaggatcactaagtaaaatagctgtccaaatgtcattctactaagaaatctggctttgagttcagttgtctatgttctgaccacagcaaataggattgggaaaaaaagaacaacaaacgaatagccccggagatgttgtttttcaaaagttcagttcagaaaaattgccgaaatggataagtagttctgcttattaaatattttcaaagttgtttttaattgccactcattgatcagtccaaatggtataggagtcatttattttgtaaatcatatatttcttctcagtacattacttatcctctgaaacgataaattctctgataaattttaagtataaaaatttcccccttttcctccaattaggaaggaactttatgtagcctgaaagtctatttttcagtgtaactctgtggtcattctttaattaatttcttaacccaagatcagctaaagacagactgaagagaataatatgttttcaaggtatattatactgagatccaaaccacattttgccagccagaatataatcatcaattctccaagtattttctcaaaggcagcatatgatgggccacccactcgactactattcagaagagcatttgtgagactgatcttctctgttgcactttgttgatgacacagtttcactgaagatggcctgcgctgattagtcaaagggctgtgccctgcaggcgagactgccctgcccccttccttgtatctgtcctttacaaagtgagctctaactggactcagatctcaataatgactgcaaccaagaaataataataagaaccatacagagacacagcacctctgtctgccttttatgtgacactagagataaaatgggtgagacaggtacaacatgtagggccaaagaatggtgattactgttctgtctcttcaaagatattgctgttgatggctctgcttcccaacgggcataaatacaagactcaaaagactgaggtaacaactggagtcttctacacaccaggatcctatgcagcccattctttggttaggaactgtggctgcagtttgaggaagcttggccactgctcttcagaggcagtaggatttttctactaacatcgtttctcaccatcaggctttggtgctgcatcagttaccacagcaattttcaattactctgcagtaacacaggtggtggtgtaagggtttgcatgtagcattgtgcatgctcagcacctctcatgataaaagtggggtaagaaaaggaaactaaacatccaaacaatagctgtcagaagactcaaatccttaattttaggcaatctttctttttcaacagagtcaacacagctgggaaaacttgatttatcatatcattcactaaaataccagatagagtttgatcacagaggagaagtcataatgcctagagagaaaaagttcaggaaggggaatatcacactctggggactgttgtggggtggggggaggtgggcgggatagcattgggagatatacctaatgctagatgacgagttagtgggtgcagcgcaccagcatggcacatgtatacatatgtaactaacctgcacaagcacatgtaccctaaaacttaaagtataataaaaaaaataaaaaaaataataaaggatgagttcagaccccccccccccaaaaaaaaaaaaagagaaaaagtctatagggaaaattaacgcatggaatttttttctgaactctgaagatggatgaaagttatgtggtcactcaataactaagcagacattcacattccaaaaaaaaaaaaaaaaaaaaaaaaagaacaactcacctacaatgagaaacatttgttaacatgaaaataacatctcaaatagtcctgactacctctgaaagcattcacaattcagtagttggtgtgatagttaatctataattgataaaaacacaaatttgtgagagagtacaacttggctgttatcagtgagtcaacaattttgactgagttgccaatatattctgggacacaaaagttaaagttcagttgattaagagtgaataaactatgtaagagttaagcgttataggaaaaacaaaacaaccttaccaatgttgaagttaatatatggtaaacacggtgcatatttatgggagggctagagaagcaaagcaataaggtttgcatttgttaaaaggaacttttaaaaatactaaactcatttttaatccctttactgtgtatatggaaaaataaaagctcacaaagtttgtggttttgcagaaagaccaggaaaataaattgtatgctagttttttttggctttttgttttaatgaaggccaagaacctaaaagtaaaatgcctggtcttcagctacaaaagatggatctactggaacatggttacagacaaacaaatgcaatgtccaaagaagtagttttatttatgccttctcactaaaagggcacatattttatgatttgtgactctgacaacctgaagaaagattacaaacaccagtaaaagttctaggctgagggttttaggaggatgcttagagatgaccatataatttaccatccaaactgtgacacttgagagtaaacaggaaactattagtgaaaataccaggaccagcagtataaactgggattgtcctgtaccactaggatctgtgattcccttactcagagggtttttttcattcctgtctttatattggagggagactttcacttgtccctgtggaatgcattccaaaatgctccgtcacttttggtttagtttaacattctggtctttcagatacttatgcaggcctcagagcattaacattggatctaattcaccaggcttttattacttaggtggggatttggaatcctggagacctgacttgatccaataagaggacccgacttgatcctgttattgacccagataatcctagatttaaagggtcccttttggcctccaactttaaaaaaaataattaatagactttgctttttagtacacttttagatttacagaataattgggcagatagtacatagagtttcatacgcccacaccacccccaaactcggcaccttccccattattaatatcttgcattagatggtacatctgttacagttaaagcaccaatattgatatgctattattaaaattcatagtttatattaagattcactctttgcattgtacctttctatggtttttgacaaatgtataatgacatgtattcatcattagagttttatacagaatagcttcactgccctaaaaatctactatgctgtacgtattcatccccctcaccctcacctcccccatcccctggcaaccactgatcttttttactgtctccatagttttgccttttccaatatgtcgtataattgaaatcacatatatgtagctttttcagattgacttatttcacttagcagtatgcatttaaggttgctccaggttgttctgtagcaacagaatccattcacctattgaaaaattatcacagtttttttcaactttagtaagaacttcatatattttaaaatataaaaccatttttctatatagccaaataatattttaacagttaataaaataaataattccttagtgtaatctgatatccatagtacaatttccataatatttttatagctagtttatccaagcctaggttcaatccaggactgcatgttgcatccagttgctctgtccttcaaggttccttttatctggcacagcctctttttcattgcaccagcctgttgtagaaaccctactgctggagtctggctgctttgccacagtgttctttacatttctttcctctaacccttgcatctcctggaaacttgtacttgtcttgaatcttgttgaactctcacacaatgtggttcactagaattgggtcctcacagggcatctccagcgcttaatgggaatggggtggcagggaatgaatggtggacattgcctgtaatcatgggcttgctctgctgtcccactggacttcagtttaacccttttatgataaaagatacaactcagaaacagccaaacagaaaagatgcatagggcaaggtatgagggaggggtacggagcttccatgtcttctccagacactcctccaagggtctttcagcctaaaaaaaaaactcaaaggggacaggggaggcaaggagctactcaaaatccatatcctttaagggtggaaaagtttggtgtattttaacaaacttaatattctgtccttttgtaacttatttctttatgctttacccaaattcccttatgattacagcattttgaaatttacttaggttacttattatgttttaaaccctgttcaaaatatgtctacatgtagcaccacattgaaactcacaatagcaccttgggtaagtattattattttcttcagttagcagatgggtaaatatggggtcagaaattacaggccttgattaagatcacacagctactaaatggcagaacaaagattaaaattctggctcagtttgcccacaggatcctttcttgtaaccacagtgcagtcctgctttctgttctgaccactactacgaaggcaactggctttcatgtgaaaacagggagattttatatatatatatatatatatatatatatatatatatatatatatatataatctatatgcttataatgcatatgtgcgtatacatgtttatatgtttatgttaatgtatgttttatatgtatgtgtgtatatgtttttaggtttatgcatacacatacatatacacacaagcatctatatacacacaatattgtatgtatgatatacaatatatgtacatatatttatacatagacacatatatacacatatatacctatgtatatgtagtatagatttcttgtaagtattatatcaaataaaacatacataattatctacttcagtgcctaaataactgcacaataggtatcatcatttggatctcattcaccagatttcagagacacagcaaaaagggcagagactatatttcttttggttaccattgtacacccagtacttaccacataaagatctttgcctggcatatgacttattcaatggatgaatacatgaagcaaaataaaaatattgtaatagtatcagtcagtgacaaacacaattccctttcattccctgtccagaatacatttttctctccaattatacgaatatatcataattaagaactcacatcaatccacaagagaatacttttctctcaacttttgctgcactctatatcactcattgcatcatttatacattaatatctttgcattattacttaactcttctttggatatgccaatgtatttcaaggatgcagggagtaactctacttcttcagcatttttcttcatattcaaagtactatttgtcacagacaaactggacaaagcctgtgtatagatttttgcatctctggtgttcccagtctggatgcctgagtcttatcagcaattgtcatttgattatgttttctcttatgatagtcccctttaacactaactgaaggaatgtataattaagaaccctataaaagatctcatttaacaatgactgaattcacactatcaaatccaatatatacaatgttctaattttcacacatatatattaaagcaatctggattctaactctaataaaggacagataaaacagagcccagagacgctaaggaaaaggtcttctatcttgttttgtgtctagactctcttatctaatttttttgggtttctgcatcacgcaccaatagaggtcagtccagcattcttgggtcaggactaatgttttcattttaaagaattccctctctatctttaattatttcaagttcataaagttcaacacttcatcaaattactttgaaatagttcaaagtaaatgataaaatgtattattgagcaaatttgtacaaatattattgccattgtaaatgatttgcttcctctaatacaggtcctgcaaaaccactgcacatgcccagtaaaggccttctctctgtttgctgggaatgtagccaggagtgtttaatagattattctgaatttttaccagaagagagcaattgtttttgtttttttcctctctttcttttttcttttcttttctttctttcttttacttttttttcttcctctttcttctttctctttgtttcttttctttctctttcttctttctctttctttctttctttctttttctttcttctttctctctctctttcttttttttttttgacagggtctcactctgttgcctaggctgaatgcagtggcatgatcatagctcactgcagtctcaaactcctgggcacatgcaatcctcctccttcagcctcctgggtagctgggactacaggcgcatgccaccatgcttggctaatttcttaatttttttgtagagacagggtcttgctatgttgcccaggctgatcttgaactcctgggcttaagcgatcctcctgcctcagcctcccaaggattgggactataggtgtgacacactgcacttcgccaagggagctatattcaaactcatcatttcttcaaaaactttctctattactcaaaaactacctactaattaatttattctttcattcagcacatgttaatttatggactaatcttccggtttcttttcacattcaattatcaaacaaaattgttgactgaagcagcctgaggttatgctgtttgttttctgtcagaatgaactttccatgcagagctgttgtgaggaccaaatgagataagaattattaagtactgtttactaggaaggcctcccttgttggtataggtgtgacacaatgcgtttgattcagaggtaagaataattattcaagttctgaattttgtatctgaatgtgcaactggtgtcttctgaggtgtgtgtgtgtgtgttccatattgactaatttctaagatgagttgctccattgagctccaggaccaaaatgatcatatctttgttgtaaacaattaacttaatcacacacagataaacatataagatcgaattttgagacaaggaaatgacctgactttcaattgttatgctttgagagtataaaccagaatcatattaccaccgcctacccataaatcaatatactacaggttttaaatcaattattgaatatgaattaggtcaaagaaaaggtaaataaggtaaataaatacaggtaagttggattttatgtgttttatatttcatttttgtctataaaatgtcacactttaaaccattgcttatattttgaatctgcttataatcaacattacctaattaaataatgctcagacatgcaatagaattggctttttttaaactccctccagattactcacatttattttttgtgttttagagacatcaggccttataaatgtgcaacagtattcttactgtagctgtgtaagaccaggcatgtgtaatgtgtgatgtatttggccatacaaattcaccagtgattaaactgattttttgcttgtgtcattgtttttaggctcaatgatgagtcgtgaaactttcctctcacctcatattcattgctacatctggtgtcatccagagttaatatccacgatgtactgattgatttaggaagatgataatgagattattgcttatgcccttaaagcatgacaactgaaatcccatcattttccacatgaggaaatatgctaaatattataatatctgacaggtctatcactgtgggattaagccagctatctgaaacaaaggtttgatattttgatctttagacatattatcttctttcgtcttacaaacacagaattgttgatttggagataatggcagtttatatttgcatgcctacatctttaattccacaaactgttaaggtcctcctggttcatatctgccaaacgaagctaagagcaaacattgttctttcttctgattatgtggggcatgaccatagaataggggaagagaaatgtttaacttggagcatttatatttcaggccaggagaatctggtttaaaagttttcaaaagactgatgagccacaaaaatattaaatgtgtaggaaatctgaccagttaaacaaaatgaagaaggaatgtttcctgaatattcaaagaaggcaagttatagaattggatgagcatgtgtttaaagctaataaatgtagagcgtttttttccctcccccttggagggaaatgttttatagaccatttacttattttattttaaaatgtacatttgatatgaatttcatttcttttactctttcctcaaagattcataatcttctaaaatttagcttcaggaacatatttctgagaatgacaagagcttactgaaactggcctctgaactattcaaaacacagttgcttattgtccatttttaaacattcattggtcgagacttacagtaaggcattcctctctccccttagcatctgtccacaagcaagtatgcacatatctgctttgtgcctaatattatttcaattactatgaggcattcttaagaagtgaaaatgcacatacatcctagctaggagataagacatacattcatttatctgcattggcttgtacatgcattttcaggcttgagacatgtctagaaagtaggatagaaacaaaaagatactagtgcctatctgacattttcacggaggtgtttcctaggcatcttaactatagccagaataccattcctagtttttccactcactgcagcctactactccaccagtccaaagtctagaaatcatctctgtccctttcttttcatgtccacaaccattcaatctctcagcaaatcttgtagcactacttcaagtatatatcgtgaatctatttgttgccataaccacagcttcttgcaactggaatcaatcatggtctctcacttgcctcactgcaatactttctttattcactcttgaccctcctaaattaattatctacacgacagctaagatgattatttaaaaatattaattagatcataatttgccactgcataagaccaacaatgtcttgcctcactttgcaaaaatgggaacactttctacaaagtactgcatgatctggtcctgcctcgttggccttccttcagtatgtcaagcttatttctgccttaggagctttgctctgtctttctgcaatgcctttctccatactttcccatagctggatgaatcttctcattcagttctcagcttaaacatcactgctctagagacgactccccagccagacaaggtatcctcccagtcactatcacacagtctaatttaaattctaagttaatgtaaagtacttaccactatctgacatttttcttatatatctgtttcttactaatgtgcctggtacccatcagacactcagtaactatttgctgaatgaatagaaattatgaccactacataatacactgtttgataatatgaaccttatgactgagtttctcagcagatattagttattgacagcttcaaagccaatctctccttgatatatttaacttttcttaaataatatacagttttaaaatttaaataacttgcaacattcataaacatttatacaaagtatgattagtgcttatttgtaaggaaatactctaattttaatactttaatacatggaacacacttgagaaatatagaaatgcttcctacccaggatgccttaattaggcagacttatttaaacgtgcttatttttaaatttggcaaggttcacaaacattaattttgttacattgctgatactaataatagtatacatatcttaaataaaggtattatgtcattttcccgtaagactttgaagaaatagaactcctaagcatgagtgaaatcccccttacttgcctacagatttttctccactatgaatcgctcccaattcagatttcaaaattcagtatttaataacttcattacacatattatttaagctatctttaagtatgtgggtttttaaaaacattattatggtataatttacatagcataaaactcgcccactatacgtgtgcaaggcaatgatatttttgtaaatttatagagttgtgcagcatcaccacaacctggttttacgatattccaattacccaaaagttttcttgcatcctttagcagccactgttcaccacctccccaagcttcaagaaactactgattcgttgtcctcataattttgtcacatccaatcatttcataaaaatggaattttataataacaaatattagtattttgtgtctttttatcttcatttagcatgtttttatacatgtcaaaatattctgtgctattatggtgtcagtctattttattgctgaataatatctcattgtatggatgtaccaccacattttgtttaccattcatcaacctgctagggatttagactgtgtccagttttggggtattagaaacaatgctgctatgaccatctgtatgcaagtctttttttctggatatatatatttatttgtctgagatagatgatgtggagtggaatttccggattgtatggtacatttttgtaacattataagaaactgccaaactgttttccaaagcagttgcaccgttttatattccaacaagcaatgtgtgaggattccagtttctccacatcctcaccgtcattaagtattatctgtcttttgatactagccattttagtgggcagaaatgtcaacatagtgtaccggttaaaataacagattctgggccaaattgtgtaaattcatatcacaacttgccatcctgtaacttaacattcctgtctatagaatgaggacagtaataacacctgtcttagcctgtttgaacatgctataacaaaaatgccatagactgggtagcttcaataacaaacattcatttctcacagttttggaggctaggaagaccaagatcaaggtgtctggtgaagacttgcttccaggttaatagatggccatctttttgctgttttcaagtggcagaaagaataggggctctctggagtctcttgaataaaagcaccaatctcatttataagggcaccaccctctgacctatcaaacctttgacttaccaaaggcctatctcttaatactaccagattggggttagtattccaacatatacattttggggggacacaaacattcaatctataacaataactatctcacaggattactggaggtataaataaattattacaacttttagcttacaaaaggtgtgtctcatagtaaatttcacatacaagttaaccatgataatttttttattatcataatttgcaaagtgacaacatacttaacctggctgtggattatagttaggctttgggaagctgtttatgttctcttaatgatcgcttccttacatgatgtcagcttaagatagttaagatggttatcacaatgtccaggcactagaatgctaggtactgtgaaaatcaaatcacagattttaaatgacaattagaatggttaaaacttctaaatggtcagattgacctgccagactacttcagtcaaatacgggactttgaatgaatgattgaaccagtggtttattttactaataaaatgtacctgtccatggggataaaaaaggaaactgctgtaggtaagctgttttcctttacaaaattgtcaattgtttgaccataaggaccttcgtcctctgttttctttatcccatttatttgtttccttgtcttcttcctccttcacttgactacgtgggtgattaatggatcactgctgctttgaccaaggaataaatggagaaacggcaaaaggatgatattccccctctcgagttactaaaatgcccattttagacacttttctagaaaggcacatgtgccgtctgcttgtcaaatccctttctgattaatagctttagaagatgttttgcatgcatgcttgccagtttttaaagcacattactgaaagcatttcagagcacttctcctgggtttccagcaacaagcagggatcacttctccatgcttaggtcactgctgtactaatttctccaggttccagcaagccttgggggtaccaatagaattccctaacagcagccaaattttacttgagaccatccaacttagccttctgtattgcatcctgggagtgacttgatttaggttatgatatggtaaaactattataaaattgcacactattttcactcacctgtgtaccactcatagtcatatgaatataagattcaactatttatggattgtcaaggttttctccatttctgaaagtctctgtttctatgaaaatagcatggatagattctatctagttttaaaaagaagtaggccaatgaataaaagatatatgaaggcacatcctccaaaataaggcagaaattgtgtataactttatgaatattcaaccacgttggataatcacaagtgtagaagagagtaatatagtggattaagtgccatactgggccaaaccacagggtgttgaagaagctttcaccaggtgataaaatccagaaggactgggtagtggactctccagaaggatgaacttcaaccaatgcatgacagaaggcagaagggaatagaagatacatttcctctccattttttcctgtgatggattaccccaaggcattgctttctagctagtctatctggagttgttccacgtggccagttggctgtcttgtctcactgaagcttgtgaagcagtggctaactcagtaatgcattaccttgtattcaagtctcatctttctctgtctcatttccatcttcttttactcttgctaccctagaattttatctcccaacaaaacattaacacttgaccctttccttgggttctgctttctaccaccctgagctaagatacatactagtcaaaagctagaatagagggctgtacattttattttaaaatttggcataaatgcataaaactactagcagactggatgatgatgatggctgatgatgataattaatagcttgcatctgtggtacacatactttgcttcagatactgtatgaggtgctttgcatatggttgtgaatcctcacaaccatactacgaggtaggtagtattattatctccactttacagataacaaaattgaagtataaaatgttcacacgtctagtaagcccaaggtcatatagctaatgagcaacagagctgggatttcaacccaaacaatttgatgcattttcatttgggttgaagcattcatgaataaggtggagttctcagtgacttcctgttcttatttggtgattctgagactgatatcactacctgtccagtagcttctggaaaaggtcatctgagtccttgccatattatttatgattacaatagcgtctctagagagccgaagtccactttctttcaagaatgtatggttgttgaggcatctgattctctacctcccaggctattcaaattgtatgttcaaaaggaggcaatgaaaaacacacacttagttcaactaaaatctctcatacctttccttgtagtagaggtttatgaaaggtctacgttattttatatttaactgagggcacttgtagtttcatccttgaatcatttttacccaccatcacatagtgcataccacattcctcctgcgcacaaacaggcacgcccatgcttaggcccatgacactccatcacgtgactggcgctaaaatataaacgttcccattttgtgtggtataagatacttgtgactgaaagtgacctaagcattctttttgcctttctgttgctctatttaaaataatgactacagactctctttcaacaaagggtcatttgtgtcaatggacagaagagaggatcagatcacctgcggtaattgcaaattaatgttctcctggtaatgcactaactacacactattgatctacaattgaatactagaggctactgataagtgatttttactttcctgcttttttgtgtgtgcttttattgctttttccataatgcatttttctttcaactggaattttctctaattgtctccatttttaatttcccacagtgagatgacttctaacttgtaattagaatctgtaaaaattcatgtctctgtctcaaaagccttttagaaatctactgaactgtaactttgatgccataaaccacatatatgatgcacagatacatagtttgagagagccaagctttcgaattttttttttattaatactcagataaaacagaaatccatttggccctctatccaaaatagcaatttgttgagtagtctgcagtaaaacattcaaaagtttcccctaaaagcattttacttggagaacattgatgacgtgtttttctttccaagagcaaacttttaaaatatgagtaaacggtttattacaagataatttttatttttaagtgtgtgagagaagcggggcacagtggctcacacctgtaatcccagtactttgggaggccgaggcaggcaaatcacttgaggtcaggagttcgagaccagcctggccaacatggtgaaacccgtatctactaaaaatacaaaaattatagccagatgtggtggcgggcacctgtagtcccacctactcagaagactgaggcaggagaattgtttgaacctgggaggcagaggttgcagtgacttgagatcacgccactgcaccccagcctgggtgacagagcgacactcgtctcaaacaacaacaacaaaaaagtgtttgagaagaggatgcagatttccaattgagtaaatatttatacacatcttcacagcatacttttgacaatgttaaattttctcatgtttgtgtcaaaaccttaattgaggatctggcaccgtggctcatgcctgtaatcccagcactttgggaggccgaggtgagtggatcacctgaggtcaggagttcgagaccagcctgaccaagatggtgaaactccgtctctactaaaaacacaaaaattagctggacatggtggtgggtgcctgtaatcccaagtacttgggaggctgaggcaggagaatcgcttgaacacgggaggcggaggttgcagtgagccgagatcatgccactgcactccagcctcggcgacagagcaagactctgtctcaaaaaacaaacaaacaaaaacaaaaaacacgttaattgataataattattctatctggtggaaattaacacacgtttgtatttcagtgttgtacttgatcatgctccctgtttagacagaggtcattcatcctaaatctggtttctgaactgtggtctagaaatcacctgaaatggagagatagtctgacagtaatttccttcactactatttgtaaactttaagcttatcattgattttctgtatttctaaataagagacatagttgtgatttctaagtgttttcaggcctgtaagaactttgatattttactgtaatttcttttacaatcattatttgcagctagtcacaattaaataccatcaaaataaatgtgtgcccaaattgtttgcttattttttattcctaagtcatgattatctgtaccaaaaaaaaaaaaaagtaataactgtcaaccgcatggctagaattatataagtctggtactctttcttttatcagtttataactagagacagatacaattacagttgatattcattttacaagcagtcttagggctggaccagagtgctgatggctccctgatgtgccaatcattgttggataatgaaaagcggggcaacaccagggtggctggagcaggagggagatactcggaggactgagactctgaattgtgatactcgctttatcatattaaatatcatttctgtcttattacaatccaatgagataggtactataacttccattttatagataaataaaccaaggtttatagaggttaaataattagcccaaatttatccagctagtaaatgttgagcaaagtattataaaacttcaaagctccttctcttaactaccatagtatacatgacaacagaaccacatctgtatacataatgatagcacacaaatactgtaaagaatcttcaagcttaggatgaactgagatttttgaaaaatgttaaaactaacaacagggttacattacaatatacattaaaagtccagagttcactatgaatccatgtaacaaaactgcacttgtaatccttaaatttacacaaagaaaaaaatgaatgcattaagaatgaggaaactgaatgtactgatttatgaagaaaaaacaaaaaatgaccaaaaacatacttggtattaggtatatacaggtataaggtagagcaattcagctttaatttcatctcactaataagagctacccatccgcctttatacagaggttctcagagcttggttatatttttggtctagagctggagtcattcccgtctagctactgtctaacattgtcttcctcccttttcctcttttctgttctgcctcagcctttagacatcctagatcaaacccaaaaagtcaataaataaatcctcaaattttctaatcttggacgatggttaggaatgggaccttttcaaatctactccataagcaataaactcagaagaaatcagaagtacatcaacacaaggaaaaaaggaaaacaagaataaaataatgatatgccaaatcaaaagtgatgagtgggctttctgagaagaagataacatcagagggtctagtttgttgtgaacacattgaaaatatggtgaccaaacatgagactaattgtaaataggcctatataaacatgagtgtaggtgttaggaggataagagattttaaagtttggtttgttagtactgcaaagagaaattgccttttgaaaaggcaaaggtgcctaaaaaattaaaggtaccagtctgaaaaaagcccagaaaaatctaaatttgttttgaaccctttagaagaaagatagtaatcatcaggtagagagagaagtcctttaaaaaggagagtggccataacccatgagtttcattttataataagcttataattcagtgttatttagaaaatgtaatgaagaaaagttataaagaattgggacagtacacacaaagcaaaacagtggggtacaaaactgaatgtcatgaatggaaactcttagagaggtagatgcttttgagggaccaactgtgaaatgtatttttgtggtctgtattttcattttttgttgcaagataaatagagtggcaaaatctattctcatctgaacccttgggaaaatttttaaatatattaagcacatgatagaactgaatgattctggaaagagatgtgtgttagtctgatttttgcattaatatttaataatgttttcccttgtatagaaagttaatgatgatgtcctaccattaacagaacatgtgctttggagacacgtttcctctagaagtgatgaatttgagttgataaaggcacatttttggggcctgtcacccttgagagtagtaaaaattatttataagcagctaaccaagggtgaaggaggcaaaaagtagccctagaagagaggagaattaaaattatgaaggataaaaaccattatttaaaaatgaacaagatgccatggaagtacaaagtagaaaaggcctactgagcattcactccaggatctgaggaaagcgacagctggtgtggtgttggcctgtgaaaatgtaaagaccttgccactctttggagacacttcactcctcaagtgcagaataacatctaaaatcgttatcatgacctgaagtactccacaagattcatctctgcctatgtctttctcttcatttcctatcattctcacctctgttcagtatgtcttgccatgcctgaaataggccatatttgctcacttgtataactacgccttgatatttatactgttgctctttctctggccaggaggacactcttctctcggggtctctgaatggctcaattattttatcattgctatggtttgaatgtcccctccaaaactcatgttgaaactcaatctccaatgtggcagtattgagaggtggggtctgtaagaggtgattggatcatgacagctctgcccttatgaatggattattccattcacagattaatgcactatcatgggagtgggattcatggctttatacgaagagaaagaaagacctgaactagcgcattagcaagcacaggcccctcatcatgtgatgtcctgccccacctcaggactctccagagagtctctgccagcaagaaaactcacaccagatgcagcccctcaaccttggacctctcagcatccataactgtaagaaatacattccctttctttaaaaattgcccagctttgagtattctaagtaacagaaaatggactaagacatcactcttgtgagggagcttctagcatgcaagcttcctgagggcaggtctcaggtgtctgagaatatccttgtatccttgatgcttgagctctgcctgggatatagtggggctcattcagtgataaagatgccattttatgatagttcattgaggacattattttcattttcctagataccacatttcaaatgtaactaagataaactttttaaaagaagctatactgtttatcttactgtcaattatatccctctatggtttttccacaaaatcttctctttgccatggttgtctccacttcagatgtatacttaagtttttgtacccaagaatagaaccttacttttgtcactaattaactgtgtcttctcatattagatcaatcacacatgcatcttctgatttttctgagtctactttgtgatttactctttaccccaagtttactccaaatttcatgttatccaaaaatgtgatcaaatggatttctgtgcttcccccaagtagagcccaggagccccagagtagccagtcttctagaaatctcaaagttttctttactcagcacgtggaaagaatgttcagaattcaaaataattttggaaactgaagaagtcagggataaattacttaataaagacaaaaacaaatatctcacttataaaattatatgattgggtataaacaaactactcacagatagagctcaagaactaagaagaatcagcaattaataagtgaaagagcaagctttcacacgtttattattttgaattcctctttcattttgctagcacatttcttgagtacagtaacagggagggtgggggatgcagagacaaattatagaatagaaatcaggtaacatggttcctagtcctactggaaagtcaactgataaaatgaacccaaggaaattacaaactgtgaatatgcaaatctataaatggggttaaaaatgcttattgatatacccacagcttcataagaattatataaattaacatatggaaaaggctttttgaaaaaatagaagataatattcaatagatcattaatactctttataatatattttgctatggtctaagagctctctaaattcccagtacagtccaggttttctagatctctaacttagtaccaaagtctataaaacattgaaaaaattttaaaacaaatatcaaagtgtatacatcaaaatgaagtggtcttttcaaaataatcacctgggaagatgttcgcactactcagaacaattttggaacatttctctgtaaactggtaattaaaatcaatttatgaactaacagaaaaaagactcatgactttggatacctaattcactcaacaaccaactttgttcattcatcttggctctctttagctttttaaaatgggaatgaaatccattcccaatatataaagagtagttactacattacctccccaaataactatttctaatagtcatttggatgaacaagacacagttattaaaaaatcagttacccatccaatcacaactcatttcaagtgacactgataaaccagaaatagaggaaaggaacaaagatatacaatgtttagaaagtaatatgtgaaataagaatatctaaacaactgagattttctttcaaaatgaagaataaaaatagtagtttaagactttggtcaagcatatgaagactctttgaaaaagaagtcagaccgttaattagtcacatctctgcatacaattcaaataggaacggacagtagaaaggatttgtcagggacaagaaaaaatttaggcaaggacatttatataaggtgaggaattttctgtagctatacgcctgcaaacatcttagctaactcatgattattctctaacttgaaatagtcattgtgcaatgctattatttttttctatagtaaaactgtctttcaaaaatattagcttgagtttcaattaatttctcttgaatctagatgttaatctttctatcaagtggagaatgtgtagtcactcaaagacgtaataagtttccatttaatttattctctttgcttataaacaacatttgttgcactagaatcaagatgctttttaaatatgaaaacctcttgaaaataacctttcattaaagtaatttaaaataatgtgataactgacacagcaattagaacatcattgaatggataaactaaaagcatttttttcttatatattattgtgagaatattgagtttccatttttaaaaatatctacttacatattattcttaaagttgtaagtgaaacattcattaaagccaggacacaagaaattgcataatggaaagaaaaaatatttctcttttaaccagttatgtgaaatagttctgattccatttaaaataattttgaatgctgtcaagtatttttactacatttgttaccctctggcctgaaactgaatgatgatgaaataaaaaattagaagttattgaataaatattttccacctacccaatgaaaatttgtaatatagggtgcaaaatttttatcacctaaagacacccgtcagtaaagttgaagcaatgaagcctctgtgtatattatgaccaagagataatatgggtaatgcatccatctgcactcaagtggaaacagtgtcatcgtgctgcttcaattacttctttttctctaattttaataaaataatacatttcctgatcacattaaaaaattccatttagcttgaactagctccatcagagcagctttgattattgttaaaaattgatttggttatctgagttcagcgagtggccgtcatgtgaccatgactttccacagcaaatgcccactatgcttcatctttccgttatatttcaggattttctattaactttagtgacaaacccacgcagaaaagatagaattaaacacacacacacacacacacacacacacacaaacacacacacatccatacaatctcaatgaaggcacaggtcataattgtttgtgaattaactgataagttttgactttctgaatcaaagtccttaaggtaatgaattgtaatggcagtatcattaaattaaattaaattatagaaacctacagtcattcagtgaaaaaagtcatatagtatgtatattttttatctatagaggaaggtgaacattttataatgaaacctatcactgaaagcaactgactcagtctgagctttggttgtaatacaaatccctaaatagtttttcaacagaaattatagtctagtacttgaatactagaaagaagatacaggactcattgggaagataagatctgggactaacagtgaaatcaaaacttaaaaaagccaatgttaatttattaaagttctcccttcaaactgttttgaaggtgaattactagttatttatttatttttctcttcatgaagaaataattggcagtcagaagcaaacttctttttttcagagtagccctcaaaaagatttcaagacctcaagagtttatgaataatttgagaatataatttaacaggaaggtttttataaatatcagtacctgaaatttactgataattttcatctgtccttttcatatttctaatttgcatattctaactaatgaaatcctgtcaaataagattaaaaaatcagggatttcaaagacactgaagttcacttaaataaattagaagtcagttgggttgactgaagaacttataagagcatttacccaggaaggcaagcctgtaatcggttttgaatcttatttctaggccacggtgttacatctggttctgttgtaatagtcattttcactccaaagttgtactaggaaaatgatctggagtacccagattactctctagctaattccttagtttttatattcaggattcattgaagcattttatccattttaaaattatacagatttaagtgtactgcatgatgttttgttatacatatacacactcaaatgatcactacagtcaagccaattaacacatctctcattttacacagcaacattttttttctggtggtaagagtgtctaaaatctactctcttagcaaatatctagtataaaatacaatattattaactagattacttgtgctgtgctttagatctccagacttactcatctgacatgactgcaattttgtatccttgaactgcatctctttgtaaccttcctacttcatgcacccacatatgataactacagttctactctctaagtagtcaactttttttttttttagattccacatataagagagatcatacaacattttcctttctgtgtttggcttatttcatttggcatagtattctctaggttcatttattttgacacaaatggcaggatcttttttacagctgaacaaaactccattgcgtatatatgctgcaatttcttcatcattcatctattgatagacacttaaggttgcttccatatcttggctattgtgaataatactgcacagaatatgggagtacagatctatctaactatctgtctgtctgtctatctatctatctatctatctatctatctatctatctatctatctatctatctgtctatcatctatctatatgtagtgctgatttcatttcctttggggatttacccagaagaaggatcgctaggtcacatcgtagttctgtttttaattttttgaggaacctccatattgttttccataatggctgcaccaatttacattttccccaacaatgaacaaaagttgccctttctttacaccctcatcaacatttgctatttttatcttgtttgataatagttattctaacaggtgtaagataatatctcattgtagttttgatttgcattttcctgaagatcagtgatgttaagcatctattcaaatatctgtgccatttatgtctcctttggtccattatttactcaggttctttactcaaagatatttactcgggttctttattcaaagaatattaacgtctacactcaagacacataactctcattcatttttctatgatttcacattttttttcttcaaagatcctgagtaaaaaattttgaaatcaggttgttttttttttttttttgcttttgaattgtgagagctccttatatattttaaatattaaccccttaaaagacatatggtttgaaaatatttttccaaatccataggaagtcttttcatcttgttgattgcttccttttttgtatagaagttttcagtttgatgtagtcctacttgtttatttttcttttgttgcatgtcctttgatgtcctattcaaacaatcatagccaaggccaatgtctaggagcttttcccctgtgttttcttccaggagttttatgatttcaggtcttatgtttaagtctttaattcattttgagtttgagtttcagctgagcccagtattacgctgaagccaaacccagaaaagggtactataggaaaaaaagtataggccgtatctctgataaacatggttgcaaaaatcttcaccaaagtaataacaaactgaattcaacagcacattaaaagaatcattcaccatgatcaaatagcagtcatcttagagatgtgagaatgattaaacctatgcaaaccaataaatataacaacacattaagagaatgaatcacaaaaaccatacgataatcttaatagatgcagaaaaatcatccgacaaaattgaacatctttcttaataaaaactctcaaaaaattagatatacagggaatgtacttcagtacagtaaaggccatatatcacaagcatgcagctaacatcacagtcaatagtgaaaagttgaaagcttttcttctaatattaagaacaagacaaggatgcccactctcctcatttttactccacatagtactggaagccctagccagattaattaggaagaaaaagaaataaaagcacccaaatcagaaagaaaaagttaaatagactctgtagataccatattatatgtaggaaactcggaagcctccaccaaaaaacagaacagttagaataaatgtattcaataaagctgcaggatacaaaattcacatgcaaaaattagtgatgtttctataaattaacaaaaaattatccaaaaaagaaatcaaagagttaatctcacttacagtagcataaaaataaacacttagcgataaatttaaccaaggaggtgaaagacctgtatactgaaaattataaaacatgaattaaagaaattgaagaaagcacaagtaagtgataagataccctatgttcaaggactggaagaatcaatagtgttaaaatatccatactatccaaagcaatctaaatattcaatagaatccctacaaacattccactggcatttttcataaaaaaaatcactgaagagttttttaaggtaagatgattggatgatttaccattgaaatgttgacatcttgtcaaagcatgttacagaataagatcatagaaataaacagtgccacggagaaatgatacattccaagaaaattcgctcaaaaattttgaagcaaattttgctatgaaaagcaataattgggctgggcatggtggctcactcctttaatcccagtcttttgggaggctgagtgggtggatcacaaggtcagaagatcgagaccatcctggccaacatgttgaaaccccgtctttacaaaaaatacaaaaattagctggatgtggtggcacgcacttgtaatcccagctctactcgggaggctgaggcaggaaaatggcttgaatctgggaggtggagattgcagtgagccgagatcgtgccacggccactgcgctccagcctggcaacagagtgagactctatctcaaaaaaaaaaaaaaaaaaaaaaaaaagaaagaaagaaaaaagaaagaaagaaaagcaataattgcccaataaaatgtaatctgaaaccctaagagacatttcagtttatcaactgtgaggtggaccctatttagctgatgtgattactatgcattgcatgcttatattaaaatagctcacataacctataaatatgtacacctactatgtacccacaaaaattttaagaagtttaaaaaaagtatatgccctttactgatcaattacattatactaaaatatattataaaataattagagataaatgcaatttggttttctcagcactgcttaaactagtagtgaagaagaacccatataatggattttataaataaatttcagtgcatttataatatgggataatatgtgaccactgaaggtagcactatataccgaagtatgttgagatgcaaaatgtattttggtatatcaagtgataataaggttcagtttgattatacatatgaaaataaataaataaaaataaactgtgaggtgatatacaatattttgtgaacttacatttaattcctcaattagcaaaaatttaagcaaatgatgctgtaacctaggttttttcttcaataaaaattttctaggatttacaaccatcattttttaataaaaatattatctttacaatgaagtctgtttttttcccacagcacttatcttatgttaaatataatacacttacatttaacatttattgtatatttttctgtctctgctcacaagaatgtaagcccaataaggtaacagactttagttgtttttttttttaattcacagaaatactctaaatttctacaacaatgctaagaatatatagtagggtctcaatacatatttattaaaaaatgaatgaatgaattattctctgtgatgcatataaagcaataaagaaggtatgcgctatcacacttatgcaacttatgaaaaaaattagctttccattcttgaaatgtcattactcttcttaatgtcagtcatatggcttaatttacaaacatagattcatttggaacagattttgaaattactaatttgagtgtaaatctttattttagcagtgaactcacttaattacataagattttgaaattactaatttgagtgtaaatcttaattttagtagggcactcacttatctacatagtctatacacatgatgaatagtgtatgagaaaaatcagaatcaaaatatttatttatattactatttctacacccattacaggacttctatttctatactctagtgtatcagcaccataacctagatatttaaatcaatttcatttgtctggttatacctgctataaagaattcattttgttggtacacatttcacttgtgaatagaaatcattagaaaggtggatttaataaatattgtaaaaccagagaacagaattcggttgggcaatgagaggcaatgaaaggatgatatgagagaaatgggaggatgatgatcaagaggctaagggctttgagctgtatgaaaaagattcgaactaactgcaagaaagaatttgaggctgggtgcggtggctcatgcctgtctgtaatcccagcactttgggaggccgaggtgggcggatcacgaggtcaggagattgagaccatcctggctaacatagtgaaaccctgtctctactaaaaatacacacacaaaaaaattagccgggcatggtggcgggcacctgtggtcccagctacttgggaggctgaggcaggagaatggtgtgaacccgggaggcggagcttgctgtgagctgagattgcgtcactgcactccagcctgggcaacagtgcgagactccttctcaaaaaaaaaaaaaaaagaaaaaaaaaaaagaatttgatgggaagtaaaaaaaaaaaaagacgaataaaaagaaatactgactagtacccaagccccagcagacattaaacactatgtatttggagtaagcccaattgcagagttacattaatttctctaataatattcaacagcttaaaactatactgaacgaaaggttaggttaacccaagattagggagtggaatgaagtgaaattcagttagaatggaagaaagatggaaatatatattctctaccctccactgaactaccaaactaaaattataaattcaaatatttcccaccttatgaccatcctaagtatatatatatatatatatatatatatatatatatatatatatactgattttaattcatactttagctaatattggttaaaaaaacatgttctggctgagttaaaaatctgactcaagctaatggcagagctgaaaaataatctttaaatttctacagattagattgccagctctctgggcaataaattctcctaggtattttttagctgaaattgtcttgatttcctcttcatttctgaagtaaaaacctatgtgtgaaactttacatttttaacaaaatcatttgggaaccaatattttaatagccagaaagtctctgggctattcccagctagagctaaagagataatgatttcttttataccatgtgaatccttgtatcccctcttcacaattctggtaaaaacaaaacaaaacaaaaaacccataaccaagcacattcatttaacaaactcattcaaccaaaatttactatatttctgttacacaccaagcagtcaatacatggggtaaccaatagcttatgatggggcctggcataaaaagataaatttaggcaaacagatttcctctcttagcagtctgagctgtacacaaaggaatataaatcatcccattataaagacacatgcatatgtatgttcactgcagcactattcacaatagcaaagacatggaatcaacctaaattcccatcaatgatagactggataaagaaaatgtggtacatgtacaccatggaatactattcagccataaaaaggaatgagatcatgtcatttgcagggacctggagggagctggaggccattatccttagcaaggtaatacaggaacggacaaccaaatactgcatgttctcacttagaagtggaaactaaattatgagaacacatgaacacatagaggggaatgacacacactggggcctatgagagggtgaaggatgggaggagggagaggatcaagaaaaataatgagtactaggcttaatacttgggtgataaaataatctctataacaaaccacatgaaaaaagtttacctatgtagcaaacctgcacacgtaccctgaacttaaaataaaagtttaaaaaaagaaatccaagccaatagacagtaagctattgggacatttcatggagaaatgagagctaaaaggctgcaatgtggcgtgggtctaagggtcatgacagccatgtgatagaagttcagaggaggcaagagtaagccatggagagaacaagagtggacagaaatttagtttcttctgaagaagaaatcacatggctcacaaaagagagatggcaaaggtcttgccccaggactgtcccactggttcttgcagttccagttccagggtcctttcatgtccagaatacaataggcttcatgtgcatagtcagtgagtttctgattttccatctaagaggagcctaagtagaaactgacatttgaataattatttcaccattcatttctatgaggacacatagtactctatgtatatttacatactaggatctgcaccctgagcacacatctacacccaggacacataactctcgtttagttttctatgatttcacttttcttctcttcatagaaacttgactctaagaggtaagctatagcctgaacatgtaagctttgagtgggcatggaagacttgcgtattactaatattcccgtcttacaggtcctgtgatggaagacaggcaatatgcccagttggaagagtatttgctttgtggctgtgaaactctagatgggaattctggctccattgctagtcatgtgactgctattaaagacacacctaagactgggtaatttataaaggaaagaggtctaattgactcacagttccacatggctggggaagcctcacaatcatgtggaaggcaaatggtgagcaaagtctcgtcttacatggcggcaggcaagagagcatgtgcaggggaactcccctttataaaaccaccagatctagtgagacttactcactgtcaggaaagcacaggaaagacctgcccccatgatttaactacctcccaccaggtccctcccacaacatatggggattattacaattcaaggtgagatttgaattgtaatctcacacagagccaagccatatcaatcacttttatcctccaagccttagttgatgtcaataaaaaaaaatatttaaaaatttcactctcaagtaggttgtggaaatactatatgtagcagcaattactaccagcacatggtagacagtcaataatctttacttccatgtgtgacttgcccatggtcacatctgacaatgagcaagagtctcttctgaaacccactcataactccattgtatccttcagctcaggtatttctacatgtggatgaaaataaattcaggtgatactcaagcctggatactgttatcttccagattctttttgaagacactgctccatattcttcctttcttcttgatatcctaaggtgccttcttttatcattttctttcttctgaaaaagctttctttagccattcttttggttaaggattcctggcaatacattctcttagtttttcttcagccgagaatgtcttgatttctggctcatttctgaaggatacaggattttgagctgacagttcttgttttagcatttgaaaaatgtcccactttcttccagactccatggcttgtgatgagaaatcccctgttattagaattgtttgtccccaataagtaaggtgtcatcttcctcttgctgttatcgaggttttatctttttcttcagttttcagaaatttgaatatgatggattttggtatggatttctttgaagctgccctctttggaagtctaccttgacctcttgaatctacaggtttatgtcttttgcaaaaattggaatatttttagccattattttttttccattcctgcctttttcacctctcctctgggactctgaggacattagtgttacatcttttgttatagtcccacagttccctgagggctgttttcattcttttcttcagtctttttttctctctgtttttcatattggccaatttctattgccaatttctattgctctatcttctagttcactgattttttcttctgttctcttattttactattgagcacatcagctgagttttatatttaagtgattgcatttttaagtccaaaattttcatctttatatcttctatttctttgatgagactttctgttgtttcatttgtttcaatcatacttgtagttgcttgttaatgcaattttataatggaggcttaaaatatctgacagataattatagtatctctgtcatgttaatgtgggcatctatcaattcttttttatgatccagcctgaggttttcctgggtcttggtatcatgagtaatttttaattgaaatcttgacaattttggtataatattaagagactcttgattttatttaaactttgtttctgctagctttccttggtgtcagtctggcaggggaagtggagaatgccacctccttaatgccagatagaagcccaggtatcttacttggctttcttggacacccgaggggcatggctcctggttactgctgggaggaggtgagaattctggctctccagtaagcctgcactgacacatccctggctaagagatgcaggcacgccttgttgctgctccctacttggccttcactgacaccataagaaggaggaaaggagagtggccttattaccacacggtgatgatgaaggtcctgactctgcactagacctcctctactactactgcagaaggggggaggacggacacctcattactctcaggtgagggtagaagtccaggcttctgatatgggatgggggtgagggctcatttttgcccagtggggatgtgagactgcttggtgagggtggacgtctaagatccctacttgtcctttgcttgcatggatgggtgtagggatggaatatttatccgtggtgttgggtggagcagggaagttatgtctaaaagttctctctcttgctagactgcccctttcctggttctttggctagagagagcaggcttttcatctgtgcctattgttgtttctgggctgttgagcttctttggctccaagtgtgagatgagatatgtgaggaaaaaaatcgcaggaaactcaccactgtgttgtttctcgggtcttgagatccctagccaatctgccttctcttcacctttcagtcttcttatatcatcagttttacatataagggtttttagctgtatacagtgggaggcacagagaaaagtaaatctattccatcttcttggaagcagaagtctgcctccattagctttctaatacatattatttccaccatagattgtaggtatttcatagaacaatgttaattctgattgtcaagttagcaacatgaactatttacactctacccttttgccagagaatatgtgatgccaaactttctgctttccaattaccatcaatgctaagtagtgagaagtcattattaatggagtattaccagagagttcacagttcacagtctagtcatataaaaagcttggtccctaggtcaattcagactacaaaacctgaatgagaaattcttatgctaaaatgtgctgacagtactaagcccatgttgagcaacattatttttaaaaagtatatgaatactttttaatgttctaatttttattattttaggggtattattaagagtacaattcactacatctcacagcatccctttaagaggacaagggaagaaagaagttccctcagctttgtaccacaagaagctgaacaatcaatttattttaatattttaaaagttataaagctaataatttatttctttggctgccaggaatctcaggatcaaatttggtaatgacatagattttcatacccttgatttcattttgtttttcaattgagattttacttttactcagatttcctcatgtattgtttttccaggaggacagtactcattttggtacctgatcttatttatttcaggatcacatgggtgaataaatgtattaagaaaagacagtgggttcgtaagccctcaacaggacaggaaataaacctcaggtctcttcataacttgtcagaggaacttaatacatgctgccattttgatcccaaatggcctccttttcaagaggcccaaaaacgaatctattttttttttgtcacataacttacattgcatttgtgagatggagatttttaaaagggacagacaaacacaatgactacctggaggacggaagcaccactatggagaaactgaagaccactttcagcagagtcaattccaccagtagccaaaatgggaaatccaggcagagcacgagcaatggaggtcacagctctcaaagcaataggtctgattgctgtccctacacaaaatcagaataatcaatggttagcacactgaccacttgagtatactgtcttatattacttctattactatgatgtgatgacagcgtcactggacaaatttcaaattactttatctctgtttaagatgtatatacatatgtagtgtataaatgttatgttttaaagcatgttaatttgttaatggatgtttatttattttaaggactttgataccaatattgaatttagacatgttatacaagtaggtatagcaaacacagaattctctgtgcacacatattacatgcatattacaattggatatacagtaatgtgtaaaagattgcatagaatatttgagcatcagtggctcacgcctgtaatcctagcactttgggaggccgaggtgggtggatcacctgaggtcaggagtttgagactagcctggccaacatggtgaaatcccatggctactaaaaatacaaaaataaacattaaccaggcgtggtggcaggctcctgtaatcccagctacttgggaggctgaggcaggaaaactgcttgaatccacgaggcggaggttgcagtgagccgagatcacaccattgcactccagcctgggtgacagagtgagactctgtctcaaaaacaaacaaacaaacaaaaaacaaggaacagcagattttgaaaagaaaaacaatcccatatagtacatcagtagacatacagctatgttatgtttctttagagtacaaagcagatgttgcgaacatagactctgtaaaaaaaggcaaggtgctgatgaacttacagattccatgttgctttttatatgtacttcccacaatttgaaaaaaaatagggagtctaatccaatttttcacatattagaaagttttaatcaagttaaagagaatttactagaatccagtaattagagtgtatgaatttaattttttaatatttaattagccagacattaccagtatattattccctaatagtaataaaaattgtatggatagaaagaatactttggggctattttaaaaatgagtatattgtactaaagctactttgaattctcaaatgttaaacatcccagagtacattaatgctttcataataaaggaatataatttgatattcctggtgttcccttataagtcaggggtcctttaagcattttctgaactaaaggcagttcaacttatgcaagaatttgacactgccttaaaccagggcttcacaaacaacataaacaaataactggttcagcctcacgtggtgagttctttgtcatcacctccaccaccactagtcaccagcaatatcaatatgtatttactggagtgcttactctgaggtagcacacacagccttcctttaaaaaatggccagaacttaaaattaaattaaattaaaaaataaaataaaataattaaataagaaaagaaacaaaaagttaaagggctttcaatttgaaaaggctagatagcatatgattccaactatatgacattctggaaaaggaaaaactgtggagacagtgaaaatatcagtggtagtaaggagcgaacgggagggataaataggcagagcaaagaggatttttaggacagtgaaaatactatatatactataatggtggatgcatgttgttatacatttacacacacacacacaaaacacacttagagaatgtatctgttacactcatagaatgcccaacaccaagtgtgaaacctattgtaaagttcggactttgggtggttaggctataggtgtcaatgcacgttcatggattacaacaaatgtatcactctagtggggaatgttgataatgagggaggtcatgcatgtgttggagcagtggatatattgagtatctctgtatcttcctctcaattttgctgtgaatctaaactgctctaaaaaataaagtctaaaacagaggctgggagtggtggctcacgcctataatcctagcactttgggaggccgaggcagagggatcacctgaggtcagaagtttgagaccagcctggccaacagtttgagaccagcctggccaacatggtaaaaccccgtgtctacaaacaaatacaaaaattatctggacttggtggcgggcgcctgtaatcccagctacccaggaggctgaggcaggagaattgctggaacccaggaggtggaggctgcagtgagccgagattgcgccattgccctccagcctgggcaacaagagcaagattctgtctcaaaaaaaaaaaaaaaaaaaaaaaaaaaaaaatcggtggctttctttttatcctgttcatatctgtttcagataaaattgaacgtttgcatgactactgcttttgtactcaacacaaaaatgtttgtggaaatgtctacttgtggctcccacacctcaaacatcttcctctacatattactatagcattccttagttaggaatattcaatgctgacacttcaaaattcataatagacattttggatacaaagtattaagttgggcaaattagaaaccggacattaagattctacttctatattatttatcagtgattcctcacagtttttatgttttaaccataaaaaggctaatagtggacagaatttatagtgagaatacaaaaacacacatatatatacacatatcttcagttatactaaaagaaatctacataacaaaagttaaaggaaagcattttttaaggaaagctgtaacaaactttttgatagacacacagctatctctgcataatataactggcatagccaatacataccaacccaatggcttctttacatacacactactttgaagtaataaagaaatattggtttttttcctcccttatttagttgacccaagagagtaaatttgagctaagtagataaataatttatttctacctccactgttagaagactatcattaacagtaaggggtaaaatttcaaagtggtatacagggatttggccacatattctattgatattaatggacataaaaaggcaacacagctttgaaaaattaaccagtgacacttaaagggcaacattattacacaggtgttaaaaaaatcagcaaattcttattggcatttgaagatgttcaattaggtcaataagacattttccaatttatgcttttcttcctttctaacgcttttataatgtacctaatgaacagaaaatcttttcaaaaaataagagtattttttcaagttaagagtaactatgttctctgaggaaatgagatccaaaaaatgaagaaatgatctctctgttgctggactacagtaaattcagtttttatttccattataaacccagtttgattttttataactcaactgatttaatacaaaatataatctacctgttctcagcatttttatggggaatagttcttaagaatgacttcatccactaagaacggtttctagaaggaaaatgaaggtatataaaaagatctttctaaattgctatgtagaatttatttttagttttaaaatgacagaaatgaagtaataataggttcaagataaaaataaaactgttggtttaaagaaaatacatatatcaatgccatacaaaattgtacatatgccaattaaaatcataaagacttcctgaattacaattatcgagataaaggtcttttaaaattttgtcactgctacagtgattaatgattttagaccaaagactagggaggaagaagccagtgtgagaagttcaaagaatgtgtatgcgggctctatctttaaggaaacaacaaggtttaaatcaagaaattgaaatcctatacacttaattgaactaacaggtaacatgcaatttaaattaagccctcatctacatggggtggccagatgaacctaatggggaattcagttacatcaagccattctgcttcaactgtgtggaatcctccaataaaaatcaagccattctgagttcccacgttttgaaacaagctgcaggttcgaacaaacaaacgaaaaatgaactggacttatgagttgcaacattgctaccaagaactttgctttgcattatgtggctcttgtggtggactagactgaactgtaacttttggtcaataatcattctaggccctccatgtagtcataatttaaaatacaaatcagtgtgttgaattcatagattgtcttagataaactacacagaacattcttgaattgattcatgtttcagaaaaacattttagtaagccagagattttgaattaagttaatcaatctgattttgatgaaaagtatttttcttaagaaaatgaactctcatttgtcagatatcattttaaatacaatttcagaaatgctatcattggctataatattatatattgatatatgtgtattaatgtattatgacaatcaggttccttactcagtcttcatttatccattcatctgtctatccacaaaatattttttaagcacctatggctttttttttcctggttcatcagtttgtgtcctaactatatatctacgcttgactcacaaaacaccaggtcttatcattgtagtaggttatttcaagttaataatttgaatccagttattcattctctaccagtattccattagaaacaattcacatttgttagaacattatacattttataaatactattaatatgaattctatcaagaaggcaatttgaggatgaactagttaccaacatcagagagacaactgggccaactgttgaggttcaaatcttagttccatttataagctgtgtgactttgtgaaaatttttaaatcccaccgaatctcaattttgtcatctataaaataataaaaattgtaataacgtcttcatagagctgttttgaagaataaattacataatatatataaaaggcgaggacataataaaaattgtagaagtgtttgctgttataatttgtactgccctcaaggacaattgatttcagagtgagcatttatgtagtttactttgacattgccttctatgttcttgtgtgtttagtgatgcaattaaaaccaatttttaaattggagacaaaagcatgatgcctatgatgacagaactttatcctctgaaaccttaagaggaccatacatgtcccctcctttttctcttttcctaacagctgtcatttagcagtgtcataatgttgatgaagattactttgaccccaaaggaaaaaaagcctcaaaaggctgacatcaatatatttaagattttttttttttgagaagcaaaatgtccatggattttaattacaatatctgaactcaagtttattggtgaaaaggaggcagagatgtacttcgcatgactaaatccttgaagaaaaaaggaatttttaatgagcaagagagtgtggaacatatgctaaataactggaattttgaataattgagtttaattctgtttgtctttctccccctaatcatttgactcctctaggacagcgactgttacacaattaattgttagaactaagtccacaataaactccctgataatagctctagctggcaataaaacagaaattgggttataatactcattcgtgctcactgtgtatgcaaaaagaaaatgtagttttaatttgcttacattaattaaaatataatgaattaagtggataacaaattcattagaaattgaaccttgactgtctaattgttaacagttttaacaccatccagaagaaaaaaaattagtaaatcaagaatttcaaggatttaggaggtgagagattgatttttataacctacatataaatgaaccaccaacaaatttatgctttactaaaattaagtgtacaatgttaatgaagttaatatactaataaatacatgggacacacctatttaaaaataacatctttacacatggattagggtcctctgagaatatttgcataattcaatcagaaactgaagtactaaaaggatctagggttatatgtagagatgtgtaatttaaagagaagaaatggaaaaaataaagttgattatttgatgttattttagttttttcagaaaagctaaaaatttcttctgaaaatgttttaattttagttgaattttttatgttttctccaagtcttcctatcttcatagctatgtttttctgcttcataatgcattcaatatgttcctagtggattcatattaaataactcagtacctagcatgtgtcaggcatttatttttaccaagagaattaataacattcaccaaagagggccattctcctttctgaaagtgtcagctactgttactggaatgagtaggatcactcattcatagagtgatttccacgtgcagacactgaggcaggggcttcatgtacactgtgtactttaacccttgtaactctgaagctaggtgctgtcctctctattttgtacataaaggaagagaagctcaagctgaataaataacttatccagtgtcacgtagtttaaaaaggatgtaatacattaaaaataaagtctctgcgacatgaaagttcccattttcagttattattgagaagtgacaatgcagcaattaccaaaagaaccatctctggattatttttgcctaagaaaactagtatcagtacagactgatgctatgagaacacagaggaagtccaaccaattaggtgtaagtctcaaaccatttgctttatacaattgtagctttgagcaagctcctcaacttcctaaaacattggttttccctaattaaaaaacaaggacattaatactaataatattccagggagtttggatgtattagatgatacaactcatgggaaagacttggcacagtgcctagcttataatgtgtataagctaatattagtgtcaaagccagagaaaattgatcagaaaaataaacattcagctataacacatataaggataaacacttaatttttaagggttgttaatattcattcctagatataacatttggggttccttttgtaacccatatattatttcattggcttcaaaattatgaatattcatagcttgagtctatggtagtaaatgtgtgtatctgtgtgaataaatctttattagatttttaagtgtaatttgcaacgtgtgtgtgcgtgtgtatatatatatatatatatatatatatatatatatatatatatatatcttctaagtcttttttgaagaatctgttccattagtgcttagacacaaagttacatatacaacaatgttcctggaagtattactttctatagaaaaaccgtagaaaacaatctaaaggatcatgagtagttactctattaaataaattatagttcaccaagatatgatattccagaaaacctttaaaattgacacgcaaatagctctaatttataatgttaagagttaatcacaagtagcagagcaatatatatggtatgctcccattgttggcaaaaaagtatgtgattacatttagtatgtgtgcatgtaaatgcatataatgttgaatttcatactgttcacaggtatcatctctgggaaagggggtgagtcctgcagtaaagggattgaagacctttcaagtttatatatatatactttttattgttggattctttttgataaaatggtgttataatttacttctgtagtaaaaatatctatttttataatgttcctaaaattcaccttacgagaataagcatcatcagtatatatgatgtgacatttttatatatgagtgatacatacagtgattctatcctctgtacattacaaagaacatgtttggttctgtgtccaatattttagataaaagatctacaaacacaacagagtgaataggatgatctctcttgatctgtctttctcacacacatatcatatatatctatatagtgattaaaagaaatcctataaatggtcatcaaatatttgaaggataatcatgaaaaaaagggcttatcctatgtagcaaattggaacgaacaattcagcatacacgattggttttattattcttatttttataattaatttattgtaaattcagcaatgaaagcagctacaatggaacttccctattccttgaatcttgatggctacttgacagcaagatgcaacagaaagacttctctgtactacaggaaatattggattagtttttctcttccaattcaaaatctggggatactataacttattcttggtagtttaagagcaattttatatgctctatagttttccaacagataccagtgattaacttagaaaagaagcaagtatgagttaacttttaagattaaatatgttaaatataaatgctcctcttttgagtgctttctaattgacagatagtttcctatttatttttgcatacattgtgctggtcacattactatgaaatagatatttctgtctctatttttatagatgtgtaaactgagattcagcagggataaatgccacatcctcaagatcactctgttagaaagtatgggtccagtatttgaatccaggcctacctgactcccaacaccatgctcttaaccacaatgctatgctgcttcctgattttaagtgtctggatataaattaagctttagaaagaagagttaataataataattgttataattaataaagatatattatccaggtatgataaaaccataaaaatcaacattatagaaaaatagacattatattaattgttggataaaaattaaattagaagtagaatagctagtaattgtataactagagtaaccatatagcccagtttgcccaagagagtcccagtttattatacctgtatttatttgtaattacataatgtaacaatagctatcttcctttggtctaaaagtatcccagttcagatgataaattataaaatcatactagctataactaaagataattatgtccaagaataataggacaaagacaattacagaagcaaagtgaaatttgttttagaaccaaaaccaaatttatgaggagcttagaaactcactatactgtccaagactcaaaagatggcatgaagagctaaatgtctttaaatttgtcactagagagaaaaatatatggcatttactaggcataattagtctatatgtatgttctttctattttcaacctgtaggtggccaccacaagctacacttattaaacaactcattagtagcattttcaatactgtcatcttcagataattagcaatttatttaaataaccaatttctgtagaaataattgccatgaaatgccctgaacctactttttataaactataataaaagtgttaagataatccctgacatttgcaaatgccattagttcacctttccttttgatagtgctatggcattatgtttaaacaattacccgacaacacagcagtttaatgaaacagtacagtgagcacattcttcaatatggccagagaggacattcagatttagaaagaaatccagtgcgcagagaggtttacccagaggaaaaacacagctaaaagaaaaagaattactgaattaaggacattattgctatttccaagttggtttagtttccatggtagatgccgtatcatatgtactctctttggaaacaagaaaggagagttttacaagttgatttatgtgataggctggtgtgaactataatcatatatatctacgaatatgtataataccttcattgtattatttgctctaaaaccttgatgcaggaacaagtagtaaatttttcttactatcaaccttaaatgtacttttactttaaaaatggtgtgcactttcaaagtagagttattgaggaaacgcacaaatggttttacatcgcagctagtatttatcatttaaaatagaccagagttctaactcagtttcttccttgctattcagttccttatactactaagatccattgatgtgggattatacagtgtgtcttggttgcgagtggtaaaactatttgaagcctttataatttttaagctggtgtccacttcatatgaaaaaataaaattagaattcaaagccagtggcaatattatttttatggttagactgaaataacttgagaacctattaagtaccagttgctctgctaaattattcactcgttatttatatcctcacgacatcattacaagtcacatatacattatctccattttacagacatggaaattcaggctcaaggaattaaatagtatgtgcatgtaagaaaggcagggccgtgtggttagataatgcattacaacaataagacaattagtctgcaatatcaccataaaattcactgccgggtttgaatgtgaggacttttctttatttccagattaacacatgcctcaatctctccaaataagagcttctggcaatgctttttgcctacaattttaaaggtttacctataagtataaatagaagaactatttaaaaaagacatatttccccagccaagaaattattctcacctatgacagacttagtggacttgaagtaatatttctcatgtgattttgcttaaggatgtccagagcaaatgttacacagcataaaaatctcaccattctatgtgttttcaaaaatgattatttgagtaggagaaggaggaagattataatgacaatgataatgccgatgaccggagtttcattttactcttgggagaatccaggataacaagtgggcattattctgagaacatacagaaaaataaaaaagaggttccacatccattaggatcctattacttcttcctttggaaaatcacaatttcttttctctctgaaatcctgtgctctgtttactctgtgggtggttctatggccagggtgtccatggcagcacttgctgtactgtaaaaccattcctttcactctcagcaacacattctctttcactttacaaagaattacatgtgttaatctctatgctctgtgataaggctgtgtccctcagagtctactgaaacacaggctgtacagcagttgatggcgttttgttctcttctttggcctgtacaactctcaaagatgtggtgtggacaaggacatctctacctgggcccttatctgaaccctctgaatcaatgctcactctaaaactgaccaggcactttgaaaaagagagatcctactgtttagttgctctatcaattagttgacaataacatttcttcctaaatttcaatagggtaaaaaatgaaaaatcattttcagtcaaaattatttcttgtacccagcaccatggctgttgctcaaaggcagcagaagagatgtctcttctcagcaagcttataaggctgggtcaatgagataaaaaacatggacaacccatgttcacatgcccaattttgtgggtcagacaacagacactgctgaaacttagaagacaaggagagccaggaaatctgaggtggtctaggaaggctttgaggaagatgcaggacttacttcagttgggctcttgaaagataagtgggtaggtctggggctaaaaattaggatatttcaaactgtggcagagtttgggaacaaggtgagaaaaatttcagatatagtaatgaacaaatcatatttataaaacacgttaacagcaaaactaaagtagcctctcaggttgggaaatggtatacagtgcattacatagtgtagggatgttgcctcgtaggcaggaaaacagcctacccccagctctcgcagctaccaatatcaatttctatatggcattttactttttaaaatgcattaaaaaatattgacctagtataagaataaacaggtttaaatttaaacaaaatatcaagtaagggaagttcaaagctatttattgttaataaaaataatattcctattttaatagcaattgttaattattaataaattaataaatattgctatttactgccaataaaaatatttctcaggggacactaaagagaatctgtactctttatacatgtccctgtctgcagcctttctagagatcataaagttctttctagtctgatgaaaagtaatattaggatttttatcaaacagaagggataagaactacaactagaataatatgatccactttttcataatatagagagcttatataatggaagagaacaagtgttccactccattcaaccattcagtaactattgccagtaatgtgaattatcattttcacagatgcatctatacttttaacaaacatcataaatagtgcaggaatctgtagcatgtattaaaaagagcatatgatcaaaaaactaggaaaggaaaaagaacttaagactacattatttcagacaagatctcctaaagtattacctaaaggaactgtaatactaccctagagcatgaggatatggagcaatctggcaacctctcttaacataccacaagtcagctacttgccaaaaatgggaagctagtttcaagctgtgcatatctgtgtggcccctgagacccctgatgtttcagggctttggactacaagctgaggatgtgcctcaaccaaatggatgataaaaactagtagtgatttgtatagccactgagtaggcatgaatttctaatgtatctaatacagaaccaaatagaataaaatagaataatctatgtaaagcaggcagcacagtgacaagcacatagtaaatgctttaaaaatgccatcactacagtttctaaaaatataaaaggataataatagaacaatatgagcaatgtcatacaataaactcaacagttgaagtgaaatgcacaaattccatgcaaaacacaactaaccaaaattgagacaacaaaaaacagaaagtcaaaattaaaaatagatccataactattgcacaagttgaattcataataaaaaacattttcacaaagcaaactgcaagcccagatggcttcgctggtaaattctattaaactaaaggaaggaataataccgatcttacacaaactcttgtagaagatagaggaagaatgagccaatctcaactcattttataaagccagtataatcttgatattgaaacctgacaaataaactaaaggaaaataaaattatagaccaatatccatagactcaaatatctgtattaaataaattcagcaatatataaaaggtgtaaagcatcatgatcaaatacagtttatcccaggaatatgaaggtaatttgatatggtttggctgtgtccccacccaaatctcatcttgaattgttaactcccacacttcccacgtgttgtgggaggaacccagtgggaggtgattggattatgggggcgggtctttcctgcgctgttcttgtgatagtgaatgagatctgatggttttaaaaacaggagttgccttgcacaagctctctttttgcctgctgccatccatgtaagatgtgattgctcctccttgccttccaccatgattgcaaggcctccccagccacatggaactgtgagtccaattaaacctctttctttggaaattgcccagtctgatgtatgtctttattagcagtgtgaaaatggactaatacatggtttaacatttgaaaatcaattaatgtaattcaccaatcaactgaataaaagagaaaagacatatgagtatctcaaaagggtacagaaagtgtacacaggaaaatctgaaatccatccgtgatgagaactgtaagcaaaacaagggtgagactatcctcaatctgacaaagaacatctataaaaaaacctatagctaaaatcagactttatgttaaaaaattctttctctatatactcttcatactttctatatactctattccatatactcacaagaagcaattagaaagttaaaaaatagtattcacaatagcaccaaaaagcaacaataggagtacatttagaaaagatatgtaagatctgtacactaaaaatattttgtaaaatatttctgagaaaaattcatgatacttcagaaaataaagagacatactaatcatagacttgttgactcaatactgttaagatgttaaacttcaccaaattgatctgtagattcaacacaactcaaaacaaaaatccaaaaaggtttctttgaagaaactgataagctgattcttaacattatttaaaaatacaaaggatgtagattagcaaaaacaatcaggaaagaaaataactcaaggacacgatttcattttaggacttgctttaaatttatagtaataaagacaatggcattagaatatacgacaaataagtgaaagagaacggagtcctgatatagtcccacaggtaaggccaattaatttttgaccaaggcaggaagtcagttcaatgaggggaaaaaagccattctaacaaatggtgtgagaaaagcaggatatttttaagaggaaggggggagaaaagaaaagaaaagaaaggaaaaaaatgaaaccatggcctctacctcacttcatatacagtttttttaaagattcaagatgaattgtaaatctaaatgtaaaacttgaaaccataaagttcctagggagaagaaaaggagaatatttctgtaaccctgaattaggcaaaaatttcatggaaaggatgttaaaagcaacgactaatttaaaaaaaaaattgataaactggacacttgaacaaaatacatcattaagaaaataaagaagccaaagtctagaaaaaaatatattcacacacatatattttaaaacgaactcatatgtaaaatacatgaagaactagaaaccaacagttaaaagattacaatagacaaaatacttgaacaatactttttaaaaagacatacaaatgatcaataaatacataaaaaagtgttccacatcagggaactcgaaattaaaatcaccatgagacaccattttaggcccacaggaatggctaaaaatccaaaagactgataacaccaaatgttgataacaatgtggaacaaaacgaactctcacatgctgctggaaggagtataaaatgataaatcacggccaggcatggtggctcacgcctgtaatcccagcactttgggaggccaaggcgggcggatcacgaggtcaggagttggagaacagtctggccaacatagtgaaaccctgtctctataaaaacacaaaaaataagccgggtgtggtggtgtgtgcctgtaatcccagctactcaggaagctgaggcaggagaatcgcgtgaacatgggagacggaggttgcagtgagccgagatcacgccattgcaccccagcccaggcaacaatgcaagactccatctcaaaaaaataaaaaataaaaataaataaataaataaagataaatcactttggataattgtttgacagtttctttaaaaaatgacatacatctatcctatcacccagcaatttctttcctagatattcactcaacagtgaaaacagaactaaaaaagtatatgtacaaaaatgttcatgacagccttacccataacagctcaaaactggaaacaactgaaatatccatcaattggagaatgaataaacacattttggtcaatcagtagaatgtaaactactagcaataaaaatgaaatttctactgatgtatgtgacaatattattttaaaaattatattgaacgtaaatgaggccagacatgtcccctactcacacacacatggaagtagcagggaagaaaggtaagaaagagaaagagagaatagaatgaatattatttagtttatatgaagttttagtacagataaaaagagtctatggtggtataagtctcagctggagatggagaaattgactagcaagcaacccaagagaactttctggtgtgaaggaaatatcctctgtcttgtttcagattgtgttactacagatgtgcatcattttgaaagctaacttatctgaacatatatcatatctgtgtattatattgtatttaactatactccattaaaaataaaaatatatgaatacataaataagaagtagcaaaatgtccatctcaaaagtgagcatctcctatatgaatccacttctaaaaaattcttttgatggtcagaatctttcaaatacttaattttatgaaatatgaggacatcttcccatttgcaaatagaaaatgaatctgtggcagggcacggtggctcatgtctgtaattccagcacttggggaggccaaggcaggtggatgacctgaggtcaggagttcgagaccagcctggccgacatggtgaaaacccatctccagtaaaaatacaaaatcagttggtcatggtggcaggcgcctctccagcaacttggaaggctgaggcaggagaatcgcttgaatctgggaggcggaggttgcagtgagccgagattgcgccattgcactccagcctggccaacaagagtgaaactctgtctaaaaaaaaaaaaaaaaaaaaaagaaagaaaaaaagaaaaaaaatgaatctgtgagcttatattttaaaggtgaatgggactgaagatcatcatctacagtacatcatgtaaggtaaatcaatgtcaacttagatgacccagtgagagcaatttttatggtggtgttgctcttgttaatgttcgtaatctccatgaaattttcttgagagcaatgcttttaaagaagccacatatatcacatataagcacgtacacacaaacatacacatacacacacacacattgtcagtgataaatcactagttactaagaataaggacacatggagtacaaaatgatgagcatataaagacaggtattacggctagactatacctctaaatcgtaactcttgaattagccaggcatgctaaaaatcactctatttagaaaggcacagcttcaatgaaccaaagaagcagtttggccctttgctgactgtagtgctaagtgagaccccagagccaaatttcaaaaaatgccatcaactgatcacaagtattgttaacatataatgagaatgtctgtttctgcactttatgcccaaattggtatttgagtatatctttacctctccaaaacgagagaggagtcactcaagggtgttattcctattaaaaccttgtagtcataaacttaacttcccagacaaatctttaaggaatatttggctcatagttatgtcaagtctatggtggatttgtaatgaagtatcctttctctatttgctattttttcaatctttaatgttttctgatgaaatttcaggctcttgtcaaattgaggtcattactttgtctactggcatggatatgcaggcaaattggccagtgtgcaaccctggatgactcaacttattgccaaatggcagttagctaacttccatttgcaagaagaggagacagcctattgtcaggaccaacttggtggggaaaggatatatagtctgtgtctaatgcacatatctaagcaaaatgtgatgcatatatttttccacattcgtagatgctctttcttgtttttttccaatttatattgttgacataagtgtctcatcgtccaaatgcttaaattgtgtataataattccaaacagcattcgaccattcagatttgggcattgggcatcacagatatgttaaatctagttacagaggcagagctagagcatggtttccatgccttgaggggagagacatttttcagtaacctttgccaaaaccgctatatactgtttttctcaacagagctcagagactcattgtaattgtgtagaagtcaacagaaatcatattaaactataacactttcaaattttttcaagtatatttgcaatccagtgtaaatagggccaatggtcacaatgtatatatttttggaacactaatatttgttttactctaggcaagtgttttcacaggtagtaactggtatgaaaaagatctgctttcactctagaagattatttattcataaacttcgaaatacaaatcataagactcccagaattctaatttactaaatgctgaatatattatgaagcagttcttaaaatttaaaatttgaaaatggaaatgtattgaaaaagtttcagaaaaaaatgatgtatttcccatatccagcacaaactgaactagagaaacatattatgattgccaaaaaacgggctatcactctaaaggctgtaggcaaacaaaatactaacaagtttaattattcacaatggcacatttatggagagtataatgtcacaatcaatgattacaagcccacacaaatagcactgtaataatcctacaaggcgtgttcagaagtgaaataatttagaatttgaaatcaatagcatttatagacattggaaaatgtcaaatggaaaacgaatgccagtatttgtattctttctggagcatttttacttctcagcttttaattattctttaaaagattttttagtatctgaaagcaaaagcaaacatttccctttcatgtctcaactaactctttcaataaacttagatatgtgagggtattgttttatgtatggaaaaatgagaagtctttgtgagagctaaggttttgctaagtgtttccctttaatttcccttctcgtggcatcgttcccttgtgccattctcatcctccatctcacaatgtttttgttccattcatttcccatcactattagcatttaaattccggttttggcacaaaaactttccaacacaaggtattactttgacaaattcttaaaatactccttgtaattagagacagggtaaattggatgagaagtatatagggattctctccactatcttttcaacttttctgtaagtctaaaatcattaaaaaataaacctttatttttaaaagtttcccctatataacacttggattcttcttgctcttataaaaatatcagtttacctatattatttgggaaaaacaaggacacaaacttgtgaatattgaaaataattcttaaaaatataacattcatagctattttaattaattgccatttcctagcaaggaataatagcaataacaataactatcctttgttgaatgaactaaatatgcacacagaactctattaaggcttttattaatattacttaagttactttatctaaatctcacagaatctccaggagctatcactttttatgctaaaaattgttaaatatcttgtctttataagagtaactggaaggtctcagattctacccaaatatgttgactcccaaactagggccgtttttcacaaacattttgccttccttcaataagttgatatttgtatgtacctattggctctaggcattgcactgtacatatactttttatatatatacttatttgtatgaatgctcaaaaataaccctgcaacaagttgctattaattctaaaaacgaaaggaaaaatcctgacattttctagtaaaagctgttctagttacgaaagcatttaactgtcaactctggtctttgctgacacttttttagatttctgaaaaaaaaactgtatttaaccatttgtccattaatggagtgatgtccaatcaccttatgtaccatcaaattacctatcaacagaaagagaaagagaagaaaatttaatttcaggttactccagaaactatggcaaccaggctgtttggcagccaaagggtgtaaaatccagattagatagatggatgtatttacatattcacttttacattaaacagagtggatgacacatccctgtataaaacctattatttaaaaacttcaagtgaaaactgttaaaataaatggctcatgacttatgaagtgttaaaataaacgtttatttcaacactatacatgtcataagccatttatttcaacactccctacttcagaagacttacccaaaacaagaagaaaagatctcacttgctaagtgtatgtcaagaggccaagacgcagaagataaaaccgaagttttgatgctagagctttggtatgtggaagttcagatcagaaggtggaagaggaggtttgatgcttaacacctggtaaaagctctgtggttgtggtaaactgttcatcatcaccacctacattggcttcatttagacatcacgtttatcttaagtcattctgagagtttagggcatgcctgagtatcaaattatgaatgaaatgcactgtttgaggtgtttctgcaaagataatatatgttttattttatgtccccacttattagagaaggctcatgtaatcaaagtcttcagggagcaaagcttcagggacaaaggcccagtttcataagcataagtgcatacacttatacagcacttcctatatgacaagctctagtgtaagtgttatacaaatattaagtaatttaatcttcacagtgtttaggagggtgatatggtttagctgtgttcccacccaaatttcatcttgtattcccacatgttgtgggagggacccagtgggaggtaattaaatcatgtgggcaggtctttccctgctattctcatgatagtaagtctcatgagatctgatggttttataaagaggagttcccctgcacaagttctctctctttgcctgctgccattcatgtaagttgtgacttgctcctctttgccttctgtcatgattgtgaggcttccccagccatgtggaactgtaagtccattaaacctccttcttttgtaaattgtccaatcttgggtatgtctttatcagcaatatgaaaacagactaatacagaggggtaggtatttttatttttgccgtttttttttttcagatgggaaaacaaatctagagtggctgagtaatctaaccaggggaaactggtaagtggtggcaccaggattttaccccaagcagttagcgccagagtccacgttccttatccctatgctaggttgctgactttcagcagcagaacagcagactatctcatgctctagaagtcatgtgggcttgagaagtcaagttcatcatttcattttcgggcagggctagcccaaatgggtgacaatttctctcctttataaacaagatctcctagatgaaaagaattaatgctatttctataagaaattagtattgactgatgactgatgatagttgattatgacagctttcagttttgcctattttaagactttatgttcctaccaaaagttgaaggcctatggttgaagtgggaacgtctgacagtgactgaattatttccctccaggatgtcttttattgcccgctaataaaagcgctagtaaaacatttccattgttaagcatacccaataatagcagtctttatattctgaaacaatgctgtatagctcccaagcttctctctccctcccttcctcatccttccttctctctttcttttatatttccctcttgatatggtttggctgtgtcccccctcaaatttcatcttgaattgtagcttccacaattcccatgtgttgtgggagggacccggtgggaggtaactgaatcatgggggtgtgtctttctcatgctcttctcatgataatgaataagtctcatgagatctgatggtttcataaggaggagtttccctgcataagctctctctttgcctgctgttatccacgttaagatgtgacttgctcctccttgccttccaccatgattgtgaggcctccccagccatgtggaactgtgagtccattaaacctctttcctgtataaattatccagtctcaggtatatctttattagcagtgtgagaacagactaatacacttcctcttatttctctaacatctcttctttcctttatctcccatctttaccttacctctcccctctcctcagacaccttagcactaagaacaaaattaagtgtggattgcttaaagtccctcagtctttataattttataaatctgtcaatagttggaacatatgatgtaaaatcatgtagtctatctgtaatacatatccttgtccacaaaccagactttaaaatatctacacccttcctctgcccacccaccttcccacttcacactacgcaatgattaccaacaagttcctttggaaatcacaaagccaaaaattggtaaaaagaaatcagaagactcagtgcactgtgacatacaaaaaacaatgtgcttttaacataccacaatggaaagaaaaattctgagtttttttgattagaacatttggcatttgaaagaagaaaactaaattattataaaattatggaatgtactcaacaaaaaagtgacataattaaaaaaataataggttggataatatgaaaatatactatatactcacctatttataaaatctctatatttgatatcttgttattagaatccaaactactccaactagtaaaacattcagatgtatttatactacataaatgagacctatatttttataagtgacacctgaaatgtattttctgagagcatattttgatatttactactggtactaaagtaaaagtacatatacatacgtatatatatatatatatagagagagagaaagagagagagagcacgtgagttatgtaaatatacatataccatatctctatatagtgtgcatatgtatatgtgtgtgtatatatgtatacgtatatatatatttgtgtatgtatatgtgtatatatatggtacaagtatatcttcccagctattttttcaatttaaaaaaagtttcataccatcaatttgaaaaaattctaaatttaaaattaatttttatacaaatttaaactagacattaaaaaccaaatattttcattcattaaataagtagacatttattgaatgccagctatgaagcagctattatgtttggagctggtgacataaataggagttagacattatccctgtctttaagaaatgtacactctagctaaatgaatatataaataacttattataatgtatgttaatgactccagtaaaccttagaaaatgatcatgacaaatcagagaaaagtgtattgtactttgtctagttgggtcatctttacttgaagatgaaatatgaactatgtcttaaaggataactagcattttgaatgcagagaaggaatggagggaatcacagataacggcatgagcaaaaggatacagatctggctggaatgttaggtgtgtcgtagggcctagagtaaagatggattaggagggagaggaaggagacaaggctagatggagagtggggcagatatttctgggacacacactacagcctccttgaccacctctaattcaacagcagctcttctagtcagttccatgtcagctctgactgaccccaagaaaacagagccccacttcatgctttgctaaacttctttgtaccccctgtcccagggcctctcctgccaccacaagagcctactaagcctgtgcttccaagccacaaaagtacaggcaagtgaataaatactttcagggacagcccttaggctgctcccgccttccatccttcagggggacaattctataaggcttctgcacactttctaggagttcataattgtgatctaaaagtgatacctgcttaagttgacttttgctccttctttgtctcatatttcctcctccctgatgtctatttcccaagatcaactcccaaataggccactttcatccaagtccttgtcttcaggctttgcttttgtaagaactcaaactaaggcagagatgcaatgaggcctgtttgtgaagggtcctatactctgcattcagcattctggacagtttcttacagaagtgagagggcctctgagaattttgagcaaggtagttaccagataagattgtattttggactttgtatatgatggtggtgttgcataaggaccagaaggacaagaaagtgaaagtgattagcagatggtcatttaagaattgtctataaacacaagggcttggactaagtcaagcctatataagatagaaaatgacataaaagatttcattcacattcggagatggactatataaaaccttgtgactaattagaaatgcagagtaaaagggtcaacagtgtcaagaggactcaggttaatgccatttactgtgataatttttaaagtatttagaggataacaaatttgagtttgggtaaatacctgaggctaactggatggaaaacagctgagctacttaaaaacatgaaatataacctattacttatgttttggtttgccatgcatggtatctccagtactgtaaaactgggattctataaatgccttatttataaataggatcctagagctcaaagagattgtgacaatgctgactactagaaagagtttgctaaaatgttattcaattgaaaactgtgtatgaactttaggatcataaaaagcttggtatacattctcctttcctctcttaacagcaaccacaaactggaatttaccgattaaaaatattattatttttgagtcagagtcttgctctttcacccaggctggagtacagtggtgtgatcaatagctcattgcagactcgaacccctcctcaagtgcccctcctgcctcagcctcctaagtagctggtaccacaggcagaaattgaaagaccagtggccaaggatcaaagtattcaatcaaggttgggcagtgacttaggattagcagatgagatcaggtggcataatgggaggcaaagtcagtgtataaggtcaagatggtataatggaggcaagaacttcaaagactggtgagtgaaaactgtacaataatgatttggaagaagcagtgaaataataaaacaattatagtaacatcacaaattttgattacatacaacaagaatttcatttcttgctttcaattttcatccttcttctatatctgtacaagtcagactagccagactgaaattggaagatgatatgggcaatggttgacatagatagatatgtacacatctctttacatatatacataaagttacctttcaccactgtcattcttggcagataaaacactataatcactttatagttgaatggcatataatgcaatgaaaggtcttcacaagaaaaaaaattatgttttcacctttttactttctttagcagtgattagttccagaaatataaggtatcatcacttctcaaaaagcgctgtaggttataagattgctcttctgaagttggcaacatgtaataaatgtgctttattcctaaacatcaatcagtttcaagaatggcacttgcttgtaaaatggtaataatagaaatagtcagctaataagtactataggcattaaaacactggatgacaggtgtgaagacttcttgttataaaagaatactctcttatataattatggttttataactagttacatcagtttctaaatatttagtttttaagatttctgtatcttttttggtaatgaaacttatatgatagtattctgtactatcatatttataacaaataaaatatagagatatagccaaaaaagacaatgaaagtattctggagaggtgtgatggctgtaggtcatttaatctgaagagtaacaaatttaaataattattaaaagtgttgcttgagaagatattaatttgttgtataagtatacaattgaaaaatatttgtgtaagtcttaaaattaccataaaattagaatgtttcagtaatttatgaaatagttgcatggataaactttattgaatgtgtggtttagtagaaacaaacaaaaaacactcaaatacaaaacaaaaggacacatggtgattttcattttccaaagcaaaacttcactctgtgtcaaataaacagaaaaatcaggttcctaacctaaatggagttatattttgctggagagaggatctgcagactgaacataactatataatgtacgaaatctaaatgccaggggaatgtagcagacagtccagagggagttcagagagcaggcaagttccagaaagtacatggaggcagtaagcattttaagtacaaaatcagataaatggaccacaggcatatcaaacttcagaaatgttttcaaagaaggcatgcaagtgagaacacatattttgttttcacagaatgaagagataatcgttcaccataagtaaacagtttgtaaatgatcactgaattgtagataggggtgtaaatagttgctggattgtgaagacttagtctagaattgtgaagacgtatgacaaacacatgacaaacaagtcactggcaaaatgtctggagttctctttccatgtagcttttcgaagtagattcagaaaaggcttttaatataaatttgaaaggaaagaaagggaaggggagctaatggatgcctctatgcgctgggcactgtgatggacacctttaactttagaatacattatttttatgacagctactttattgtaaatatatgtatctgcaatcacatctatccaaaattaatgtagagatccaactgcacaaatatgagaaaattaagtatcaagtgacacttgctagtgtggatgaagttatgatgactttctttgagaaaatgataaaagactatgcatctttttttttttttttttttttttaaaaaagaacgatttgtgtctctctcctaacttgccaagcaggaaaattcaaagggaaattgtgccaaatgactattttatttaaagaaaatagtttgagatggcagttccaaaattacttctgaaggtagcaaagggtatgaatttagttaagagataaaactgtgtttttagaattgagaacttaggctaggcaggcatttggcatacattagctaatttattcctcataatagctctatgaagtctgatttttggcattatcttcagttcacagtgaagttactgaggtcatcagctggtgagtgtgtttctgacattaaaactccgtaagtttttttcatcattcatgtgacttctacctgataattccttaaacactaaactatttgctgtttcttgaaaatatcataattattcacacctctgtgtgatttctcctgctattcctactgcctgaatttttttttgtttttgtcttcttctctttgtttgttaaggctaataccaaatattacatcctttggggagcactcctagaccatcctcaatcaccagattcctttctttttgttctctctagcatgagtgggaacaacatcttgaataatagcaatacccacctgcctcatcttttaatgtgtgagctccgtaagggcaggagaaatgtctagttactactttgactgtaggtatatccattggaaagaaaataaaggtaatctttacgcacactgggcatgaccagataagctccttaagttctttgagtcttggtttcctcatatatgaaatgaggccaatggaagtatctatctcatgtgagttagatgagcgattgcatgtaaaatgctccacatagggttgaacacattgtaagcccttaataaatgtcagttcttaccaacatcatcacctttatcattattattcctagtaattaacaattcgttcttcaacttcctggacaataaaaatgggttacattttccactaaaacttgaagacaattaattttaactttttaaaattctaaagttttgagagtagtaatgaaaaataatctttatttcttttatgatctatattttgtcttaacttctgaacgaagcctctacagaattagcagtttgggatatattttcttttaccagaagctatataaagaacaatataattcttcttatttctttttctttttttaggaggtgaaaattataagacattttctgatagagaagataatatcagacttaggtctacagcaggttcattctggatccatgctgggagagaaaacaatgaatgttacacttcatttataatttccactgtgaacatgataagggctagtatattctcaaatcaaattaatccacaattctagcatttaagatacagtgcaaatccctaattcaagtataaagtatcacctacaaagccaaaataaatggggtaagataacagttctcagtgttgggttatagtgtcaatgcaagacttgagctgtgttaattcaacaagcttgatcttgattgccaaagcatgcttgtcaatatttagctcccagagggcatgtcaggggcctttacagaaactagcttaaatacaaaatactatagcaggatttgtgatccttttcctaatactcagattaaactgctgattttctttcttttagctttttaaaccaagaacgtgttttccatactcctatggtaacaagaagagaagaaattgcatagaagaattgtaaatgctattattagagttccttgaaacccagataaaattctgtcacatgaaatcactataaagcttttatctgaggtctgaaataccatttccccactatgattacaatatagaaaaaggcttggaaaaaaatgttaatctttattcaaaaacaaatgtaatacagatgagatgatgggtaatgattcccacaaacttaaaaacaaatagtttacaattttaataactctgcacttagaatcttctgctacaaggatgctgtgaggttttgaagcttatatagccattattatttattatttaagggttgaaccattaaaacaattacacttaagaaaatatagtgggaatcagtagtacactgatgaaaacctataccctctatggtgattaagtataatacatgatatgaaaaatagcatttttccaaattaatacatttgtttgccttctaacttttattcctcattagatatcaattaattggacatctacattctccttttcactgaacctgacaaaacattctatgagattgggtatggtgagattctgaccaaaatatttccaaaacaaacaaaataaaccctaccaccacaacaaaaacatgttaaacacatacttcagataattgaaaaattacccccttcatttgatgatcaaaattttaatatatgtcaagtacttataacatggctgaaaatagcccttgatattatcttttttcttttatctatttttttctaaaataatgactaaagataaaatcagatcaatgctgcaacaatgagaatcaggctgaaatggaagagccagatcatgatctagattcttttggttacctacagatagctatgactgccaattctgaatcttaatagcaaaattctgtttttttttttttttttttttttttttttttggacaaagtcttactctgttgcccaggctgaagtgcagaactcattgcagcctcaaattcttgggctcaagcgatcttcctgcctcaccctctcaaatagctgggattataggcacacgccaccatgcctggctagtatttttttgttttatgttttttgtttctaatttttagtagagatgaggtcttgccatgttgcccaggctggtcttgaactcctgagctcaagcaatcctccctgcttggtctcccaaagtgttggaattacaggtgtgagccaacccttctcttcccactttatacatttctgaattgaaaattccagtgatttgtcgaaacaataccgtttccattaatcatatttgttttactaagctaagacaaatgcataagccacatccctaaatcctattttaacttttacacagtaataaatttttccatcattgtccctaacttaagcttcctaaatgtcagctgatcttcacaattaccatattttatagataataaattgtgctcagatggatcaaaacagcacaattcaacaccacaaggcaaagctaatttatatttaaattgggactcgaacctgggtctgctgactacaacctttttgctgtctttatccacacatcagatatttcttgatcaaggcaaagcttaaatataaaaccactatgacttcgagacctgaaagtgtttttgttttcagagaaatgttattcctcagcatgtgtcaaagatatggttatgagaaagacaaaactttatagttttcagttatattttgccttgtcccttcaattttaccccaatagatagtaatagcaagactgtcccgttcatccgtggacagtgccattattagatactgggaatcctcgttataaattacatcataccactttcaccttgtttatcagactcctgcctcactgatacttgttgtttcttaaattcccaagctcatggtagtaggtcctttgcatgaccttttccctcttcttggtgttctaaatccatattattgcatgattggcactgttcatacaagtcttagcccaaatgtcatttctcaaagacatcttctctgacccctaatctaaagtcccatctctttttctatcacaattataccacctagttttgctattttcataacagttagaggtatttgagattattcttatgtattttttattctctcctccccacagcaatccctgcttcctgtctgctcaatgctctacgctcagaatttagaacagcacctggcatatggtaggctcttttacaaatatatgtttaatggataaataattgaatcagagcattttaacatctagatgtaatatatcctacaagaattgttttaagaataacatttgtctttatcagtcccacctgtgggagtttgaatgtggtagaatttgtgtcattgtgatgtacaaaaaatcttattatctgttttttattatgtagtgtatagtttttatatcactactgtttgagataaatgtgaccttttaatcttcttattaaacttttaaatacaattttttctttaatcattccaggtctctgactaacatgctcaatttcaaacatgtactctatctactcataagttagaaaattttgatactctctacttagatgactaagtttctaagaaaaccccatcactctattttggtctaaatttgattcctttactcagaagtttacaaattaaactttctatatgagatgcattctacagcattttaattggtaaatacattgtgctttaagtaaaggtaaaaattacttttaaagtcacatgaatttagacaaatagtactacacaataaagttactgctgatcaccaggttttttagctaatagggacatctagaaataaataaacttaatctaagtttcacaataattagctcataatatttttagtagaatatgaatttcagggatatcctgtgttataaaatctgtgtcatttgttcctttgagttcagaagggtattaataaatgcccctaggcagcagtatccaattggcttagcatatcaagggagaatactaactagagaatgaaaaatagcacattagtgttcagaatgctcatctattaagagaagatacgtctgcaccatggagagagggtacaaggacatcaagacaaaatctaggagtgctatctaatatcaattaaacaaatcattgctgtgtcctgcagttcagggttctgcatctttggtgtcttaatctgctgtatgctgctataacagaatactatagactgggtaatttgtaatgaacagatattcatttctttttttattattattatacgttaagttctagggtacatgtgcacaacgggcaggtttgttacataggtatacatgtgccatgttggtttgctgcacccattaactcgtcatttacattaagtatttctcctaatgctatccctccccctgccccccacctcatgacaggccccagtgtctgatgttctctgccctgtgtccaagtgttctcatcgttcaattcctacctatgagtgagaacatggggtgtttggttttttggccttgtgataatttgctcagaatgatgacttccagattcattcatgtctctgcaaaggacatgaactcatccttttttatagctgcatagtattccacggtgtatatgtgccacattttcttaatccagtctatcattgatagacatttgggttggttccaagtctttgctattgtgaacagtgctgcaataaacatacaggtgcatgtgtctttatagtaacatgatttgtaatcctttgggtatataccccgtaatgggatcactgggtcaaatggtatttctagttctagatccttgaggaattgccacactgtcttccacaatggttgaactagtttacactcccaccaacagtgtaaaagcgtttctatttctccacatcctctccagcatctgttgtttcctgactttttaatgactgccattgtaactggtgtgagatggtatctcattgtggtttttatttgcatttctctgatgaccagtgatgatgagcatttttttcatgtgtctgttggctgcataaatgtcttcttttgagaagtgcctgttcatatcctttgcccactttttgatcaagtggaagaaagggtatcagtgattgaagatcagattcatttcttacagtttcagattgaagatcagattcattttttacagttccagaagctgggaaatccaaggtcaaggggcctgcatctggtgagagccttcctgctgtgtcatcccacggtggaaggcagaatggcacaggcgcacacaagagagaaagagattgaactggcagcctcaagcgcttttataatgggcattaatccattcatgagggtggagctttatggcttatcacctctcaggaatcaccctcatgaatgggcattaatccattcatgagggtggagacttatggcctaatcacctcacacctcttattgctgttgcattggggattaagcttccaacaaatgcttttgggggacacattcaaaccacagcattccaccatggtccctcaaaatcatgtccttctcatatacaaaatatgttcattccatcccaatggctttaacccattccagcacgaactcctaagtccaaagtccagagtgtcatgaaagtcagatatgggggaaacccaaggcacaattcatcttgaggcaaattcccatcagtctgggaaatcgaacaagttatctacttccaaaaacacaatggtgagacaagcataggatagacattcccgttccaaaagaaagaaataggcaagaaaaaaggagtaacttgtttcatgtaagtccaaaccacaagaagggaacattaaattttaaagctagagaataatatgttttgactctatgtcccacctcctggacacactggggcaggggttgggcccctagggattgggcagccctgtttatggctttgatgggttcagtacactcagcagctctcacaatttggcgtcttatgcccgcagttctcctaggctacagttgcatgctggtggcaccacagttctggggtccagggactgcctcactcccatggctctactaagtaatgtcaaagtggggattccctgcagtagtctcactcctgcactctgctgtgcattgccctagtaatagctctttgcagtggctctgtgcctatgacaagtctcttcttagggacccaggctaaccgagagatcctttgaaatctaggtggagggtgccatggccccagagctcctgtattctatattcttgaagaattagcactatgtggacactgtgaaggtttgcagcttataccttctggagtgatggatcaaggtgcccctaggattgcttgagccactgctggggaagctgagggtgatggacaaaaattcagggaacaaagtctcaagatagtgcagggcacctaatgctgaggtccgatatgagcccctgtctagaaaccctgccttcaatgtcctacctaacttgccttgaagatctcagaaatgcctccatggtcattctcccatagtcttgatgaataaaacctggatttcttctatccatattaatctctttagcaaacagtcgcttagccacacacttagtattccctcctgaacacattcttttattctttatgtggctaagttgagagtttttcaatgttttctgttctgtttcccttttaattataagttccatctttaaaacatttctctctctcattttactgtaagctgccaccatatagcaccttgaatgctttgttgcttagatatttatcctgccagatgttgtttagatagttcttcttaagttctgtcttccacgaaatcctagaacatagacacaattctaccacatttttttttgcaactgcacaaggatagctttttactcaagtctccaataccacattcgttatttccatctgaaatcttatcagaatgccccttaccatccacatttctacaacattctgattatgaccacctaagtaatccctaagaagatttaggctctccctgtagctcttgtcttcttctgagccctcaccagaattgtcctgaaagctctattcatggaaacctaggctttttctagccttctcctccaaactgttctagcctctacccgttacccagttccaaagtcatttccacattttcagatatttgttatagcagcagtcacacttctcggtaccaatttcctgtcttagtccattttatagtgttttaacagaataccaaagactgggtaatttataatgaacagagatttatttcttatagttccaaaggctgggaagtcggtggttgaggtgctggctgattcagttcctggtgagggctctcttcctagcttggagatggctgctttctcactgcgtcctcactcacatggtagagagagagctctgatatctcttcctcttcttataaagtcaccagccctattgcattagggacccacccttatgacttcatttaactttcagcacctcttcacaggctttatctccaaatacagtcacattggaggttaggaggttagggcttcaacatatgaactttggagggaggggcacaattcagtacacagcgctcaatatctttccaagtaaattacttcatcagcaaatttatgataagatttaattgcccaaattccctctgaaaagcatatgagattatgtcacatcatttggctcaaatgaagaactgtaaactcttccatatttcaggtgcttttcggagggacataggttataagcaccacgaaggcctggggccatgtatgtttccttcatgccattccagcagagtggcatatagaaagcactctatttgttaaaggaagagaggaggcaagaaaagtagtaaagaaagcaatagaatcactaacaatttcccattaggagtctaaattcataaacaaccggagaatgggtttagtcttcccaaaggaaagatatatggtcatcttgcggttgagaggcatcataatattccagtagaatgtgtatagactataattttttattcttccctaccccaatctgtgttcttgcaatatctcaaccaagtgctgatatttctcatattcaagctattcctttgtgttaaatctagaaaaatctaattaaaacacacacacattttctgtgaaagatcattaactacaacatttacaccattccccattcatatggacctgtgctctaaaggctgtgagagggtaaaacatggggctggtaagctctgctgcaagtgtggggccagaaaatatttcatatataaacaattgctacataaggtagagtttgggagaaaaatgtttgtctcaaatgaagaaaggtgctgtgaacactgggaatttgtctgctaaaagaggaagtaaaagtgagagggacaaagataaactttgtctggttatgttcttcaagagccatccttgcctatttaaacagtttaaggagaagttagttatgtaagttctctcacaaactcttacatatttcgagcaaatttattcaggaagatttctgctcttaatacctgcctcttttattctttccccaagtgtttattgagtgcctactactacataccaggtactttgctaatgcaagatttaaaaaatgaccaagaggacatttctgtgctgaaagaacttgcaaactgctaaaagagaaatgcagtaaccacacaaaatgataagtcctttgacagaaacacactgaaagtatgtttcccatcaaaggaagcatcaaattcagctaaagaattcatagagaaggtttgttggcacattgaaggaagctgggatttccccagacaagagataaggcacggagtgtggggagcatggtgcattagagagtagaacagttccctctgactggagcacagctgagcctgggggcaggcagggaaagctaaggatagaaacgttcttaggaatgagcttgtggacatcattaacaaggattttgaaaataaaagaaaattaaatgtagtgtagagaatggacagaagggagagaaataaaataaaatcaggaagaagttaattgcagtattcccagagataatcttgtggaattagacaaaaaggaccagctcagaaaaactttaagcaagtaggttctttgggctttagagatcaatcagatatggcaatacttatcaaagcctcacctgtcctcttagaagaggtaatgtgtactggaggaaaaattgtaataaagatcaaagagagattgctattttaaattcaacctttttcaagaaatctgcatattctccacattctgccgatattatattttgaaaaccccataaaagcatgttttgctaatgcagattaaaagaaattactagggcataaatatatagatcattttcaatttagtccctactcactactgttttgtaccttaccacatcctcaaatagctgcattctcctttctcccacttggtgaactattgaatcacaatatccaaatggaaggacttccacactttgaataattgatctcaagcatgttccctgatgatttgacattcactctgttcttctccctgaagtatatttatatcaataactgcagcttcagttgcccttatatcacagtgttcctttttaagagcaaactgataccgtaagtaattgctagcctctttctgaaaaattttattctttctgcaatttgaacttagagcaacagactttgtcaaaggcaaaccagcacatttttctcttttaaaaacacaagttttgaacgcctgtgaaaggtctccattcaatttgacactcagccaagtcctaggaaaataaaactcacagtcttgtttactttttctctactttttctccaacttcctctatattttaaaacatattttctggcctcatgaataaaaacaaacaaaaatgtggcagagagcacaagcatgaaagttaaatttcagaatgggctacatttagctattctgttgcttctagtctgactctttatttgcacagcaattaatcagctatggtatgtcttttaactgagtaaacgatcatcaacctctcctaaacatgttaagaagttcatttccgtctgaattgtcctgacaaatactaaaatagataaccttaataaggcactaatgagatcattataactagttttgtctgtatttaaagtacagatttaagatcttcattaatgattaactactggaaaactttgttcaatcccttgagttatttttaatctctatatactataattacatatattcaatcataaaactttccatggtgctgaacacaattgaactttgaataagaacaagtacgttacacatcttggctgtttaaaaaggttaatctttaagtagattaatgacatagtgatcttcactcagttcaagctttttttctttttgactgaggaaaagatacgttactacaagctatttcatatctttctgatggaacttacatgaatgactgctttagaatattgaacaatcagaaccctgaactttctattataaggtgtctctgagatcagataagtaggatgtggcctatcactggtctttattttcagttgtgctaaaatgaaacaagtgtgttttctcccgtcagtttcagaggagagtggatattaaatgttaaatcacatttaagctgaagtcaatgtacaaaactttcaaccctaaagttgcctaagggaatcagaaataagggcattttacgggtgttactataaaattaaagaggagacagaaatgtgggatgtttcctttcattaaatgccaaatagttatttcaaacaacttgtagatgactgtattttaatgttatgacatacaattttcaaaattaaatgtgttttaagtcaaatttgctaatagtatccagcaaaaagataaattttagaaacataattctctaactgttcaggcctttcaaaatatagtttgccatgggcccaacaaggccaagggtgaaacgcaatattttctgatcctaaaatctttgcaaaaaaggaatgcagaaaatcaatgcagaattatataaaatatgtttgaggcacagactagctcttcatctatactccaactaaactactccctctcacaagataccactttttaatatagtacaattacctccatactgactgcaaaatggcagttaaacctttaaagtgtaaatctttgcttttgtgtgtttacctgtcatggactttaaacagtgtggagagaggactaaggaaggtggtaagctatttataaattggaaagtctttttgcatttatctaggaatatagacattgtcaatatgtgattgaattactgcaccagttttcctggaggatttgtatgtttattgcttttttgtaagacatttatccagctctctcaatcctgttctctttcttgcatgagttcacacatattaaaatgcaagtgtcttgcttgtctgatatgtcttttgcattatttgaaaccctgaagccccaatatttcttgatatctgtacaattctgaaacaaaattatttagtaataatattccagggataaggcaataatgaaatgtatatgcaacaaaaagttcacaagccatcatttcaattttcctcttgaattttcagggtaaagttgaaggaaacatttacttttgaagaaagaacaaaactctaaattattatcatcacagcctgtgaattattctttgatgcctattgtgctaaataggagattttatacaacataaagttaaggcaatatttactttagcagcttacattttaaagaataaaaacgagaaaataaatatgaatttggatatatacatctaaattcaaggaacctagaacatgatatggtttgtatatttgtcccctccaaatctcaggttgaaatgtaatccccgctgtcagaggtggggcccagtgggttatatttgggccatgggggcagatctctcatgaagggtgtggtaccatccctgtggtaatgcatgagttctagcaatctattatttcacacctgagccgcttgtttaaaagagcctggcatctctcttgtgccctctcttgccatgtgacacatctgatctgctctccctttgttttccccgatgatcagaagcttcctgaggtcctcactagaagcagatgccagcactatgcttcttgtagagtctgcagaacctggaaacaattaaacctcttttctttataaattacccagccttgggtattcctttatagcaaggcgaaatggactaatacaaaataatatgaaccaaagtacaaatactcattcatgatgataaagcagaaaccagcatttactattaggttggtgcaaatgtaactgcagtttctgccattactttcaatggcaaaacgcgcaattacttttgcaccaacataatatgttctattacacaggaagttgctccaggttgtcaaaaagtgatcagtgctggttggtaaccattgtatcctagtgtgtgggtctagggatcagttatatgccaggcaagtctctgatcccctgaagttcacagataagaaattatatgtagaatatgatataaacacgagagagatgcacaggatgcataagatgcatggaatcaggggtaagggcttctaaagtagtttggggagtgtaaggaaaatattggactgagaagctggttctaagggtagaaatgcctctgtgtctaaggtagcagtatgcttgtaggtaccataggtatagaagcaagagcaaccttggcattaggtaaaagtgtgagtagctcagtatggttgattatggcctggggcagtggcaggggatggcaacagaaaaggctggagatgtaagctgggacaaaatcatccagagcatggaataccatgactaggtaacttttatcctggaatcatattctttcttcaagttttagttaaaatgttatctctcccacaaagtcttccctgatccttccagtaagaagtgatcactcccccatggagctcctacagatctttgtttgaattgctcctttgacaggtaccaaattttctactgcaataggtaatggagtgaaaagtataagaatctaggattcagagggcaagaggttctactcccaattttgtcactttgcagtggtctatttgcctttgggcagatctgttcaccttattttcctttacctgtaaactctgcgtaatagtagttacaaacatttgtcattcagggttattatgagtatgtgaaagtggctttagaaattttgaaatttctaaaaattgaggtgtttgaatatatgtcatctatttcctataagaatgcacacaccttaaagggagcaagatttagattctagaagaggtggataatagtttgccaattatttataagcctaaaaccttgaagattaatttatctcaatccttcctctttccaggaaatcttccttcagttcttttccatgataagtcagcttcctgttagcttcctctctccttgaggcatagacatgtgcatagctatctcactgcacatggcttatcatgccttctcctgatcttcttcctctcagcttcttttgctggatcttcttactcttcctgttcataaaatgctaaaatagccattggacctcttttttttctttatctgtatgcatttcttagtttatctcaacaggttccacaactttttataacatgtttatggcatgaaggttcaatttatgtattcagttctttcttctccttgaacttcagggtcaaatatctaactagttaatctatatcttcatttggatgtctgataagatgtcttaagttcaacatatccaaaaagaactattctttcccaaggctgatgtccagaatggtgtttcctaggttttcttctaggactcttaatggtcttatatttaaatcttatgactaagttctcaaaagcaattgcaacaacaacaaaaattgacaagtgtgacctaagtaaactaaatagcttcagcacagcaaaagaaattaccaacagcttaaacagagagcctacagaatgggaggaaatatttgcaaactatgcgtccaacaaaagtctaatatccagaatctataagaaacttaaacaagtcaaccagcaaaacataaataactccattaaaaagctggcaaaagacatgaacaggcacttctcaaaagaagacatacaagtgggcaacaatgaaaaaatgaaaaaatgttcaacatcattaatcaccagagaaatgaaaatcaaaaccacaaagggttaccatctcacaccagtcagaatggctattaagaagtcaacaaatgtgacacagcaagactctgtctcaaaaaaaaaaaaaaaaaagtcaacaaacaacagatactggtgaggttgtggagaaaagggaatgcttatacactgttggtgagaatgtaaattagttcagccactgtggaaagcagtttggagatttctcaaagaacttaaaacagaaccagcatttaatgcagcaatctcattactgggtatatatccaaagggaaataaattgttctaccaaaaagacacatgtgcttgtatgttcatcacagcactattcaccatagcaaagacacggaaacaacccaggtgcccatcaatggtgaactgaataaagaaaatctggtacatacacaccatggaatactatgcagccataaaaaagaataagatcatgtcttttgaagcaacctggatgcatctggaggccattatcctaagtgaattaacgcaggaacagaaaaccaaatactgtatattctcgtttataagtgggagctaaacactgggtatacatggacatatagatgggaacaacagacacttgggactaccagagaaagggaggaaggaaaggaggtaagggttgaaaaacaactcactgggtactaagctcactacctgggtgacaggatcattcatatcccaaaccccagcatcacacaaattacccatgtaacagacctgcacgtgtacccttgaatctaaaatgagagttgaaattaaaaaaaaaaagagaacacaaaaaacacaaaacaaacaaataaacaaacaaacaaaatgcccctcaaatcagaaatgaactattgatcctcctcccttactcttttgccataaagctgttctccagagtttacttaaaatggcactactgtttgttcacatgctcagcccaaactatttgaagttatttataattccctttcctcttgtatcacacattcaacccatcagttaatcccattgaccttctctaaaacatattctgaacacaacattctccctcctccaattcctccattgctactacactggtctaaaccacaactgtctcttgcttagattcctgaattagctttaaaaataattgccctgtccccattcttatgctgtatagtctgtctgctacacaacagccatggtgcccatttatttagaaattgaaattagatcatataactaccttaacaattagaataaatcccaaaatccatgcagggcctacatgatctctggttagtcctccaatctcattgtcaactattcactctcctattcaacttacttcacaccatgcatccttattgctgtttctgagcattctactatatttagccctttgtctttgggatttctgatctatttatttagtttgtgattgcctagttcaccttatgtgactaactctgactaatgtgccagtgttaagtgtttactgtcaattcatctcatgactcagtctgttccaggaaatgcaaagattaaaaagaatttctcttgattgcagcttaatattttccttattctaaaatgtttctttctgtcttgagcaatacctaactactagtaactaccagaaatgttagtgaaagtttgcctactcaggggcttcatctcataagaaagtaccagaaaagccaaaagtaatgcgccagtctataacaaatctgtgtttttgataatctaatttttaaaagttacatttactttctgactgccccttatcacattacagttcagggcagaacaaccagaaactacagaaagtaaatggacagggaaagagatgtgccattgttgttgataatgtgccggcacatgactaagctgtgatagttcaatgtttcttaatgttcttaactcaatgcctagatttaaaaagtcacagatcagagctgcaattatgccaaatacctggtggttttattaaacccccaaacagatttcctgttgttgctcccctctaaaagtttcaaaatatgcagagaaaaatgaggacagccaaatgaggataatctgatgtgtacagttgaaaataaagcatcatttaggaagaaacaaagttttctgttatgtagtaatgatgcaaagggctagagaaatctataaccctgaattctgacagtgcagataataatctgtttttcttgcacaatgaaatttactatcagtgtatgaattttaactgtgtgtagatatatatgcacactctaacacatatatacataaatatatattacactcttactaagacaatggtatttcgtaaaaattttttttttcccacagctctttgcagacactaaacttgagcttctgaatggcagaaattgacttttaaaatatatgacttcttaaaaaaattcaactttgattctagattcaggtgacggacatgcagatttgttccatgagtatattgcatgatgctgaagtctgtgatatgaatgatcctgtcacccaggtagtgagcatagtggtgaatctgtaagacattagattctgatattacaatttccaagggattgtttttgaaattacattaagcataccccatactttgtttaaacatggcagattccccacacatatatgagaagttttggaagatgaaaagcagattgtaaaatgataactgacttagtagaaaaaaaagaacattcaacatgtagaactcccaaaaaggcagctaaagacagggtactggagagcacagttcaagcagggaggcacagtgggtgaaatgtgaagactgtctgaagatggtatatagagccaattggaccccagtttccatcacaaccctgtgcaatcaggtttctagtggtccactggagacagagatttgtttgtttgtttgtttgtttgtttgtttacttgagatggagtctggctctgtaactcaggctggagtgcagtggtgcgatcttgggtcaccgcaacctccgcctccggagttcgagcgattctcctgcctcagcctccgagtagctgggacaacaggtgtgcatgaccatgcctggctaatttttgtatttttagtagagatggggtttcaccatgttggccaagctggtctcaaactcctcaccttaggtgatccgcccacctcagcctcccaaggtgttaggattacaggcgtgagacagaaatttatttttatagaagtgtactagagatactccagatatcaaaactagtggaaggctgtaattgagacaggaaactgaaagcaaggaaatgaaatgaaagtctgcatattgaaagctgggactaccattcatccactgatcccttttttacagaaaggcacattgctttcatgacggagatctgaggatccttctaagaaattgtttatccccagagaaaagacctgaagatactcacatttgtcagccacagtaaaaggaagagcttaccactcaatctcctctgcaataaagctccctagctgttaaatttcactcacatactcaaggcttccaatcaactttttaatatctcacacttaaaaactaaattgaggatgtcttgaatctccagacatttcagaagtctttttttttacatgaactagagaaaccaaaacaaataatcaaaataaataaatgaataatgaggcagaagatatagagatttatatacgcattgaagggaaactgtaagaaaaaaaccaaacatagctaacatcttcagagacagtacagaatgaactgcatccaaaagataatgcaatcaagaagaaaccaccaaagaaaatgatatcaatatgctgaagagatatctgtgctcccatgtttattgcagcactattcacaacagccaagatatggaatcaaactaaatggccatctatagataaataaagaaaatgtggtatgtacgcaatggaatactattcagccataaaacagaatgaaatcctttcatttgtggcaacatggatgaacctgcagggtattacgttaagtgaaataagccaggcagagtaagacaaatactgcatgaactcactcacatgtggaatctgaaaaagttgatttcatggaagtagagagtagaaaagtggtattaagagactggggaggggtagggggagcaggggcctggataggttagtcaatgaatacaaagttatagttaggaagaaacatttctgttgtttcattacacagtagggagattacagcaaataacaatatagtgtatatctcaagatacctcgaagattttaaatcttatctccacaaagaaatgataaatgcttagagtgatggatatggtaattaccccgatttgatcattatacaatgtattcgtgcactggaacatcactacacaccccataaaaatacaattattgttcgattataaatacaacattattttaaaaactatcaaaagcagaaagagttgtacaaaagttaaaatataatgatcaataaaaaataagttacaggtatgatatcaaagaaatctcccaaaagagaaagcaaaattcaaataggagaaacaaaacaaaataaatcagaggggagaatgactaaaagaaagaatggagaaaatgggaagaaaaaatgataaacagataacaccagagaatttccagacctaaaaataaaattttccacatagaaaagagctgagagtaaaacaagaaattaaaaggaaaatccaggttgtgaaaaccagatcacaagagataaagagtagatcctaccaaaaggataaaacaatttgaaagagagaaaatatataaatatatatatggatgtgcatatatataatttaaatcaaagagcagataacagatgagatcagccctctctataactgatagaagaaactagaatattggctataaatacttaattaaaaattgttttcaatataaaattttatacccaatcaaattattaagtatgaggatagaataaaaacattttcaaatatgcaaattttatctaaagtttctcagaatgcttagaatatctcaggaagttatcaaactaagtcccagaaaaataagtaaatatactaagggtgagaaatgtatgggatccagaaatagagggtttaacacacataagctaaggaacatccctaaataacatcaattaggacacacagggaataattttaattttttcccccatgatgtataacaaagtgcaatatcatgagtagggtataaaattatctacctcatcattatctttgaattatatattgcctttaaatattttaccaatttgatactcaaaaatagctcaccattgcttcactttgcatgtcttcgcaaactgagttttaagagtttttgcacataagttattggcttttttccatctattgctcaaataactttaaatatctatctctattttaagccagagcagctcagagttgcttttattgacttaccacttgatattatgtttgatattaaacctacactgagggatgttgtaagagaaaacccactggtgttactgtgttgactacaaagcttttgttgaggatacagctattttatgacatcatactctctgagtgagaagtcatagaccttgattctgaagcaattgcattattgttgtcttatgaacactgtttcatattcgtcttctaattttgttctttttttgatatataaaaaattaaagacaatatgcagtcaaatatttgcaatattttcactgatatttttccatttattttatctttacaaagctttcctttaccattttctctttttttcagagatgcagaggttgtttaatattaggaaatacattaatattattttatgactctaatagacaaaagcagaaaatcatatattttctagatacactagtttatttgactagacagaagctaatttactagtataaaatttttaaaataaaattcaacttttttcttgccaacatttattttaggttcaaggggtacatgtgcaggtttgttacatgtataaattgcatgttgcatgggtttggtgtatagagaattttgtcacctagttaatcatcataggtagtttctatcctcaccctcctcctaacctcctctctcaaataggccccagtgtctattgctcccttctttgtgtccatgtgtacttagtgtttagttcccacttccgagtgagaacggtatttggttttctgcttctatgttaatttgcttaggataatggcctccagcttcatccatgttgttgcaaaggccatgatttcactttcatatgctgtgtagtattccatggtgtttatataccgcattttctttattcagtccactgctgatgggcatctaggctggttccatgtctttgctattgtgaatagtgctgtgatgaacacatgtatgcatgtgtctttatggtgaaatgattttcaaataggataaacatacacctatcttttttcttttttaatagtttaatttagtacaattgttaaaattttagtctactatttattttgatacatagtatgaagaaaagttaatacttagacttttttctaaataaatagctaatttatccattgattatctgtttaataaaacatcttttgtttccctgacaattggtttgagtgtcttcttttatatgcgatattcttggaaatacgaagactatttcagagttctctgttccattggtttaatctactggttcttgtgccagaaaacattgtcttagttattataattttgaaattggtttaaataatctgttatgtatgtcctttttcacctttcatctaggtgaaaaagttgcttagtgattttttcctgtttcctcttgctcttaaattttaaagtaattttatgtgtcttagaaaaaagctcatttcaattttgtaattgacttaatttgaaataactgccatattcatttctaatttgaactaaatgccatattatgagtcttttattataactcaatttaatataactcaatttgaaataaacgctgtatttactatgagtcttctactataagaacatattgtgttttgtcatatattcaaagctgcttctctatgctgaagtagttatgttgtttctttcagtcccatatattatttaagaatgagtgttttatacttcgtttttgctagtttgaatgctggtgtataggaaagcaattgtttgtgtgtctactgtacagtggaacactgggtccaagagtataagccttggaatcagtcagatctgacctcaagtaccaatggacctcaggccttggtattgtttttctcatttataaaatgattctttgtgaaagctgcctaactcagagcctggtacacaaaatctccttaataaaaggcagccgatataataccttaagcatcaccattatcatctcactatcttatactttaattaattctgagatttaaattaactcttcacatttcctaggtatatgaacagagcatctctattaacaataatggtattttctagaatgatacgtcacttctttcatgttacatgtgtcacacataactttcacaacaatattaaataacaatgttcatggtatatatctttgtcttgacttttattttaatggaactatttttaatagtaaactcactcattaagtgtgagtttgacttttggtttatgatgtatattctcaatattaatatttatcataaactacttttagttttctaagattttaaacagaaagtgatactgaaattttagaatgagtttccagatcatttcaaaagaattaagctttttcatattggatacagttatatagtatattatgttaataatgttcataatattaagccatctttgcattcctggaatattcttctttggtcaggatggctatatcttttaatgtgctgttgaatttaatttcccagcaattaatataaaattaattgctagtcaattttttaaagcatcaaataaaagttttagatcaatttcatttatgaatataaatgtatattcattattctgctcccccactcccatcctgctacttcatcatgaattcattttgggttgtctcattgtcaccttctctttcataattttgattactctgtcatatttttctacattttctggagaaattcctatggctatccttcacaacacattcaattttccatgatctcaattctgctctgtcacaacagcaatgtgtattttatttgtgctgctgtatttttgattctgtattgtctttccatttcccacgtattttcctatccattctgtatcttcttgtttcaacccagtgtgaattgccctgctttttctgtctgcttgtttgggaaaatccccttttcaggactagagacacacacaacattgatgctaacgggtctggatcaaagccaaattggcagaatctagcagatttttatgggactctacaagactaaaggtggagggttttaacttttcctccttgccttgacctctaacactctgtatagaagggatatatgtaaactacaaaattcacagtaaatagacaggaaacttgaagtctctgattctacttgaagatcatggcttctgaaaattagacctcttaaacattaggcattgcttccaacaactgcttgctcgcagaaacgaagagaaatgaagaggcttccttcactgtaggttctatcctatggcatcagaacaagagcaatcctgcttgccttaaagtaggtataaaagtgccaagtgcttcatttctctatttttatctattcgtagtttagaaaacaaacacaaaaaataaaatctgaaccacttattacagtatccttataattgctctttgatgtatacaatcatatatacataccctcagaaatacctggtcagaaattaggagtagtaaagaaggactactactgctgaatcccatcactcaaagtttaaatccatatgtgaagttcactaaatggaatatttgtgaaaatttcttggccattctgacaattggctgaaagtcaactttttattgttcctttaattttttttttttttttttgagacagggtctctttctgttacccaggctggggtgcagtggcataatctcagctcaccacaacctttgcctcctaggctcaggcaattctcccatctcattaaatttttgtttatcctctatgtcttcatatattttagtgagacttttggagagtccacccgagtgtccaatcacaaacctaaattccttttaactggaccatttagtccatttacatttaaagttaatattgttatgtgtgaatttgatcctgtcattatgatgttagctggttattttgctcattaattgatgcagtttcttcctagtctcgataatctttacaatttggcatgattttgcagtggctggaaccggttgttcctttccatgtttagcgcttccttcaggagctctttagggcaggcctggtggtgagaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgctgagagatccgctgttagtctgatgggcttccctttgtgggtatcccgacctttctctctggctgcccttaacattttttctttcatttcaattttggtgaatctgacgattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcgtttcacatagtcccatatttcttggaggctttgttcatttctttttattcttttttctctaaacttcccttctcacttcatttcattcatttcatcttccatcactgataccctttcttccagttgatcgcatcggctcctgaggcttctgcattcttcacgtagttctcgagccttggctctcagctccatcagctcctttaagcacttctctgtattggttattctagttatacattcgtctaaattattttcaaaattttcaacttgtttgcctttggtttgaatttcctcctgtagctcggagtagtttgatcgtctgaagccttcttctctcaactcgtcaaagtcattctctgcccagctttgttacgttgctggtgaggaactgcgttccattggaggaggagaggcactctgctttttagagtttccagtttttctgctctgttttttccttttccccatctttgtggttttatctacttttggtctttgatgatggtgatgtacagatgggtttttggtgtggatgtcctttctgcttgttagttttccttctaacagacaggaccctcagctgcaggtctgttggagtttactagaggtccactccagaccctgtttgcctgggtatcagcagcggtggccgcagaacagcggattttcatgaaccacgaatgctgctgtctgatcgttcctctggaagttctgtctcagaggagtacccggctgtgtgagcagtcagtctgcccctactgggaggtgcctcccagttaggctgctcgggggtcaggggtcaggcacccacttgaggaggcagtctgccccttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcatccttgagctgtggtgggctccacccagttggagctttctggctgctttgtttacctaagcaagcctgggtaatggcgagcacccctcccccagcctcgctgccgccttgcagtttgatctcagactgctgtgctagccatcagtgagaatctgtgggtgtaggaccctccgagccaggtgcaggatataatctcctggtgcgccattttttaagcctgtcggaaactctcagtattagggtgggagtgacctgattttccaggtgccatctgtcacccctttctttgactaggaaagggaactccctagccccttgcaagacacagactggcaaattagataaagagtcaagtcccatcagtgtgctgtattcaggaaacccatctcacgtgcagagacacacataggctcaaaataaaaggatggaggaagatctaccaagcaaatggaaaacaaaaaaaggcaagggttgcaatcctactctctgataaaacagactttaaaccaacaaagatcaaaagagacaaagaaggccattacataatggtaaagggatcaattcaacaagaaaagctaactatcctaaatatatatgcacccagtacaggagcacccagattcataaagcaagtcctgagtgacctacaaagagacttagactcccacacaataataatgggagaatttaacaccccactgtcaacattagacagatcaacgagacagaaagttaacaaggatacacaggaattcaactcagctctgcaccaaggggacctaatagacatctacagaactctccaccccaaatcaacagaatatacatttttttcagcaccacaccacacctattccaaaactgaccacatagttggaagtaaagctctcctcagcaaatgtaaaagaacagaaattataacaaactgtctctcagacaacagtgcaatcaaactagaactcaggattaagaaactcactcaaaactgctcaactacacggaaactgaacaatctgctcctgaatgactactgggtacataatgaaatgaaggcagaaataaagatgttctttgaaaccaacgagaacaaagacacaacataccagactctctgggacacattcaaagcagtgtgtagagggaaatttatagcactaaatgcccacaagagaaagcaggagagatccaaaattgacaccctaacatcacaactaaaagaactagaaaagcaagagcaaacacattcaaaagctagcagaaggcaagaaataactaaaatcagagcacaactgaaggaaatagagacacaaaaaacccttcaaaaaattaatgaatccaggatctggttttttgaaaggatcaacaaaattgatagactgctagcaagactaataaagaagaaaagagagaagaatcaaatagatgcaataaaaaatgataaaggggacatcaccactgatactgcagaaatacaaactaccataagagaatactacaaacacctttacacaaataaactagaaaatctagaagaaatggataaattccttgacacatacaccctcccaagactaaaccaagaagaagctgaatctctgaatagagcaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcatgttatgaggccagcatcatcctgataccaaagccgggcagagacacaatcgaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaacatacgcaaatcaataaatgtaatccagcatataaacagaaccaaagacaaaaaccacatgattatctcaatagatgcagaaaaggcctttgacaaaatttaacaacccttcatgctaaaaactctcaataaattaggtattgatgggacgtatctcaaaatcataagagctatctatgactaacccacagccaatatcatactgaatgggcaaaaactggaagcattccctttgaaaactggcacaagacagtgatgccctctctcgccactcctattcaacatagtgttggaagttctggccagggcaattaggcaggagaatgaaataaagggtattcaattaggaaaagaggaagtcaaattgtccctgtttgcagatgacatgactgtatatctagaaaaccccattgtctcagcccaaaatctccttaagctgataagcaacttcagcaaagtctcaggatacaaaatcaatgtacaaaaatcaaatcacaagcattcttatacaccaataacagacagagagccaaatcatgagtgaactaccattcacaattgcttcaaagagaataaaatacctagggacccaacttacaagggacgtgaaggacctcttcaaggagaactacaaaccactgctcaaggaaattaaagaggatacaagtggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaagagagcccacatcgccaagtcaatcctaagccaaaacaacaaagctggaggcatcacgctacctgacttcaaactatactacaaggctacagtaaccaaaacagcatggtactggtaccaaaacagagatatagatcaatggaacagaacagagccctcagaaataacaccgcatatctacaactatctgatctttgagaaacctgacaaaaacaagaaatagggaaaggattccctatttaataaatggttctgggaaaactggctagccatatgtagaaagctgaaactggatcccttccttacaccttatacaaaaattaattcaagatagattaaagacttaaacgttagacctaaaaccataaaaaccctagaacaaaacctaggcattaccattcaggacataggcatgggcaaggacttcatgtctaaaacaccaaaagcaatggcaacaaaagccagagttaacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaccaaacaaccccatcaaaaagtgggcgaaggacatgaacagacacttctcaaaagaagacatttatgcagccatcagacaaatgaaaaaatgctcatcatcactggccatcagagaaatgcaaatcaaaaccacaatgatataccatctcacaccagttagaatggcaatcattaaaaagtcaggaaacaacaggtgctggagaggatgtggagaaataagaacacttttacactgttggtgggactgtaaactagttcaaccattatggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtaaggaaatggatgaaattggaaatcatcattctcagtaaactatcgcaaggacaaaaaaccaaacaccgcattttctcactcataggtgggaattgaacaatgagaacacatggacacaggaatgggaacatcacactctggggactgttgtggggtggggggagtggggagggatagcattaggagatatacctaatgctaaatgatgagttaatgggtgcagcacaccagcatggcacatgtatacatatgtagctaaactgcacattgtgcacatgtaccctaaaacttaaagtataataaaatacaataaaataaaccctaaaaaaaaccctaaattcctatatttgaattactagtactagaatgatcactgactaaatttaacctaccaaagatatatatttttcatttcattctccttaaaacaaacattttaaattttttttacacaaaattataatgcgttataccccacattaggttttattttttttcctttcaaagtggggactaaagttgcatgtatcagaatcctctgagatgctaattgaaaatatatatgcttggccttaacaaacatctactgaattagatgctctaattccaagaatctgtgtatttgaaaagctcctcaggtgactattatcatactaaagacttcagtgacctctgctgtattataagctacattggtctgttctcatgctgctattaaaggcatacccgagactgggtaatgtataaaagaaagagatttaattcactcacagttctgcagggctggggagacctcaggaaacttacaatcatgtcagaacgggaagcaaacatgtccttcttcacgtgttggcagcaaggagaagcgcagagtgaagtgggggaaaagccccttataaaaccatcagatattgtgagaactcactcactatcatgagaacagcatagaggtaactgcccccatgattcaattacctgccattgggtccctcccatgacatgtggggattatgagaactacagttcaagatgagatttgggtggggacatggccaaaccatatcacaagcctatataaaaagggtgaaactaaagaaaggtctttgagagtgatttcaaataatgtacaaggaacaaacacccagacacaaacacacatgcgtgcacgcgcgcgcacacgcgcgagcacacacacacacacacacacacactatttctacaaaatattaccacaccctcatctagtataagcttgctattaaaacaagggtttggggatctgggaacactagggtaaaaagatatttcaacaacacaaggcattgttgttggcctaattcatttctattatgttttcattttaactacttaatagagaaattcataatttcattttagtattggagtaaactaaaaaaaagaccaaatgtttggaactattgaataaaaatccaacatagaaataatttgatccattaaacctttggcatctgccttgaaaagtacatatgtttctttgtgttatttctcagtatattaatatgagaaatgcatgaagcacagaggttaataggaatatggagaggtttactagaccacttacagtgtaattgtgacctgtcattactgtgaatttttttaaaacagtgattaatctcagtgttatatttatagattgttttcagtcaatttttttgtcaagtacaaaagtgactatatattttcatcctacaatatgttaagacattacaaaagcttaatggaataaattaatacagaatgagcaatggagaaggggcagctgaagcacagtgcttaagtgtacagtatgaagagtcagacagtagagattcccatatacctggataccagctgtgtgatgttatagaatttacttgacctttctgtgtctcagtttatatttcaaaaaagcaggcccctaattgtgcccacctgattggtttgttgtactgattaaatagcataacatgtgaaaagctcccagcatctgacatctaacacatagtaagatggcctatattctattagctagaatttcttactaagtttccaaagctcaacagcaaaatcaagatggctggcaaagattaaaagtcagtccaggccgggtgtggtggctcatgcctgtaatctcagcactttgtggggctgaggcagatggatcacctgaggtcaggagtttgagaccagactggccaacatggcaaaaccctatctctactaaaaatacaaaaattagcaattagccagcatggtggtgtgagtctgtaatcccagctactcgggaagctgaggcatgagaatcgctcgaacccgggaggtggaggttgcagtgagcagagatcacaccactgaactccagcttgggtgactgagtgacactctgtcacaaacaaaaaaaaccagtccaatcactaaatgctcctgcttgtatgcaactgaatattaagaataaaatggggtttcttacatgtctactatgtccctgaaactttcataaattctggaggagtcgatatgaaggaaacaacggctcttgcttttaagatgtttataatccaaacaggtcagtcatcaaccgaatgtgctaaatgaactgagactaattaggaacattccttggactcatggtttctgttccatacacttcttttcaaattaatacacactaattaacatttctcacaccatatcatgacagatatgtgctaagacagtttaaccttcttgtttatttttgtttatttatattatatatcgttttgttgtaaaccaggagaaatgagaaagagtgtgagctcctttttcacttcagaaaggacttagtataggttttttaaatctcaatttcttccctacctcaccgtcttcaaaatgtccttctctttttcctcatctaatgaaaaggtagcatatctgaattacttactaggcttttgcaagctcagttgaaattataaaagagatgatgttgctttggggaaaaagatgaatctgttcgaaaagaaggtgagacatatgcaggaacacaggtatttgtaacttactcaggattacaaagaagaaattaagaaggacatccaaagttgctcttggcatcacagttagactgagtgctcagacggttcatccaaggcagtaagaaataaagttttttattactatattgatggcagctacatttctagctgcatgcttacacttcaagaaaaatgcctgaatgatgcctctcatttttgttccttgaaacgaatccaagaatgtttccctaatttacctatctgactcaattttccaagatagagactgagtgaaacaggtaatatcggcccataattttaacaagggtcacagaagagtacactggcagcttttcaaaaccagagagaataaatgttagattagtaagtgacacttgtagactattagaatttaatgagtatactatatttagacagatatgacagatgttaatctctgatattaataaaaatgcctaaaagttcattttggagaaagatctgagtatgaacccagactatgacatatcctggttatgtaaactctggcaagtttcttaagtatctagacttgagtctctaagtctgcagaatgggcccaatggtatccacctcccagggttatttaaataagaatgcatacaaagtgttcaataaagttctgggcacataaagattgtattattccaaggcctcgatattcccacacagctgctatgcattgcttgaatagccagtgctgctgaggaatgcagaaatgttgatcaattttctagcaatacaagtctgtcaacataaatttccaaataccaaaaagagcacatattaacttaaatactgagatttataaatctataaataactttttttttttatagggtctcactcttttgcccaggctggagtgcatgggcgcaatcttggctcactgcagcatcgacctcccagactgaatcgctcctcccacctcagcctcaggagtagctgggactacaggcgcatgtcaccatgccaggctaagttttgtgtttttggtagagacagggtttcaccatgttgctcaggctagtctcaaactcctgggctcaagcaatctgcccgccgcagcttcccgaagtgctgggattccatgtgtgagccatcgctctcagcctgataattttcttaaaattgccagtgctactgtaagagacatagttaagtttatattaaaaggaaaaccaaggtattgcttagttgtcataaagttgtgtgaagattaagtgaaatatgttagtggttttctcacagagtatacacacagagagttacactttacacagaaatctatatatcccacaagtaaactgattttaagggaatcattttctagtttcccaatttccatatgtatgatgtcttaaattttgtatgcctgagaaacaatgcaatcaaggcatcccgctggttcttctgtctcaactcctctgtttcaacagtctttcccttactttcgaaaaaaagcatatttttcattgatctcaaatattacaataacatatacatagaatataaaaatttggggataccaaacaaaataattcaaaatattggtgttggttttgagaaaatgattgattctaatgattgagtgacaaaaattcttgcaaatcaggtaaaacccaggtttctgatttcaataaaatagaaagagcaagtcatcaagttgcttaatcacttttggtgaagatcgctaactaattttaggcttacaatggagaaggtgtccaaatatttaggtaaaatgactataataaactccttccagtttatttatttagataaacaaggatttccaatgtctacacctaaaaaaaagaataaaactgatgataaactctatttaagaataatatgtctcgatagatacatgatcaaattatttaaaaagccatatgtttctcattaataaatgaatcttcaataaaattcacttttattttgaataattgtcaatatttatgatatattcatgctgttttgataaagtataaattataaattctaacaatacaggaaatcatttatcatttaaagactgaatctaggaatttttaaaatgtaaaagtccatttatagacatatattttgttaaagagtacttccaaagaggatccttaagatgttcaaattttaaaaaaaacataaaaataggataaaatttgatggagaaattgttttaaaatatgagtttaaggaggaaaaaagaggcaaaacttcccactatttgttagagcatgtttatgaatttttaaatgggtgatgataaatataaaaaagcacagtggtgttatttattcctagtaggtttatttaaaaaatgctgaaacaatttcatttaaagaattcatatttgcaaaacatgggggattatgtcttttgctagcacttgaacttactgctaaaattctcaggtcaactaaaatgagtgaggagtatatggtttataacgttttaattgtagggtatttgtaagcataacaatttgaaaaccacagaaataatgtactgtatataaaaatcttcagtacactttccaatccaacattttttcactgaattgaattgaaacgttggactctccaaaagcatagcaagtaaagttaagctggcctgaccaaattcctttctcttctctattctgataacaactcttatcatcactcctgtataaccctggcagtctccaccttcaagtatcagacaccatgtatgtgtctcaaaggtttactatgccccacacttaaggacctcttggaatttgaggtgttttctaccagccattcacatggtactaaatttttgggaatgcacatcaggacatttgtctgtcagagaaggtttcaagcagcttccaggattgatgaataatatcatgaacagtctataaagatgactttggaagagctcagtgcatagtgtaacagtgctaacagcagggacactgcattgaaatagcatatctccaaatcattgattatctcctcccttccactaataaaaggatagcattgtctggggatggcaagaaagcagtaaattaagagagaagagcagtaagctaccagcactgctgtttcccacactttaagggtttgagaacataactaggtaaatttgcatgtaagcactgtcctagaagagagctgttatttctcaatatgctagtgtctatacaaagttaagaagaaaaacataacatttcacaatcgagaacgtaattttatccttgcctaactcacacctgtttccttttcaaaggactagtgatatccataaattgtcttcaatggcactcataataaattctctttgcataaacaatggtttccactcaacatttaatcttaaaagagtgaatgttattccctactctgagacctcaaagactgtgttccactttttctaagaattctgacttcatttactataatttgtttcagatacttaactgtgggcagagattcttatttatttatcaaatactatacccctctaattttaccattgcttaaagcgtttgacattattttggaaataagatattctaactaaaatgctcgatgatactaatctttcttcatctactgttctcaaagtgtggttcccagatcggtagcaaaagcatcatctggaacttgttagcagtgtacattctgatacataaggccctccaagccttatgtatcagaaactctggagaagaggtccagcaatctgtgtcacaacaagccttccagtttctgatgcatgctaaagtctgagaaccactgatctactggaatctcacctcaccaagaggatgttgatatgcaaaaattggctacagtttacaagttaaataaaaatatttttctttactaacatagatgaatcctgatccataaaagactcataaatataaatcttaaatcccataaattaagaatctgatttcttcttatgtaatcagacatttgcttctagcaggtttcaagatcttcaactacggagaggcaatgacattttgatagtcctctagatttaaggaataaatatgctggctgtatagtcagagtaatgctagagagtttggtctgatgcttagggatttaggacgacgaatggatagagatggtgaggaatctcattccagtcatgctctcctttcctaatttcccttttcactgtttggtcttctcccccttttccttagggagtcgagtgattgatagcctaatccaatgactgtattacagctgcctcaactaggactcttttccttatcattagcagttagcctatggttaaattcacagctcactgcttggtacagcccctgagatttaagggtctggcctttagaaaatatttaacataaaactgaaatcttgacatactgagaactcagttctctgcaaggcttccttaattaatccaatgtactgtaccattgttctgtatgagactgtgacatggtgaactgtttctgaagcttacagagatgtgtagttctaaattaaacagccactgacgtgtacctacactgattttttagtacagtagatatgcatgaatctgtgaatatttaaattcaagctcaaacagtgacacaatactctctagttttactttcataatagaacattttttgattaatttcaagcttgaaatcattctttatgaaaaaacacacacagaggaaagaaatttaataattcattaccactgctgcaaaggtaagttttcttaatatgcttgtcagagttctttggtttacaaagtctatcaaatattttcttaggaactggaacagacattaatttattttcctaatttttaaccaaaggaaaatatatataatatccaggtacccatgaatttgttggctcttaaatactatttggttctaccatttatctgcaggacaatagttatcttaaaatacctaaggaaaggatgtagaccttgatctatgctttaaacctttgcccttgctccagtctgtccatgagctgtaagcatctatgaatatggcagctgagtcccagatgaaaaattatgcatctcataaactgctattctgctgaaatgtcaagccaaggcaaggctgtacctcagactcagcacttggcattttccttctgtctgctttgttgccatgaagcaaacatgaacagtgaagatttgtgtagggcaggtagcaggcgagctcactgtcaaaaatctattattagggccctggtctcctgcacagaccaacgatggctaaacagtgagatactgaggctctgagaaaggcaacataatgaaagaggggattctttgtcaatctgtacatgaatatattcaaatgagcattatttaaatgagaatatttctaatggtaagcctctctcaaccaaagtgataatttataataaaattgtaatctagcatctgtatttgaaatgcctacttttgactgttctgcaaatatagtacatacatatttgtataacaagttctttaatagtttgatcagttaaacttgtaataagctaagaatgtttttacataggtgaataacaggccagattttttgcattacttttgtccatacaaaaaaaggaaaaaagtgagtataaaatggaaggctctccttttaattattctttttgcatgaattactacatttttatccatttaaattctatctttatctatcaggttattttagatcttcaatgttaaagcctaagctcttatcgatcaagatgattacaatagatagcttaaatttgatgacagataataggcatgtttttctaaaagcaatttatgcatcgataatcatgtgattgacacataaaaaaatccagcacattaaaaacaacttcccaattaaaaaaatactaacactgttttttatgatggaattgtaatgtgtggtgtaagaacttaaagcaatcctgccaaaatcttcagttgctggcatgcgtgaaaatagttatttaaagaaaaatgtaactaaaacttctgagtttgtaatctgttttgttttgccatctccctgattttacacaaatattcactaataaatacaacaaaataagtgtatgattagagtgggttacactggatttgtgtttacgtaatgcccagtagcacagtgtatgctgccaagttattattgcattctaacaattcacgcctaagtaactatcttaaaaacacataaactatgcgatgtgaagtcgatgcctaaaatccctttctaagctactatattgattcacatttgtgcaagttttctaaattatacactttgtactcacttctggccctacactgacgcagatctacaaattactagctaaatttctaacttgtaccttcttttattagtatttcctatgttggatttacaatgaaaacacctttaggaagctagtaaccatacaagccagtgtccaatatctcacacagctagatttcaaatcattcattattcacttgtagactctaagaacattcatggaatattccattataacttatttagaaatacacagtcatttactggattctgtaataacctctatgagaggagtaactttgagctgaaacagaaaatcttaaaagccatcttttatgaattattcagaaatcaataataaagtttatgtcttaatactgaaaaaaatgtgttctattgttgtaattgtataagttcatacataatgaataacttcaaacaagcattcaaaatttgaagttaagaacaagaatttcctttcctttggtgaaaatagaacaaatttggcaaataaaataatttaaaataataagtttttcaagcttgtgggaagtaaattatattgagcctaaagtgtctatcattatttcaatttaagtgccttctgcactctttcctatatatgtgaatgtgcatgtgtttgtaagtgcaacacacaaaatatatacaggacaatgaaattcattccccattaataaaaaaaagttaaaaacacaaggaacaacaacgaaaacttcaaatgaattcaccccattgaaaaatgcttgaatactgtttctcccgaagcacctgtaaatgaataaaggttatcctcatgaagtcagctgcaagaaagacatctttagcttatgccatgcaggactgattcttaaccagctctgaaagaatcttacccacagggaggatttcatgtgaaaatgtcacaccacagctggataacaccatttatataggtgatagtaatcactgatttgggggctatcttaagatgccctcattatttgggaatgaagtcagaaaaaaaggtcaaaatttcaaactaaaacaagaaaaaaagaaattaaactgggaaaaataatgggtcacgcagtcaaggatggagtttataattgttactgagattagggtttttttccaatcaaataagtcaaagaatttcttcttcctttcctctctccaaacccaataaactattcagctgtgtgatgatacatgaattaactgctgtttgatgcaacagaagttttctgcatggattctagaaaaaggaaaggtcgtaacaacttagtgttacatctatactgtccaaagaaaggtacagaattatttagaatcaatggtttagacagagtacttatatggtggagagctgaatcagccatccttgtttgataaaaaatattccttttggataccaaacaagatttccttttatactgttctcactatgaaatcatctggtatataattcaactttttaatggagcaatactatgatgtatttctcccataattgaaattcaagtttataaatcactttattatgagtttgtttcatatatttaagcaccgccccccagagtttaatcatctgtagatgaattagaaaaagtgcttctaaaatagcaaagctgaggataagaccttggagtgaggtcctaatttgctctcttgatgtaacttttaagctacagcaggtagaagttatctttctatagtcttattgacttcttttatttaacaaaagagacctccctctgaaacagtaactctcaaaatattttgaagttaactaagtaaaaagtgcgttttacattatggcatatataagtgtatattatgtgtataactgaaaaagaagtttggccaaacaatgcttatcccaactatatgcaaagcattctgacatttcttattctatttcattatttaaaatgttgattacagttcactaaacttgattgcatagtatactcatgagttgggaaccaacctttgaaagacattgctctcaaatccaggctacttatatcggaaataattccactgacattccttagctgagatcccgttttcccaatgcaagtcactgtcccttattagctaatgcattttctctagaagaacattcctgaaatgtgcccagttttctacagcaggtatactactccaggtgcctcactatttccgtatttaaacaaaacataatcttcatttcaaagagcagaaatcttattctgagaaaaataataacaattgaataaacagctaaagaatatattgaaaggggaaaatatccttcactggcaatgaaaagtatgtattgtgttcaggtggctatccaaaattaaactctatttagttttcactttttaaaaatctgtgattcatgcagcatctctgaaagcagacattgccatgctctgagacaacacttgagcagatattagcactgtgctatggtaaattttttaaaaatcttataaaaatatctagcttattttgtgtaactttcagtattaaggcagcatttgaagtcctgacaaccatatttgatacaactctcgtaaaatttgaaaccattattatttaacacaattttgctaggctaagttttgctataactcatactgaaggtactctgttatagaacttgctctgtcctaaaatatattatcattgcctatttaaactgcttttcagattctattacttttaaacttaagcaagcattactttaaaggaggaaaactatattaattctgtcaatgtggagaaaggctattttcaaaacagattgtttaatgtgaagaaacttaatatagaacctattagaaatgaggtacaagtcctttaaaatgttagggattttttgttgtttaaaatgaaagttctacccaggcttacctaagcttatagcccaagtgaatatttatatatgaatttataaatcttagaaatagagttttatggaaatgctaacaggccctgaggtatgactgagcttgttttcaggtactgctataatttccagtgtgtgtatgcttaaagactgcaacacaaaagactttttctaatgctgtaattttgtagttttattagactgagttatagtatgggagaatattcagacattgcagcttaaatgagaaaacatgaatggtgttacttatataaaatactactgcaatagttcttttattaatttttaatgttcagcaccctctgtgacctcctttattctcttgctgtcaacatggcaggctggaaaaattgaaatgggctgacagaaaacatagtgcatgttacagcccaactctggagtctcttgactctctttctgtggcacatgctaacgcggtccacgttattctgcattacaataatatttaaggccctgtttgatagctcctgataaaagcgagctgtgtctggagcctgagcaggtgctcctcgtcagccttcttctttctgacattgtgggaatggcattcaattaaaagcagaatataaccgtttttgttcttcatggctcacaggcatacttcatactctcaaaactgaatacctcagcatggatagagctttatttgtgtctgtccagcctcttccaaaagcacattttggtctgattcagcaatgcttttcttgaacagtggggcactgttatgttatgtatatttaccactttctctatcaccaaggagactaatcccaaaccagtacagtcaagaaccttacagcattgtctttgcaagaccaagttcatgttgtcacagtcacagagtgcacagggtaaagatactgaacaggaccttgagattaaaacctctctttctttttcaaattcaagcgtatgctgatgagaaagagcgtgcaaaggtgtgaggtctgcaaatgtcttgtcagctgatgcttaattcagtgttttaatggcttgtttgggacagttgggacaaggtttttgaagaaggtagatgtctaaattctaggaagaatgaaaactagtccagaccatgaaaaagatattataatgagggtacttatatttttctctcagagggccctcatattaacccttactagtaagtggcaaaagaactgagagacgatgagaaattcttaggaaagcatggaccacaagagaatagaatttgtgcaagaccttatcttgatattctctcatcctgtgctgtcacttgagctttcatattcaatccgttctgtcataactattaggaatattgatcagctatgagttataagaatttgggatcataaagggcacaaaactcttgcaacatgaccttctgatttttcagcaacctccaagaaagcacaatgcaagaagtgggcaacacctaccagacactcctccatatgtagttcgctttgcaatccccactgctggccaaggtgtgccatcagattttaatcccatcagacctgagacagtgttggtggctgtaacgccattggcaccacctatgcaagacacatcaacattttcatgcagctcttataagacacgatagttaaaacccattcaaaccctcacatcccagaaaaatgcattctattttatcttgagaacatgtcttctcctcaaagttcttcactaatttaactcctacatttatgtttaaaattttaaacattaaagaagttttaattaccacaactttactttctcaaatattatacagacttgttgttaccaaatgttttgtatttggtgttattttccaggtaatttacaatgtctttgcaagtcagggtgcaatttccctgggatggaacacaagcacgcatgatttttgtattcaacagatatttattgagcatgtgtttaaggaagtcagctaggccctacaaaatatgaagagaactcataagaaatttcacattgtgcaaattgaattttctttttttcttttttactcattaaagtttaatatattgaattgttacattatgaggtcatttattttggacgggtttgctgtgactgtgttttttgttcttataatgtgtgaaataagtgtttattaggaaaaactataaaggatcttgtgtttccagatcaaaattcatggtcaatttgctagcatgagtccaggtgtaaatctcctgtgtttgtgggatcaagtgctcaactggaaacttttaaaattgagacaaaaaatatgcacatgtttgtaggaaaagacatacttgagtatggctacataatgtgggccaatatttacaatagcgggcaactgattcaagtcaagttcttaccttcctttgcagctcttgcgatgctcacaatatcagtgacatttggggtcagcttggcaaaaaaaggaatctgaacagcttgcctaacccagcggcagatgttccgcaccagctctggatcctgttcaaataggtcggttaaatatagaacaaaattaaagaattgtgatcaaaatgtgtactggaacaacagcaaagctggagacgtgcaagacaaatccaacttgacaatgagctacatgatatatttctcaaattcctcctcagtattacacctagactcattagggaactaaggttaacacacttcaagtgaactgcaaattcatcacataaaggttaaattcctcaacagagcctttagaaaataaaatttcaaagaacaaaatggaagacagtgtttcccactttcagttaaatattatcaggaatgaaacacaaacttttgatgttaagtacaagaaacattacaaaatttctagtgatctcattggtttaagcaaaataaaaaatatttaaaactgctgactcaagtgaatgatattaaatctaaagcttgttttcattattagacttagtcttgatgtgtattcaaaataaaatctatgacttcatcatcaatctacatgtgatatatagtatatgcaaatatggaataattcagccttgtattatacatgagctgatcagtaactttaatttacttttgtaaatgttaccaagatctgtgcagcattttcagcactcacaaacttgacagaattgatcaaaatgacaaaaatgaaataaaatatcaaatgctcattttaaaaagcaagaaatagacatttccatgtgcctattttctgtgattttccaggctcttattttctcatggggcaagtatcatttagagggcaaacacctatcctctccattgaataacttagctacagtacagtaatgttctttgatttcaacacatacaatagtcctttttttcattacttttagtgcaaaatttattctgacaggtactgataatgtgctttgataaattaccttaaagtatgcaatagcaattcattatcgaacttggtaatattatcttagcaagttaaaatgtttttgaataaaagaaaaacccagagaaatacagtcatatatttaaactatgaaatagcaggcaagcatatcatttgtaattaatgtttttgtatgtaagaaagttgctctttgcattttaacctttcgaattcctttaagatgagatttgtaatgttataacctttagaaagaaccttctcacttaggtttaatgtgtcttgatccatcatcctgtattactcaaaaagttatgcatttttgtgctaagatactgcaatgaggtaatttctgttgattgttatcatctctattaagcaaaacttaatacttttaaaaagaagtctttggcttggcttattctctttttagaacagtaatttcttcattaaacataaatattaaaaaagtgctatatggaatgctctacagggcatagtgtgcattatgaatagtaaaatgtggagacttagctgtacaaattctaactcatgaaaatggagatctgcccctgcccatgcaatgctcatgaaatatttataaccactgcattggtattatgaaggcagttgcatctttgtgactttcatttctaagttatgaatttccatgggacttagcctagaaatgacagtaactctagatgatatgaattgcatgtcctttgtggaagctctctttaaggtagactttgacaataatttaaagatcacttgaatggcataatacatggaatgtgtcctgataagaattactgaaacaaatttgaaatattatttggttccaatagagtaaacactaataatctgatataggcttccaagtggctttcaatactattgacccccatgccataataatttactctgaacatctgtcagacatttttcctgattttcactaggtgactgctttaaatgactgcctcttacccattgcttaatgatctggaatttgttcaaagtttttcaaattcttagaaacacatggttttttttggttagcactgtttacttgaatcatctgtctctattttgagataccataatttgaccctccatgagtaaatttgaccctccatgagtaaagttgacggtgttcacatatatttttctcatcttcatacttaggcaagccagctgctgactaatcatcacagccaagggtaagtacagtttggctacctgagaattttaaaaacaacttctaaccaaaattaccataaaaattaatgattgttctgtaaattgcaatgttttgtttgacaggtataatagagaatattctaatacaactagaaatgtggtgaggtcaataacatcatgaaatgaatctatatacttcagggaattcacgaatagactgtaactatttatattttcctggtttcttcaaaattttgatatgaatgttcaagatctaaaagcaattagtagtgtttctacatcttgaccttctcattttctagtgatagcatgagatggctttgccttttgtaacaagccagtttttagaatcttattgaaataaataagttttagacaatttctaattcttcccaaaatcttcaggatctgaaatatacaaaagtactcttatctctcagacaaatcaagagtttaccattaccaatacatacaaggagaagaagaagaggaagaaggaaaacaaaaaacaattattgactgctctatttctgggcactaaaaaatatatgttgtgtcaatgaatgagaaatgagtgaaaacttggcaacttggcatattttcacattatttccttatatatccatcaaaatataaactatgtctagatttaagaaaaacccagctatattttatgacaatgtccaaaagcatgaaatgtaggaagactactttacaaatcactggtaattctgtgaaaaagtgatggataattaagaaaaacagaatagcttaacaaaatcttaaaaatgtctaatacacaaaaacgtctacgtagatcacaaaggctttattggtgctttctaaaggcattaatgcttctccctgaacatgatttgcaatctctgtcacagtagttgcttgtcttgtgtgtgtgtgtgtgtgtgtgtgtgtgtgtgtgagcatgttcttcaatacctgttaacccttttgctattcaatgtgatcaccaaagaaagctctgaagcaacaaaatgatttcctgtgacagaggtgcatggcattataagcagaaagacacttgaagcccctaagagaatgagtgacagatctagggagcaaatggtggtcttgaggatactacataaagtgaaggtaccagagcagacttgtgaagtgctgagaagagttttgataaaagcaagctagaggcaaatttggcctatttgaaaattttgatgaggtacagcccagtgtctgcctgcaactaatcttatcgggaatagattcctatgaaaatcaaacaacggtgacaacacaactagaaaaggtaatgctgaggaatgcagattacttgctgcagtaatgtccattatgcaaaactggttgtttttaaagcttaatttctaatctgggacacaagataataatttttaattctagtaactactctgtatttagttacacattaagggagttctataaatgacccatcctgctgcttttgagaccctgaagatgacctcttcattgtagagcaggtatttctaccaattacttagggcatcaaatctcactggtttcatgtcctctgcaaaggaataagcactacagaatgagactgagaatttcctgataagctaaattacaagtgaaattttgacttgaagaaacatttctctcccatttacctagtaattttcactctgtacaattcatttcaaaatggctttcttagaatctggcatttcaataaatccactgcaaaattttaccagttataaaatgtttttcactaagcaactcttaagtcttaattcatatgacatgccaagaggtggctagaattttcattacatccatgtttctgatggaaagaactggggcccagaagatcaatctgagtaccaatttcaccttcttaattttctttcccattatcatgtcctaaaccttcatcttctttagcaaaattgctccctgaagtgaaattcagccatcaattgtaaactagaactatcgaaggcttctacttcacttattcctgtaagactagaagtagctgcaacataatgagcaaacgtgatgtattatccttctatgtcaataaaacaggacaggcagtcaactgttccaggcacaattataatattagtgaatgcaaagactatgtgttgaaatggagatgtttttattaactattttttagcatgtgtccttcttgcatctgtttttctgacttaagtattctaaaggtggtccaaccactttggaaattagttgtgcagtttcctaaaaaggtagacatggacttactaattaacccagaaattcaactcttaattatatatacaagtgagatggaaacatatttctacattaaaacttgcacatgaatactcacagaaactttttcaaaataggcccaaatttgacataatgccaatattcatcaatatgtgagttgaataaacaaaattgctgcatatccacgcaatgaaatatgattcaacaacaaaaagaaactaatgaatcatgccacaacttggaattaataaaacaaaatgatgctaagttacagaagtagacattatatgcatacatttattaaaattctgtaagaggaaaaaccatgagtatggaaagcagagcagtggttgctgagactgagaattaggctggaggagcaattaagtggaaataagtataagaaaatttttgagggtaatggaaatgttccattttctttaaaggaaaactattgatatatttgaagatattaaaattaaaatgttaatatatttaaaaacattgtgaaaagacaaggcacaaagtgggacaagattctgaagcacaattcataaaggagtagtatccagaatatataaaggaccacctgaaaattaatgagaaaaatgggcaaaactttaacatacttcgttcaacatagcatacttcattggatttcattcaagatgaaatccaaatggccaaaaaatttatgaaatgtgatcagccttatgaacacctttcacattttttccatataaggacaatgctcatttaaaccacaatgtgatgccattatctatctaccagattggggggttgggggaaagtcaatacaccctggggagaatgtaaatcagtacaagagtctttgggaaacagtttcacatgatctaggttccactcttacgtatatgtccttttaaagatgcaaactccagaatacatgttcaaaatatccatagtagcactgtttgaaatagccccaaagtggaaaaaatccaaattgtccatcaagagtaaaatgaaaaataaatggtaatatagtcatacaatggaataaacacactagagctatatacaatgataaggattaatctcataaggcttagcaaaagaaaccagtctcaaaagtatacaatataatttgattcatataaattccttaaatagaaagtaaatatggtctttagagacatatatatgggtgataaaactacgaagaaaagcaaagcaaagagtagggatggtgttaaagtggacagagagggttgtgttagggtgggacatatagggagcttttgaggtgttggagatgttctatttcttgacctggtggtcacatggtgtgcacattatgagttgttaaaaaatatatatgtgtgtgtgtaggtatctgtttataaatgcatacatatatgtttcatgtatgttgtctatattccacaataagaaaatatacaaatgaccagcaaatatgaaaagacatcgaatctcgctagtaattagaaaaacaaaagaataaacatgatcacctatcatgatttgccgaaaatgtaaagactgataatatccctctttgctgaggttgcaaagaaacaggcattctcataggctctcaataggaaagtaaattaataactcctttttaagaacaatgtggtaatatgtataaaaatgtaaagctcatcttataagttttaaattccaattccaaatacctagcctaattaaatccacatgcattcaaaatatgtgtacaaagatgtctgccattcactacagcattgtttgcagtagtggaaaaaaagaataaatgtcaatatgggaagatttgtgaaaagtactataatccatacaatgaaatactatgcagccattaaaaataaatctttgtaaactgacatggaaagatatccaaaacatattaagtgaacaaaagcaagacacagaataacacacagatagcctaatcctgtttttaaaatataaatatgtacatatatttatatagaggtctgaaaaacagactatgcatttatgctgtaacctgttagcagtgattacctctgaaacgttccatattttgaatgtggtataatcgggtatagacatttgccaaaacacatcaaactctatacttaagtgtgttcatgctaatataggtaaattatttctaatatagataaatttcatctattattctaaaaataattctaaaggcactcaaatataaatagaaaaatgaaagaaagtggcattgtaggtaatgtgggttctacccttttggcaaatatttattgaccatgaggcactacaaattttccgtgctgaacactaagatgaatgaaactagagtctgcaaggaaatgcaaaccaggcacacaataaaatggacatctgatattaagtgtcacaaaagacaagacatcctgaaagtgttctatcatttcagcttatttcagagcatgtagcgcagaacctgacacatagtaggcattcaacagtattgttgaattgatagagcctacaccacacaaattgacactgactttcttatttctatgtacttggaggaaaattgagagtacagtatactgggtccaggataacataatagataactgttttaggtactatattggataatacagatttagagatatgtaatatgctatccctgttctttaaaaacataaagcaaaatactttacaatctaggggagacaaatgcatacaacaaacacataatgtgattataaaatgttgtaactgtatatacctggaatgtgtacatgtgtgcctgtgtgtgtgtgtgtgtgtgtgtgtggctacttccttgtgccttaaatagaagatgacatagacccacctgtgtgtcctctcctccccaagcacatagccttctctattctgtttctcatttcaagttttttcttatttttctctttctacctggaatgcccttcattttttgtcccttgaataacacccttcaacgcagccctccatgacaaatccttccatctcacttcagcataggatggattagtaaatgactgcctctttagtgctcctataatgtttctttattactgcatttatcacagtgttttatagtcatcttctctgttccataatcaatttctttctactagactattagtcttttaggggatgtattttactcttttatcctagcaaagagcctggtacatgaaagacaataaataccatgttgaatgaaagaatgaagaatttctaattgcataccagctttccatcatgaaccacaaaacatttgcatctcctcttccatggagccaaaataagctggagatacaggatattagcagctcttgctccaggagccaactgagtttgaaaacagtcttttgatgctctccatcagtgagctaaaatacttggagagaactgtctcctactgtggcctagaagtccacgagaacccacctgaggacccaggctgaccatgatcctttctgtctgaacctttaatatattgagggcttttccagagtttgtacctctgaccctgaccctgcctcaactctcagtctttagtccctgggaccttgaggggaagggagatgctgtccatatttttatcagctaaggggaactatattcctgttttgttcctttaaatatcatttctggtgaacataacttaatgatgtttttttcttcctttcagacaaaatttccctagtgtaccattcctctgacattcttagtgtcaatgctccccattccacttagtcgctaaagctttctttttttttttttttttttttacaaatggacaagaattgccatacactactcactgtttagttaattcctgactgccagcgttctttcaggcactattttaattctctgtgaggactctcagatcctctccaccagctcacttctttactctcaaatggcagtgttaattgtagagatcagccctgaaagctgttcaaatttcagatctcctctgccacaatttgtccctatggaatcagattcagatttcatagaattatcttgcttctgccggctaatcccaacaggaaatccacggcctcacctggccatggtaatgaagtttgagaggtacctgcccaaataaacagatcaatgaacaccttctgcccacagtttcatgtgctattctagacactgagcctctcaggggcactgtagcactgttgctattttaatatgtaaataccttgtctctattccaggaatcccatgttgcatcaaagaaatggaagcagggctcagaccctgcatggtagagggggctctgcaatttaaagggttaactttctgcaatgttgaggagtcgcataacttttcacgagaactgatgagtagatatgctaaagtaactaagttctgaaaacgtctaagaaaaatacatgcagaagcaggcaactgcaacagacacagacatgaaccactcggatctaccttcaggaacagactctggcccagctgcaggagtgtggtgagctgactgcctctaactgcttcctcctttaggtgtgcctcgcttttaaactggggtcatgctcctttcagggagaccccagtgaatgatagcaaaactgtagtacaagggtctagctatttccggtgaatgtgggactcctctaataggcactttttgtcctgaagctccctactgggctagcaaagacttttcttgtgtctgtatcagggtccaatggctccccttttccaattttgcttccacttttttcctttcacaagcatttctctccaataaacctttggccctcctaactccctctctgtgtctgattcctggaggactcaactgacacaacagttctctacttgtatgaagaattctccctgtaagaggattacgctatattctaggaaagtcaaagaagaaagaaacttgcccaagtgaccccaggatatcttactgagaggaattcaagaaagctacgctgaatccaaacgaatctctcaaatttcttctgaattctagttctacccttggcttgacagaacaaggtctcttggaatgtcctgaatacagttaagccttgttggtgacctacccagcaatagccaatatatgctcaggggaaagaaaaggtccaataccaggaagcagggctaatttttttcctagaaaaagactgcttttagggacatggtaggagacaatgattgagtgacctctgcaaaaagacaactcagagacatccttaaagagtttggacacttacttgatcttttgattcagaacttgctcaaactcactattgtgatgtgggactctggaagcaattgtgcaaatgcccatggataaaggacatgatgcctttgtgtccgcaagacaaaattatccatcaagggaggatggccagaggaatcagtgtagatgctaatactcattccaattctttgtctcttacagatgcaatcaatgacaaaccctttaaaacatcactgagaggctgggcacattggctcatgcctgtaatcccagcactttggaagactgaggagggtggatcacttgaggtcaggcgttcaagaccaccctggcccacatggcaaatccttgtctctagtaaaagtaaaaaaaagaaaaaaaaaaacaaaaaaacaaaaaaccaggcatggtaacacatacctgtaatcccagctactcaggaggctgaggaatgagaatcctttaaacccaggaggtggaggctgcagtgagccgagattgcgtcactgcattccagcctgggagacagagcaagactctgtctcaataaaataaaataaaataaaataaaataaaataaaataaaataaaatatcattcattgagaggtcagatgaaacttcttccaggtgtgttgggcctccaatgccctctgttctgaactgtactccattctaatgtctgccttagctttcataatccattctgcttgtttgaagtctagttctccctttccgctatctgtactctacatttctagactttatccattgttcacttctttctggattggatccctctgagcctctatgcctgcctgaattgacctaaagttgcctaccttgcacccaaaattgatccatgacttgtctgtcacttaggggcagccattcctttctgccttataatgtttttctttacctatggtgtatattcccaggtctatttcccttgtctttaattttatcatgttttttttgtaaaaccaagattgacacaggttccataggcctatcttcacaggcaaacaaaaaactcttcgagagccatacattggccatatttcgcagtaattaggacacctccaaatcttctacattaaagcatttcagaatagtttattcttttgttgaatcctttatactgggccaaaaaatgagcttgaactttctttatgtgtgggatattatttatctttaaattaaaatgctagttttatctaccatacaaaaagggtgtcatccatagtttgcttattaatgagggtatgcagcataatttggaagatcttaatatatgcagaaacaggtcatgtacacattttcctgataccaccagtaggtgttcaaaattgtggaccagctgagccaaaatgaaccccagcaggtttcctaatcattgcttagaacacattaaaaagacctcagtgggttatgaaatataggcagctgcttgccctactatgtatggattcattttggataagggcaagtgtgtatgtaaatgtataataaggagtttttattctttgcagacttcaagcagcttggcatttgttttcttaatgcaaagcattagtgtaaacagtataacaatttatattttatacatctgctggtctattcacttagcttatgtatttcagtgctagacttagaaaacaaccacaagcataaaacctcagtatttttataattccatattgaagtgaatgattaaccaacacagggaggaagctagtgtggggcaccattctgccctggagcacccaccatgctgatacatttaggatgaagagagtctagggaagtcacgcttctgtcctgggaatgttatgaaatccaagcaagaaagaattactattgaggcaattttaaataacctatcagagaaaaactgcaatcccttggcaatgaatggttccgactaaggagaactcatccataacaagttggtatagttctttaaagaatttcaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaactggtaccagccgctgcaaaatcatgccaaaatgtaaagaccattgagactaggaagaaactgcatcaactaacgagcaaaatcaccagctaacatcataatgacaggatcaaattcacacataacaatattaactttaaatataaatggactaaattctgcaattaaaagacacagactggcaagttggataaagagtcaagacccattagtgtgctgtattcaggaaacccatctcacatgcagagacacacataggctcaaaataaaaggatggaggaagatctaccaagcaaatggaaaagaaaaaaaggcaggggttgcaatcctagtctctgataaaacagattgtaaaccaacaaagatcaaaagggacaaagaaggccattacataatggtaaagggatcaattcaacaagaggagctaactatcctaaatatttatgcaaccaatacaggagcacccagattcataaagcaagtcctgagtgacctacaaagagacttagactcccacacattaataatgagacactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagcactcctcagcaaatgtaaaagaacagaaattataacaaactatctctcagacaacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaattgacaacctaacatcacaattaaaagaactagaaaagcaagagcaaacacattcaaaagctagcagaaggcaagaaataactaaaatcagagcacaactgaaggaaatagagacacaaaaaacccttcaaaaaatcaatgaatccaggagctggttttctgaaaggatcaacaaaattgatagactgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagcagttgaatctctgaatagaccaataacaggctctgaaattgtggcaataatcaatagtttaccaaccaaaaagagtccaggaccacatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatacagcatataaacagagccaaagacaaaaaccacatgattatctcaatagatgcagaaaaggcctttgacaaaattcaacaatgcttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaagaaataaagggtattcaactaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaagtcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagagtcaatatcgtgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactgactagccatatgtagaaagctgaaactggatcccttccttacaccttatacaaaaatcaattcaagatggattacagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaaaaacagccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaacaaacaccgcatgttctcactcataggtgggaattgaacaatgagatcacatggacacaggaaggggaatatcacactctggggactgtggtggggtggggggaggggggagggatagcattgggagatatacctaatgctagatgacgcgttagtgggtgcagtgcaccagcatggcacatgtatacatatgtaactaacctgcacaatgtgcacatgtaccctaaaacttaaagtataataaaaaaaaataataaataaataaataaaaggaattaggaagggaaaaaaaaatttcttcccactgctgctgtaggagctggaaagaaatatctaggccattttgtttgtttgtttgtttgcttgcttgtttttgccagctctgtggactgatatccctttttgaggtaaatactcaaaactaaatactaaaggaaataataatactaaggaaatactaaagtgggtgactttggtagaagtctttggtgataatgtgggatagagaaggctttaaacatgaccttttgtaagtgtagtattcacaaattcaaaatgaaattcatggatactggattttatctaaaatctttagcaatcttgaacctaaaaatccttgaatatatttattacactcatgtggtggtttataagcatacatgtcataaggggtgtgtctgtgtaaaaagagagttctctattttaatctttcaggtgtcaaggaaaggaaacatggcgaggttaccccattttggggagtttattacaactatacatggaaaaataaaaaagtaagtgaaatgtttttggtaaaggaagggctaggcctctggggattgggacaccataaatcattttgtaagacatacagcagctctaaagagcagctcctgttttcttgttgttactttaggaatgggtgtctattgttttaaggattaaaaactctgcaatacgaataca

SEQ ID NO: 2196 - DNA, 201303 bp, Homo sapiens
ctcagtagttcccacgaggacatttttaatttataatttgatattgaaattacaattatacaaactataattggaatgaaataagcagatacattcctattctaaattccttgattcacttaaaatgcatctactgcagtcctaatctatgcataactcttcattaggtgatacttatggcaagacctaagtgtgaccactctcaaattttagtaagtttctaataaattctgttctgaaggcacatgtctctgtcttaaatagactctgctctgggaatgagtggtagaaccaagtaagagttcccagagggacagtgttcccagagaaaagaattaaaaccatgtgagagtttccagaggaataatgtatttccctgtctctctctctctttctctctctctctctcacacacacacacacacacacacaaacacacacacctctcatgaccagatcaattactaatgatatcattttaattcattttgttttaaaatgctgtgttagttgatatacatactatgtgacctttcacttactgcatctgtgaaagcttgccctggtttaatgaagaggcaatgggtccccaaagaaaagtgaggaggaattcaagtgaatcttctccatcaactaaggattttcacaggtagtaaagatcatacttcgtagtggtcaggtaagcctaatgcaattttgaatttggtaagaaaagaaattaaatcccagaatttattgcaacaatccacaacctcgaattgtttttattttcttattcccaggagctcttctttagaattaacctgtcagaaagcaggaagggaataaccctgatttattactaagagcaaagtgagacttaagcttgaggaatattatgggaagggtcccaaaatgaaagaacacattgtgtttatgctgacaaaaccagatcagtaagtcattaactaaaaatctaggttgacgggcacttaatttgaccttctagccaactagtctccaaagattataaaatcttactatacccttcatataagctgatcatttaaatgatacatgggaattaacctgcttgttgactccaaataggagacgtcagagagcccaagagtgtctgaagaatcaaagtctttacaaatgattcattaaagagaaagccaggatcaaagtctatgggataaacagaaaaaaaagtgctctcattttatttccttatacattttttacccaaataaaagacctgcttccaatctataagttcacaaaatctaatgacattattaatgtggttaaataacattacttagtttcagggtttttgaaaattctctaacattattactcaaagaatacaatgaaatatgctgtatttcaagctttaaagattaaggagagcttcagggaaaataatctgttacagaagatagtcttttcataagagggtctccttgccatacttccacataaagttaatgaataagttctattttcggatcatctaatttatataatttcagtcaaagtattttaataacctgctgggattgcaactaatttgacatatggttttatacacttcctttttgtagctaagctgctgaataaaaataaagtttgttgtacaaaacatacttgagctgtgtgtcacactaaaaatgttgggtatcaacagagcaccaaggattaaagttattttaagatatttgtgcatggtgatggtagtggggggatgtcacgtgtatatcatacatacctcagtagcaaattgctgcaatccaccaatattaatgggtccctcttcagtggcatataaattgcatccacctacacaaagatcagaggttggacataccattccacaagtcagaccaagtgggttgtcagaaaatatcatcttagcagctccataatagttctgcaaaattaatacaaaataaaattttactacttaaaaatatactttaaacagccaaattacgacaaacattatttcttctactaggtaatcagattgaagataatgatgtgtataagatgcataggtttcaatactactatcaggaaccatcaattaaaacttagcagagtatttgacacataggaatattcaatgcacagtatgttgataaatgaataactaatcaattttggaaaactgaagtttaaaatataataaatgttctgtaaatggttttcatttacaagtcatctaactatatcttgtcaaaaattattcatttcactttttaacaaatgaaaattagatggcattgtttgaacaaactcaaaacctaaactttaaaacaacaaaaaatggttatactcaggttatcctccatttaactaaattaaaagcagccagagctttcattatttttggaacatattattttctgaaaaaagaatgaataataagctgaatatttgggagaatgttttcctctaatcaaaaggaagaattgcatctgaccagtactcctgaaaacaatcaagtacatcaaaaacaagaaaagtctggcaaattttaacagacaagagaagcctaaggacacatgacaaataaatgtattgtggtgatttttatgatatactggaacagaaaaaaaagtaaaaattaagaaaatctgaataaactagggactttagctaataatcatatatcaatattatttcattaactgcaacaaatgtaccatactaatgtagggtgttaataataggggtaattatgagtgcatatggaaactctctgtactactgtcacaatttttccataaatctaaaactgctctaaaatacattttaagaatagagctgatagaatgcacttaacaatataaacatattgcatttatttttcctttggcttttatttgtaataattttgaaggtctttgaaagcacagacgttgcttccatgaaaagcctcagacataagtacagattcctagtgattacagaatactgatgataacaaaaaggaacaatgacatttactatttattgactctttaatatatccccagcactttaaaagacttttatttactcttagcaccaattattttatttactgttatcatctctcactatataggatgtccattgctcgatcaaaaattcctagatgcaagaagagacaggaccaaacgcctgataataataagaaaacaataaataaaataagcaaactcctaggtaatcaagaaatttaagtcagaataaaagacttttaaaaataaccttgacgaaaattcaggaaaagaaaagacaaaaaaagaaacaattaataatagcaccagaatactggaatctgtttaaaaagaatcaaactgatattttagaagtaaatgaacattttaaaataaaagctaatgcacggctttcacagcattcgtggtggtttaacagtatttgtcttgttcagtgtcccttcagcaatgaaagttatgtctgccatgtaagaatggttcttctacatatattttctgaatatgcagtaagaatgtggtatgaaattaaactcacaagcaataaaactgaaatataaagggtaaataattagcaaaggatcataaagcagataagtggcagagacaggattcatactaaagcatactgttcatggctcaatagattacagaatctagttacagtgatcttattcagctatggtccatatgttgatgtaaacacacacacacacatgcatacacacacacacaaaagttcttttcaatataagctggaggacatatagctagtccattcgattcattacactttatattaagtagtttttattacatagttcttttagttgtggtctttccatcagttcaatgaaaagcttaataagttaaaagtctgtttcttttaatcaagagattaggatctgtttattcccccaaattggatcagatttaccactgtgtttgtcagagtcttcggtagtgtctctaaaagaggttaataataaatcattaagctgtcaaagtataatatccaaaagtcaacacagaaatatcttacacacagagaagaaaaatgtgtgaaagattatatttacctcattaacaaatacagaataaagatagtaaaatctgagtcaagggcatttgaggctgccatggcttaatcggtgaattgtataaaacatataataacaatttatgctaatttctgacaaatacttctagaacatacaagaaggatttatctcaggaatgcaaggttggtttatatcaaaatataccatatcagtagaataaaagacaaaaaatcacacaatcatattaaaagatgcagaaaaggcacttgacaaattcaacatccctcatgacaaaagctatcaacaaactgcaaatagaaagaaacttcaacaccttaataaaaggcctctacaaaaacccacagttaacatctcactttatggtgaaaactgaatgccttcctccaatatcaagaaaagaatgttcactgcattagtcaaggagtcaaaagttctccagagacacagaaagaataggatgtatgtgggggggggggggggtgtgtgtgtgtgtgtgtgtgtgtgtgtgtgtgtgtgtgtgtgtgtgtgtgtgtgtgtatgagatttattataggaaactggtacacaattaagaacctgcaaatttccaagatctgcaatttgagtctgccagctggagacacagaagagccaatgttttagttcaagtctcagttggaaggcctgagaaccagttaagttttagttttagttctagtccaagagtaggggagaaagccaatgtttcatttcaaaggtagtcagacaggaagaattatgtgtttttcagggtagagctagcattttgttttattcagtcctttaactgattagatgaggctcacctacacttgggagggctatctgctttactaaccttactgatttaaatgccaatctaattcaaaaacactctcacagaaacatccaagataaaatttaaccaaatacttgagcacacaaaggttcaatcaatcggacacataaaatcagccatcacactaacttttacaacttctattcaccatagcacttgaaattcttgctagataattaggcataaaaggaaggaggaagtgacagagtggggagggatagagatagagaagaagagagagagagggagagagggagggagggaaggaaagagagagagagagagagagagagagagagagaaagttatccagattggaaagggaaaaattatttctatttccatgtaaaatgatcttgtatatacaaaccctaactaatccactaaaatactatgagaagtaataaaagtacagcaaacttacaggatacaagattaaaatgcaaattaattgtatttcaatatgttagtaatgaacaaacgaaaaataaaatcaagacagtaattccatttacaacagcaacaaacaaaataaattattcagaactatatgtattaaaaactgtaaaaagttcaaatttatactctgaaaactatagaaaactgttgaaaggaactaaataatacctaaataaatgaaaatacatcccatgatcatgggccaaaagactaattattgggatggtgatactatccaaatttatctaaaatttcaatacaatctctactaaaatcccagctgagtttgcaaaaattgacaagctgatcctaaaattcataggaaaatccagaggatccagaatagctaaaatgaaaaataagaatgaagctagaggactaacacttcctgatttcaaaaattactgcaaagctaacataatcaagatagtatggtactgacatgaggataagcatgtagatcaatgtgatataaatatgagtccagataaaagccttcacatttatgttcaattaatttttgaaaaaggtttctaaggcaattcaattggaaagaatattcatttcaatgaatgatgctggaatatctgaatattcacatgcaaaagaatgaagtttgaccctatctcacaccaaacaaaaaaatgaactaaaagtaaatcatagatctgggggtctgagagggaatggacaataactgctaataagtatggaggttttttttagcggtgataaaattgttctcaaattgactgtggtgatggttgaaactgcaaatgtactagacatcagtgaattgtcaacttcacttacatgaacaaatacatgggaagtgaatacatctcataaaagctgttatgttttaaagcatgcatttaaaggagtgggaattatatactcaatttaataaaggaataattgcataaaatagctagattatatacaaaactaggcaatgacctgtagggcaataaaacataacttttggaatcatttttcttctgaatagaaattgcatctctacttgacacaaagctactagttaacatgtacattcataggttgaatttttaagaataaatacagaagtgagccaatggttctttctcctagaaaactaaatagtacttagttgttcccttgtatttaaagaataccttagtatgataataaaaagacacagtcatctccttgacctgactttctggttttggataattttacttaataataatgaaaatgagcaattactaactcagaattaatcagtctattcctaagcaaacatatttagttcctgctgaagcccactgatctcttcacttagtaaaagcaactgagcaggtcatcattgttagaaataatctcaaagtcactgtcagtattctttcctcctcttatatgacatcacagaaacacttgatgtgattcattaacaaatatttgactgactccatgactcaaaattcccattgtataattagaagtgtccttgtaatataaaaacagtatcatgcaaaaaaatgtgatctgcaattggtagaccacttttaaggatacttggggtaaggaagcacagaaaaaaaaaacataatccaattaaacacttaagtatctttccacaagaatattgattgtttcatgggccccaaattagcttcaagattgcacataaaatgatatcacaagaagaaaaagagacacgtttgaaaaattgcaacaaataaaatatttaaagttatacttatggctcatgatttttctatagctgtcaaactatgagtgtctgatctactactgccatgaaattgtctaataattcttaacactctcatgactctaagtaaaaccctttcactaaaataaaatttgtaggaggttaaaaattgttttaagttagtaaggatttattgaatgtcttctaaatataaagcattatgtgtatgtttatttttttgaaaaaaacaagtatatgcttcctgatatcaagatgctttagcatcagagtaagaagtcatttcaggttaaggtgtccagaaacagcattaaatgggtaacagtcaaaatgattctggctgtgacttgtctaagataagagagaatcatagccacatcattcttgattgatatgagtaaatattcaagaaagttcacaatagggtttggtgtaatgacttggcaatttggctgaggtaattcattcacttgggaaagattattagaagatatatttgaaaaatatgcatgaaccaaattatggaggattctgactggcaagctgagggattactatttaattaaagctttttaatagaagggttccagtattaagaaactaactaagaaaaatattgaatagatgatgtggaaattctcagaaaggaaggggaaaggtagggagcccaagagaggttacacaatgatgcctagaaagaggaaagcataggcatgtttcacagaataaagaagcatgattttgaaaatgggttgaaccaatattaagcaatgattcacaagtcacctttgcaatctatctattacaaataactttgaagaaatggtagataactccattgtttagggatcttagtactcagagccaaagacactcagaaacctattaggaggggaacacctcctcaattcttcccacagataatgtcaagatcagtatcaatttattctctcatagcaagtgggaagatttcttgagtcctccttctacataagaggtttgatttctgttctgtgagctcttcattctttttaaaagtaaaggctagaaaatttaaatttagaagggtactttatagacaccccagcagtctccttctagaaaatacacactacttcaactggttcatgttattcaatcagtcacaaacatttcagtgttccatcatgtgaggaaaaaatgtacagagctatgtcaggagggatacaaaatacatatctgatttttttgtgcatagagatattttatgtacaaaacattaagactttcaatccttctcctaacaaaaatctaaagacaaaaataatatttgaaatgtttgctgttttcaaatcaacacattaggcattgaatgttctttggcccactaatttacccacaatttgcaggtgttgaattttctattagtccttggggtatttaaagcatgtctataggcacgacatgtgccacttaggtgagttaattttaaaataatttaatttctatactttgctttttatttaaaattacagcatgaaactgcattagtgtcattcctccacaatttaatgatttccaaagtcattatcaagaaatggaaaactcacaagccgctaccctgtcatatggtataactaatttaacaaatagtcctatcatattcaagtcttcatatcactacaagattatcaatacagctggtggatttattttaaagtgttcttccttcttccaatgacagttttcacagatggaagcacccttccaagataaactccaatctgctgcatttaaaaaaacacttgggctaaacttcaagaagtttgcatgtgtgagaagggtgaattaacattacttttatttctggctcaagctgtaatggtgaatgtactgatgtacattaattgaatagaaaatgtctctagcaccacacacagaaagtacatgcacacagaacactctttttgtcaagctgtcaccatccctcaatgaacaacctgtgggtcctcagatatttggcaaagaagaatgtagatatattgtgaacagaacacatgaaaattcctgccctcatcgtactcatactctcagaaaaaaaaaatggagatagaagaataggtttgactagctttattctgaaaaattctcttttcatatcttagatataccacattttagatcagctttatacaatatgattcatttttagaactacacatttggttcagtgagcctcgtttaagcctatacatgtaaggaaattaataatcattcttgtagaagataacgtttttattgatcctgagatatttaactggaacaaaaacacaggcacatacaagcacgtgcacacatacacacacgtacacgagctttgaagtcatcaactgaatttgaattctgcttatactatgcacaagcaatatgactggggaaatgtcatatctctcagcctcggtttcatcacttgagacatgaagatcaaaattccttcttcgtcaggcatatttatattatgcattttttaactgtgcatggataagatgcctattccattatgtactatacaatagattcagtgaacttaggttcccactctacccctttaggctttttgtcactaaaaagattttgttaaatgttaatactgtgagtttaagattttaatatttactaaataaatattaaataaatattccatgttaggaagtagaataagaaatacagaaagaaagaagcaaaatgtatgtacagaaaatcactaatctaccaaaccataaaatatcaatgacatgggggcatatgaatggtggtaaattttttatatagaacctatataaattttaagtcacttctattactcctattttctgcatcctatcctccctgctctatttaatgaacttgagaacttacaatcttccccatgagttagtcaaaataacttagtctatgtgtgcacatgtattcaattcattattcatcaaatatgtgagagcgcttttggtaagcactagatatgaatgaagaatcaatattgttgcctctatattgttctagctaaatgaaataaaactttcatctgtatcaaaacccattcttttcaggtaacatttcttttaaagacctttatcaatacttcagcttttttccaattggaagcataatgccagaaagcactttgtacaacagccttttgatgattgtgtttgttaatatatatttgcggtagtcttatatttttatgacgtgtcttattttttcttttattaatgtcagagatcatgtctaatcaaccccttttggctgtaagcatataggcaactacatatataatactagaaactgaactactgattactacttatcgtcttctttttagacagagtctggctctgtcacccaggctggagtgcagtggcgatatcttggctcactgcaacctccacctcccaggtttaagcaattctgctgcctcagtctcacaagtagctgggactataggcatgcaccatcacgcccggctaatttttgcatttttttagtagagacaggatttttccatgttggccaggctggtcttgaactcctgactacaagtaatccagccgcctcggcctcccaaattgaggggattacacacgttagtctctgcacctggcctacttatcctttaatattgaaaatgaaaatctctataaaaggcaaaaataagaaagtgctttatagtttttgaattatcaattaaataacatgaatatatattttaaaattataaaagccccactttatccagggaaaataattataaatgcaataaattttataagaaatttagaggcttaagtttttcatttccagtaagttattaaatttgaagagagaaagaaaaagatgaaatactattttatttagtgtgtagtagagtttctacaatttgcttcaaagaggatacttttctacatcgaaacactaatacaaatacaaaaacaaagatgtcaaagctagtcatcattagagttgaaaaaaaaagcattgggtattgaaagaattctacaatttcatttatgaatattacacagcttgcaagcaaatgagaatctttaagtttgagaaattattgaaaggtgaagattattaatcaaagaatctcatattaatgtgaaatatatatatattcaaacatatataacttacatataaaatgctgaaaactttttctttaatgattatttatgccatgccaaaagacacatgattatttatgccattaaatctagactgtaatatcacaccatttgttctatacaaaaaagtcagactattttgtgcgagtttgctctttattgacgagaatatgagcaattccttaattgacagactgttgtgatgcatagtacagtgtgttattatattctacagtggaaataaaagggtttttcaaaaaagcctccattctaagtacataatttaaacccattaatagcttcaaaatataattagtatcgattctaataatttactttaaaaattttaatttttcaaagtagttttcaaaaaaactaaactcaagtttctttaacatgaagtctattacattatactttttactcaacattcaagacgttaatagcacttacaaaatttggtcatgatagcaaatgttccagccttttatattttaataatatttcataatctgcatactttgttaatatcgatagtatagtgtaatacaaaggcacactgaacaagaaatctagaaaattcaattatactatcaagcagctgtgtcattagctttgctgggtttcaaatttcttttctatacaatgagatgcctagttcaattacattttcttttggtctatattctgttacattgacttttacttattaatattaaaaaatacccaaaatagtatcctatgtgtttcttatacagatttttcttgtcttaatattgtaaaagaaaatagttgtgattccaatttaatttatatatatttagtttttatatcattagtgttttttaaaaataatttaaattttatcaaatatttacaaaagcatatgtttaaatttgtctatactatacacaaccacaaacaatatgatgttactcgtttcatataaaactggcttaagatgtataataaaaatcctttctcatttatactaacatgactcttggacttatagttgtttacattttataacttataattgactaacatttgctttgagcttacaggcttttcaaatctgaacttcctctattaaagcaaaagtgaataaaatcagtgactattacacattgtatcagctgtgattaaaagtaaaaatgagccgggagctgtaatcccagcactttgggaggccgaggcaggtggatcatgaggtcaggagatggagaccatcctagctaacacggtgaaacctcgtctttactaaaatacaaaaaattagccgggcatggtggcacacgcctgtagtctcagctactcaggaggctgaggcaggagaatggcttgaacccgggaggaggaggtttcagtgagccgagattgtgccactgcactccagtctggcaacagagcaagactccatctcaaaaaaaaaaaaaaaaaagtaaaaatgtaaccttgtgaagttatatatatatcaaaacagaagcaagatacatcttatataagcattaatgactcaatagataatgttatatccatctatccttttcacaccatacattcaattaagatgtgatattttaacaataataccccagtcctttgtctttaactctagtaaatttagtattccacaatttgccagattcaagactaggaagctatttattaaaattaaagtctggattctggaaaatttagttaatagttacattaactacagtaacattagtaataaatgaatgagtcaaggtgggcatacatttacattaataattagaaattaatattttattatagtctgaacatggtgctcaatatttattctgtagaactctttcagtttacaaagctagttttacacgcagaaaaaagctaggatactttgaaaataactgtaatgtcaaggagatgcttttagttaataacaaaatatactacacagcaaagaaattaaaacagcttggtcctgttacatatagataggtaggacaaagaagatttgaaaatagatctaaataaatatggaatcaaataggcaataaaggtggcattagtatactagagtaattattcaaaaaacatatttggaactattttagcaatctgggaggaaaatcttggtatttttctcactccttataccacaatgaaaacttagaatagggtctgtcatgtgctattgtgaaacctctcagctttactttatttaattttactactgaattttaatatattgtttttattataaaacgtatgttcattataagaagcaaagtcatttagagatttataaggaaaatgttagaaacctaacttcaccctacactaacctcaatcaaatgaagaaactaaattacatcctccccttttttgtttatatacagattaaatttttttctaaaagtagtgtcatactattcacattactatgcaatttgtcctctttcacttactacaaatatccttttagaccaataaatataaaatgcaattttaagaattgcttcttaaccttccataatataaatatagcctaatagattgagctgatactaaagtattcacccgtttttattacttcaaacaatgctataattgctttaaataatatatttgtatatgtgtccctttacattgtaattactttatttctctaggtagaacaaattaataaagcatgctggtgaaacagtacatatatttttaattctcaaatatatatccatcatatcaaagttctttccttcctgctgagtaacacaggggtttacttttcaacttcaacaatttgatgagagaaaactggtatctcattttttcatttacatcttactgactaatatgcaagcaggctaattttaatatgattaatagtcacttatatgacttctataatagtaaaatttttgcctatgcctgcactgagttatccttctcatataaattttcaggagctctttgagtaacaaagatgttaacacttggactgaaacatgcatggcaaataatttttcacttggtttcaagtgtggttagtttttattttaaaatatatttttaaaatgcaggtagtaaaatgtcctctcccatattttatagctgcttgtaattaaacttatccttaaatatgtacttttaatatctaggttagtccacctgaaaagaattctaggagataacctatgaaagattctaaaagtaaagtcaaaattattccagatctacttattgaagaagtaattaattttccactgaattgaaatgtcctccttattatatattacacactcatatttacttggttctatttatagactctcatctgtttgagaaatgtatattccagcaccaatactacattgttttgattacagtagctttgtagtatcagtatctgatataataaatcttttttgtcttcattttttaaagtttctttcttccatatatctccccaattactactcctatattttcctacaaaatctctgggttttttatcagtttagactatccactcattgttaaatatctaccgcacttttccagggcatattgaaaactaattatctgccatgactcttctaattagaaattaaaattataggaaaatagcttttaagtcatgaataggcatgtccaaggactgaaaataacaaggcagtaagtagaccagagaaatcagtgggaatcatcttaaaggcatttgccaaaccatgtaaacaaaggcttctgttttaagggtctccaagcatataggttttagaaaaaaaagctcaaggcccacctaaagtctgagtctaacataagactcaatcataaaactaggattgtgtaagtccacatcaccagaaagagaaattaaaattaaccccacctaggtcccacctggaactgcacagaaacttttcagtcttaaacttgggtacacaagaaaaagagggaaaataatgtccttagcaaattaaatttatatttgtatttttggtctgattcacacaatcttggtgactcgaaaaaaaacattaagtgaggaatttagtttaaggtggtcccagaggactggcggtaaagccactgcctgagggaagcaaatataaatcccttgtaaagaaacatgcatgcttcacagttctcagagaatttcctccaataaggcatcaacacaaatgacagagtaaaaaaataataataaaaattcaatgaacatacaagggaacacaaagcactcagtggaggcaacagatagcacagacagtatcatcagactcgcagagacttttaatagtaaaattgacagaatatgaaaacgaatattttaagttttaagaaataaaaggcggccaggtgcggtggctcacgcctgtaatcccagcactttgggaggccaaagcaggcagatcacgaggtcaggagttggaaagcatcctagctaacacagtgaaaccctgcctctaataaaaatacaaaaaaaaaaaaaaaaaattagccgggcgtggtggcgggtgcctgtagtcccaggtactctggaggctgaggcaggagaatggcgtgaacccgggaggcggagcttgcagtgcgcagagattgcgccactgcacttcagcctgggcgacagagcaagactctgtcataaataaataaataaataaataaataaataaataaataaataaaacaataaaagtcttgaaaagattaataaaaagctggcagattagaaaaaaagcacaaaaaactcttagaaatgaaagatataattgtagctcaaaactcaatggaccattttaacagcatatttgaaactggtgaagaaattattagtaaacttcaaaacagaattgaaggaaattatctataataaaacccccacactgtaaataaaaagacaaatgtatgaaacctaagagtcattgagaacaaagtaaaaagatttaacatgtatctaataagagcttcataaagaaagagagacagtgagatatttcccaacatgatgaaagaaatcaatccagtttcaataattgcaaagaaaaataagtaggacaaataaaaagaaatatggacttagataaatcatggtaaaattgtttaacatcaaaaactaaaagatctttaaaacagcaccccaaaggcatattaacctcaaatgaacaataattagacttccattcatttttcaatagtagcattgtatgataaaaggccccaaaatggtaagttctatgaagtggaaaaataataataatcattgccaaccctgaattctataattagtgaaaaaacttttcaaaagtaaaaaaaatggaaataaaaatagttcagaaacaaaaattaagatagtctggcaacaaaaaaaaaaccctttctgaataaaattttatttattccaagtagaacggcttccacatggaaattgcaacactgaaaaaattgacaaaaatatgaataaagctaatccaatattgactaaataaagcaattataatactctcatcaaattttaaaagagagaattaatatccacagaacgtcttgtaacgtggaaagaggtaattagaattaaacctcattctatgacacaaaacccactcacattgatattctaaatgacacaaaccaacccataatacataggccaaaattggcaggtcatctgtaatgaaaactggcacgagttcagaattacttatttaaatcacatggcatactcaactcagcaactctgcaggattatggcttgtgtaccctctaggaatataacagagatagaggtgggggtgtgtgtgtgtgcatttgtgtgtgtgtgtgtgtgtgtgtgtgtgtgtgtgtgtagggctttattaagatataatctacatagcatatgtacaccaattaatttagaacactgatttttgaatcactcaaaaaagatactccatcaccactagtagtcattacccacttttataaaatactcctcacctatttttgcccaactctccaaaccgagtcccaggaaatcacttatctactttccgtttctatatagttgtctattacggacattttctaaaatattcctcctaactgtaattctataactttggagacatgctggtcaaaggagatagaggttttgttttgttttgttttaaagctttgttctcttgagcactgtcttatggcagatagataagtcaatactctttaaatggatagaggggtaaatacttattatccaacaataaagatgaaggaaatgacctcctgtaccaagggaaacctgaaatcttatcactactttttgttgcatatatctaaatcttcacattttaaaaaattactgggttataaattacggactttccaacattttttcttccacttacttctttaatataatagtgggagaaaccccaatcaacttacataatagattatgtatttggacattagtttctaggcactggggagtaactacagttactgagcaaggaagtcagaatttgagcaaagctttagaaagttattctggaaatgatcaatattttgtttgataagagtataaaccattcagccattgaaactgaaaggcaaactggaaagcagaaagcaccaaatctattggttacatttctgcttttctgctttgtaacagctgtaatatgtgtgtgtgtttgtgtgtgtgtgtacaatatatgtacaatatatatccctctcaaccatatatatatacacacacacatacatgcatacacacaaacacgtatcaatgtaactttcttataaatgcaaacattattatcaataatttctgctgcttcgattttgttgtttctttaacttccagttacttttaataaggatctatcacaaagaaaaacttttcttttacatcgtgtaatttagtcagcttttctgtaacacatagtatacatttatttatctatacacaaaagccacactaatctgattacacagattttataaacacatgcaaaatcatggaaaaatcgatggcttacactttaaaagttttaaggagaatatatctctattgttttaaatacaggatcacgaaatcaaggaacactgtttaaaacagccatttatttcactatatttatagactgatctcatgcattctcatataaagtagtgttttttaaaagaaaacctatcaagaaatataacccaggattcactgtttgatgaatctgaaatgtgtacttccaattgagagatacaattgcaaacaacagcctgcacaaaccaaacagagaaaaactgactgaggggggacaatagaattgagtgtacctttcaaaactagagctgtaatccagtttgtaagaaaataaagaatggaagtattggcctaaactccactgaatcacagaagcctaacacaatacaaaacaagtgacatccttttctcaaagaggcgcaaggctcattgagtctggcgattcaattaccctctcaacctggaaagaacacccctcctgcgttgaggtccactggcaaagcaatgtgggacagcctacattgtacacagctggtaaatatctaaaaagctgcaggctttaaagaacaacagtctttgaccttttatgattgctacagtgatccttcaacaaaaaattaggagagttttttttttttttgaggtttgacaacatattatcttctcaattaatcatcttcaaatctctcatattcatataaaaatcttttaaatagatatctaagcacaacgttccattaggtaaagaatatgaacaaattaatgaaacagaaagtggatttccaaaaatagagatgactgtgatcttgcttagacattttgtaaacctaagaatcctttttgtctttttttctatacatttgtgtagaccttgaataaatgaagtgtgtactcataaaataactactgattctgaaatatctatgaaaaaattggggtagcatggatcttgtaagatagtccgtcataattctcatatttcctcatgcttgatatgaagagtgttaacttagatatatttttagcgaaaatactttagacttcaatctttggattctccttttctgatgagatctttattaaaaaatgtgattttataaatagcagtttacttcaaaaacagcaatcacttctatagtatttaccatattgaatgaatagggaaactaataattccacataaaaaattgttgagtaatcactatattagacattttcacataaaaatattattcagtttatactacaactctgtaagatagatgctacctttccttcataagtgaaagtaaggaggtaattacccccagtttcacaataagcggtttatctaaaaattcaaaccagacttcaaatcctaataaatctgacaatgcagatttaaatctgaccatgcaggaataatttttaaattctttcaagaccctaaatttatataaaagtatttatcatttttctcctaaattatctaagtacttgaaatattaagaaataaactttatacgtaaaaaggcacctggttgttgaagaacgaggagttaaggtatctttacagcattttagaaaattagtgttaaaccttgtgaaaggattctctgtatctttatgggagacattgttcagcctttgctcatccttaaaggattagacacttgggcgagctctcaatgctctcttcacaaaaacaataggtactatcaattattcaatcaatcaaccattcacttagtgaatgaaaactgggcttagacttacattgatttttaaaaaaaaataaagatcaaaattccttttgttctactcatgcccatataagccttttcttctaattttagttgtgtattttttttgctacaactctatgagtcattatgaattatttcaagtcttaaacatattaactgaattttagttaaaaaagtctattaccttgatatatctatgtgctagacttactatcaaagcacactttcatagatatttcacaaatcataaatgtgttttgatgatcaatgacagttcttgtctattagtatttagcaagcataaactaaaatcaatcttttcagtgtcttgaattttaaaaatcattcattttaacacaaactaattttcaaaacaaaaaacaatgaacctggattttcatgataaatcacaacttggaagtgcttaattaataaatgtgccacatttttaaatgcctatagaagtcatatttaatggtttaactggatttgctaagacaagctgtattctgtacccacagataatagagaacaagatcaaatactgttattttcatttgcagagttaaatctgaatttaccttgtttgcaatacttgtgatgaatgatttaatatcaagattagttggacagctcttctgacacggggcatctgcacatttcaggcatctaggaaataaaataactatgttaagaaactacaagataagtgagataatctattttctaccttatactcattcagagtccgtgtctagtaagtataaataaaatcgtatcatttttaggtacaaaacatttttaagcaataaatacaaagtttctgtgtttcatctttggcactcctcttgggatgcataaatgagaatcatgctggctagtaactgtccctcctctcagagttccttcttgattttaagagaatcatacttatttaggacataccattccctcactctatcagttttgtttcatccttcactatgctgacaatacttgcatgcagttttttatgataaggtttgtaattcttttagaccaaaattattaaacaaatgcaaagattaaaggtaaagtcttattttaccacttgaaatatcctttcttccactcttccttcctcccagcttccctctctacctctctctctctttccaattgtctgaagtctttcagcctccatcccattcacaggacaattgagttctgtaacagatgcctcaaagcatagcccagatccatacccttcaggaccaaagctttattcccacagctgccttccctctgctgctgaagagaatgggctccaacaaggtcagcctcctttccagtagcagcacacatacaattcaaggtcagtgagcggggttggaggctctctgcccattcccatatttggggaactagtctgcaaggagccattgaagcatttattgtgactatttgctcagtcccacttccttcactcttctacagatgttaacctgcatataaacttcctgcatattaatctcatctgactctcctctccgggggactggccagagatgtattcaaactttgttgcacctaagaaccacctgggaagcttgataaatggcacagacttcacagaggagcccctactgagtccaagttactgacctgggaatccgcattttgaaaagggcctctgaagtgattctagtgttcatagttggaagcacattgttagaacaacattctataattattcattcaggacaactaaaaccaatggccagactcatcctttatttgcacattaacttatgtgtgtttttcttcatttattcatttatttaatacatatttaataatcctccattacatagcagaccctgggatatgagaatataaaagtgttggaaaaagatcaccatggtcctgccatcatagaacatgcagtttgaatgaagtacagacacagaaaaagccacacactggtcaatgtggtcaatgagaatctgggtgaaatatagcatgctaagggagcacagatgaaagacagtagtcctggagggaggttgtcaggacaggcttcttgggaggaataatattgaaatagaagcttgaagaacgagtggacattaggaaagcaaatgacagtgggattctgagtgcagggtcactcaggataattacccaagaatagaaagagtatgcaccagtgcctggaaagaaaagaacgtgacaaggtaggtgaactaatgaatttggtctagcataaagtgagagtgggagtagaaagaaatgaatgtggagacagacaactaaagaaaatatactactgccacatgtgtcagaaaaacagcattctccaagaatttcactgagcatgaatcctacattgctcagtgacaaaggtgactagctagttcattttctatacacttccatgtgtaaagaccttggttcatttccttcatgaaaacaataccagtctccttgtcattcttttgtgagtaagagagccctcttcattgtctgaaccaatttctcagtgcctaattaatatcttgtttttaaatctgatctcttttctctggtttgtgcccttagccttctctctaaattaaattttacacaatgagtaccaaaggcttttcataatcaattgtcctctctgaaatgtagtcattaaacctcttccctatcatttctctaaatgccattgttagattcacatctatcatttagttgaattcctgtctgctcatacttaacgttttttccccgaaacactattgttgagttcaaaaataatttcttcgaagtataatctgcagcatacattgcaaacaatacaaaaagctccataatgtatggcctatttggtccttgatgttaaaatgaggtgatatttatatgtgtaactgtcatgtggataaatatactgagcattaatagtggtttgaaaggattttcttttatgtcgcaatacaaaatagctaaaaagtaaataatatgccaacttaaatgtcaccttattgttgaaaaaaagtcttttaaacagttgtaaaaatatctgccatcacacaaaagtaagcgcacacacacacatatatggcacatcatatggattctggttatctctatgaagtcacaagttttctgcttttcttttttctaacacccaacttgaataataacacaattaaaaaataaagttataatgtcagcagatataagggaaccaaattaatgtgcagtgtatttttctgttcttccagagaaatcttatattcaacataaacagattcacttaacagtattgacaatgtaaggatttttagttgtggttattaagcctctttaccaaataattctccttttattattgagctagttcacaaataacagctgttgaaaatgtcagatgttaatgaggcagggccacgcaaacctgaattgtagcattcctttttcctttggtgtcatgaatatgccagaatgggcagactctgataataataccatcttgcaattctctaagcgctctgcagactaaagtgcatcaggctgccattaatcccacttatcactctgacagctcagtaattacactactgctatagccaggtagtcctaataaaatatcaaccactgcactggaatgcatactggtgagatgttttattaaactttgagcggtgggggttgatcatcaagtgacattagtgttgacctatttttctatttgacaataaattatcctttgaccatgccataatagatattacagagtgcatttactgcaccaaatcagaaaggtactgcattacaatgatataggcaaatggtgtaaataaaatagcagaaatgcatgtcagaatgttattacctaaattgctttaaatgattgataccatgaaaaatcacagacacagtacttaggggaatatgtcaacaattatcgtaaaccacagttccacataaatttctccttaaaagtaacatttaaattacacttgttttcatctttagtcatttaattccccttttacctttcaaagttactctgttatagtgcagtttatttttaaatgcataagcagcaaaaattaattcagagaaacaattatgtcatacattttcccccaaatagttgttatacataaagaagtatatttgatttttttaaactacaagaaaacaacttagagttttcactaggcatacactttttaaattttcatatttaatacaaagcataacaatgaatttgtcgaagagcaaaatatagaatacttaatcaatgttaattttttataatttgacatgaacataaaaatgtatgaaaacttaagtactgttacttaaaggccaaaaactattaaagatatatttatccatgatatttctctagagaaagagaaacatgattcctcttcccaaatatccgtgaggctagacagtttgactccatagtatgacaccaaaaatattatagtgagtaatgaaacaagcggcatttcattcttcacacatctgagaacagatgcctgcttcttttattggtaaccatccacagcatttggaattgtaacctatgcttgttaaagaattttctagtcaatgagtttaaatggctgaattaatttctttctcagataaaaaataataataaaaaaacacatacacacaaagctatctgaaacccttaaaactcacattgcattgtcttagctttgctagagtttggtttaattgagtcagcatggtttcatcaggctatgtaaatatacgttaatctatatataatggcattaagcaagaaagtattcacattaaaaattaaaatattttcctaatattaacattgcatttccttagatatttaatgttctacatcatcatttggaaagtctacctaatttacatgtatcagatggattcaaaaccttgtttccctaccctataagcaccagtgtaggaaaatacataatttaatatcttcctcagtggtgcaacatgtctactgaaaactgagcagaatcaactatcaggttgaaaagaaatgtgaataaagaaatcaaagttggaagtgtcatacatgtatgagttccacaacttttatcctttgcttccagaccctatcataataaaggagacaagaaagatggctggtatctttaaaacatgataggactaactccatgttctgatccattaagcagtcaaaacagtcaaaagccatcctcagcttccaataattatctgcctatttatacctctgtgcttctcttaataatccattaacagcccttcctatgtacttctgactctgcttttctgattacaccacaggttcttaatagcttagggctatctggaactaactttgaatattcttaaatatgcatcttggctcagcctctattatactgagctggcagctatgataacatcaatgaaaataactgaatttttaatgctgtgcaccatttgccttttaaccacacctgtgatgttcatgttttgaggcttttgatatttatttgtatttacaagttaatgccaaacataattttaaatagctatttatctactagaaatttccttttgcacatgggtgcttcaaaacaattcaagagaagcaaatttagaacagaacacaattcacacaactgatgctcaaaattatttgttggatgataataaccaggaagctgggaataaaacacagttgagaactttcctgtaagtattttctgacgtctatgtcaggggattattggttttaccatataatagctttaaaatgtatagtttatactttttgcatattttgaattaaatgaagggacttacattaaattccatacacattatttatcttcatccataacagattcctaaaaatttataagactacctctatctccacctcatagatgaggctccagtcatctcccgtaagcataaaagaccagtggccaaggcagtggaggaaataactaaaacacatttagtatcttacacccaggactatcccatctacgtacaaaaacaggttagaattttaaaaggtggtgttctagtgaccccatctcttgatgacatcagtgcctccttgccagagtaatttgaagactgagaaaaaagcagttaagaagtcacagctagaaaaagactacagtattatctctcctggagtccaattttagtttaggaaaaaaaaagtgaaaggtagtcttgactgtctcctcaagaggcttctcaagtccagatgaaaaggttggagttttacagtatcacatagttttgaaggcttacccaaccttagtagtcattgaggcactatgactcagagaaggaaagtgacttgtcctaaatcttcctcagagtttatggcaagcttttctaactcaatccattgcctattctagtctgtaacatttattttcttctaattcatatgctattattaggaagctagttttattacaattttaagcaactgtgatttagctgtttgtgctggaaacatacttttattagcatattcttattaaaaattaaatatgctacaaaatcctcaatagcataagaaaccacaaccccaatcaagtactttgtgctgtctcacaagcaaataaaatatcttcataaaaacttagtacatatcaccttttataaaattttaaacaaagcttgtcctattttactatacacgaaaaatatacttatgactattaaagactgttgctcttaaacgtatttgtttcgctttcttaccctggaagatatctggataaagaagaaaaagattaaaaaataggcttttggtatacagtggtggaatacgaaagacgtgatggaaattgtatacattaataactgcaaaggagtcattggaagaaaatacacacatcatgaatacaggtacagacagttataaccaggaatgaaaagagaacagagcccatatgaagaaagtagcgtcagtacttaataatttctgaatctactggggctctcacttattggaaatataaacgatataaaaatgaaaagatttaaatagtaacactaaacaacaatgaccaaaaggccaaaagaaaatgttttttgttttttggattttttttgttgttgttagtggtgtgtgttttttttttgttgctaaacgaatgtactgataattatgctgaaaattatgggattgaatgaaattactgtaggttgcagcatgaaggaaaagtgtcccaattctgactactctctgttagaaatttatttatggagcataagatcatggtttataaactgaattcttaaaactgaacaaaaaataagttattaattacaactattagaagtaattaaatattagctattcaccagtttttatatatcaataatacagaaacagtaacagtaaagacaatgaataccagaaaaaaatacgtaaaagcattcattaaatgttttcctgcccagtagatatgttggcactaaaatagctgatataatttgatccctgtcacctgcagctacaagtgaggtacactttaatcaagaaaaccagagaataccatagataaaagctctgctttatgtcctggagggacgggcttgttggcgacactctcctaggaagccattctttattcaccttaaagatggtggggattgagagtatgtacttaaagggattgaggaagatggcaagattcaagaagatcagagtttcctctgtcttgtagtaatgaggaaaatagtgataagccatgtacctaggacaggatgctttatagaatgtctatatttagcataagtcagtcagataatacatagcatatatgtatgtagctatgtatgtacatagcatatatgcatggacccagactttcgtgtatactaatattaagtgctcaaatgtgcttgctcatccaaggcctttaagtgtattaactcagaaagcgtagcattgaggttaagagtacaagtgctggtgcttgattgcccatatttaatttttgacttcactttactggttttaacacattaggcaaaggacttaaactctctgacatgacttttctcatttgcaaatggggataacttgtacatcaaattgttgcgataatttttaaagattatacccttatatgcatttctttagtaacttaacaggtattctctacaatcttcaatatattctgaaacttatatattgctttctcttctttaatgtggaaggaattagtgaagagtcaatgtataatgttttataattatttatgtacattaaacatagtagacatctgacaaacatatacatatgctttaagggttcattttctccatacgggatttcagaagaaggaaaagttattttcctctcaggagaaccagagacgccttcttagatagagaaacttatgctgaaagttgaggaacaggtaggttttgaccatgtagagattagtataatagatagatagaatgaagatagattatgggttcatccaggacaaagagtataatttggccaggcacggtgactcacacctgtaatcctagcactgtgggaggccacggcgggcggatcacgtggtcaggagatagagaccaccctggctaacacggtgaaaccccatctctactaaaaattcaaaaaaattagccaggcgtggtggcacgcacctgtaatcccagctactcgggaggctgaggcaggagaatcacttgaacctgggaggcggaggttgcaatgagctgagattatgccactgcactccagcctgggcgacagagcaatactccatctcaaattaataaataaaacaaaagactataattcatctttggttctcagtgcgtatcctattagcgggcacatatataagtgctcatacgcgtttaagaaacatttctcagtcactgtacttcaggaaatcaaacaacaaaaatacatgtcaatctcatcagtggtccaatattatttacagtgtactgtatatggaatcctttcttcttgaggcttttggttgtttccccatggtaatggtatgatgtaaaaaatattcttctaaaataattaaattaaaaatgacaggttggacaacacaatgtactgtgaagcttctacttttgaaaatggctacattctagctaaaaatgtaattgatccttattatggttgcatatgtttgaaaagtatctgaaggatgcaactggtaagtatgagaatatatgtgacaaaagacgctttcctttattcctgctccacacattatctctagctattctgtacagcctatctcccttccctttctcaattgttatctaatgagatggcaacaaaatatttctcatgttccagggtaaggcagcaaatttccgtgacaaaataggctatccatgtacaaatatggtctatctttctgtaagttctgaaagttatacattgctttctcttctttaatgtggaaggaattagtgaagagtcaaagagtaatgttttacaattatttatgcacaataaggatagtagatatctgacaaacatatacatatgctttaagtgttcagtccaaccatttttacattttgcactggtcatatgaattgactaggcaaaagcaaaccaacgatactcccatatatgaatttcctttctcaaaatccttccaaagctttacaaagaattcagttaagagttttaatagagaattttaaagagttcagttaacagctttaacagagaaatacctatatcttatataccacattaatttaaataagtttacataaatgcaaccacatatatccataatagagaatagttatgcatttagttaacacgtagccatattctgaagcccaaggttcagagtattttttacagtccaatcattttatagttaccatttttaatttaacaataacaagccatatgtaatttttttttgcaaaccaagatattgttccctgctcaccacaactatggtttccttcatattctagacagctgttacatgatgctcaatacacttttgatccttcacagaccttgatgacagtactaacagtttttattatagcttttctattgcactgtaatcttatttcacctggaccatttccccactagcatcataaactctttgatttatatcaaataattattccaggcttcatagaaaaaaaaaggaattattttgtgttgcatattcacatgctatgcaaattatcttcttaatttttgaaacacctgttgtatgtttatcttaatttcaatgaagctcctttagaaaactttaaaaaactaatatatatttttcatagatgccctagaagtaaacctctcagcaaacttcaaaacagagaaagctctatattttatgacatatttgtgggcaatttcagaaataatatattagtaatagtaatctgacatatagatttagagtgcatgtaccctagaacttaagataaaaataaaaatttttaaaaaagaggtgaaaaaggaactcaaattgttaaatccataaataaaataggttatttgttcctatacaattcctagatgtacggaatatgtttgttatgaaaaaaacagtatgtagacaaatatgtaaacccatcttagggcatgtggactaagatttgggatagattttacttttcacaatgctatattgtttgcgttttttgcaataagtaagtataacttacgttattaaaaacaagacatagatgttgactaaaatcacattatcctaagtaatttttactttttgcactggtcatatgaattgaccaggcaaaagcaaaccaatgatactcccatatatgaaattcctttctcaaaatccctccaaagccttacaaagaattcacttaagagttttcatagagtgaccataatggatattcaatttacacaggtttgaactgctgggctcaagtatacatgggcttttgttttcaaccaaacaaggattgaaagtgtagtatttgtaggatacaaaatttgtctatatggagggccaactgagggacttgagtatgtgcaaattttggtatatgcaagggtcctggcaactctctagcatataccaaaggatgaccatatttctgagtatttggtggctcataaagctaccataaaaaagggctgaggtggatgaaaagaatactgagtgacaatgcaagtgctggaggcactcattcattaagctgaaacaatagtgaaaaaaagtttggccttaaaattaaaagacagtattcatcaataatagaatcttgaagtaaataaatgtctccacatattagctgtgtaggtataattgaacaacagaaataattcaactcaaaattattaaaaggttctgtgttctaagttctgtgctggcaaaagggaggagttactggaacctacttagaagaggatgacttaatatactggacacatacttcatggagagggctttcaaaatatatatatatacacacacatatatatacacatatatacatatatacacacacatatatctatacatatatacatatatataaacacacacatatatatacatatatgtgtgtatatatacatatatacgtgtatatatatatgtatacgtgtgtgtgtgtgtgtgtgtgtgtgtgtgtgtatatatatatatatatatatatatatatatatatggcaggggacagtggctcacgcctgtaacctcaatgctttgggagaattacttcaggcctgggttccatatcagcctgggcaacatagaaagaccttgtctctaccaaaaaacaacaaaaatgaaagaaattagccatgtatgatggtctctactttagtcacagctgtaggctgaggtaggaagattgcttgagcccagaaggtcaaggctgcagtgagctatgatcataccactgcattccagcctcagtgacagaacgctgtctctaaaaacgattttttttttttgagatggagtttctgtcgccctgactggagtgcagtggtgccatctcagctcactgtgacctctgcctcctggattcaagcgattctcatgcctcagcctcccgagtagctgagatcacaggcctgtgccaccacatccagctaatttttgtatttttattagagactttcaccacgttggccgggctggtgtcgaactcctcacctcaggcagtccgcccacctcagcctcccaaagtgctgggattacagctgtgagccactgtgcctggcctaaaaaaagatttttttgtgtgtgtagtttttttctttaaaagtgcaacagtgattgccattattatagaggatgaaatagcacatttggaaagcaatgtccatatatgaattgtcttcctcttagaactgttgagtttcatgtgtgacatccatacaagtttatttggtagttttattccataaaaatggtgtcattctcccttttacaaaaataaaaagtaaacctacttcacacacacacacacacacacacacacacacacatacacacatacattaaatttaaattcaatttaaatttaaatattcattcattttacttagctaaatctatgttgattacgccaagtgaaaggataatttattcagcacgaatttttttctaaagttttaatgcaatcctggtgatctttttaaaatccctgtctgatcacgacattctccttaaggggagaatcttggtacaatattatctctgagcctcggcttctattgcatttccacagctacagctgcaacacctgcctgatgctagaactctgctcatagttccatgtgtaggtcattttcaaactgtgcattccacatgctcttccctttcctgaagagccacacttcaagtcttcatccgaactcagctcagatgtctcctgtgaaaccccctggctatcatgcttggagccattctgatctctctaatagcaccccgtgggttcccttatcaaagcaattatcacattggacagtaacagctgattcacttttctagtctatcttctatttcctcctccagtgagaaaatggttgggttcctctgtctttgaggttagtctacttggaaatagattaatttgaattcagatgaaaaagccagaattttggcaataatccagtttttgtacagttaatgtttggtaaaaattattttttaataaatgttcttcaaatttatgtaaataacaaatctttataatttaaacattatatttaatttatttagtaggtatttatgcaaggggttactatatgctagcactgttctgtgtgttttataaatgttaactcatttaattttcataatcactcaatgaggtagatataaatattaactcctatgtttataaaaacccaatgagatagatactgttgttattctcattctaaagaaaaagatattaaggcacaaaatttgctcctctgatttaggtttgaaatatgttactgcctatttgtatgatcctgataatcatcaagaagttaataaagatctcctaaaaatctataattctggttatctctgccatttcctcagaacagagtatggtgacatcaaggcttgtctcacagtttgtgaaaggcagattcaggactcttatccaggtttgacttgctctacagaccagcctgtggggatcatcatttcatttctgcaatagttctcataatgatagccagtaatcccagagaacttgagaaagtttcctgaaataacacattaaaaccaagcataacatagtcattactatatattttatatatgactgaatttagaaacaagcaaacaaaaattcctcatttatttactaggaactcagcaataatacttgcagatcatgtaattatttacaaagcattttctcgtatgtaaattacctatagaaatcagtaagaccaatctttccagtagaaatactagacaaaataaaagcaattagaaacaacatttataactatcagaaatatgaggcataatagatacaataaaaatatataatggataaaataaaaatacatatctaacttatataactttgactctaaactaattatgtccctatccagtatctggaatattatataaaatgacataaaagtagctcagaacaaaattgtccccattaaaactattgtgtgggaccactataacctcatgcaagcttttgtatgaaatggcttaagacatgacttttgttcttaggcatttaatgcctaagaatcaatgctgatgttgcacataaagaatatgtggaaatttcaggaaattaatgaatatgggtgaaaaacagataagaatataaatgtttaatcttctcagtttaattcatatcataaggtagaccacgttttcgggcaatggcactgcttagaaagtgaactaatatgaagatgacctattcattaagagaagattttttgagaaaattagcctagaagctaaaggacacaatattcagaaataatatcttaaataacatcaataaaattagctgtctacagcttaatatgatttaaactagaaaaacaggaaaataaaaaagctaagggcaaataatatatagttttgtaaaaatggaaaattccctccactatgctcctaatgaaatgcataagagcactgacaatgctgtcacagtacgtggcatgctccattaatttaagaaagctgaatgaaaaatttgagtcaaggtaatagtacttaaatgtgtttgtgttctgcggaatcttaacatgttatttgcgttgttccttcattctttgttttcttctttccttcaatcaacaaatgtctatagagcacttaactattttctgagattttgctaagtgctggagatagcaggatgaataagttataggttcagccctcaagaatcttcacagtggtggagtcagataaataaatgcccatcctcagattatgtacaggtggggtaatagaaagataagagatacagggtgtttatctttttcttcaattaaaaccctagttcagaggtacattcatttgttcattcctctatcttcaaagcctagcatcatgctaaggacacaatgacggttcaatgttcatttgttgattaaatgaatgaggtatttatttgtttcttcgggacgaataagagggagagagagtcttgtggacaggccaagtaacacatggctttaagaagacacagaatgtgaggaattgaaagcacttgttactatcctactgaaagtagcatagaggttgcaggacaattctatggatggccttgcaccaacccggttctcccctctttcctgcttgtaggtctcaagaacaactatagcatgtgctgtaaatgcagcatcttgagctaagaagggacaaggtagaacagatcaagctctgctctagtctcccctagaaacagagattccttcaacactttagcccaatatgtcctatgaccctggggtataaaatccagggcaggctgcttccctgaatcccccagctgtgatgccagtgggatgcccccattagtgataccatccatgcctgggcaactctcctaaaccttggaagactggcccacaatgggtcttaggctcctgttttccctactatctatctgtaagtaataaacctgcttcatgcaacttgttgcatgtaagcatgttttgtctcaccagacccagacaagctggtaactgtgcacaatgagtctgcttcacagagctctctgcccaaccacatttaattcacccccactgtaaacaaatcatcccttctttcaactgatctctcttcttttatccacactccatacatttgatacccaccacaacacaatatcataaaaggcagtatggtttaatggattctggatttaaatccagctctattattagctttgtgatcttgagaaagttatttaaatcctttgtgtcccagtttcctcatctaaattgctaattatagtctagacatcataccattatagggaggattaaataaataatatatgtggaacatttggaacagttcctgccattaatgagtgctcaataatgtaaatcatttgtattataatctaggaacaatgcagaatacaatgtgggaaatgagcactgttttttaatagccacttggaagtatagagctatggtgaaaactgtaaaacagggactaccacatcagttactgtgaaaataaatgaggtaattatgacaagcaccaacatcatatttatagtagctgctcaataaatgttaactagaaaacatgatgaaaaatgtctcaatctcccaagccaaccaagggggaacacagaagggaagtagtatgttgaataaaaataaactgtgtaaccaaagagatcataataaaattgtaaatattacgtgcatctattaggattataatgaaagcagcagccataccacaaagccaaacataaactgatctccatagataccccatttgcacgatgagttacattacacaatgacttggcaatcattatcttatagcgcagggtggtgggagcaggcagggaggccaatgagtctccctttgtcaagggaagatctctgatggaagtttgatttttgcctcgtttattcctcacatctaaaatggatatttttccaaaacatgaatgccttccatatgatgagacaacactaaaatttctgctttaattaaacagaaagaagaagagaaacttattttaaaataatattacagaaatttttcttatgtgccaccttttcattaagctgtgaaatttctcacctgctccctacttggtatttttttaaggtgaacttttcagaacaaccccacagagaggaaattgctttgcaagctaggaagatattaatctgttctcccagcatcatgggtgcataaatcctttcatattgaagaggtgttgttaaagttctatatataagatgacagtacagtattgactttagtaatgctaatacaaaagcagtattttcagttaaatatgctatattctttcaattttcctgcctttacttttgcttttccctcaatagaaatgcgtgctgctcattcccactccctatctggcaggttcctgggcatccttcaagacacagcattaggtgtcatctccgttgagaagctttcctcaactaccccccactcctcctaaatgttatttttttcttattcatatccccatatttttcaaactataatataattaatttgtaagctaactgtatccccaaatatcctgataggtctcaagaggacattcattcattcaacgaatattgtttgagtacctgttaggtccagggtcaagggaaaatgatggcaagtaatacagagacagattctttctgtaactcagaattaaacaagtgaacaaacaaacattgcattgtagactaagcttaaatcatgatagcacagcacagtgagatcaggggatcaggaacgtcttcctgctaagtcaaaaagaagcaggagttagccagggtgaggagacagtggaagaggcagaagagatgtgcaaataccatcagatgcaggaggcccagcatttggaggctctgaaagaaggccctggtgactgaagcaggaggtgagtccagggaggctgatgagggcaaggaaaatgccaggttagtcttgcattttcagcagcagccacaccaggtgttcaacaaatgctttttgaataaataaataataatactaacaaagataacgatgccattgtttggcttttgaggatatgcgttcctatcttgaaaaaactgaaattgttagaaggtaatttacctcccattactataaataggaatatttttgccttgttaagactttccccttttcatatacttaaaaataatgtagacagctataattcagtattaaatacagaatataaagtatttatgatgcaagtaactagaaaaacacacatcttacatacatcagcttccaagacaagtattcacaatatgtaggaagttccactgtggatccaaggggatgtagatggtacaatctctttaggaaaaaaatgatcattattttctacatagtgttaccaaatgaatacccaataaggcagcttggcgctaaccatttcttttgtctgcactactgaattctcataatacgcactgcctgagaaatggagcgcctgcccctttttgattatctcattcatagacatctcccatcacaaaatacttcagtcatagggcaatcaaagatacctataaataaactcttgagggaagacaaataagaaaatctaacccataattgtccctctgcattgaaaaaacactggacaaataatgcaatctggctgccattctgttatcaacaaattatataacctttaacaaactacttaacctctgctaagtgaaacctcatttttagctatgagcaatgggtgtatgattaggtggtctttaaagtgccttccaacacacaagggccattaccccatatcctcttcacatatgtcaaaagtgttatcagattatgagagcaaaaaaaaaaaaaacagtttcattttaggggaaattgataatcaccaaaattttaaactctgaatgtttctttacatgagagacattaatctttcaataagaacatagttgaggcctctcctaaaatttcattagcagtgaaacccttattttaaaaagaatgtgaataacttgaatgaaatccaatccacagcagtaaaaatgataaaatatttgacaactctaatctggtccaaaatatttggctacattaagtgattaggatatagaatgtttccagcttctccaccctgtagttcttggcagtccgactagtaaaattttggaataagtccttaagagagttatttaagttcaattttgagaatcaggcactgaccttcactacagtcagcaatttcccatttatttctatccctatcatgtcattttagcctcctgcacaggaaacatcaagcttctttctagaaagtataagacagaataaccaaaagatctggtctggagccagaaaataagagtttatatcctgtccctgctacttggaggctgcagggcttggctaagccacttaatctttctaacattctccatttgggaaatgagacaatatttaccttagaatcatgagaatccaataaagtacacaaagtgttggggcaagcagctattcaagacacagttatttattcacttatacatggtttgctggtgttcatgcccattccaccaacaacttacctgcagtgtacttctgtgggactaaattttttggcttgtgttttgcttacttgctgcccagtctgtataccagcgttactgcatcctaccaaaacaaagctttgctgcattggtgttcagaaatatttcactaaatatcttaaagttctaagagcccaaggcatttgttgactaatcattaggtcagatttcttattcctcttgtcctacttcccttcatgtttctggttaatgcttcttaaaattgctaaaaccttggcttttgagtctttactgcccatttagcttttaatattatgctcaccgactcttaggcaatccaacaaatttatccatatggctgcttctgacctcacaaccatctttgatatttctttttcctgctagccatcaagttacacataacagtggaaaacagcacttatccaaagtaacattgaaatatttctcttagaagacaagcaaatttttgtttattattgtgtagaaaccattcagtactggtattttttcagctgtgctttgttttagatgaatatttgtaaaacaaataaatattacattgtattgccaccttctacaatcttttatgtattttttgttgtcctaaattgatatactgttactaaaggcatgattctgatttaattcacttaataattacatatttatttattgaacatttcctagatacttacaatgggacaaacactatactatgcaccagagtttcaaagatgatcagaatgtgatccataacttacacaataaccatattattggacagcaaatacttaaatatccatttatggatatatgggacgtgataaactaaaagcatgcgcaaaagactctaaaaacacgcagaaaggaatgggaagaaacaagataaatgtcccatagaaagtggcttttgggatgaatcttaaagaacgatgtcttcaacagagaacggaaggaggtgttttggtggaagaagcagaatgggcagaggcatagaatatagaagtacgtaaagcactcagggaaaatctctgttcctcggaagagttaggataacagatacctgagagagggtagctggaatgaaattctagtctgtattggaactcagttttactagtcctctaagaattttgttgtaaaacttttattggaagcccatcttcattccaaatatacagccatatttgaatctctctctcacacatacacaaacacaccccacatatatacagttgatcctcccgtatcagtgggtttcacatctgcagatccaacaaactgtaaagcaaaatattcaaaaataaatttcaaaaaataaaaaatagcaatacaacaataaaaataacatgaattttaagatacagtatagctatttatatttgtatttacattttttaggtatatgagtaatctagagatgatttaaagtatacaggaggatgtggaaggatgtgtgtaagttacacccaactattaaaccattttatatcagggacttgaacatcagctgatttcagtatcactggggatcatagaaccttggtggacgactataatgtcaaagtacagagggcacctaaagaacaactgagatacttcagggatcagagaagaaacaaagacacagggtagcaagcataactgaaactacaggtctgaagtgctccaggttctgaagcaagcagagatagcctagaatcaactctgctagtgtaattgagaccaaacgtcccctgcctcaggtgggggactgtagttaagctccttgcttcaaatcgtgggccaggtggataggactgatcttcccatgcaaggggttagaacaacactgaaagtcgtgctaattaggataatataaaaccgtatgccaaagagaaaggaggaatccaacacagatgtagcttgaatctaaggtgtaggtccagccacccctcgtgtggtttccatagataaaacatcaacacaattatcaatgggactactcccagagccaccagtttaagacatggttctacatcaggtggcttaaagtccatgttgaggcaatcacagagttgttagttcatcaagataaaaacaaataaacacaacaatcaccgtagatgcacaaattcacaaaatttctaaaatgatacaaggaaaaactaataccaaagaagactgccaattacaagaaacaaatttattacaaagtgaaaaaggagcaatctgaaaacgtctttaaaattactgtttaaaattctcataagaaaagaaaagaaaggaggtactactatcccttaatgacaaaacgagaatatatgaaacaaaatgagcagaaattaaagagaaatggagggtactaaaataagccaagcagaaattctaaagatagaaaatcctgacattacagctattactaaaaagccaaaaagtaacagatgctggcaaggttgctgagaaaagggaattcttacacactgttgctgggagtgtaaattgttccaatcattgtggaaagcagtgtggcaattccgtaactgaaaaccaaactactgttcaatcaagcaatcttattactaggtacataaatcattctaccataaagacacaactatgcatatgttcactgcagcactattcacaatagcagagacgtttaatcagcctaaccaccaacactacactggattttttaaacagtgttatatatacacaccatggaatactatgcagccatgaaaaagaatgaaagcatgtcttttgcagaaatatggatggagctgaaggccattatcctaggcaaacacacacaggaaaagaaaatcaaatactacatgctatcacttataagtgtgagttcaacactgagtatatatgagcacaaggaaggaacacaaggacactagggcccacttgagggtggacagtgggaggagggtgaggatcaaaaaactacctatcatgtactatccttactacttgggtgacaaaataatctgtacaccaaaccccagtttcacacaatttacctaaacaacaaacctgcacatggactcttgaatctaaaataaaagttaaaaaaagaaaaatctgtgattgaaatgaaaaagtaaaagatgaggtacattccagagaggacatagtcagagaaaaatttagtgaattggaatatgttactggagaactcatataaaatgtaccacagagtgacaagattaacacctttatatccgaggataagaattttagatattattgtacagataaaggagagccattaaggttattattcagaggatgctgtagaaactcaattctggtgtcagtataaggaatgagtagcaggttattgtcatagtcctgccaaggaatgataaagtcatgaacaaatagctgatagaaggaatggaaagagaccaattatttccccctgcttttctctgtaactccattaagtcaacctttatattttaaaactgcttagattttgttaaaacttgattagtcattctctaaatcctctccttcttaaccttagattctctctccacatttattcctgtcttcatcctttctttccaatctacttagcagagaacttcagtatttcttgactagaatataattgtctttttttcccaaaaagatgtacacctccaatttgttttaagcatagcagccataacattttcaaagaactgtcaaatcaagctcacactcccgaaatagggtagtagaaatagcagtctcttaaaagtaaaatggacttagattcaaatcctgattattctacatattaaatatgcgtcgtcacaactgctgtgagcctcactttcttaatctgtattaagtggcataaaaagctccttcttcctagagttattatgaggaacaaaggagattaagtctctacagagtctagcaaagtgtttgtaaagtagtaaatgtccaataaatattttgctatcctcattaacacccagcatgaaaggtatttcctaatattcttgactgagaaagaaaagaccaacacctccattgtgccttacttttctgtttatatatttgattaaactaatttatggacacatctatctccccctactaaattgtaaaatcatttcagagcagggcccatattgtattcctttctgtatcattatatttctagcacagtgcccagttaataggaggggattaataaatgttagattaacaaattattgtagataaagtctaatttatcttccactcagtgcctatacatgcaaccaatgtttttttttaattgcacaatacaaacttcttaaattattgttaccttctcttcctcttttttctgtttctctcattccctttagttttcttcttctggcaaaagcacacccaatctaccttcattgtgtccatcaaggctgacctatcccttctctgaactcctccatcaagaaaggaaaatgaaaggattttaactattatatccaacaacatactcttgtttcctagtctagtttgtcatacacagtaggaattcaaatttgttgaactcacctgaataatcttgcctattgattaaaatagttcttgcataggggtaaaatgcaccatataaaaaggtaatgcatcttttaaattattgtgatttattaatttgattatttttgatttatgttagggtatttgaaaagaatattttaaaataaaaaaggcatcaaaattctcaatattcatccaaacatttattatgaatcttatttttctctgaatgtaaagcttcatactagcttaattagtatgcatttattgtgtgtgaaaacatcctcaaggattttcgttttcttccagtcaggtcacaattgtttgcactaacagttactacatattttattaattcagaatgaacataaaagtaggatgtcatcactgtattcaaaaaataataacactgctgacagaaccttttgtggtgagaaggatggcatgagacgggaggaaagacaaagttgataaagaggaaacaagggtcaaagcaaactgaataggaaataaaaccgatgaaggggtaaatataaaacaaaaagtgaaaaaaggagggaagattacataaagtaaagagagaaaaacaagaaaagagaaaattggagaataaagaaggaaacaaattataaatgcatagttagatccataaaattctagcactaggaaattaaaatatagtataaggtaaaatgactgtcttcccaacacagagatttttaatattttcccattccctactcagaaattcttgtataattccaaaacacttaaaaggagatctgtatttagattttaactatctattctggtttagtacaaaggtgacattacatctgcactacatgttcaagttaataataatgaatactttttagcatttgtctttcagttctaagcaaaaaaataaacttttaactttatcactttacacaaagttaattgtccaattttcagttcccatattttatgtgaaaagaagtaaactagttctatttataattaacttacactttaaagaatttttaaactctagggaaaatatctttttcctaagaataaactttaacaatactttattatgatctgaaatgctgatttataaatagcttcaccatattttacgtaccatatttgttttagagatttattacgtacttctccctgtagactgaaaattatttgaaagcgatgttaattttaatttatattatatctctcatcctgtgaacagtgcccaacaatttatacattcaatgaatatttgttgaatgaattaaggaataaatcaatgagatgttatagtttaagtatactttgattaagttctacgtgaactaatattctcatatgtttgacatatttgtatgtatttcttccatttgaatctacctattactaccaggccaatcttctttaaatatttatttcataatggtattgcccatttcctaaacattaagaggaccaactctttctaaagcttaaaaatataaatgccttgacctttttcagtcacagattttaattctatacaacgccttcactcttgagttttacttttagtttcaagcattgtcataaactcattgtgggagttgtttatagagttttggggaaggaaatgcttttctattttatgtttcattgcttggatatctaatccatttatcaacaaagtattttcagaaatttgtgtttaatatatttctttggtctaaggctatatagagaggctactagagcactgtgcccatcagccattactctgaggcagatcactggagctattcaggtataagctcacaggacacagaaccagctatgtaagacagcagctaggacagtcaacacagagaatctaccccaggaattccatattccatttttacttaacagctcacacctcccaggtgggtttaggaaatgaacagaatagtttgacagccttactccttaggaggcactggcaagtcatcagaaaattggctgagatcagttgagcccagtgtagacctgcaggactgtccacctcacccttagacttgtgagcagtaatacatgcacgttgttctaggccactgggttgggagtggtttgatctacaacaacagctagttgatgaaagactgtgtctacaagtacaataatatgtaacacaaacctaaaatatgtggcactggctctaggatcaggtagtaagcaaaggctgataattgatgcaaaagctaaaaagacgataagtgaactattatcaaaggctgaataatgaaatgatcatgtgtgctggaagaatggtgacctgtgttatgcagcagcaaatgtaaaactgttgtggccaggtgcggtggctcacgcctataatcgcagcacttcaggaggccagggcaggcagatcacctgaggtcaggagttcaagaccagcctgaccaacatggagaaactctactaaaaaaacacaaaaaattagccatgcgtggtgacacatgcctgtaatcccagctactcaggagactgaggcaggagaattgcttgaacccaggagatggaggttatggtgagccgagattgcgccattgcactccagcctaggcaacaagagagaaactcagtctcaaaaaaaataaataaataactgttgcctgtggtaaatttaaagtaagataatatacctaatggatttatgaagtatggtaagataagtttttagatattatattcagaatgtcagttggttttattgcatgtgataaggtatattgataaggagagaatcaaaacagcactcacccatttgcaagcagattttagagggaatatagagaggccaaggattgctgagttggaaaataaaattgtttttccttatagtcttcccatttggcaaaagatcatgtaaaatgaggcttaaagactatgatcaaattaaggctgtggccgtaaaaccctttgttaacacctctgaaagaattaagtggtgcccaacaggggaaaggaaaggggaagggtgcttctagaaatcttaaagagtggtcccacaaatgtcaaatccctaaatagcagtagttaagtgtgtacaaagaagcattcttgaaaataattgtagtatggattttgcagcagagagtagagtataaccagacttaaagaaaacacacaaagttttacagtaagtttcataggtaaaatagccatcaactaaattgtctgcaactttctataggaaagaataagtctaagaaaactaatcaggtgccaaatagaacatttcttcagaagtggcccaggaaagtgatagactacgaaggtcatcatagagggtagagcaaaagggtaccatgtgaaaaaataaacagggaagttactcccaaggagcaaaggcaggatttaagaaacatttcctattctgtagatgagggacttggtaacatttttctagcatgatttcagaattactactgatcggtgattgctaggtagctcctgtttttcccctttttggagttacatctgagaagccacatcagaacttcatgtagtataggagaccctggaattaacatgatgttagaactggattcaatttctgggtttggattgggcatattttttcctttaggagagacatgtataactgagaccagggatggtagtctttgatagacttgagacaaaatgagtccatttttttacccttccctgtattcataacctttgcaatgggactttgcagctcttcttatcaaagggtaggctttttccctactctgtgaatttaaactgagacaaactgctttgaccaagagaatgtggcagaaataatggtatgctcattctgaacctcagcctcaagaaactctgcatgttctgtttcctctctggaaccctgccattcctatgtgagcgactcctaatttgtctgacggaggatgagagacgacagggagaagagtccacgtgatggagccaaatctaccagactactctacaggcagcaaatcccaaatgtgtgaaagagttcagtcaagataagcagaacaacctacacaattcagccctgacaggatgcataagtatactcaagtaataatacatgtttattatttgaagccactgagtttggggctggcttttttttttttttttttttgcagcagttaacacatgcaatgatcccctgcaaatatcaactgcagattaactaacatccaaatgttttaaatatctagaattaatttcagcaatcctctctttaaatagagccaaaactagataatcattttaggttctttcaacttgactgtgtttttcctgccaacataccaaggaaatgatgagatttgtcaaagttaatagaaaatccactactgcaatagaagagtatctgatttttacttaaatgtttccatgaataagtttacaatgctcaagtaaagaaggacataacccagagagacagcaatcaggtcctcgaaagttttgggaatctgagtagtattctcataaatatgtacatgtatctcttcctaattatgaaatatcttgagcaagcagcccaaataattcttgatttttttaaatacttggagccatataatatacaggtttctgaaagttgctgtatgtctgtatgtatatctttgtgtgtattaaacaaaaaaattaaaaaatttccttataatgaggccatagacatgggacccaggaaaaacgaactcgtgtcctgaatgtgcccttgccagagtttatttcaacgtgaattgattctaaatacacttttttgcaagcattgcccaacatcattatataggcaagaatttcacacaaatcactgattgacagaaaaagaaattcactcttctcttttattgtcattttagaagatacattaagatctgtgatgataatgtaagaactttaagtattctttcacattccaagcttagtcattttctttgtaatttagataggtgaacagttattgtgatgtgaaaattggaataattcaattataaaagctaaatttctgctacaagatgcataaatgctccacattttttgctgtggctaaaaactgattttcatgcatgtagggcttctaaacccaaaaatattatttcaaaatgcatcttttccaaataagaaaaaacccacattagtctaccaggttaaatgaaaaggctaaatgagagagctcttaaatatagcaaaacaaattttacaaaacacaattttaagatacaataaatatttgtcatattttggcaataaaataaatgggaaataaaattatatttataatattaaccacgatataatcaaaaaatctccacaaaataaagaaaaaaacacataaaaaactcgagtattaaatttaaaagtgaaaatttcatttggttttccatatgagattacaaaaagaaaggcatttactaagatataacttataagaggactttctatagctattcatctttctattgacagaatatcccagattctttacaaactatttagaaattgctgggtttgcctagatttccattaagtagcagtattccacaggaaagaaaaggacattttggaaggaataaagtattctttggcataatgattttcattcccaaagaatacaagaactggatacaattatacatttttttctaaggcaatggaaaagtaatagtcaacaaggtggtaacaggcttcttctttaccttgaaaaaacactatttttaacatttttcaaccagagaataatctctatcatgtatttgagttgtgtaacaccatttaacatatcatgctggaaaacatttgccattatatgatttcattttaaataattataagatgatttgtggtggttaaaacactctgttttttagattagaaaaacagtttcgtttcactctaaacattttcaaagagtaggacaagatctcagaactagccctcaaaatatttggtggaaaatatttcaaagtgaaatgtgaagttgatttagaaatatttctgttaaaatataaatacatgtactatcaaacttgaacatattagctgcttattctacctgtgaaaacagcttaaaaatttgcaaacattatctccataaattattttaaaaatcactgtccaaagaaataaaatagaaaattataggaaacatttaaaagaagttatctttccacttcggaagtaccatttagggtgggaatataaggtggtgaggacatgggaacaaatcagtgaacaaatgaataatcaagatgatttcacctgtgattgtgctgtgaaataaacaaaaaacttggagactgatttatagaagaagagatcctttagattaggtagtgaggcttttgcataggaagccagtatttacactaagcctgaatgatattaaaaagccattcaatgaaagatctgagaggaagggcattttggcagaaggaactgcaaatgcaaagggccagtgctcattaatatgttcatgctgtgcatccacaactaaactgcaacctgcctaagtttgaagctcgcatgtcctagttgtttggtgtaaagattattatcagtatgactttaccatcgcaacaattaattcataaaagtcttatttaattaaaacacaaatttggccactttacaggggtatgatatatgacagcacatactgattttagctgttagaaacaaataagatgttatgatttaggtaatgtaaacaaagaaatgcccaatgtttttcaataaattaattcaataacaaaactcaaagccttttaaaaaaactttccatattttcttttctatgagtaccaagattttccaaataagaaaagggaaaaaaaaattttgaatagtgaatgctctgcatgtaaaggagaaaaactgtttggaatgtaaagatattaataactgtagtgactaacactgtacatgagaacaaactgttttcaaactgttttgagtagctagaaaacatactaagtttgcgtaagtgttttttgatatagattccatacaggctgactagataatataacaattacttttatttcattaaattgggaaacttcataatcctcttgcaaataaaaaatttcattgtaacaatttatttgctgcacacgtctctttcaaatattttattttttaacatttactagttccttaatatatcttattataatcttaaaatgatatgtgcacacatatacacaggatgtgtttgtgcatatgtagctaaaacagacaataatatcataagtattataaactagtcattgtgaaaaaattcaaatgtttatctaacatatgaaaaaatgtgtaatctagttattaaggaaattaaatcaaaatgtacgttttctagcatgaaatttgctaacattaaaaagaaaaataggctggatgcagtggcttatgcctgtaatcccagtactttgtggagctgaggcgggtggatcacctgagctcaggagttcgaggtcagcctggccaacatggtgaaaccccgcctctactaaaaatacaaaaaaaaattagccagttgtggtggcatgcgccagggggtagtggaggttgcagtgagccgcactccagtctaggtgacagaacgagactttgtctcaattacaaagaaaaaagaaaaatattaattttggaaagtaaatgagaaataagtactttaatatgctgttagcggctgcatcaacttcaatgagctatttcacatttctagtaaaaaatacttctgcctttttaaccagaaattgatctctagtaatatatcctatagagacatgcatatatgtgcacaaaaagacatgcatacagatttatttcaaataaatgaaggagatgaaattaacaaaaaagcatatttttactgtaaagcagtatatcttatttaaaagcacacattctaaagaaagaaaattaaatcatggtatgattctgaataataattgtatatgataccatattcccttacatctgattcaaaacagctagatgaatgcattaatcttctttaaaactaattatataacccatatttggggattaagaatgtttctgacttcatctgtcaatatgatagacagtacgttagccccacagattttctaaataattacgaaaacattcatatttaatggataaggaaaaaagccattgctgtttcaaaatgaataacttgtgtgcttgattacatagtctaataatttaaagcaccttttgttttatcttacaaaatatattataaaatattatctgctacatggtcttttcttatgctcaacttatttccatttcttaataaaaggaaaaggctataaaatttagtaagtagaaaaataagtaaaaggtattaatattctttcttgtattctttatcatattatacaaaaataaaagataaatctttatttatcaaagtcctctcactttttctgcccaatgatgttgtcttaaatttttttatctctttaaactactctctgacttcctcattctcatcagggaatacaaggaaaatggagaaaataagacaagactctcaattttgccactcagcatcctctgtattcaataactacttcttgagtgtcctccatagtcttaggcactgcacaaggtcatgaggatacagcaggggatgagtcaaatccatgtttgaccttaaagaactcagaaattgtacttctttctttcttttattaaaggaaaagttagctatccagcctgttcagttaacaacagcagtattccacctctcatcctatcttctctccacagaaaactgtagagaagccacttgaatttggagaactccacagtcatctataaaagtataatttcaatagatcacattgaaggcagaagtgtaatttcacaggttggaagtaagcatttgatgaggaaacagatgcattgtttgtgtgtgcagatttgttcaaaataggctgacttgtgaaagaaagaatttaagtagaatgataactagggagaacaggaaaattgagccaaagcatattcagtatagaagaatctcatacatgcttacaaatggaggaaactggtaagtagaggagaatggagaatctagcataacaacaacaacatacaaacatatacatgagggaacaaggtgctgaaggaggtaaactagtttgattgaaggcataccttaaaagtaaacttacaaagaatagaaatatttcttctaataaagttgaaaagctgagaggccagatttctgaagaggatggatggtctctgatagagctctatacagatgattttccatggcctctatgatttttcatggcctctgcaggagattcacttggagagtagaaaatcaggaatctaaataattagctagctaagaaatttaaaatttgttttgaactaactttttcagagccctatggaagaagtgtgagttttattctatctctaacaatggctctgaaataaacactgagttcttacaatgcctataccccgctaattttcaatagggtaacttatgtattcttacatcaatcctgggaggctaatgctatttatcaaatgactgcacaaatgagacaactgagccagaaagtggttcaagtaaaatttgaatccaggaaatttaattccaacactcttaatcatgaatatatatttcctctgagcttatttccacaagacatattaggatattagtaaataagtttaattcatatttactaatgatacaggagaagggcagggaagtgctggcagagaagggcattgtccccggtgagggttctaccctcgggcctgtggcccacggacctaagtgagaacagcactcctattttcacgtccgaatgttccattttccaagaccactctgacccaccatgctccccccatcctgtgcctataaaaaccccgagacacgaggaggcacacagacacaggcagctggacattgagtggaacacaccagcagaaaaacacactgacagacactgtgtttgccatcgatggcagaacgacacggccatagatggcagaacgaagcggattacatggaatttggctgagggtggttggagaagagcccagccactgagctgcccaactccaggggaagaccaccttcctactccatcccccttctagctccccatccatctgctgacagttacttccaccactcaataaaaaactttgcacccatcttccaagcccacatgtgatctgattttttcagtacactaaggcaagaacccaggatacagaaagaagcccctctgtccttgtgataaggcagaaggtctaattgggctgattaacacaagctgcctgtggacacctaagctgaaagcacactgtaacacacgttcactggagctttgggagccgtaaacacccaaccctagatgctgccgtggggtccacattccccactacctgcccatatgcatgctccccctaggggtttgagctttgggacaatgaagaagcaagccacaccaccgttgcatgccctgtgagggggataagagaacgtttcctgttttacctggggctcatccaggatcctggaaggagagtatgaatgcaaaactgtaggatctgccactcttccaaaacactgccacctctctctctttcctgtgagtaaaaggatctgtttgccctcatggagttttaaccaccctaaccaggctggttaaacaccccagacttcgtctcttgtctctctctcactgtttgaaaggctcttatctcttcctttatgatattaagagttttgctagaggctgtggcaatgttactaggtaaaatgagcatttcactcagctgccaaaggtgcaaatcagaccacctgtagaggtacaccgactcagcctctacctaaaaagccacaggcaagtatggctctgggtatctacccttactctttcccctcccatctcgggtgcctgggcatgtccacagcatgcaaaggccatgcccaacagccacctttaaattgctttgccattttaaggaacacatgaaatcacattctactgagagtttcaagtgtgaaatacgcaataaaaagtatcttctggagagcacacggaaacagcacctaaattgaactaccctgaagtagttggtaactgggaaagaactaggaaaaaaaattcatgtatatcagtactgtgggaaacggtttgacgattttgaacattttaaagaacatctttgaaaacatacaagggaaaaaccttttgaatgtccaaatcatcatcaatgatttgctagaaatagcatcctcaaaggtcacctcactgcatgccaaactggagtagggacaaaaaaaagaaagaagctctatgaatgccaggtttgtgacagtgtctggggtttatatgtagattatcatcattatattgccagactcatattattatctactattttaaaaatatttgtcttttatattcacttgtactctcaatttctaaattgttttccattcaagtgtaaaatattttccaggtttttttcctaataggttagataaatggtatattttctgaacccctgaatgtctaagaatatatttatataccaacatacattaactatcttgcctctacgtgaaactgttagcccacaacataatttcttttaaaattctgcagacaaaatttttctattatcttctgatatatggaagtgaataggtgaagccacctaaatttccccccctgctcttggtaacctatctgtcccttttgcctacatatttattggcaggacttttcttaattgctgtagtataataacttgactagataatagtaaactaggaaaataaatcatttggagttatacattcaggtaaagaaaaaactcttctatgacatctctgattattggttatacttatttaactttctctttggggtatacctatttctgcctccctactctcgattcttaactctgctctgtttttactcaacatgttatcatctcccaacatattatatatattcttgtgtcctaatgtttataatctgtcttcctcctcaggatgtcatctttgtgagagcaggtgcaatgtttgctttgtttattgctgtatttccagaaaattgaatgataccatagctagaatgcaaatagttttttagtgaattcaagaaatcccacattgggtcatcatttatcctgaatattactgagtttgtctcacattactgtatcttaatttacatttagaattttaaaaataattttctatgatgtgtttcattttctgttaattttttcatttttacttacggtgggtgcatattaggtgtatatatgtataggctacatgtgatgtttgataaggttgggagggaaagcaggtggggaaaggtggggatggttaatggttacaaaaacatagaatgaataagatctagcatttgatagtacaacagagtgtctcacataattttaagctttatcattttcatctgctttatcaagagctgatcaaatttcttttttcaccactgattgtatttttctttagctataattctactcatgaatgcctgcaaagtggagtttatttaatgtttttagattcttaattctgtcttacctctttcctttgttttatctcagtctatattttgctcctttttcaaagaagtcatgctttcatgaactgtgctgaagtcctaaaattacgccaaggtgtgtccatatctctgaagttatcacaaaggttaatatttttcagtatgctccaggatgttagaatatagtgcgtagtagttgcaggcactgctaccagggttcatctgtatcatacaacctgcaagtctttattttttgaggtgatcctcttaaaaaggtcttatgattggattattttcccaagacgttctctctagtttttctatgcttttcaacatctgcctgcatgtagaagaagaagtagtggagacccaggaaaaagtcctctgttttgcacagacaatctaaaaaagacagagaaactgatactcagcttcctcattaacacaagtgtaaattctccaggcagaggcagagtattgaagcattttccttccttggtcttaggcagtctacgttttggagcacaacaatttggagcacaacaaaaataggaaacctgcttaaagttttcttatggaaattctttttgatgtatacttagtgtatttttctttaggactttattaattgtcaaaattagttgttactgttattacaagtttagacattttctagggtatttgagaatacataaaggcgcaaagctacaaacgtgagttttaattaaagtagtattcaaacttttcgacaaaagttatatactctaagtgaaattatctaaaaatactataggaagtgtggatatcatttaccatgatggaactactaataactgcaacaattatttatctgtatgtcttttcttctctgagtattcattatttactacctaacacctagttgtaaaaattttaaatgtttcgctttttcacccagatcatttataacattaaaacttttaaaaaattaatatactccaggcttttaaatgttatgtatgtatattttttcacttaccatagagacaagattatttagtcatgaaaatgactatccattcacttatgagcaactacaaagctgtttcttgcaaataaggccaaagagactgcaaatactcaaggccacactaatttctcttccctttgaaaatctactgtatgttgcttacttattagcaaattcataacacaaaatattctgtggataaaagtgccagaagggaccttacagatgatcaagttcaatgtacaaatgagagactggaaccacagaacttttgacacctattcaagatttcaaagccagctaaccctagaacacaggtcttcccatttcttatctagttttattttttcagccaaacagaaaggtatttaaggacagatatcatgtcctctgggtcctagtaacctcctccatgcacataatattggtaggaaatttaaaaatgctttaatgttgatatatggttgatgatgaacaagacatgctttttggttttttgttctagcttgactgtgtggtgaagtagccattatgtactaacctgtcatgtggcaaataaatgcgacaaccctcaagtttttctcttaagattacatcagaaaatagaaataggagccaggtgtagtggctcacacctgtaatcaagcactttgggaggcctaggcaggcagatcacctgaggtcaggagtttgagaccagcctggccaacatggtgcaaccccatctctactaaaaatacaaaaattagccaggcatggtagcacacgtctgtagtcccagctactagggaagctgaggcaccaggacagcttgaacccatgagacggagattgcagtgagtcaaggctccgccactgaactccaatctgggcaacagagtaagaccctgtcaaaaaaaaaaaaaaaaaagaaagaaagaaagaaagagagagagagagagagagagagagagagagggagggagggagggaggaagggagggaaggaagagttaatatattatttggttataataataattagaaaacatctcaaaatttagaaagcatacccataaacatcatctcattaaattcttcaacagtcttgtgtggtaaacattatattatctctaaattattaacaagaaaaaaaatccagagcccaagtaactagctcaagtttgcaaagctaatgagtgagaaggtaagaaattaaacttactctatttcattaaaaagcttaaattctattacttctccatagactaatgctatttattaaatcctgccaaaatacttctgcattcaatgctaccaaagtcaaagttataactattacacaatattcaacaggactataacctaaaatgttatatcttaaaacatgtaaactcacttactacttaaatgtatcaatgaccataacaaaaggcatttattttcattgctgtatcaatatatataggcatagctagggtgaaggaaaaggttttattttatgcagcagtaagtaatactgaaaatcaaaagagtagtatctttgataatttcacacatattacctaagaaatagctgctcaattttcctcaaaaaaaatctacagggaattttcatacagagctcaaactagctaaggaaccacttggttcaacaagctctctttctatactgatggttagcattgaaacatactgccaccttatgacaattctttttatatcttaattttcagaatattctgttataaaaataaaccttcaccaggaatatagccataatgtctagaaattatctggaatttatttgagatttttaagttattagctctattgaaagcaacctgagagaaaaacactacatttaaaagggtatttttagatttggaacaaaataataattttgacatggtttcacaaggatttttaaatccaagaatcaggcatataactgattacatgctggcaagtaacctaaaatttagaatctatttttccaataacagtttaagaagttatattcaagtatttgcccttattgtctctataattttgcaaacacacacacacacatacacacacacacaaagacttacaagctgcaatagcttagatttgaagaaagtacagggaaaataaagactaaaattgaaaaaagactgtaaacataaatacactagtgtgtgaaatttacaagaagacaaaataaaacagtactacaaaattactactactacaaaataaagtacctgtctacatataaccctctttttgagtatccacagtagaaatttccattgcaccatgaaacatgaagtttttatacaggaactgatttattcttctctatggatccagtgattcatgtttgtaatgggttctctgtttccctttttgcattagttgctaaagtacttacagaataatttattttttatctttatcaagtatataagaaatcatggcgtgcattttgtacagtattatcactcctggttgcatctttttttttggccttattttcactttggcctggtagtaccatttactttatgtaacaacttgtttctatggaaagataagaatttagaagttgaacaactagaaccaactctaacttttactagctgtagggccatgatcagttacttcatctctaggataaattatagattgtctattcataagttgtgacaaaaaatacctttagagatatctaatatttattgggtgcctaatatataatggctacttacataacttaatttctacattgtttgatttcagtgaagcttctaaaatcaagttatgttttataattacatttaatgcagttgtgttctcccacaaaagcaatttttaaatcagtgatgtcttggaattgaggaaaaagagtattaacttattgtactgtacttttgtaatcacctttgtgttcttttcgaattaagcagaattactaacaaaaacatttcagtaaaatgctcagttgcagttaaatcataaatggggaaaaattagaaactgatgaacaaataaaggctatgattaagacttcgacattgttgttttgagaaaaaagttgacaattcagtaaacttttccatatgtcatgaacactgaaaattcactaaaacttgtttaaacttcatggacaaaagaacaataaattttttaaaaagtcatgcacaataacataatgcttagtttaattactgatttgctgtttgcccaaagttttaatcaagagagttcttacatgtggataacaatgatgacatctgtaaaagctagtgccacgtttaactcctccaggcactacagcacctggtgacgccacagggaagaaatcatggatacttcttgaacatactgcaacagctgtcaactcagaaggaggtatattctaagttctaccaagcaagtagtactctacaaaacctcattctgtcccttcttttaactgaaaagaagccagatggaaacatgcaacttgtcaaattgcaaatgaagaattactataaactgtattgcatggatctctgggtgttcaccactaaaaatttggtcgctcaatttgcagagtaatttcactgacatttaaagaaaactaaagatgcttgatactatttcagataaagacaatatcatatttttaagagaatacagcaaggtaaagacaatgaaaatatgaacgtatctttaacataacagcagaacaaataactaacaggcattattctagaagcttcataatgtccagaatgactacaactgcaactctcacgacagttaatggggcaatctgcttggagcacacagccacagaaaaccaagaaaacaagctgtattactcatgatacagcagtcttagctacactgctatggttggctaaacctccacctgtatcttcattatagagttctatttccatccactgtatgtgattactataaatgtttaaacattttgaggaaatattcattgtaaatgtatacaaaagtaaaaactaataaatttgctttatacttttggtacaaaaattacctatgattttaagaccaccatttgtttgataaaattagacatatgtagttatctcatatttagagtgtaagcattaccatttctgagatgccccagggaatgttttgatttgctcatccattcttgtatgtctacatatatgcatccattgagcacctactgtataacatgttccatgcatgtttagttacataaagacatcctttcaacatcattaaacccttctttaacaactagagtcttgtttagggtagaaaaaatgccctgcaagttctgaaacaaaatgatttatatcaacctgaatcacatcctaaatgtatatgtgatcctaatgatgtgataaagatcactgagttcctgagagtatccatgaacacaccttccaaaactgtggtacaaataatttcttagcagctttaaatgatagacattatttacctatcttctaaagaaaccctaaaaattatacaaatgattttaacaagtcaactcacattttttctataccaataatgcattttaatgtggttaatcagcactaaataatatttcaaatgcttataaatttagatacagcttagctcaataaccacaccatgcatgtccacagaggagaagactgagtcttagcaaaggttgagaaagctgcttaagatcacacagaaacaggatatggtggttctgactgattcactttagcgtcaggcctgtgtctcattccaatcctttattctttggtaaatctcttagaccgaaaagtgcaacactggaaggtattagtacaaggtaaccatgtagggacagaaagataaattttaagttgttgaggaagtaaactcagacacctttttctgttctctctcttcctcatcctctcacactaatagatacatgattaaaccactgcaaacaaaggtctgtggaggatgctttgtccatactgcctggttcacttcacattacataaatcacggcgcagagctaccagcctaaaccacctctgttatcttcatttctctacagatttgcctttctttcaaacccactatcccattttcttctgtggccccagacagctgtctttgcagcacaacagacagcagtcactgcagctttgctttgagcatgttctacagaagtccacatcccttgcagttgcctttcctggatcatgggaccccatcacagtgagctcttccctatctgcaggtagaggactaagaattatacatttgctgggggcactgccatgtatactcactttacttcccattttactaaactgtattctaattttattcatttccctgtttagatttaaaacgttcagtaaaagcacagaaagtaaaagtagtataaaggcaagaccagtgaatgaaaaacaactcagaaattgaccacaaattcagtgctactttatatgacaatcccttctatctttaatagtattaatcaaatgtcttaaatcatttataaagagtaaattattttcctttgatacctttgacagaataaatggtcaaactcctttgttacttttgtctgtaggagtcaggactgagaaagtattctctggatatcaggtggtggtatcatcagggtgataccatggttcaccctaatgtgagccatgtgagccgacatagtgaaggcacagtcctaggggaatgtgcaatactgtggtgggcactggagaattctgaaagcatggggtaggagtgtgttggagagaagcaccaaatgctagctgttataatccctgtgttactcatctctcaaatgtcccctttctatttcttacagagccaacgctgttgaacagaaaaggataaaaaatggatttttgaaaaaactattattcgaatgatcatgactataaataactggcctcctccaaaatgaaaaagaactccatgccctagttgtacaggaataggtattgatcatcctacttaaagtaatacttttatacaagatgacttacaccacagaaaatcagatgtgctttatcgggtttggcaagtagggactgctttcccagggagatgtttccaaataaggaaagaatacagctttgttattttattttattttttatttatttatttacttatttatttttttgagacagagtcttgctgtcactcatgatggagtatagtggtgtgatctcggctcactgcaacctccacctcctggattcaagtgattctctcacctcagccttctgagtagctgggattacaggcatccaccaccacacccagctaattattgtgttttagagatggggtttcaccatgttggccaagctggtcttgaacttctgacttcaggtgacccacctgtcttggcctcccaaagtgctgagattacaaggtgtgagccaccacacccagccttgttattttatttttaatcaaagtaaggaggcatcatttaccagaggtcatgaaactggaaaagacaaaaaaagttgcagattcggaagacaactcattcagagaaaggctacacctttcttatggtcagtaatttattctaaatcccaagtctaacccaatatcatggtaacagaaagcatcagcttttccctgaaatctctcatgcttccaataaaataatggttcccatgacaatagatgctacctcagcagaggcaagttcagagtacaggcagtacacatatcttggcttaataagcagggaggaaactacactggcagtattatcctctcactttctttttgctgttagtaatagaagtaataggttataagagatatgaatcacattatcagccatctaatatgcaatacttgacttcatttgattttctattccaaagagactgtcagcgttcaacataggaggaatactaaaaagcaaaatgggagacatgacgattcctgctaattgccattcattacctctccaaacaacagtgtttccttagatataagccatgcttttcctttttttaaaaaaaaaaattactcttacagtgtaaataaaaccaatttctcagcgctttataccaacagttgagagtgtaggtatctacttagtaaccaagcttccctggcaagaagctctaggggatatatgaagtagatctctagatgaagaggacataaagaacaagagaacacacttaagtctctaagtgttttaaacaaatgtaaatatatgtagttttataagactaaactatctttctgaagaagtgtagtacaaaatgttctgggtggttctcatttaacaaaataggcgattactttaccaagaaaagaaatccagtttatatttcctattactccacacaggcactatggaagcactctctctcataaatgatctgtgttcaaatctacctacctctctcctatttccttttcagacagtctcttctaactactgtgaaaaacatgtgagggatgcatattaccagattaacctgagttatccaatgtgacattgtcatgagactgtgatttggactgtcatctatatcaacttcttaaggcctccattttttatacagttaaatagacactaacaaaggtagccaatacataaaattttatgtccagaagaattttaatgacaaacagatgctaggaaaacaattcctgccctggttacttttgtgtgaggatataatgtgcttaaaagcaagaaagacaataagctatttgtaaaatataattttttataatttcatggtgttctgattttaataaacacaaataaatttattaatctttgctgtctaatgaaaattattcacatcctgttgtttagtaaaatcattaaatgagaatatagctaatacaaacttttatttgtagaaagagaaaaacatagcagcatagcaaaatatacttgcattttgtataagcttcaaacaccacaaagtccattgaacgtttaataattatgcatatttcatttgttattttcataatgtataacatataaaagtactttactgaatatgagaaaggtaaaaatctatctccctgagatacaacatgcaccacacagatttcttctatctgtgtgttcttcatactgtcatacaaatcagtttggatcactgttttatgttatgcatattattcaatttgaatatatatttaaagtggtatttcacaaatggaagaaaataattacttacacacatatttgtgatttgaagctttcaacaggcaatgacactcatccatcaacagtcttcaatgccgtatgtttttatagcagttctccaaacatgaatagaacctaaatatgcagtgagtttcaagcacatcacacaccctgtgtttattaatagatctttatgctggccacaagagagattatctttttttcttttgggccactgactcttttttttttttttttttttttttttttttagacggagtctcgctctgtcacccaggctggagtgcagtggcacattctccgctcactgcaaactccacctcccgggttcatgccattctcctgcctcagcctccctagtagctgggactacaggtgctggccaccacgcccagctaattttttgtattttgtagtagagatggggtttcactgtgttagccaggacggtctcgatctcctgacctcatgatccgcctgcctcggcctcccaaagtgctgggattacaggcttgagccaccacgtccggccgggccactgactcttgactgcaatgatatcttcccaatttggcctttaaatcttgggtcaacgatatgcctcagccaaattaaaaaaaaaaaaaagaaagaaaagggattcaacttctctcccaaaatacgcaatttaagacaatcagaagatgaatggcaattaaatcacattactctaaaaagaacaagggcaacttttagaaaagcattcctttctcttttacatgtttattattaaccaacactttaccaattctaacaaacttgatgattggtgccctagaaaatttatatttctgatgaaattcatggattcttttaacgtacagatgaaaacaagtgtgatatgtaaaaatgtggacatttgtgacgtgtaattggccttcacttttacgcaaaagacatcttccttacaaatgattttttttaaagcacaaagataaaatgtgcttagtccactctgaattattgtaatgttctcatctaaaaccaccatctatcaaagattatcttattttataccaaaggaccatccattcaatatttatccttctcatcctggaaatgtgctcacacacaagatgagggccctacctgaggagacatttgtataagtcattttattagcttgtctctgaataaaacagaatagacacctgaagtttacacctaaagagcagcactatttttaggctgaagagtgtgatttctgaaggccaatattaaattacacattctgaaggcaatgagttaacttatgttatcttggcaacaaggagttattacttattttgtttgacctaaaaatagcaaaaatttgcaaagggaaagcttgttaaaatatagtatatacctgaaagaatttgggtggaaataaaaagctaattattacataactagtgagggagaaaactgtgtaaattgttctccttttgcatggaagttcctaacttctagactagttagccattgcttcatattttatgctttatttctctggctttgaggaaaaaaaaccacaggtcactgtgaactaagaacagtccttaaaatattcatgcattctcctattttccatacaatagtaatgaaaaaaattgaacatttggtcaattacagaaaatactactacaattttcaagttatatatgcacacaaataatacctaaattcagaaagaaaataaagcctctcatcttgtttcacagatttcccagtaggatacttgatattggcagtgaaaatatttgaaagcataacttaataagccacaattgcatcaacatctaaagtaaaatgaaataagtgagacttttatcctaaacagtgaaatagatcataatgaaaacactttggaaataaagaagtttcaagatgctatatcacaactgctggcttaaattgtcaacctgcatttctagcctgcatttagaataatggcagtcatccatggcaaagttcccctgctagtctgtaatacgtgaagaagaagaaagaggtctatttacaagattcaacttaccgttaggcagagaagtagcaaacactttaaagaataattcttggcaaagactgcaagtctaaggcacaccatttaaaataatgatccttctgcaatttttatgatgtcctccatttgttcataaaaaagaaaaaaaaagctaaatcttaagggaaattctgaacaaacagaagttccgtcgaacaaggctataacaataatagagcacttttgaaaactaagttaaactcaaaatcctcttttctgaaaagaggtgaagatatttacatgtaagtgctaaaatataagcatatataaacattgatattaccataatcaacaacttcaacataaagatcactctaccattgacctttattggtcacctgctgcatacatataagagacaagatttagtaataaagcttcctctagaaaaatcacacggtagtagagaggtagacaggttaaattgccattgcaacacaatgtgaaaactactttatttgtaataagtggcagctttacttcaaagatggtgccaataaaccctcccatccctgtatgtccgtgatatttatcccatgaagatatatagagagctgcaacagcaatccatgaggtatgtgcaggacgtggggcagctttggggaagaaacaaagctacagaggaggcacattaacagagacttgggaccttcattcccttcccttgaatctggactactttgtgagttccaatgacctataaaatgatggcagaagtgatgctgcaccagttttgaacctggttttaaagaagcttggtaacttccacttttgctcctttagaatccagacctctaggctgtaagatattagtttagcctaccaaaggaggagaagccatatgagagagaagaaagatgccagataccttagctgacgatcagtaccaactgtcaactacatgagagaccatcttggtcctgccagcatcagcggcgctcccacatcactgaaatagtttgaatgagctcaagcaagaccaacgaactacccactgagtccagccaattgacacaattgcaaaaaattataagttgttattgcattaggccattgaggtttggaatggttgattatgtagcaattgataactaacatgaagtgagaaaaaagtgatcaaggagtacataggcctatagaatccaacctgattttcccaaggctaatcagctaataaaggacagaaaggcaattcccctgaattctcatccaggattgaataatattgcaaaggcaaaaatacaagctgtattatttttcttattgttgttgttgttgttgttgtttgtttccaagcaaactctggctctatggcccaggcaccatctcggctcactgcaacctccgcctcccaggttcaagtcatcgtcctacctaagcctcctgagtagctaggactacaggcatgcaccaccatgcccggctaatttttgtattttttgtagagatggggtttcaccacgttacccaggctggtctcaaactggtgagctcatgcgatctaccgcccacctaggcttcccaaagtgctgggaacaagctgtttaatgcaaacacctgtggctgaataaaaccttaacccaagaaataacctgcactggggtacacattagtaccttcattcaataataaattcatagtgacccagaatctggctaatgtccacataacagccctaatttgagtataaaattaatctactaattacccagtattaaaatttgaaagcactatccatatattacatatttcagaagcaaatataactaatcacatgagctgaccctccctcagaaatgctttatatgagacacagtttaatgatatggcttctgactatactgggagcatcaatcatttaacagcatttctttcttttgcaaaattgaatcacaagctattatttgcatgtttactattgatcagtaagatacaaaaccctgcatggtgaattctagtagtttaaattctgggaaatagtttatgaaaatgaattttaggctttcaccctcagaaaataagtcatattatttattgtagatgataaggaaaattttaaatagccttgttttttctgtgctttttttctcacctcccacacttccttccaagcccatatgacctcatgctggcctaagttcctttgctacttcataattttctcaaaagcagtatttgaataacaaaattaagaataaaataaatatgtcttcttagatatacctcctgaaagactccgtgtccacaaatcactcagctcccttcctcaaatcaaaatgctcaacctctgagtacagctgatctcagctagttattagcatgcagctttaacacaatatgattaatttatatactgctttaagtctttgatagacttagagattgatggttttgaaaaacaaaaaacgaagcccttcaagattgcaagggagaaatatcaagttaaagaacagagaaaaaccgcaaagcatcacttgaggtatttgtgggaggtggggcagctttggggaaggaacaagtctaatgaggagccacattaacagaaacctgggacctacgttgtaaacttttcatctacctccctcaagaaatcatctggaatccccacactgcttaccattttctaagagcaaactctttctggtattggagaaaaatgatcaattctgtcttaaagttggcctaggttcaaaacgaatactcttcatggacccagctgacttcaagatcacgtgctttttacacagaaaagttgctgctaaaagaggtcacttttcttgcataagaaagagaggaatgatactaatattttagtctctaatagttatttcttaaacatattgaaaaggatgatacaaagcccagaaggattctacaccagacgaccctagagagaactgattttctacagaatttacacatttcaaacaaaaatacaatgttttcatggagggcacagaatagtctgcaacaatgtgatttatatggttctcttacttttctgacatttgtctcagaaaacgtgcttgaatacattctatttttctgcaaaatgtggataataccatatgttgaaaaagtaaaaacagtgtggttattttctgtgttctcaccatttggatattatttcttactctcttcacatctctttttcactcatctttagaattcttcaaaagactaggctcatgttaggtcacatattggaaaaagtagaattactagaaagacattctgttgagttcaaaagattcaattaggaaaaaaaatcaacagatgattttaatcaaatttgtaagcatgattaaagattatctacaattttcacgtccttatttgctttagtataagctgctatcaaaaataaatttccagttatctattaaactattgaaagacattttatgaatagataagttattctgttgagcttatagcttctttattaatttttacatattcagtaagaaaaaaggcagttggttcatccaaagttatgtctaaataacagtttaatacataatgtacataaacacagatttttctcataagacatcaggattacccacagttctcaagtggcatgattcacatttttaagaaatatttaatgcttcccttttattaaatgctttccacaacattgtgggatgtattgtatttccgaccccttcctatcaaatgtcagagaacctaaaaatcattgtgacaatcatttccaaatgtccatacatttccaaatgtcctccaaaagacaggaacacccagtcccccagttaagaactactagactcacaatatgattcaggaaggaaaacatcttcacaaaattaaaaccactgaaacctctgcttaatttggaaaccataatgatgtgcttttgcaactgtagcattagagtattggaacaagttttgtggtctaatgtagattcatactacaggtgtgctaaatttgtaccatgtgtaaattttttgaaggagtaatttgcatttttggtaacacagaatgtctccagagaagccatgcttaagtctagtaactaaatgtgatggtctggttgtgaatcagctggcctcagatacagttctttttactactttaaaaacttctttcttttgagaaaaagaataattaaatgctagtgtattgactaacctaatttatcctattcagtttcccacactgaggacagagaaaaaacaagcattttatacacctgtctaaagctattctgatcactaaaatttgtgcactcaaatatttagctgcaccaatattgtaatggatcttttttatgttacattgtaggaaaagacaaagaagtagaaatatagaaaggaagttagtaatgggtaaaaaagaaaaaaacccaaatattgtcaatatcctattgctctgcgaagcagagtgctcataatattttgagtttgagaaaccaattacaaaaaaaaactatatttttaaatgctttagctgatggaatggattcatacttcttaattgttctaagagaacctttcacctgctaactctattatgcatagtcataatgcagtaccgagtgaagatatttccattaacaactatttttggtatgcccattagacacaaggaaggacagtgcagtaagaagaccttaatcatagatactcctgacgccaaactagtcatatggccttgcccatctcccaaagagaaaaatactgctactgagcttttatttttttattttattttttttttttgagacagagtcttgctctgctgcccaggctggagtgcagtggtgcaagcttggctcactgcaacctccaccccccaggttcaagcaattctctctgcttccaggcagccaacacacccagctaatttttatattttttagtagagacggggtttcaccatgttggtcaggccgatcttgaactattgacctcaggtgatctgtccacctcagcctcccaaactgctgggattacaggcgtgagccaccgcgcctggccgctactgagctctttagtctgcatcagatcttcttaatgctaaatactttacacacatagttttctcacttagtgtttactgcatgccattatcattatctccactttacagatgatgaaactaagcctcaatcacatcaaaacgcccataaaatttcatgaaaataagagaatgacacttcatcttagttcttgtcctcccaaaaccagtaatcccactctaatcatgaggaaaacatcagacgaattctaagtaaggcacattctacaaaatacttgaccaatactcctcaaaactgtcaaggtcatcaaaaacagggtaagttggacaaactgccacagccaagagaagcctcagaagacataacacgtaaatataatttggtatcctggatggaattctaaatcagaaaaagaacattatgtaaaaactgaggaaatacgaataaagtatgcacttcagttaataataatgtatcaatactggttcattaatttgacaaagcacatttatataagatgttaaagataaaggaaactgacttggtgtaggtgggaaatctctatatagtgtactgtctctgctatttttctgtaaccctaaaactattcctaagttttaaaatatgttttaaaaaactaccatgctgagaaaaaaatttaaagtccttacaaaatggaaagttatactatgttcatgggtcagaagactcaattttgttaagatggtgattcacctcaaattgatatatcaagtcaacacagccccaatcaaaatcctagcagatgcttttagtaaaaatagacaaacttattctaaaattcatatggaatttcaggtgacctagaatagccaaacaacttataaaaaggaaaactaactttgagaactataactaactgatttcaagactaactgtgaagacaatatgataccagtgttaatatagaaaaaaagatcaatgccacagaatacaaagtccagaaagagacccacaaatatactgacaactggttttcataaaagtgcaaagtcaattccgtggagaaatgagtcttttccacaatggtgttaaaacaattggatgcccatatgaaaaaaacaaaaacaaaacaaaacgaaaaaaaactttgaccataactcataccatatataaaatttaacgtgaaatgtaacctagagccaaatgtaaaacacaaaactacacaacttctagaggaaaacatggcagaaaatatttgcaaccctagggtagacaaagatttttttagatatgacaccaaaatacacatcatagcacaagaaattgataaatttaacttcatcaaaaataacaatttctgttctttaaaacacctggttgttgtgtttgtttgtttgtttggtttgtttgtttgtttgtttgagacagggtgtcactccagtcgcccaagctagagtgctgtggtgcaatcatggctcactgcagcctcaacttcctgggctcaggtgatcttccttcctcagcctcccaagtagctgggactacaggcatgcgccactatgcccagctaatttttgtatatttagtaaggatagagtttcaccatgttacccagactagcctcaaactcctgggctcaagcaatccatcaacctcagccttcccaaattttgggattacaggcataagccaccaggcaaggccaaaagacattcttaagagaatgaaaagacaacccacatactaggaggaaatattttcaaggcacatatctgataagaacttgaatccataatattgtttaaactctcaaaaataaataataacagaaacaagccgaccaaaaaaaataaacaaatgtcctaaacagacacattaccaaataagacatacagatggcataaaacacatgaaaagatattcagcatcattcaccattatagaaaagcaaattaaaaacgttaaagactgatcatagatgtttacagttaacatatattacttccgttttgtttttaaatctctattttaaaaagcttgtttgacctggattccattcacctaagggtacatattatcaacatgacttactaccattgatatcaatcttgattgcctggctagttagtatttttcaggcttctcttctgtaaagttactcttttccaactctttacatattatacttttcggaaaaaagtcaccacgcttatttcacacttaaaaagtgggaagccatgcttcacttatttcagggcagggtacatagatttttagtacacatatctttcacatctttcacaagtcagatttatccctagtactgtataatttttatgctatcttaaatggtattgctttaagttttaatttttaattgtttgttgttagtgattagaatatatttgatttttgtatatcaatcttgcaatatacctaatcttgtttgttctagtatctttttgtagatcacattagattttctttgtagagaacaaataagagtaggaaataaaaataattttacttatttccaaaataataataatgtgagaaagcagtcttaactaatgggatgagcacagagtccagttaaagtcatacttctttatgtaaagttaccagtgttgggtaacttcaaaatgggtggcagaaaaatttacatgagaaaataattatttttaatttcctaccctctctaaaaagacatttagcaatgggaggcagtttactacatattcaccatatttaattcattcattcaacaaatatgcctagctacaaatttcatcaaattattttattctatcatgtatcaattttctaactgctaaaagtgtataatttatagtgttagaatgataaataaatacataattaactactcaacatttagtaactgatactaactgttagctatatgctgatcttgctaacagaatacataaaatacgttttaaaagcaaaataacatagaatggagactaaagatcataatgcacattgacgcaattaaaaacaaacattcctacataaactcatttctataattttacctttgtcttagcaacttcactttttgacatagtgaacaactcatatttcacatgtactcaccattgtagctttttaaaaaataatggacatactatacacactcctatattattttatatttcaatgctgaaattttaattaacatatacatatactcaataaaaacaataaaaaatatgactcattctctggaaaatttcattattaaaattactgttattttataatgataacatctcattttgttgtgccctaggtataatgaaacactctttttattataataaaatgcaataaaaagtgttcttccctgtgttactgctgttattttgaattatccttataaattttctgataatgagggtaggctatcatcaaaagatgcctccattaaaatataacaatgatggtaatagcttaaaacttgtattgtacagctgaaaattcatttgtacacatatctcttttcatccacataccaattctgttaggtgaatatacttaaccccattttacagatgtatccccatttatatgacaatgatcataatagcttaaaacttttattgtacagtttaaaattcactttcacacatatctcttttaatccacataccaattctgttaggtaggcattattattatcccaattttatagatgtaagtactaaaaagctaagttgttttccttgtcctaagcaacacagctaattagggaagttaatttttctccactgcttttaatcacattaaactgatccttctattcaacacatgaagttaacattctatgaaaataaaactggaatctctgagtctacattgatcacaaattgaatgtatcctctcaatacactgttttagtcctttatatctttgatagaagtgaacatcctaattatgcccatgagttacatatatgagatgccttcaccccacttcaataaaactctttcttaatgccaatataaaaaatactctacattaattggtaattgtgaaaagagactcagggagagagtctgaatcaacaaaagaggaaaatataggaaggaaagggaaagacaaagaaggagggtgagacagagaagagagaacaaacatccaggagtagtgatgtgaattatttgcttagttaccacaaaagtaataattacactaactctgtgggaacaatggtaatttcacagtagctcacgttactgttatcaccttatatcctgataactgtgaaattaatttgtggcactactgtatgtgtcggccataagctgttcccttggtaacagtattatgctaccatagagaaggaatgtttggcagtaaaatgggcagcagcaagctgattacacagggaaaagcttctatctaaatacacatagcataacaatcacccctggaaaaactacatggcttaccaaaagaggtctctctgttcactgtccattatctgttgactgaactagttcaaatgaataacaagtaatgatcaaattgccagtttatattttacaacagagtcttatctttaaaaaaatgcaaggaggaaatacaaaaatgtaatacatttatcttgctttcttttctatttcctcccctgaaattattactatgctattggaagccatacaaacacatatatacacaaatatacatatgcttcaatgaaaagcaggcatgcagctgacagctcggcaaccctgaggtataaacaaagataccagacatattttttgaaataattttgctcaaggaaattcatttcagtaggaagatcagttactctgctgtctcctacctacaaagttacagaaggaaaagttcaacatttggccaaaaggatagtagcttacatttcttttttttccttttttcagcacagaattttgaagagagaatacactaaaagggaagaacataactacatgacatcataagaagtcctgaattagaagcgtatatttgaaaggtcatgcatcctgagctgccaacagcttaacaaccagaggcagaggccagctttgccagctcactgcttctactcatctttcatgatagtagccaggctgaatatagttccaggatgataatgaattggctgggcatactgtttatattagtatgtatgttcctgtactaaaccaagcatcatgaggccagcactattttgccatttttcagaaaaaaaatatgaacccttcaaaacatagtaagccttttttaaagtatatatttgattttgaaataatcaaaatatatgtagggatatgactgcatcctaagatttatgataagttctgatgagtaatattttctttctacatgcaaggcaaagttaatagtaactagaaagtctttatttggcatatcatagatttctgtcaaccaaaacaactaactctggggaacataacgttctgacaacttcagaagagttaagtcacagacaaaagtttattggatcttagttggctcctacccaccaattctttcttttccaagtggaacataatagattttcaatatttgttaaataattgaaaaaatatcctcaaaattcttttttggccatcttcccaacaagaatatggtcctaacctatatgtagagtcctttgctgtgtcatctatttcttcagaattattctcctaattcatatgtctggatagtctctctgaattgttatagaaaattaaaaatgtgaactatgaaattaatttttaaacttttataaccatctagtcatacacagaataaccacaaatataaacatggtttcaaagaattccctgtgacaatcaagcaaatagtgaaatagtttctgctattatgaatttatcacttactcagtgtatgaccatgggcaaatatcttcacctcaatcctgtgaggcaggtactattattctacccattttaagtatagatttgcaatatttgttaaatattcaatatttgttattataaaatgagtatactaatagtacctacctcacagtattgaggtgaagatatttgtccatgtacgtacaatatgggcataataatagtacctacctcacaggattgttattaagaataaataagataatccatacaaagtatttaacacattattgaaaaattaaatgatcaaaataaagcttgttgttattgttatcttttaataaatgcatctaaagtatttttaaatgtattcacttcagttatttaaagtttcatctgctgtatcacagagcacatatatgttcagaaacatttgttaagtatctatgtaccagataataaaggtggtattgaaaaaagaataggcattgtaacaggcagacaggagtataaagtccagccttgccacttatgagactcccatcttcaaattatggaacctttctgaatctccattttatacctataaaaaggggtagacattacgtctctacttgcttcttatcattaaattaaaattcatattcctttctatggcaaggaaacgagtcctgtatagtcttgtaattcatctccctccaccaaacttcatccacactgacttctttaggccaagcttgttcctatatcaaggtgagcctggaagcctgtacactgttccacagtggtacacctcctctagccctatagaatgcaaaatggaagcacagagacattatacaatggttagccagtcacattacatcaagtaaaaacaacaagttaccatgaagtttatttattggagtggcttcagtatttcttgagaaacacaaatgatgaccctgatttgtatgatcaatcagcaagttttcaaaaaggttactgagtatatgacagtaatttctagagccaaagatatacccgcatgaataagctttcatcctgaaaaaaaaatcaccttctgaaactccatgctagttatctgaaataataaaggtgaagtacaaattatgtgatctatcataacctgaaataaacatatgttgctactctgtgatttggtctttatcccagtctgacccatttcttgagactgttacctcaagatgctctcccatggagctttcactgagaatactttaatccattttcttaaaaatccataacaaaattactaagatctcaatgtcttatcaaaacttttttttgtctcaaaaatgatacatgaaaaagataatcttcaataaatgcaggtaaagtattttatacctgcagcattgaattgttccactggagggtagcagggggaaagaaagttcacgttgcctagaacagaaccttgttgttaccttaaagtgtgttctttctgaattttctaattcaatcatcatctcttccaatgcacatctccaaacctcccatttcacttgttcaattcccccattagtagtgatatttatgctcctcaggatctctgtgtagcaaagtcctttagcgaaggcacaagaactagactatagaaacattcaaattccatatttgccatttattttttgtataaaggtagatgtcttcatattaactgtaaaattagagtaataatggtagtttaaatttaagtaataatacctacttcataggagtgtcacaagaattgagtaaatatatgtaaaatatttagaaaagttgtttgcacatagtaggtgagcaacaaattatagctattattattattgacttctcttattttttcttatctatttacttcaagtttttactgttcaaattctatttttcatcacttcaaataactctttataaagagcccccttgcagttcttccatcatgcctttcttagaatatcctaagtctagatgaaaatatccatgtccacggtgaaaacctatgcagaaaactagcctcatggtctaacctctgtcacagatcgagctctcaacactgcacagcaatggaacttaacttctttggtcaaactcccactctcccattccccagaataactcattaaaactttcctctttctcttccaatttccaagccagtcctattccattccttcttcctcaccagataacctttctttctacttctgtgacaaaacaaagttttcaagtggcactcccaaatagtgctgccaccatctctgtggacctatttgtaactgccactgtctttttttctgtctgttatcatgatgctgtttctgaccctcctcccagtaaacaggaatccccacaagtgtaactagattccatctccttccaccttctgtagagtcaaatgcttttaactttcatctcttctgttgtttcttggagcctccttaataccatttaattatttttgattgttccaatctgataacatttctccctgagtcttacatctccttcctcctctgcacagccaaaaagtaggaaaaagtttgtcatctatagtgacaatctccatttcctttctttgcattcatccatccattcattctacaacctattccaattgttatggactgaatgtctgtgcctaccaaaattcacatgttgaagccctaatcccagtgggaagcctttggtgggtaatgaggtcatgatggtggagccaacatgaataggattagtgtccttctaaaaagaggacagaaagctagttaatctcgttccaccatatgaggacacagcaagaagacaatactctgaaagtcagaaagagggccttcaccaagaacctctactggctccttgatctgaaactcctaacctttagaactgtgagaagcaaatgttcgttgtttaagcgatccattgatggcattttgctatagcagccaaaactgaccaaaacaccaatttagcttctgttcctactcctcaaatggatacagcttatgtcactaattatggccctgccacgagcttatattttactgagagagatgcattaaagatttttaaaatgtaagatatatagtatattagatagttgtaagttctcagaagaaaaataaattagaaaaatggataagaagtgttaatgctataagttgaattccaattttatatggtagccaaaaaaggcgaacctgagaaggtaacatttgaggaaagaactgaaggatgagaggaagtatctgggggcatgcaaatatctgagggcagagggatcagcaaatggaaaggcccattatttttctctctcgtgtttcttttttcctgtattctgtgaaactgttttatggtttgcctcctctcccttattgaaatttcaaccatgtgcagtaactattcactgcttagcatgtttttttccaatttctgtagttcttgtctcaattgtttaatttaaaatgtgataaagattatttattttattatttgactagtagtgtctaattttcatacaaacttaacatatctccttttaatattttagaagtaggatataaaatataaataagaaattaaaattaaaattcatcagtatatcaattgagcttttactttgtaaagggcactatgtctaacagaaaaaatgatgcaaagaagccagattgtagtgggttgaggtatgactgggaggtaaagacgtagagtcacgctgttcagactacatattcaaaaagcttggcagtgaaatgccttccagataaatttgtagttggatacagcacaattctgacagttggctctagcaaattctttcaggtttttaaaactatttaattatgaacatatgaacataagccttaattaagacaaatctttcttctgcctgaataagaactgccaaaatgtcagagggcaagactaaaagttcctgtctgaactcattttacagtctccacatttgcagactgtataatgctccatactaccagcaatcactcagcacattctcacactgttttagggtcacctcttctgcagtaggaactttggacttacacaataagaaatatataaggaaccacagagtcagaagcagcttgtactactcaaagcacaattttccttttggggcctcagatctatccctcagatatttattttaccaagactcccaactatatcttttcaagattcactgtcaagagacacctgacttttgagatcttatcctcccttagtatagaagtcccagttctcccacttatccttcttgccttggttgaactttctaaaacctagatctcttgccattaaaagtgtcaaatttccacaaatccacaaaatcaatcctttttctcctatgctatagtccaagatgttgtcctgaagtaatttcagactatttttcaaaagttctattggatcctatgtcaatttttttgtgatgtttgctgttcgtttaattcacaacatcttttcctcaaactaaactgaactggcaagaaacagataccagcaaaaaactgatacaggcaaagtttaaatgattcaaagtttacttcttacatgccttcaacataaaagtttattaatctttcaaaatgaacatattctctcaaactgaaggtatgaaattattacaatgaaaagaaactaaatatattaaatactgtataattatctcatttatatggctaaggttattagcttatatatggtgtctttaaaataattcccatttgcagttacatttcaaactgccgatttgacgcaccagtcaggaggaatgccacgactcctgctgtgctaaacttactgaaacaaataggaaaaacactttattgtgttttgttcctgttttactattttgtaattggactaccctacaggaaatactcttctttataatatatcactaagttactataataatcttgtttcatgctcttcctttacatatattcctgaattatcatttgtcatgggtaaaaatagtatgacagaaaaaaattgagacattaatcaaaaaggtgttttaaaattactgataatggtgattgctcttaattacatgattgaatgtatattcagagaatgaaaatatggacacacatacttctatccaagtatctatgaaatgggactacacaaaaaacagagagatgagaaatattttgaaaaatgtgacttctccaattttttaagaaaaagattaacagcatatatttcattattaaaagactacaaagttccccttctgattattaaatgaaatatggctgaaaagttaaaatttccttgtatataaagcagtcttgaaattcactcctgtaaactatgacttagggttatatttcattatgcttatatattaccatgcgttacatggttagttttaccaaagcaaataacttttatgaaaagtgctgatatctttattgatgaatttaaagtgttaattcagaaaatacttggcaactccacctcatatgtacctggacttaaaatatcaagaccatttttaaagtgaaaataactttgaaaatattttgtcactgaagcagtgcaattcatttaaatggttttaaatcgaagtagttttatgaacaattgtgctaaatagcaatgaaatttcatttctagtgaataatgaaaagtctcatcacagtctattaaaaaaacaaaatttgttgttatattaaacgttatttttcttgacccttattctcatttgttatgaatatctctgagggaaaaacaagagcctatgtagtgggatataatattcaatttagaaatttatataaataatgcctgttctttatgtattatcaccacttactaaggatcaaactacaagaatactaaaagattttactttacataaagacacatatagaattttctcagaaatagacacgcttgtgagtagtgaaacaattgaaaggaattaaacataatcatgcaaattacttcccataatataaagtcctaaaactatttgtgaagtctcaagatgttaagatgctatacaatttcattaagaaaaataaatgaaaacatttatttcataaaacattaattagacaaattctacagtgtattttgagtttatctatccctacagtatgtcattgatatttatcttcctacaccaaagtcaaagtcatttgattgtgttcacccaagtatagcatactcaatgatacagaactctctccagagaaaagagggaattaaagaaattagaagataacaggttgcatattctagctgtaaaaacagacacttcaggataggtaagtgtttaagtggtcacataaaaagctcaattaaaactaatttaacttcatctcttaggatttgtaaacctattcttttgagcattgaactgagttgacaggacaaagttatccttaattattatttaactagaccaattaataactaattcttaccaaagtaataaattatttcatttacatatgaggtagctgcaattctattatggttttataaaaaagataaatactaattttgcacttgataaaatattttgttaaaacaagcaatctagctacattttgattcgtttaaatgaaatataaattgaaaagtaaggatcacagagattcagaggcttactaaaaattacagtcagtcccactgacagagccagatgcagaaccctgggaatgtaggagaccaactaaaaggcaaagcaaatgaatttggggattgaaatgttgagtctgaagtttttgaagaacaatcaaatgtcaaacaaacatttaaaactgtaagtttgagattcaagagggtgactagggcagagaacacagacttgagagacactgatacacacagtggataagagccaaagaatagaacatgaacatagagtgagaacaggaccaggcacgaaactttcttacgtgtccagattttaaagaaaatataggggaaaaaagacagtgggttaaatattttgcttgaaataaacaaaacagaaagtaaattattttaaaaagcacagttttgtcttcctttaaacataatgatatgtagttgcttatattcaatcaatccatgactttgattaccaaaacaatgtgctgaggtagacacagaaaggaatttcaccttctaggcataatgtagtaagtcacaggaggccagtgaatgttctctctgctaaaatctagaaaaagctggataaaccacaacaccatattttttagaggcataagagatctgagaaagcaaggagaagtagacaaacaaaagttcctaagagaggagaactttcttaaaatgggctaaggagaaatcagcaaaacgtttaatgatcaccggcacaggcggaggggtgttataattggaaaattaagagaacaaacacatctgtttccccactggacacatactgaattcaagaggtttgtgggaggctaaaaaagagaggctagaagcttccaaaatacagaaataaacaaaatgaatgagggttcaggagaagcataaaatgtaaactgtcagacctgaaagaaaaaaactgaccaaattcaaatcatagttggagattttagcaaccctctatcagaatcataaataaatgacagtaatgatactgaagagctagataaatctacctattgcctcaatctaactgatatttatagaacactaaatccaacaattgcagaataaacatttttgtcaagttcacacaaaacattcaccaagaatagaccacatgcagggacaaaaatcaagtttcaaaatataatcttacacattttattttcttgccataatggaagaaaattagaagtcaataacagtaaaatctagaagaaaatgcagttgtttcacatcttcaccaaaatttgggttttgccagtgttcttaatattcatcatacaagtgggtataaaatagtatgttactgtcgttttaatttgtgttttcctgatgactaatgatgttgagcacactctcaggtttctactggatgtgtgtatatcatcttttgggacattttttactcaaatattttgactatttttaaaaattgtacatacttccttttttagaatattttaggttcacagcaaaattcaaaggaatgcagagttcccatatttctgctacccccacacaagcaaaaactccctcaccatcaacattctgaatcagagtactacacttattacaatgatgaactaacattgacacatcattatcacacaaagttcatagtttacattagaaatcaattttagtgttgtatatcctaaggcctttgacaaatgtataataatatggatctatcatgatagtatcatacgaagtattctcactctcctaaaaatcctctgtgcctcacctattcatctcttcatcttaaacccctggcaacccctcatattttcactgtcttttagttttgccttttccaggatgtcatacatttggaataatacagtgtgtaatcatttcagattgatttctttcatttagtaataagcatttaactgtactccatgtcttctctgacctgatagctcatttatttttaactctaaataatattcctttgtctggatgtaccacaatttatttaggctttcatcttctaaagaacatattggttagttcaaagtctaacaattatgaataaaactgcagtaaacatccgtgtgcaggtttttgtgtggacataagttttcaattactttgggtaaatgccaaaaatgcaattgctggactggatagtaagagtatgtttaattgtgtaagaaagtgccaaactgccttccaaagtggctttactaattttgcattcccagcaaaaatgaatgacagtcccttttgctccacattctcatcaacatttggttgtgtcagtgttctggattttggccatcctaattgtgtagtggtatctgttgttttaatttgcaattccctaatgacatattttcacatggttatttgccatctgtatatctttcttgatgaggtgtatgttcagatctcttgcccattttaaaatcaggttattttcttattgttggattttagtgcttctttttatatttttatgtcatttatttatctgttatgtttctttcataaaatttttaaccagtctgtagcttatcttttcatttccttgacagtgtcttttgcagagcagaagtatttaattgtaataaagtctaacttatcaattgtttatttcatggatcatgcctttggatttgtatctaaaatgttatcaccaaatccaataacatctatattttctatgttatcttctcagaatatagtaggcatgtgttttctatttagttctacacttcattttgagttaatgtttgtgaaaggtgttagatctgtgtccagtgtgtctagatttttttttagcatgtgtatgtccagtggttccagtatcatttatcgattgaaatgcctttgcacctttgtcaaagacaagttgattatgtaggcctatttctgggctctgtattccagctcattgatcgtgtctatcctttcaataacaccacattgccttgactactgcagctttacagtaagtcttaaatttgggtactgtcaattctcagactttgttctccttcaatatatgttagttattctgagtcttctgcttttctatataaggtttggaatcattttgtccataagcaagatataacctcctgatattttgattgtaattacactgaatctgtggaacaatttggaaagaaccaacatcttgagaattgtgagtattcctgtccagaaacacaaaagatgtttccatttattttgtttctcttcaatttctttcaccatatttttatagatttcctcatatagattttgtacctatgttatgagatttattaaatatttccttttttggtgctaatttaaatgatattatcttttaaatttcaaattcttattgtgcattgctgacatatatgaaaacaattaacttttgtatattaatcttgtatctggcaaccttgcctattagtaaggaactaataattgttgattagttctaggaaattttttggtcaatttttaggatttcctacatggacaatcatgtcatctgtggacaaatgtagtttcatttatttcttcccaaactgtacacctttattttcttttctttctcatcacattagctagtgctgccagtatgatgccaaaaagcactggtcagaacgaacatccttgccttgttcccaatcttaccaggtcttaaattggggtttatatctttttattatttaaaatatttatttatatatccataatctttaaaaaatataataaatatatggagtaattttattttgtaaaaacactgccaaactgtcttccaaagaggccataaactttaagtgactctttcactgcatttgaaaagttttcatgtttaatttcattgttcagttcaaaatatttttttaatttcccattatttattttctgacctatggttattttgaagtgttaatttctcaatgtttagaccagtatggctaaatatgagagataaattgagttctaaaatataaagtcatggaggcagtagaggggatcaggatcacatagggcattgtcagaattttgactttaagtgcagtttgaaatcactagtgggttttgaacagaagagaaatatgatttgaccaaattaaaagatcactcaagctcctgtgtgaagaacagtctttatggataccagttacaagagtaatcttcaaccatgactgcattctgaaattatctgcaatgggatgcttcaaaaacactgatgctaactgctacctctccaacacatacacatacacacacagacacgtgattcatgcatgcctgtgattctcatttaattgatctgaagtttgtattgggattctgttaaccaccctcaccacacctccagcccaagatgtcagctgttacaatagccagcaattacggtggcttggactgaagtggtagtcttagaggctgtcagtcttttaatattttggatatatttttaaaggagagtcaacaatagtttccgattgactgagtgtagaatacgagggatggtttaaaaaagactagaagagtcaaggactacctaaaatttgggagtaagctaacttctgttgaactacaagacaaatcagtggtcacagggagatgcaggatagctgaggtaccatgtagtatacacaatatcacagaattaagtgtctgaggtaactgtgagagtaggtgactgggttaaggtggagaaccaaaaatactggagaagaattgaaggaatagaggccagctactgaacgcctcatctatgtaggttattgaattaacaaagaatcaggacaaaagttggacaaagcgagcccagagacaaactttataaagaatgaggagtgtgaccaaaggatccataggtgtctacaggaaggatgggtaacaggcaatatgatataatgggaatcacattttatagatttccagaagagaaaggtaaaataaacaagcaccggccgggcgtggtggctcatgcctgtaatcacagcactttgggaggccgacgcgggtggatcacgaggtcaggagatcaagaccatcctggctaacatggtgaaaccccgtctctactaaaaatacaaaaaaattagccgggtgtggtggcgggcgcctgtagtcccagctacttgggaggctgaggcaggagaatggtgtgaacccaggaggcagagcttgcagtgagccgagatcatgccactgcactccagcctgggcaacagagtgagactccatctcaaaaaaaaaaaaaaaaaaaagaagcatcaacgggaaataaaaagggcacttacccatctcgcttaatacaacagatgtgaagagaaaacagcatcatgtgttaaataattatatagcatatcatcctattttccctttaattacacattaaagggagtgaatatttaaatttgatattgtcaaataaacctgcaaagaaacattctactaatgtacactctcaccaatacagttccctatccatccagttacaccagagacctgactgttaattctcttctcccatccttcacattttacatcctaaacatctctccaatccctgcacattacttgagctctaatatccatattagagctctcatatccatctcttaccaaaaccagtatgacaggctcccatgcagactctctgtattcattttagatccttctgaacctttttatttcagccagagtgatatttttaaaaattctacaattatggtgatatatctcaaaagcttaattattttacatacttacctagtatacgaaatactcctagtatagagagtatttagtaatacgaaatactcctagtataaagacaaaatttctcaatggggtttcccaaggttggcccctacctatagcttcaacctcatctcccacaatgtaactccgtaccctctgcgtttttcatattggtcttcagttactttcatctaccccatgcccacaaatactttacatcagaaaactctcatttatacactggcctattttcttagcctatatccacttacccttctttcagacttcagcttgattaactctttgttgaagactcccctgtcaaatcttcctataatttgttgaagactcccctgtcaaatcttcctataatttacactcttagcaacacttcttcctctttgtagaattatcttagttacaattttatatacatttgtgtggttatttgatcagtgccacctgcctgcccgttatccaattttcatgaggataaagctcatgaaaatttgctcataactgtatctccagtttctacttgtactttgtatatgtaagaactcaataaatatttgaaagactaaaccaggtgtaagagtatctccacaaatgttcaatgccactgtgccttcaatggccttacactataattcttaaactagagtcatcccttagatataaatgctagtagtattcacaaatacaaacattgctcaaaacaataaatatttcaatgtaataacccctctttcttaaagaaaacctctaaaatgtcatagattagatctcagccccttgcacataaaaaataactttgtttcgaaacttcagttttacaatcaatcagtattcttaattccatcttaatacacatactaaaatttaaaactatattaaaatacataatcatgttgcaaacatacataacttttcccctattataatctccaaattgtaggctgaaattcaaagtgtatatgatagtgcactgtaactcttagctataaatagttcttataaagcctaataccctttaattatcaatcacagataaagagtctgaggtcattaaataaattaatttaaaactataaaaaagtgatacatacacatttgaaggtatcattaagattagaaaatcactataagtggaaattttagaaaacaatacaacagtcatctctttctggtgataacttctttctttcctcatcagttattatatagctgtgactattttcagattttcctttacccactgcttcttccccactggttttgctttaatcttccctcatgattttagaattaataaatgcatgctgatgacttaaaacattttatgcacatcactggcttccatctaaatactttcaaaaaaccacctcttttgacagtaaatctacccctaggcactaagctttgaaagcaggaattgagggctgttcattcttataccttagcacccagccttgtgcctggtatttgacaggcctcataaattaactgaatttaatgatcaagaacagaaaaagatttgcctcatattgtttttagtaactacaatcactttctgtataattagagataaacctgaaatgtgataagccattcaaaaatattcaatctgaatcatggtgcaaggaatgtgtgtgtataatatttatgtatgtcttcaaacactaaggacttttttccaaagtacatttttaagactgagtaccctaacagtaacacaataatctagatttagtcaagtcaaatttatctactatgctatatatttatgaggatacaaaatataaaacttggcttatggagaggtattcatggtcctaaattatttggcattttaaaaaatactctatttctgggcatcatcatatttaaaatgtatttgtttttataaacaagcagaaaaatcataatcacaggcatacaatgattcaggtatgtctagaaattattagtttgctcatattaattataggtttcaaagagtatacgttagtattgatatagtcaagaaacccttctgcaataactatgtcatctatggaaatatgtgtgacaaaaatatttatcatgctctttaaaaacagacaggtactttggtggaagtactgaaagaacaatcaattctcaaaaaatttcagatgaacagattataatcccgagtaaatatgaaatgcaggacaagtcttgtattaatgccaaagaacaatagactttcattttggtggaatgccccatacaaggaacaactttcagactgcagttaatggtagtgactggctcgaactggctacccaatgtatttaaattatttaatatagcttcctcatatgcaatcatctacctttaattatgtgtcaaaactagtaattattttcattcacaggaagaaaattcttatcattttttcactactaaaaagaaaaaaaatctgattccccaaacagctttttcatccaagctgtttaaatttcaacccaattcttacctctgggtgagaaatgtctcaagcaatattccctcccagaatatgaaattataaacatcatctaagaggatgaagaaatgaaatatgaagaaaaaatatgacaatgacaaatataatgccagtaagtaatttaaccttattgtaaatcatttttctttccccatctaaaagaaaaaaaagaattactctaaactctcctgaaagatagagaaagatgctagcaagataattggtttgtaaacatagcacagatatcaactaagagtattacctctgtggtccaatgacaaacacccatttccactaaaaattgatgttatggaagatctctaaataaaattactactattacttctattccccagccaaaataatgtcccttaaagtgggacagagctataagcctgaagttagaaaacatactaaattaaactaaatttcctagaccccttgggaaacattaggaagactgatctttaaatatctgtatataatttcatgatatctattattttattcctgtattcctttaatgaagctttctctaatatgtgcataaagtgtactgacaaagtacttttatcccatggcctagataggaaacacacagacacacacacacacacacacacacacacacacacacacacccctaaaattttctgagaggtaatgagttctgcaagaggaatgagtctgggttcaaattctggctccttcaattttgtgccatatgcccaaattactttacctctttcattcaatttttattcacctaacctttattgatctcttttggaaaagatgacactgaagctgagagctgaatagcaagaagcagcaaggcatggaagagcccatgtaagaaggagcccaggtaagcatcaggtccaagcctggaaagttttagggatggaaagacggttggtcagaagctttgtgagcaaggctgaaagaggttagacatatggttaatgagtcagaggaagatcacaaaggtttttgcaagacaagttaggagtaaggaatttgtcatttattctaagtaaaatagcaagcctttggagagaaaggtcacaatttggttcatcctggtgatctgtggaaaatggatttttaaggaaagaatgtaaaaagggaaattagtagttcagatgagaggtaaggagggtagcaggggagaaacaaaactggacagattccaaggatatagctttaacaggaatttttatacaactttcttactgattagatgcgcatgtgagagagaaaattttttccacgaattccagatttgtagttcaaataactaaagatgatgctactgccatttactcagatagaaagacttgtggatgaattggttcagtggagggttgtggtgagaaatccaggaatctccagcctggccaacatggtgaaaccccgtatccactaaaaatacaaaaactatccaggtgtggtggtacatgcctgtagtcccagctactcagtaggctgaggcatgagaattgcttgaatctgggatggggaggatgcagtgagctgagatcgtgccactgcactacagcctacgcgacagagtgagaccctgtctcaaaaaaaaaaaaaaaaaagaaagagagaggaaagaaagaaagaaagaaagaaaggagagaaagaaagaaagacaaagagagaaaggaaaggaaaagggaaagggaaaaggaaaaggaaaggaggaaggaaggaaggagagagagagaaagagggagaaagaaagaaagaaaagagaagaaagaaaagagaagagaagagaaaagagaagagaagagaaaagaaaagaagtccagatccagatatcacctttggatatgttaaatttgggttgttatttacatactgaagtggctaagtcaagtgtctcattgaagtgtaaagctgaagtttttttaggggagacatcaaaagtagagatgaaagtatggcagttatcatcaaatagatggttatctaaggaaagaaatgataactacctaggaacagaggagaaaatagtagaaacaaggcattccaattttatgtcctataatatgtcaatatttagacattgaaaagaggaggacatagctgccaaggagagttaaaaggagtggccaatgaagcaggggaagaataaaatgatgtaaagtaacttaagcctaggaggaaaaatgtttcaagaaaggatagtcaattgaagcaaatgctgcagaccagtcaagtacaaattacagatttggcaacacagagcactctcactgaacagacagcaagagatgtccaggtggagtggattaaggtgagaccaggagattagaaaatgaaaaacctttattgacaactctttcattaggctttgagggtgaggagcaaaatggagtggcacctggagaggaaaatgtagacaggtttcatttatttgtttgtctttaagatgcacaatatgcaagtatgaagatgtaaataaccatgtaaaagcaaaaattaacgtttcaggagagagagagtaattacacaagggaaacttttgaaaagactagaggaaatgggatccagatcacaagtgaaggtgttggcctttgacaggagcaaggcctttccagccaccatatgaagccattgaaattagggtttattcccagttcactgcatatctgcacatatcacaacagctgtcaccaaataacatcttgcacatcaataaaacaccaagaacatttacatttttaatttttaatttttttttttttaggagatggattctcactacattgcctaggctagagtgcaatggctattcacaggtgtggacactgtacactatagcctcatactccttgtgactcaagtggtactcacaccttagcctcctgagtagctgggactacaggtgccaaacacattttttaaatggagcttagaatatcctatataccatctcctttcactcaaaaaaagagaaaaaaaaaagaaaatacaaaaacaaaaaaccctctttgtagactacaagaaaagtattcaagattcactaatttattaaatatgcattgactaaatttttaataaaagtaattctttagataattccatgggtataaaacttacaaaggcattaaaataatagaccacaatcaatattttttcaatcggtagcagatatcatagatatgccttagtatagataccatgattcatctacttaaaagaatcataaataaactaacacaatgttgtccttttataagtaccatactatacaaagctaattgtccaactaagagcaacattatactgtttcataatgtaaatgattcattggtggttattccacattttaactataaaacataaacatgaataatcaatgctagttaattcagtggcactagtacctatgtctcatgtttgttgcatattggtgatttcacaagctagattgtctgtttaattcctaatcacactaattacttgaaagagtaatccaggaaatgtgacttattcaatttcaaagaacagcctagaaattagtagatagggcacctcagtaatgttatatagtcatgttcattgataaaattggaaggacttcatagtatttgtattaatctatcagagaaaatcacaaattcttaatatatttctccaaacattatttgaaatttcttctaatggacttaagtcatgtttgctctcaaccaggggtctgcaaactacaacacaagggctaaatccagatggctgcctgtctttataaataaaattttattggaacacagccacatcaacacagccacacctatgcattcacatatggtctacagatgcctttgtacaacatcagcacaattgaatagttgtgacagaaattatgtagcccagaaagctaaaaatacatgctatctggccttttacaataaaatgtttccttacttctactcgattttcaaaagaggcaacacattttttaaaaacaacttgtcagaatgggagacttttttccccaaaataaaataaacacaaataccttcaatggaaggtatttagtacacatcataataacctgtagaaatgctggataagaaattgtattaattatcttctaaatggaacaagctgatatatgagaaatgagaaatattataactaaatgtcaatgtctatcttccagaagagatgacttacaaaaaaacatagggccagctattttattatagtatattgtgacatatataccaaataattagaacgagtaataaaaaatgccaacgtgcttataaacaatattatctgtaaatctattctattagtcttctttagttgtagaaaatgacaaatataattacaaaatacttattcaaaacatgtaaaccactaattttccacttgtaaaagcctgattcaaaaagcaatttactttaaggtttacttaagctttgcaactacattaaaatatgatagtatatacacaacagcttgttaacaagattatcataacattaaaatcataatgtggcacttcaattatggatacttaaaattaaagctaatcctcacagtaccaatttttatctcctaaataattttagctattagctgctcattcaaagtctgtatctaaaatgataagcattctagagtaacgacttagctctgcacttttctttggtagcaaaacaaaagctgcatcccttctttcctagtccttaatatacaatcttttgatactaaggggaaaatgcagttttttcctgaccttgcttggctcagagcttcttactcatgttgctgttgccaatgctgttgtttcaaacagatacattctgtatatcaatggtacatatttcttttctggttttatctttccaaaaatatcaaactatcacttgcaatattaatttgatattttctgcaaatactatgtttgaacaaatgtcacctagtacctactaggcaccaggtggaacaaaccaatgcttagattaatgagtattataatgtatttcataaataaataattaataacaattaattgtgttagcctattaactgatttcattttttctactgtttcaccagatttgtacttgataattatgtaatcaatatttctcacctttgaattctaattcaagtttaaagtgaaggaaaagattctaaattgaaagaattctgtatttataaatgacagttaataacaaatccataaataatccagaagcattgttgccgaccatatggttgattttactaaacactggtaacagctaatataattgttttcttctatttccccaattaaattatatttgggccatttgagcagtgagattggaaactgagtgtcaaatcttgctttcactcactcctaaagtgaatgaatggaagtaatattcctaatttacatggcaaacagataataccaaatgtgtgtatccgtgtgtgtgcatgtgtatatatgtgtataaagacatatacacacattcatattacaaaatgtacatgaaactaattatataaattaccaaatgtgtgtatccatgtgtgtgcctgtgtatataggtgtataaagacatatacatacattcatattactcaaggtacacgaaattaatcacatacattacaaaaattacataagactaattacatatattttctgacctgtatttcaatgatatttattagggcaggtgcatgattatgtaaagtaatcatgcacttttgtcttttgatttcaaaaaaatctgaaagtactcatcctgattgacttcctcatgtgttaggtggcataaaccaaatcaaagaacctgctctggacatggtgaaatatgtgtttttctgtaatagaaatgataaagataacatgttctctgtgcatagaagacaagagaatactcttctctgctgatttggggagtagggctttcaggaggttcctgctgatctatttagtgatagaaaacttggaaaaacataattaagatagaattttagaaatgattaaaatagaaaagagttgaaacattgcttctgaatccaatctcactgctcaaacttttcaagtagttaaaatatacccttatacatgggcatttctgattataaaggaatttgtttttcaacactttgaaaattaaaaaaaagttacaaacgttaaatcatgtattactacttccatcattacataacattttcagaatgtttaaaaaattatttactttccatactattaaacaacctgctaatttcactggaagtattttgttaatactttctcattttatttattttatattcttcttcaatgccactttgatttttccctcatagctttatatttactttgtaaactacttaatcaatttgctaatctcaaatacttagcatgccttgtccttccactcttccatttttaactattttaaaagaattccataaaatttccttaaatctttgtaatcctaatgaatacacctgaaaggcaagggaagtccaaactccaaatgctgtcacagtgcaagttttccttgactgcaaagaggagattttatagagaaatatatccatacatatacacacatgtaatatctatataatacataccacatatagaaatatgcatacacatgcacacacacaaatctctaagaataagataaagtagaataatggccatattattatctttaaatcttattcagaggaacaaaattactcggttcatggtttactaatcacagcttcctcggagtcatggttcatgtagaagtatcagttaaagtatcagtgtaattcaaccattatatttagcaacagatgcaatattaacataacccaaatcataaacagctaaaataatacctaggttccagtagtaacacaacccttaggtcagatggtagtcaacaccagtactactgaatactaacagaggagtgaaattaaagacatacattaggctaatacacacagacgggacatacctgaaaagctgaaaaactacctcttttaaatgtcttggtatctcttttcggacctcagcctttcaataaaaagttagattgctatttatattgcttccacctctaaaagtccttgagttgaaggtaaagaaacaatgacattaaagcaattttaaccttttgactcaaataatatttagaaatgttagacctcttaaaagctactttccaagtttacatggctatacttttatatttaactctgtataaatggctgtttatgatgcacctacaaatagtatacacacaccagtaaaaaagccagcacagataaactgtgcaactcaacatcaccatctagtgacaaaattcttaacacgtgataaagccaagcgaaaaagaatacatttcagagacattctgtactggtagttcatctttatagtactaatgtaaatataacagatctcactgaatagacttcgctctgcaaataaaacaatgcctaatggcaatgttggcactccaaaaataatttgtattcttgccatagagatatactcataaatctattaacaatctatattttatgtgtattaagaaatacactgtaaaaaactcccaatagtatttttattttttttattaatgagtatattctatatgtacctcttctttttcagaatctgacgtcaccttttctcaagttattcaattcaagtaccttccaattgcatatatctattacccatagccctctactgcctgtgagactgaaaagggacaaaaagacaacacattggaggccgaggagggcagatcacctgaggtcaggagttcgagagcagccttaccaacatggtgaagccccatctctaataaaaatacacaaattagccaggcatggtggcacatgcctgtaatcccagctacttgggaggctgaggcaggagaatctcttcaacctgggaggcggaagttgcagtgagccgagaccgcaacaatgcactccagcctggacaacaagactgaaactccacctcaaaaaaaaaaaaaaaaaaatacaacacaatgttaaaagtggccccatccttccctttactgttcaggatttatcacaggggctaaaataggtacagaatatgatagtaaagaaatcaaatccctttggcatgattacagagttgaatcaaccaagataaagaaagaatatgatgaaaagaagttgagaattttacctctaaattcattatcatactataaaccagagatttgacctagagatgatgcacttttttcctgtccttaaaatgctttttctttgattatcattttcagaaatgctgtataagatttccacacccatggcactacaatagactatgtagaagttggacaagatatacagcttctagtattctatatgctaagactgcagtgaacttctccattgaattccattatttatacattacacatgtaattcttgtaagcacatacaacattaaaaggaaaaatgtatacaaacattatattttatatcttatttttattaattttcataaattacaaagcattctctcctctatatcctagttcctcatataaatcctaggagattttaaatcccattttacaaaaaagtaagagtaaaataattaatttacctaaaattacagttggagtctcaaatctgattcttactattgattccagtatttatttcatatttttagttttctccatttttccttcactgtttttctaattattcataatatattcccattacagaaaatatagaatggaaaagcatacgcctcaaaaaattatctttacgccaaccagccagatgtaatagccacatttcattcctattttttctctgcattttttatattcagttgagataatattctacaagcaattttgtttctctctctctctctatatatatatacacacacacagatttattttaaatatatgtaaatctgtgtatatatctgtaaatataaatatattatatatctgtatatatacacagattttatatactttataaatttataaatattgtaaaattctaaatatgaatatataaataatatatatttatatgtaatatatacatttatatatatttatgttatatacatataattgccttgtctattgtcttaatggtagacaattagttcctgtaaaatttgttcagggttatattccataatttgagtatcacattcatattatgcataatttctatggcttctgcataatatattcctagaaggtaaattaatacaaaaaaaagtatgtttgttttaagtctcttaatacttagtgacacaatcctttccttaaatgcagcagtaattttcaatcctctgagaatgtgagaatggctgtctcaccattccatctctagccatctgtgagaatggctgtctcgctattccatctctagcactcaaaaacttcccaccaaactgcattagcagcaataagcaagagattggtgtattttttgtgaaatttacactttttgtttgccattagagttgaatatttccaagggttacttaatcatagtttgccaattatctactgagttcccaatttttaaaatctgtcatacatatggcaatatagtacattgatgtcttttaattttgtgattgtccccatttgcataagttttttaaaataagtttgtttttaattggcacataatagttgcacatatttattggatacagtgtgatgtttcaatacatattagattgtgtaatgatcaaatcaaggtaattagcatatctattacctcaaacacttgtctttttttgtttgtttgttttgttttttgttttttgttttttttgagacggagtctcactctgtcacccaggctgaagggcagtggcgtgatctctgctgacttcaagctccacctccccggttcatgccattctcctgcctcagcctccaaaatagctgggactacaggcccccgccaccatacccggctaattttttgcatatttagtagagacggggtttcaccgtgttagccaggatagtctccatctcctgtgacaacactccaaattttctcacgttattttaaagtatacaatatattactgttgactatagtcaccttactgtgctatagaacaccaacctctccccatttccactccacactactctcccaagcttctggtaaccactattctactctctacttctatgagatgaacgtctttaaattccacataaaagtgagatcatgcagtgtttgcccttctgtgattagcttatttcacttaacattaacattttctaggttgatccattttcttgcaaatgacggaagcttttttttttattattggaatcaaagcttagtgatttcttcacctacttgttagcgtatcatctcttcccccatctcaatctcaaaagtcacttctatattccactggactttgactgtttcatttatttcccttagctctttaaaaatgcatgaaatttcctttgggccatgtgaagtgagactacaaagtctttttttttttttttttttttttgtccaaacagcaaaaacaaacaagtaaacaaacaaacaaaaaaaaccttttataccatttactgggtgattgaacatgtcctgaactacttggggtacttcatcatataataacttcatcagatctttatagtatctattatcaattacagacactatttgttttaaataacacgcagaagaacttaagaatttccatcttcattttgaatacaatcacattaaaagatgtcaaattcttagggaggttttgttgttaattctgttgggctttctaggtataaattatgtctttataaaataagagctaccttgtctcctctatatcaaattatactttttagttttggttttacatctattaccaggttatggatctaccttttactattagttttctaagaaagtaagtgtatctatgtgtgatgtgtgtgaacatggtttagcttcactctggcctctccattgttgagaactctgttaagtgagaggcagtcaagtgtcatattagcaacacaaaaacttccctttagggcagcacagaacaaaccacagccactaaccacatataagtatttaaatttaaattaataaaaattaagtaaaattaaacattcggttcttcagttacactcatcgcatttcaggtactcagtggccatatgtggctgagggctctcacactaaatggcacagatggagaacatttctctcatcacagaaaggtctgggcagcattggtctagatgtctctaagagccacagaaaaacggccaggaattccattcccctgtccttttcttcttaggcacattatatttcagtctagtcttactctgttagagaaggttattcagaattttaaatcccaaaatatgttttttctggcacgtattttcctaagccctgtattttcgtagacatctggctggactctccttctttcttatcccaatgcactattcttggaaatcatatgccttcccttggctacaacaagtatcaaaatactaacaagtctcaaatgcgcacatcaactctcagtcttttccttgagttgttgcattgtattttccctctgcctattgcacatttacacgagttaacctcagctatctcacagtcacctgaaaacccaaatcttcactaatcctctttttttctctctctctacatcaattaatgtatttatttaacgttttatttagctagcatattccagagaaggttgtaacccctcgtcctttttacacaccagggctacaggctcagggcatcctcaagactgggatcaggaggaagcatgggagggatctaaagtgatttgtaaactcggatactgacaagaaaccagattcaagactgcacagcaaagactggccagaaagagagactggatgaggtggctaagaatcctctcttttctgttctaagctcatagaaatagtaaaacctaaataaataaggaggtacccaagatggtgaaaggccccccaacactgcagccacaataggacaatcttcagatgtgggtccaactctgttccagttactcctggctagacacactcaggacaagaacaccactgtggggacctggagccacttaggggctgctaaagagatcaagctaataagaaaaagggatgctccatgttctcacccacaggtgggaattgaacaatgagaacacttggacacaggaaggggaacatcacacaccagggcctgtcatggggtggggggagggggggagggatagcattaggagatatacctaatgtgaatgacgagttaatgggtgcagcacaccaacatggcgcatgtatacatatgtaactaacctgcacgttgtgcacatgtaccctagaacttaaagtataataaaaaaaaaagaaagaaagaaaaacggatggtcccatagccaagctatgccaggccaatggactaacagagaagctaccatgaaatattctgggccagggaaaagactgaaatactcagtctctgggtcttcacctcaagcatattccgaacacattttaaaaagcacctgacccaccatatactaaattgttgtatgctattaattactaaattattccactgtgtttaatgaatccagacattaccaataatgtgtgtctgtgtgtgtgtgtaagtaaaatgtataacttaagcaaacaagtacatttcatgccataaaattaaattctcacttaaattatccagactactgctttgtctcatagaatgggtggttggcaagttattccaggcaggtaatacttgtttttatcatcagttcatctctagttttttaaaaaacaggacatcctggtatgttctaaaatgttatgtataacgaaatttggcagaatttaatcatctcttcatttgaagttaattcttataattcaatttgtttttttcttgaggacaaatttcctacactgattacatatcctttccttgttccttgtattttcctcattcacatcatttttcattcacattgcctcttttcagttctttctgtcttttggtcttcagttcttttattcaaagcataagagttgccaccctctttgtcttcctgtttgtctatgtatttacttcaaaataaatagatataaaaatatagagaataactgcagttttccaagtaaatattggcatgcatgtttactgtatttaaacttatcataataagcatttacaaaaaatgttaaatttatagcagtggtaattttaggataaaccactatgtatggtgaaaattagaaattcattcataatttctgcattagctttttccaaaacaaatattttacaacttatttttaatttgctaaaattttcaataacttaaactttctgagaatatctgattgcattttatatagatacaaattctctattgtgtactcagttttatttttccctcttttttttattagtaaagacattaacaataaaataggctcacttgctccagctggtaatttctcatactagtaatatattattcctctttttgtgacatcataatcatctatacagaagtaccatgtatctttgtgtagaagctactgtttccattaaatttaattacctccccctgtggttttaaatagaagtggcttcaaaatgagggcagcttctattaaatttaattactttctcctgctgcttgcatggtaaaaggaaggttactaaatgagagcagcttctaaactaaagtatatggtaactgtgtgctagcaataacaaaattgtatctaaactacctttctaggaagctcttaggtttatcctttctctcattttaatctctttagccttaacatccttgaaaaatgagcattaagatagaagaaggcgtattttaaaaacatattttaattttataggctaaataaatataaatacactttctttacaaagatattggaaattatgctactcaaatattcaagctcagaacttttaagactactaacatttgttgttttctcactctgtggatgatgagttttatttcccacaaattttcaatgtctaataaaaagcctttcttgattctgatcaaatagatttgaaaaatgcttcactaaaagttatttaaaaggcatcaaatttggggcaatttcatataaatattcagaattactgatgttaagaaatgaaaaaagaaaaaaagtcaggctcattatagaccactatagttgaaaggaagttaattatatgctttgtaatagtgtaaaaatgtaaatcactaaaaatactataatataatataatcctataaaatgttatagaagatgaaaatgtaagtacctctctttaaattaaatattaattaggaggaaatactactcaattaaagcaccattgtacaatgtttatttctttatatacaggcagaatttagatgaacaatattttcattcaatcacacagtttagtataagtataaaacaagacaccccttaagcattttaagtaacaaattaaacatttacattttttactgtgcactgaggcttaacatttatgcagcttcaaaaccaaagtacagcctcaagggaagtctctccactgacaaattaataccttagagaacagagctgaatggtggcaatgaactcatttgttccccaaataatgaagaatgactttttctttaccacatctgtgactgttgctatggtgacccagacttacctcattgcttctcggagagctcctcgctcaccaagagtcgtgtgcttgatgtcatcaaaattattctccagcttctcacaattctgcaacatatttaaaaattgcattaattctctaagatcctgagaaaaattgtatctatgcagttatgcaaaaatgtaattgattatattgatcatggactcatgaaaaatatgcataccactttaattgggtagcattcattaaaattgacagttaaatccaacagtaacaaaataaaaacattttatgatacagctgtcacagaagtctcattatcaatttttcaaagtggagtttcgttatcaatttttcaaagtggataaacagaagaaatgaatttataaaagtaggaaaacttcttaagtttggaggaataaaaattagttctctaaaataatcttaagtatagaaaatccaatttaaactcaaaagagaaaaccattaagtttttgatcaccataaacagtatacaataaataccaagttctaaataagctagcattgactaagatgaagggatagagcacagatataataataaaagtttcaaaatttttgaatcaaaattttataatcagatctttaaataacaattttatgtgtaatatttacaactgcacatatatatttatatacttgaaactaaagttaaaatcttaaaattaggtgaaaattagattagatcaggttcttagaagaattttaagattgagtaaatatgacataagcagtttaaatttcataagtgtttctactttttggtaaaatagcaatactagactgaattttctaaaagtactttaaaaaatttttactacaattctaaatataattatacgtacttaaaactcacttaatctgagagaacccgaataggttttgagggcataaattgtagaaattttcaatttatatacatatatatatgaatcttttggcaccctagatttcttatggaatttactagtatttagttgataaaataactagatttagtgtattacttatttttacagaaagaaaaactaaatgacaaaattttagtattaatatgttctttctattcttgaataagtatcctgaattttacaaaattacagaaattatattaataatgtccaatgtataagaatgaattgatttgaaatatattggtatataaaccactatttttaaccttgatattttttaaaactaagtcaaattaaggcaaagatccttttaacaaacacacacagttatatgttgttataattaaaatctttgaaattaccaaaatgaatctacaataattaaaattatatatttttcaaaaagtccattttgggtatatacattaaaagtatcctcttctgtcttatcttcccacatttttagaagtgtctttcaataaagagaactgcttagctgagatcaaatttgttagttttctaatttaagtacagtgtttttgtgtgctgtttaagaaatttaaaaactttctcaaagttataaatgttgttgattgagaccattaagaaaaaatacacataattttttgtttgtttctttttggccctgaaattcctcatcagcttcctcctctttgccaatcctactgcaatcttttttttatttcttttttttttaattatactttaagttctagggtacaggaacgtgcagttttgttacataggtatatatgtgccatgttggcttgctgcacccgtcagctcgtcatttacattaggtatttctcctaatgccatccctccctcagccccccacccccagacaggctccagtgtgggatgttccccaccctgtgtccatgtgttctcattggtcaattctcacctatgagtgagaacatgctgtgttcggttttctctccttgtgatagtttgctgagaatgatggtttccagctttatccatgtcccttcaaaggacatgaattcatccttttttatggctgcaaagtattccatggtgtatatgggccacattttcttaatccagtttatcattgatggacatttgggctggttccaagtctttgccattgtgaatagtgcctcaataaacatatgtgtgtatcctactgcaatttttaactttacttgggcctccaccactgtagaggaacaagttcataaaagaattaaagaaataacaaaattattggacataaattttttaaggtccattcctagcataaacagcagggttggaagattacttgactatctagtttttctagccacagagacaggagataaacacattcttggattaaaataagagacagaagcctgggcagagtggctcatgcctgtaatcccagcactttgggaggccgaggtgggcggatcatgaggtcaagagatggagaccatcctggccaacatggtgaactctgtctctactaaaaatacaaaaattagctgggcatggtgggtgcacctgtagtcccagctactcaggaggctgaggcaggagaattccttgaacctgggaggtggaggctgcagtgagctgagttcgcgccacggcactccagccggggacagagtgagactccatctcaaaaaaaaaaaaaaagagagagagagaaagtggacacgtggacactgagagactgtagtagccacactgagtagccacactgagcgctcagtgatgccaggaattgaagacagccaaatttctgatttagctgaaataccgtgtttcagagtaccttcactataatgagtagaagcggcaaccttaataataattttatcaggaagtggttaaaatggcatattctgccttgatgtggaatgggaaacccaaaatgagtattaggctaactaacagaagaacaaatgctccatgttttacactttgtgtctgcatgaagtttattatacccaacagaacaacaaaggaaataagtaagcactgtagcatttaaacagttaactattaccttgactaaaaatacttctgtatacagaaattgaaatcaaatctattttttatgcttcaagaaccatatgtagaagcactaagtaacagacacatgatttgaattatatttcagacaatattaggctcttgccatatagaataagtatttcaagcaactaacatctttatctgctcaaacttctcataaataaaagtaagcattaaatatccactgagtaaagggcaaacagattcactgtcacgtttaccaccaataacacttctctaacattaaagacaactgcaggtaaaattgagccagcggcctccaatcaaaatctgttctcagcccactttatatgaacatggatctgagaaaaactgtaaattatttgtaatcaacaagttattcattcttggggattctgtaagttagtataggactgtcccagaatacgatttcagtggtaagtatcacataggggacttactttacaggataggaaagttcataaaaattcaaaaaaattatccatggtagtggcttgtgatttccaccctccaagtgcctcctaatttcctttgaccaatataatggcatgagaaacctacaaccatcacagcagaagaaaggaaaaggcaacagataaaaagagaaaaggggacagagagaatgaatgaacaaactactcctgagaacagcaagcagaagaacaaaaataatcagtgattagtaataaaatactggaacaaaacgcaggcctgctagcctagacaatgtggagcaagaaagtgggaatacacaggaaaaatggaaggtcacaaaggtactaaatttaatgccgaccagacatgccatgtaatataacaggcacaggttagctctaattaattggtagaaaactgaaaattcggaacaatttgtatcagcaaccatggtacacattatagctttaatatataatgtattgtgtgtgtgtgtgtgtgtgtgtgtgtgtgtgtgtgtgtgtgtattaattatagtaaaccagttaacattgagtagtgactctgggttaggtactttttctaggaagtctaaccatttaatctgcatgacaaccatatgtattcctattttacaaatgaggaaacaaccacaggggagattaagataaagcttgcccagggttatacagctagcaagggataaagcagggatttgaacccaagcagtctagcctcagagccagactcaaactcctcgcgagtccgcttctaaagagtaaactgcataagtgaatataataaagttctgaataggccttcctctaggtgtcatcaaatttaaatactgagctggatggaaaatagtttactagcagagtcaaatgtagcagaagctcttgcaggattctgtctacatctgtctggaagtgctatactttataatgtagaaaaatatggaatccaatatacacatttaggccaaattaatacccataaatattttgcatgcaacagtctttatttgggtctgtgacaccaccgtgacaaatataatgagcaattaaattcccaagtgttcagattttggcagcaattgaagtagaaactggaaactaagcatcaaaaagaactggttttggtggcctcctgccaaatgaatccccatgggttgagggaaggtctagagtttcaactgtgatagatttcatagtgttttatatctcatctgtgttaaggattctataaaagtataatgaaacaagtagaacaccaacagtcacatgaaagaaaataatatacaaggagatttcagaacgctgaggattttaaataaaattcactgagttatctttgctcaaattataccaaaaaaaatcacaaaattcaaccaaacacctactgattctggatggaggtggaaagaggcaaagaaaaaaaaaaaaaaaagaacagctagcaaattacattattaaataaaacaaatcactgataattccacaggactttatttccatgggactgaatttttatgttataattatgataactaaaactaaatcagatctaaaatttatatacaaacctaaattgaataaattaggaaaccaattttaacaaatgaaaagtcacaaagagttaatggcatagctactggagtttaagtctcagaattactaagtaacaaaggctcgagttaatgaattaaatttcagtgcagaaaaaaaaatcttgaaaatctattacatgtcaggaataatactatgcacagggatatgaaggtaaataagacaagacttcaacttgctcacatgtagtaagaatacagaggagagaaaggaaataattctcttggaacaagagatgactatgagtttgttacttccaaacctgtctttgaaatgatttacaattttccagattaagagaaaaaaagggggaaggctaaggtaataaaattggctctagcctcagaccttaccattactgtctacaggctaagtccttaggcaagttaattaactcagtttcctcatcgtgaaatatacttaccttctagagctatcaacaagattaaatgaggtaatatatgtaaatccattagtacattcagcaacgacgttttcaataaaggtggaaaaagaggaaagaataaacagaagaagagtatccatgaaccccaactcaatcctaatggatcagattttatatggtgaaatagaaaaaaatgtgcatttttcatgtttaaccaggtgatttttatgaataataaagtaaaagaaagtctttatggatttttttaaactttttggtcataagactcctatgagagtataatgaaaaccatgatccttttccttaaaaaattacattttcacaaaagtacatatgcacaagtacacaatatgctatgctatatacaatttcagtgggccaatacagctcctgaagcccatctatggcccaacgtctatgtgcaacaaattttagtatcagggaggatgatttcacaatggacctagacagcttagaaacggaagttacaaatataatcagtagtccaagaaccttgtgaaacaaggggtccaaaagttggcaaatttctattgctgtttgacaataaagcatcttaagttcaaacatcaaatttctaatttaaaaaaagacacaaaagtcaatcctgttgccaagctagaaatgaaaaccagtcattcattcattcattcaatatttatttagaacataatgggtgctagatagtatgctaatcattgagacaccaaggtttaaaaccttttttttaactccttattttgaaaaaaaaaagccaattcaatagggtaactgttataaggtaaataggcctcacatccattgccatgtattagtgatatatcagcaataattacaaatctcagctggttgaaaacctgcaggatactaaattttgaaggaacctcagagaattatcacaagggaaaccaccactcttatgaaggcaatgataaatttcatattttaaaatatgaggaatatttaaataaaatggcacactccaacatgtactgctacaattctaaggcagttcaatgttggttactacaaagcttttctttaggacataaagtaaattgggaaaaggtaatacaagtacatgcatttctcatgtagttagaatttcctaaggtctaggttcctctaaaaaaaaaaaaatgagtcaattaggtgaacttactctttctggaaaatgttgtatcttaatttttgcactcaacaagaagtctcaaaactagccctgctgaagttctttataagtacaagtaagaaataattactatattcatatttttttaattctagatgaacattctactgtcaatatatgatttccagttctaatcaagagattcatatttcaatagataattgcttttccctttggtgtgtcttaactagtctaatcctttcagggaacattaagaggtaatcatatttagctaatgtcatttcactaattgtggccagcttacaatcaggccctgtctaggagaatcttatatgagtcacagtgaaatacaatataatgcagtaggagaggtaggagctatgcagagagaaaatttgtttttgagtttcatctctacaactaaacagcttatgtgttcttacaaaaatgcttaacatctcaatctgcaaatagtccttcataaaatgaaggtatcaatgaagatgatgaaagtaatattatccactcaaagtgttattgtaaagattaaagtaaataaaaacatgtatgtgaaaatatatacattgttcaaacattattacatatttttaaaagatagaatgaatctcatttctgccttcatagtctgaaagtatgttaattttatttgaaatattttaagatttcatctctcatacacagtaagaattaagtaatattttagtacttttttgagataaattaaaagtttagctacagtatcctacctgctgataattcattcctatatctatgagaggtcaacaaagttcaggataaagtatttgctttttaatcataatttcatatttaaaattacaatgcgtttgtttgcataatgtatggttatattttgattgagtctcatatggtttacatgataatcaaatgaaacacagtatcattatttcaatatatattgtggagttctatgtcccatgtactgccaaccacaaactattatacaaatattgatatttactattttggaagccattataatttacttactcacttaatcttgacaagagggaaggctctccaagagcaatttaaaaatgaaaatctactatttcaaccagggaagcctgctcacctttaagctctgaacaatctgacccatctccactaaattaattaccaccacagggaaaccacagctacacaactgctctctaggatattatccctataaggataaaaaatttgatgtaatctagaggctttaaacttaaaacaatcccttgtccttgatggagtttttgctgaagcatctggcaatccctgctagactaagtggtgtctaagcaaatgaggaaaactttggtatcagggatggggtgcgggtggcaaagtcaaataaatccactgttactacttgaacatcagtggtgttcctctgtctcaattttggatggttaattttttcatctatgtttataggactatcactcacttaagaatgttaaatgtctcatttactcaatccagtgattttgttcatgcatttattagtaacacagaaaacacgttattcttagtctttggaaatcaagttttaatgtatgcttaatctagttaaaatatagaaaagtctatttagatggtatggctgtgtaatgcagtgcatgatgtactgtaataacaccacccagtgtgtgtaagattaaagttagacaccaggtaaactcacagatgtaaacagtcttttctctagaacatacttagaaggatcacttattttaaaaatacgttgtttaaaaaacaattaacatatgaatatgtattaccttaagctacctcaattctctgattggaaaaaaaaaccttgagatcacaatggagtgggtcagttcaaacagaaacaaggaatttactagattagggctctaaaaattaacaatctttggtgtatcatgaattttaaatgtacattacaaagaaaaatatgcaagccaatttaacataagtctcaataaatagtgcctaaattgataaactgatttttgtttacaaagaaaaaatatgcctaagatttccatatactgtacacagttatggaatggttggtactagatagatatcaaataaaaaacctaaaatagtattcatgatcatttatctttaaaagcacatgtgtgcattttaatacatgaggaaagattaatagaaccatttaagtttttgtgttaagttaaaattcagagaagcaatcatttttaagtcacaaaagataaagccttccaatatccttctggttttggaggaataaaggcttttacttgacagttacttacatgaatttgtatcaaaaagagaatttggcagagacttctaaattcataacaattgtctattagtctgtttttaataatttttctttggcatgtaatcctctttaattagattccactctctgttgtttcaagactccataaacgggtgtcttatgtaccagctgctaaagcaggagttactgtctaaatgatattcacaatgagtatttagaaggtttacaattatacccttgctaataaattgtgctattttccccaacaattttaagtgctaatcttcagaaggcattttaaaattagctaaaattctgtcaagagatttacaaaaattgttagcatgaagataattatgtcacagtccttggactccatctctgattgtgtgcataaatcagaaaatgtcagctgtgttttcccttaataattatccttgcagcaatatattatagtctaaactcctattataatttctgtttctggtttctaaaacaccagacagttatttcaaaagtttggaaccgaataaataattcatatttcccagaataataagtgattatcaattctaaaattgtaagtattagcaataaatagatcaatatggaaaagataaactctgttttcataaactctccatcctgaaaaaccaaatgcttgaatgtgataatgactttttaaaaatattaattaggtaaaaatctaacatagcagatagtaggcaaatagaagcagggatctgaatagaattctaaggcacccactattttttattccaacagcacagacacttgaaacacagatgtctgaaatacatatcaagttgcttatcatctgatactatccaattttctatatttcttattaagtatataaaattttgaccctcattttagaagatacaaaataaaaaagaattttttgactttcatccaaatatcaaaaattataagtatgcttttattttctctggttaaacagattagaccagaaatataatttttatgcaagctcagtaatcatgttaaaaacaagtctcagacagcagtctttataataaattagctaagcattttgtttagtatgtttctaatactatcaagcatttcagaattcacaaagataaaaaaatccagttctctaaatactttaatgctgtagcatatcaaactcaggtttattatataaaccatataaatccagatataatagcaacggtatgtggctcagagttgtgggtattcaaagacaagtgaaaaacagaatatattttcctagaacattaggttcacggaaactattttggaaaaaggttttaaaattttgctcatcaactgtaatcaacagagtcagatttttcaagttactcaatattgtgttctttccaattgtgtgtttcctcggagtagaaacagtcatgtaacttaaaaataaaagaacttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccaggtacttgggaggctgaggcaggagaatggcgtgaacccgggaggcggagcttgcagtgagccgagattgcgccactgcagtccgcagtccggcctgggcgacagagcgagactccgtctcaaaaaaaaaaataaataaaaaaataaaagaacttgagtattactactgaagttaacataaacttttcaatcacatcaaatgaacagggccaatgctagaacaacagggactataggaactagaatccgtgatttccgcagatcctcatgaatcaattttctgaaaaataagtttatagccttaaatcagacttccttacaccttggttaaaccaaccagcaaacaaaactttctcctacaaaatacatccacttctttccaaaaccacttcctttaaaaaacgttttagtaacaaacatactattaaccttccttcctttcacagtatactccccaatatataaagcatgttgaaaattacgcatattgtaaatggtttaattttttaacttcaaatcttaatatattcaattacaaaagtaatatatgcccttttataagaactgaatacaaagttatgtaacaataattttctgtctccaacctaacatctaattctactccagtgagctagattactacctttctatagttttccatgctcacacaacacgttttatgttgcagctttttgtgtggggtatgtgtgtgtacttcttgtttctcagtggggtctacttacttaaaaacatcagtcagcaattctttgtgtgtgtgtgtgtgtgtaccacaaacaggtggatctaccaccaggtcaataaatatgactataaaattccaaaaacttctcaatattacatattttacttaacaattttcttaatgatggaatcatagttttatttccctagaattttgctgttaggaataatgctataatatatccttgtacatgtgtgatggtgacttctcttactaggggataaattatggtgaaaatgacaggatctttttttaaccattttgatatacattactagacaattcaccacaagtttgtagtaattcacaatccactagcaatgtatgaaagagcttagttgcctgaaactttgccagtgctagacattattaatctcctacatatgccagttggagactgaaaagcattttataattccctggatactaatgaggtggagcatcttttcatgtgtttatcggctatttacattttatttttagatattgcctattcatatcctttgccatttttgtcatttatgtcataaatatattctcaataattttcccttcacttgtgtagagtaactttggccacacaatagtttgttgtttctctttaaaggatattaagaataaccaaaaaatgacataatgtttgagataaagctatagtggatttttagaggaaaatgtatagcatcaaaatataaatcaggagacaacaataaagtattgaaaattataaagtgtttttttaaatgcacgacaaaaaaaaacccagaacaccctctcccttaatcaacgaaataggagtaattttttaagcccagtgctgtaatattttggttgaatctgctttgggccaaagtgaagcatccaagcggaaaatggggttgttattcatctaagtctaaaccataaaatgtaatacatagaaataatttctgaataactggttgaaaatggaggttaactagatactgtatttttctgggattaaaggatgaatatcaacaatattccttattctttgccacattcaccatttcatcccattattttttatgatgtcttcatttcccaaatatttaaaattaaaatatgtgaagaaaacatcagtagggtaagttttttgtcttatttctttttaattattaaaaaatatgacattaattggaaaaatgaatggagttatgtgcacaaatgatgtgaaatccatgaaaggcagaagcatgaggggatttcactgcatctaggcctggccactttccaaattcaaggaacaacagcctcactctcaaattatactttgtctccaagagtttattttttctcaataggtttatttcagtgataaaacagttgaattatatacatacgaagtttccaaaattataacttttagtccattttaatcaaatgggcatgaatgtggacagtttgctcttctgaccttcactggaagaaagtgtaggtgtaagaatttttctccatgaagaaaaaatgatgctgtatcagaggttaaaaactacaagtaaaacaacttaagttaattgttcaccctaacacagacatttgcacatttggcccattaaagtattcttacaactttgggcatgattcattttttaaaaaatgtaaagaaacagtatatttatggtacatgaccaaaatgctgcaatgaaaatgaaatttgaaaattgaatgaagagagttgattatgtagattgcaaggctcagataatttacatgtgatgaaaattacagtatcagttttaaaattaatggcattatcactcatcattattccctgaactgatccttttatgagattatcacagagacaagagaagattgaccaaaagattagtgaccctttcatctcatcataatccacaagtggcttaacttgtcatcaaaaaatatacttatcaaaatttctatcaacacagcctggaaatattgcactgtactgcttctttgacttaattctgagtatctcttactagtgattatgttgatgtattttacaagcagtgaaaaaggaaactgatggcatctctccccacatgactgtatgcaatcttcaatgctatgacagctcaagaatgataatcgcctcattgctgaaatgaatatctgacataagtatttaatttaaaccagtttcctgaacctgacaggatcatagaaacagtatcccaccaatttacctaaagggagtagcaggggaaaaaaaaaatgtttgttcccagatatggaaaattcatatatcattttaatgtcaaaatgagcaaatcttataggaatctaacatactcaacattatgcttattttttgtttgtttttattattaattttattaaaatagaatgcaatctctaggagacaagaaattttcctgtatttcattcactactgtatctgaagggcttaaacagagtctgacccattctagaagttcaaggaataaataaaaaatatattatatgtagaataaaaatttgcattattattaaaattaaataaagacttcatagatattgccttttgtgggctaagggcctggatcttctctagtagtcagaggcttctttttttactattagtggaatttcactggaaaatttgatatgtagtcccttgttgataaaattcttaaaaactgacttgctacacagggaaagatgttaagcatattttaattttatttttaatcaactttggcgatatataaagtaacatttttatcaaacatattaaatatttcaacttgaactgaatagctatattgttatccttgttagaataattaaatattggctacaatcatcaatagaataacaagtataataaaattaaattgtcagtgcatatgttaattgcagagaggaaaatattctagagcttaattttcaaatggtctttcaaaggaagatcatactaggtggcattcaagttgattttctctctcactaatatatatttatttctatcagaagacattttaatacaattgagtaatccaaatatttcaatgctttctacaattcatacaggaacttatgttgcataatgattctactaaatgcaactattaataccttttactcttctactgatttcattaattattataactaacatcacgattattattttaaacagcttaaatgttgactagttctacaaagttatcagccctctattcactgacacattgctgaaatcattaaactggaaggggctttaagaatgcaataaacgtttgttaaggtgaattgacactagtgcctatttataaagttatgaagagaaaatctatattgtttaaaagatctctaaaaaacaaaattcataacctctcaaggatttaaaatcttcatcttagtacattttttagttctcatctaaagcacttatacttcccatcctcttgttctgcacttggtggagatgttcaataaatatttgttaaatcccatcttcttgttctgtactcactggagatggaaaacagctagtcttctttctcttataagaacccttcatccttaaagactgttattaactccccactcttctagtctcaagcctgaacaatccaatcttttagccttccttcatcatcctgacttctcttaagtctcaatttatacagacgcctatctcagaaaacctactcagggtctcaatttcccttcttattaattgagcttaaaattggaaaagttacccaatgcatttaaccaatttttaccataatcaacaaaatattgctttacagcttctcactatagcaataactcacccctacacctatctatatgttcttttgaatataaataacacttcaactcactagaacattcagatttagtagaagaggctattttacctcatagcaaataatatgtttctcttcagtataggcaacaggattttatcttaacttcccttagcataatctgattgtctggcccaaagccatcatctatggagccttctgaacaatccccagtggacattacaatattgactgtgtgagaaattttattttcctagacaagttagaaatgtgaacttggttttctttaacacttatttatagcattcaatcagactgaccttgtttgatggaatacctaaaggatactcatgtttctttccataagaagtcaaatgttcattaatttagtaagcaatactctaaacactccataattattttcatatgtacagcatttgtatgaatttgatctgtatgaatttcctagaaaaaaatttacaatacttttagagtttattctaaatatttattctaaatattctaggcatctgccctcataagcttacattttaatgaataggggagagatgatacaaatatatacttaaaatatctttttaaaatatgaaaaaatatacatacttcaaatgtttacatttaacactatgtgataacctcagatactatcagagtttatcagatagtgttaaacactacagggaaagaaaggagaataaagtgatagggaaataaagatctattacaaacagaatggtcagggaagacattttcaagatcttaacaaagggaaaggaactgcaaagaccctaaaagagagtcagtatgcctaaaatatgataataaggtacataatggtagaaggaaaaataggagacaggtttcagatcacagagaatcttgccaaaccatggtgatactgcaatataataaaaaatacatattttggttttcatccctgttttctggcacacagctcctataagctttgtaatctcagaagtcgtaagtgtctttttgtatgctgatgagatgactgatgcctggaggctcctgtacagcttcagaatgggggctggttgccagtcaatcaaccgtgtgattacagagttggaacttttagccccatcccctatcctaggagaagggagaggggctgaagtttgagttaaaaatgaccaataatttgatcaatcatgcctacataatgtaacccttataaaaacaaaagaaaggggctcacagagctttgggtcagtgaacatgtggaggtgctggtgataacagcggtggtctatctggagtggctgctgtgaagacaccagctgcagctggggaggtatggctggaggaagcatggccagcgctacaccctccatagggccagcaggagccaggtacaggtgggagccccacacacttctgagttggcagggtgggagccttgccctcttgggtgcggctgcagccacccagctgtggctccagacctgggcaaccctgccttctcaggggcctgggaaaccccccactgcccctgcagtctcagaagtgcctgctcccactacctggtctctccccacccaggcacctgctctgattttggagcaaagttgtgcctgagcccaggtgctgtcgcaacctggctgggtgtgcacacatttgcagcagtgctgacaggccagctgtctctcaccttgtgcccctctggactttgggtaccgatgaacaacagtggaaagcagggggtgctgaggggtgctcagcatgggcctgcaggcactcttggcacaaatagcctgggcactgtagattacctgatcaatggcagcaatacgcagacagcctcaagcatggaaaggggcgggtccccagtgaagccccaccttcaagccagggacttcctgaagcatgagggctggactgtcagttccaggtggagtccctggagttagaacttacagtgctttttctggacctgcccacagccacctatagaccaatcagcacacacttactcccttctgaagcccatacaaactctggactcagccagactcagagacatcaggacaaccagctgtggaaaggagctacccaatttgggtcttcaccactagttgggacgacctgcctacagaaagaagctacccactccaggtctcctttctgctgagagctggacactcattaggacgacctgcctgtggaaagctgctaaccactatgggtctctcgagtactgttctgtcacacagtgaagctcctttctaccttgctctccctccagtagcctgcgtacctcattcttcctggacatgggacaagaactcaggacccaccaaatggtgggaatgaaagagcagtaacaaaaatagggctgaaacagaatcctcctactgctcgccaggttgtgggagacatgaaggagaggagagctgtggcccttcagggaggccagacctaggggttacctgatccagggctgtcacatcctctttggggctctgtggctcctgacatttccaagcttccgggcaccatcacattcccctcatccacgtgtgggtgcatacagcagatgccgcatgtggtacatctgatccagctgcagcctcacatggagccgggacctgtaccagtgcctggagctgcccaccctgctgcagcagcaagcatccctggctgtgtgcaatgggtggaccccacactcactcactcacacacctcttgccactctgcaactggcttgccctgggcaggtatgggatccagactggtggtgcgagccgagaacagcctgctgggccgagtgggcagaatgagcccaggtggcatgggcaatactcaggcagaaggcgttgttgaacacagaggtttccggctggtgaagtgacacctcaaggatcacgtgacactgggatggtggcacaaccaagacaggacatggaagctccgtgtcttttttccccataccttgctctatgcatctcctccaattggttgttcctatgttgcattcctttatttaaaaaaaactgggaatctaataaataaactgttttcctgagttctctgagccattccagcaaatgattgaacctaaggagggtgctcttgcaacatctgatttatagatagttgttcagagacacaagagacagcctggacttgtgtttggcatctgactcgggggaagtcttgtgggactgagcccataacccccaggatgtgatgctacatccaggtagatcgtgtcagaattaagttgcagaacacctagttggtgtcctcagagaactggagaattacttggggtgggaaaaccccacacatctggtattagaagtgaagtactgagattggtatgaatataaagaagaaacaatatttgtttattttgttcaacaatgataatgtttgcatttattcaaattacagtatgaagtctttacagggaaatagttatgtagcatcattgtcttaaaatcataggaaaacaatcacatcatactttctattttttaatgactattatttgttcacctatgtttaacttctcaaaatgtacaactaataaaacattagttcatcgtatgttttcataacagaaatattcagtaagaagtacagattttcaaaaaaacagcacttttcagttgtgaaattcaaaaccataaagtggagggagggatggctgccccaggtatcatttttagctattcaccttcaaatcccacttacactttggaacttttacctaagaatcagtcatttatttccaacggattgccatgaatttagaactggactatgtgaatttagaactggactatgtgaatttagaactggacatggagttttatatttttcctcaaaataactgtctttcttcccaggaaccacaaaataaatttggaatacagtgactgctaaagaataagaatataatctctacaaaaacacgtcaaataattactcaaacaaaaactctctccatttacataatttcttaaatagaaggaatatgtaacatacaaactgaaaataaatgaaaaataaaagtgttacaaacttaagcaaatggtattatgtcttcaacatacctatgaagcttaataaaaatatttaaaatcattctttgaaaaaggattcctagtgccaaaaaataaaaagtagaacacatttcaaacacaggcatattctaacaaaataacagaaggtattgtcaggcagggaataaaggcatgctaattttatctgcttaaatgaagggactcaatggagcctgactctatttattgactctgatacttattgacaattataaaaaacaattcaattatgtttaaaatttaatattaagtacttacagaattaaaatatagtgtatgacattaatcaggagaaaaacttaaaatttcagcaaaaacaacaaaagaaagaaatactatatacattgtaggggtgggctgcgagctaatacagcatttgaatgcaagtccaaatatgtaaattaaaaataaggttaaacttttctattaaaggaaaagattctcagaatcaaaaataaccaaataaagcttactctgtcatacacaagctatatctctatatcaaatgccagaatttaaaaataaaaggatgggctatgtgaatgcaaagcacatgattgttttatattcataaatggtgaaacccacaaagaacatacaataataggaaactaaggtgaaaatatagcatttaaaatattaaaatattcaatgttaatgaaaattgttatacccctctaacgaacaagagaaaatatcacttctttttttttgagacggagtctcgctctatcacccaggctggagtgcagtggcgtgatcttggctcactgcaagctccgcctcccgggttcatgccattctcctgcctcagcctccctagtacctccaactataggcgcctgccaccacggccggctaactttttgtatttttagtagagacggggtttcaccgtgttagccaggatggtctcaatctcctgacctcgtgatccacccacctcggcttccaaaagtgctgggattgcaggctgcacaaataccacttctatttaaaaacatttaagaaacttttagtgactattttccaaaaatgtcatattgagtgaagtgaagtaaattcagttcatcttttaagaggatgtgaaagtgttactttagagtattcaggaagttggactgtgaaatgcaattatattttatgttattagggcaacagatgtattagttttcttttatgcgtatctagcatgaaaatatcaagcacaattattatatacaataatgcttaatttgatatgaatcagtgctattgcatcacacttataaaggaaagattatgttgtataattaagtataagcagaatctccctctgcatggcaccattaaccagcatcttgagtattacacttgttttagagaagctcaaataaagaacaaaggttttcagaggaaaacaatgaagaaaggtttcgggatttttttctgtgtattataaggagattaggagtcatatgtctccaaacatttgaaattggatcaatttaagcttgtctgagttgtaagtaatgactgaaatctaaatattagaaagaaaatctgtatatatcctaaggaaatactcttaaatacgtgaaatgatagtgattacaattacaccaattgaggcattggttatgatagcaaaaaacaaaacaaacaaaaaaagccctgtataaaaatttaatgattagctctagagcattagataaccaaattaccatattattgtgatactgaagtcacttaaataatgtgtagtataatacaagattatgcaaaacatttgcatattattttaaatgaacaaagttacaaactaggaatatacactacaatctcatttttaaataaaaatatagacatatagaataagattaaatgaacacacttcaaaatgttattgacttatttctaggtggtaggatttcaagtgattctatttgcttttgttctatgtatatgtatttcctgaattctgtacactaaaaatcctttagtagttaactcttactgagttcttactctatatatggcattgttctaagcaagtgctttatatgtcttaatttgtaaacacttcaacagccctgtaaaagagccatttctacattcatttttttttttttcgccagctgagaaaacggaagcccggagcttaaatgacttgcctaggtttcctgagtagaaactgacagagcctagatgtgaaccttagaagtttggcaccagaaccagcacactccaagcactccacaaataagaactgtattatctttcataattttcaaagaaccttaataataatgataaaaataaaggaagatatttgattaattttaagtttgccacacttgccattcatcacaaagatcagttctatctttatttctacaaatttacaaattttatttctacaaaattacaggaaacaatactggccaatattcctcagcagtgtttgaatagagcttttcctgaagacatgagtgtcttctaaacttttaattttgtgactttaacaaaaacaaaatatcacatgttgttgttgtcctcaggagcactaagaaatttcctgcctgagaagtaaatgactgaggggaaaaaattatagaccattatggcatgctaataatccaaattagataaacaaacacaagcaatggaaaggaagaaagagcaaatgcattcagcagagaatggtgataaaaaataatggacagctcattctccacagctaaaattgcacaagctgagctgtctaagggaaatgagtcatctgtttctcaagttataagggaatcttacagaatattttgagtttgaatagctaacaccgcaggcaattgaaataggtctccaaatatctgattaaagtcatgcatgattacagctggtatagaatatttttgtacctttcttgcaaatggtaaaatgtaggttaaatctctaattttctctgttacttaacttctaaagtaggtattaattaaagaaataaattaagatatgcttaactaaattcttagatatgaaaatgaagtatgaaactttttattagtacattattcacttttacaatgcttcttaatgaactatttggtcctttgattcaacagtccttttatctcatatgaattctttaaaacaaatggattttctggagtagaatccggttttaaatatctaaaatatcagcctcagaatgccagagtgactgaatagaaggaaaaatgagaagaagaagaatataaagggtgctgtgcaatcatgacagataaaaacacaggagatcacagtaaaaataaaactaccaatagtgtcatctatagaattcggtcacctattttttccaacttaatttgatcgagcaaattgcctacaaaaaaaccatccagcaaggtgatttttgtacttcattgcttataactataactccaccatctgttctataaatgatatattaaaaatcaaatcaatggtgatttttaaaacacatgtcctttttaagaatatgatatattatctcccatgattccttaccaatttgctacttcacagaaaaaaatgaattgtcctctggtttcttaaattgtctatgtaataaaacacagtaacacatactatgaaaagctgagggtaaaacagaactttaggatctttcataagttaaatatgtcataatattttgtcatttcacaaagcaatgatgctcaaggagatattatttgaagaacagatagccataatctctattaatacaaaaatatatagggaaggacattttcatttagacttttatacactatgataagtttctaacaatttataattttggaacataaattatcattgtctaattaccatatatatatatatatatgtcacttctgttgccctttatttaatactcttattcaaataagtaagtggaaagtattgcttatgatgaggtcagattaggattctccttatttttatgttagtgtaatatgtcacttcattctttattcctttcaccaactatatgtattaaatctcctagatgcacatagtgcatgtaaggtcaaggtcaaataaaggtaaaacacatgaatggcatacagcatcacggaaattcaagaaaatatagttataatttaaatatgcaggtgcattcggacctcccctatgtagtcttttcaaatctctacataatcataacattttacagaaagtttctgtcccgaagtccaaatatgatatttaaccctagtcctccaaactcagcaaataccaggccaacttttgaaatttctaccttggctaatggtgacagtagcaaagaaaaaaaaaaaaagaaactgggctctaggctctaaacaaatatatgtgaaagttttctatcaattataatgcactatacatgaggattttctgtctacatttgtctacatgtttgtgtttgtgtttaattcaggaaaaccaggactgtaaaaaagaaaatgcttaaagcttgcatctttgaaccaggcagaaagtgcagcaaaccaacatgacacatgtatacctatgtatcaaacctgcatgttgtgcacatgtaccctagagtttaaagtatagaaaaaaaaaaagacataccagagactgtgcaatttacaaaaaaaaaaaaaaagaaagaaagaaaaagaaagtgcagctacctgatgcctgaaggaaaccaaatgaaagaatgtggaaattaagccattcaagcattcaaggaccagcactaggaaatttcaagtagctattacctagatttaaaaaatcagaaatccttacattaaaaactaatcatttgaattctgttttaatttactttctattttctcttaggtgggataatcatacctgattagtgctattataacataacagtgcttattatgtgccagacctaaggagtcacatacataagagttattatttactgttattactaatattagtatatattactttcatcctcattttataaatgaggaaactgaggactagacagttgaagtaacctcctcaacatcacagagctggtagttttccaaaattcagttttcccatctttaaactgaagaataaaacataataacatggaatctattacagtaattcttattgtattaatgatgatgttatccaaattgtacaagtggagtgtagccattgagcaatgaacactgcatttttatcagtgatttccattgttaaactgctttgtataatgccaactatttttcgtcttactcaaattcaactgatctgatgctcatatagcaactttctgaatacaatttgactcccaatagattttcttcttcaaggatgatgatttctcaggttaaatcaacaacatatttataatgatgatgtgttaccccatgaagctgaaacacaggcaaaaaatgatgttcgtcacaattcaaatactcatacacattttcctcattataatttagtaagctggcacactggaagctactttagcaagacttattcagatgtatttccctcagggatacttcaccaatttattattgaaaatcaattggctgtcaatatccaaacccctttgtatcatgacatcacttctaggcagaagtctcccctgatacccagggagcccattctgagtaatggttgcacagaagggcatcctagcacttgggcatgtgtcaagttgtttctcttgttttactgtagcattctgtaggtctccctcctgcactaaacattatgagggcaggaactgtcctctatgtataaatgtctgttgcataacccagtgcttgttctatcatagtttattatatggtaatatcagtttcctgaattaacgctcaatatcaatgtactgaattaattattgatttatatttaaatcaatccttcagaaacttctatgctgttagttcagttatgcacagtcttaagcatatcttcattcaataaactctctgggtattgtcatactaagtttctgaagcaggtgaactgctctgataaaaacaattaagcttgtgttgccaaatgtgggcttacttgataaacatcagtctttatgatattgctgagcacaaccttaaggctgattttgttcctaaccaagtgtgatacatattacactacatgtggcctagagtctataactagaatattacccaaatgaagattttcagtaaatctattaaaccatatgaataaattaacagctacagtttatttaaaatttagtattttccaaaatgttttacacatcatcttcaattatcttcagactaacacttttactaggaagtagacatgaaggacatgatcagataacaagagatcatcagataatgcacagaagtcaagtgacttgtctaagattgcgtagttaacataaatagtgttctcccactttccagtattgttttgctttacaaaactatactcagacaattaaaagaaaatgttataataaaccagtccatgtggaggcaaatctgtctcatccttgcaaaaaatacttatggccaaaaaagaatctcatataagaaaaaaaatgaaaagacatttcttataggaacagaattaaaatattgctttgtctcatcttcctgtctgttgctcacacatttgactgctgattatattgttaactcttcagaataaaaaggaaataccaattcaccatttctattatccagaaaatatatacataaaaagaaaacattcatattatttaattgtttgcctttttttcttgatttttcaagcctctatgcaaataaattttggagcaaagacagagatgtgcaagattctctgataaatttagaaacacaagagatttctgcaaaggaattcatgaaaatatctgtatttgcagatttttttacagatgttgagactttaataagcagcatctttaatatcatacatcaatttccaaaagtttatttagcttactgcatattctcaatctgatactcaatagtagctaaaaataacatataatacatttatgtaatacatggttatagttcaaagagccatccactacactgggaagaagctcaggtgccccaacactcctaccatgggagcagagagagttctattcagtatcaaatgcccccagtttaagattctgaacactagcatgtagaaaggcttttgtgtcagaaaacattttatcacattcaggaagagtttaaaatcaacttagatagcacattgctgatacgtgaaaagtttgaaaattctactgaatacttctcttccttagttttgaaagctggtattagtgaagtaagttgaaactcttggttcagccttccaaaccactcccataccccctgcttatgtacattcaagaccagccaaatacaaacaaaagagggtacagggtcaggagattcttgtgcccatcatgagcagggtgagatgtccatggccacagaacgaaaagtttattaagagaaggaggagcactggccaagcctaggagatgcaaatccaacgcagtttatgcttcccaacagagaacccatgaatgctttatgggtatgacaagaccttgatcccatcagctaagcccatcacctcagcctcctgcatatctcaggggccaggtgattctattatagtctctgagtgtcaggatgtgaaggaggtgggaaagctgtgttctactgtttgcttccccttcccaacctccactgaggtctgtcctcattgccaggcacttgttcggttcagagaagaattgtatacgtgtgttctcgaaagttcatagtggtaggcaggcttctggcgacctgagatagctcagcagtggcctcgggagtcacagagaacgtgttgttggccatggtgctctgtgtcaagctggtcctggaactgctatgacaggtgacggtagtgctgccagaggccctaagcccaggcacaggtccctgcagatttctggatgcaagtagggacaaagaacagactactggagtttttgtcactttagaagaaaaaacatatttatgagatttgtctcattcaaaaaaaaatggccttaaatcaactttggtagaagacaaacttaagaacaaattattagaaattcacaaactggaaatctttaataaagcactagaaagccccaactctttacttgggcttatattaaagactctcagaaaaggaccaaaaaaaatctaaatgtttagaacaatttaggttggtagcttaaagacagaatgtttcagtttttaggagattcatcgaaacacaattcacgtagctgcaaccaaaacagccttcgaaatacatcagaacaatgaagaacaacttcagacagcattgaaagacacttcggataaaaattccaatcttcagggaaacacagagctgctttcacaagaagctgaagagtggaaaagggaagagggagcaaacatactaagcagaataaaatgctagaaaattctaaaatgtgtaggaaacaagttctaaaatatgacaagtctgatcaagcttctgtgtgaacacaagttaaaggtgagagactgggctactgttcttggagacgacgacatggatgctaagaacttggatataaaaatgcaacagaaacggagacatcttagaagatgaatcaaaattttgaagaatcttactaatggagctgagttatttagaaaatcttgattcaaaaaacatgaatgctcactaaattaactgaaagaggggaggtcatattaaaagtctgcaaactgggaaagcttcaccgcactcagaaacaaactaacaggaaaacgcacacagaaaggagaggcaaaattgctggtggaaatttcaagtccttcttgaactgaatcaaagaaatgaaatatattttcacaaaatatcctatttagactgtgtttaccccataaagatagaggagaatcttcccaagggaggtgaaaagatcagtcatgcatgtgaagagatggacacctataaaatataagcctaaaagtttttagaaaaaaaaaggtcattggcctattatcaaagccagattattttcaatgagcaaaatactcaaataacaggttgacagttctgttgtgtgagtgaaaccttaatcatgtaagaaaacaaaatgcctgcacataagacaaattattaacaatttacatgtttcaaaaaatatcctaatatccttgatattccaagtgaaacatttagcagagacttctgaggaccaccagggcacactctggctaaccagatctctgatgaaggaggagtatcaagttgtgaaggtgtgcaaatgcaaggcctcatgcgtgatatggaccggatgccacccactacccagcccaggctcaggactgcataagcagggtccttccaacagaccactccctcctgacataggaggtcctccataagcgcaaaactgagtttctcctggtatctctggcattggcagatgctgcagacctcctttgggctcaactctcccactgatgtggagtttctggttcaggttctggtgctctgaatctatcctatcattcattctgttaaacggcagctattacaaagggatccccagtagcaggtactgagaagaggatcctctccccaacctcctattctataaagatgaacctctccaagaaccctatttcccagaaacttgccttgcccagtacatcttcccctgacaacaagaagggtctcaataccagcactggattttgtcttcagaccccatagcctgaaaaatagaagtgagtcaatttcctagctatcatggagtatatgtcttaaaagacatacactgaaaatagcctaaacatagaagtgagtcaatttcctagctatcatggagtatatatcttcctccatgtttcctggcatacaactcctaaaatccttggaatctccaaagtgctttctttttgtatattaatgttgactgatagcatcaggataaggctggttaccaaaaagaccaagccatgattaaaggattggaactttgagccccatcccccaacttccaaggatgggaaaaggagctgaaggacaagctgattaccaatggccatggtttaatcagtcacgcctatgtaatgaagcctccataaaaacccaaaacgagaggattcagagagcttctacatagctgaccacatacagtttcatggagggtggtgttcccgagggcatggaagctccacaccccttcttccgtagctcaccctatgcatctcttcatctgtatcctttgtaatatcatttacaagaaacaggcaagtgtaaacaagtgtttctctgagtcctgtgagctgcttcaacaaattagtcaaacccaaagaggtggtcatgggaatctcaatttgaagctagctggtctgaagttctggagacccgacttgatactagtgtctgaaaggggtgcagtctcgaggcctgagccttcagcttgtgcaatctaacactatctccaggtaaataatgttagtctgactaggaagagactcaactggtgtctactgcttggtgtatggggcttcttggtcaaacaagtcttctgtgtgaatgattgctgtgttgtatgagagcagaggaaaaacaaatgttggtttgggagtttttctgaaacataagttgatcctcttccaatgagtctgtttctaaagattcagaattatagcaaaatgcttttctcgtctctttacttaaggaattttaacttcttcccttttatttcttctgctattaagtgattatacagtggctcaaatggaagcttgataggactggaatctgtaagataatattttataactttagattattatttatatatgaagtgcataactaaattgcttcaatcttatttgatttgtaggccacgaattcaagtgtttttgttaagtctgctaaaataatccagaaacacaacaagtgtcttcaaaattatgattttttgttttattgtgttatggctatttaagtaattaggaaaccttgataggattacaattctaggatagtgttttaataaatgcagcttatttaaaagtgaatttcatgaataaattgcttcctttcttctacttccagatattataaagatagtacatctgtttttcctgtttgactagtcccattaacattggctgtaatcagaattttgtcagggaaatcttcagttaagatgcttgaaactcaaactttatttctgtataccaaagactaaatttaatcaagttatgatactaatatatttaccaaaataaactggtttaaaaaaaatgaaactacgtaaacatacaagcctttggggaaaaaataggcattactacctagtacttcattcaattaagtattatcaaatctttgctactgtcaaaacaattttaatagtagtcataatatatgcttaatgaatatatacatgaaatctttaatcccaaatgcagaatgtgtttgacaaatattatgtagcagtagtacttaattttgattcagcataacatgtcatgttacagttctatgaatttacaattcatagaacttaatttaactactacttaattttactcggttttcaaatttttactcaactttttctcctctgttatttctagtggtaatttttgataatttccctcctttttgaatcatttccttctttgttcttaaaaataagtgatttttctgtgttatgttttattcttcagctttaagatttctgtctgtttgcctattacacaaataactctaagcaatactctttttaaatataaaatatgtaagcttaaaaaaaagaatctctatggtatgattgtgttgtctagcaacaccattcaccacccttttcaataaagagcagcgtatggcagatgcatctgaaagcaataactaatatttatttggagttctgagctaaggaatccaggaatgatcaacctggagattcattccttatctataaagaacatctgaacctggcccctcatggggaacatgggctgtacaggggatcaaggccctttgtttcgggttaaaagttgtcagatggaggatgctaaggggagaacgctaagtgaaaatgctatataaactgcatgttttttacaagcggtagcagttctcctgtacagcccaccaccactggaccaccctatatgtaagttctcttggtaaaccctatgtgtccttcactagctccaggtctcttctttggtctcttgaacatggtgctatcactactgaagtcaacaggctccagcaagacaagcaacgacaaggattcctttctctaagtctctttagtatactagtatgcaaaacctttcttttactcattatttaataatagtaaaaataaaaataaatactcacgtatttactcattataaatgtaaacaaagatataaatgacaaagatatgttccactatgaatataaatatttgtaacaatttaataatttttcctcagattttcataaatatgggagatagaaattctaaatattaggctgggtgtggtggctcattatgaatataaatatttgtaaccatttgatatttttccatatttttctctgatagatcaaacgagatacctcagattttcataagtatgggagataaaaattctaaatattaggctgggtgcggtggctcacggctataatcccagcactttgggaggccaaggcaggccgatcacttgagtccaagagtttgagaacagtctgggcagcataacgaaaccctgtctctactaaaaatacaaaaattagctgggtgtggtgatgcactcctatagtcccagctaccccagaggctgagatgggaggatcacttgagcccaagaacaagaccctgtctctacacagataaataaaattctaaacattttttgagatcacatttaaacatatcttacttactacgggaaaacaattacaaagagatgcaaaccatatttgtactaaaaagtataaaagagaaaaacataaaattagcttactgtgggacataaggtattaaggtattatgaaattttctaaaacaaatgaaataaaacatatctatagtggaaaccaacacatagcagagaattatgcacaaagtaaaaaattaaatacacaaattccagtaaatatgaggcacctgagtactggacaaatctttaagttaaaaataaaatataaccagtgacattctcagtgcacaacgacattccatacaaatgacaaaccagaaactgaaatttgcaactgaaataatagatacaaagtcagttaacagaaaatggctaaaactatttctaacctaaaatactgaaaacaaaagccatataaaaacaactctagtaattaaaaaaatcacattatatgaaacattggaaagcattactctaaagatatttaatacacaaagaaaatgttttgtcctctcaaacgataaaaagctacagggtaaaaaaaaaggagggacttaaaaaagagatcaggacaacattttttaaggtttatatatcttttgagataaaatctagctaaataagatgaggatgggatgagagaaaggcacttatagaaaactaaaatgcaataatagaaacataaatcctttgtaagcattagaaaatagaactgacgttacagacagaaagacaatttactagtatcacagatcaatttgagatcatttctcaaaatacaccgcaaaaaatagacataaaataaattaagggaaaatgataactattttgtactagtaaaagaaattcaatacatggatagtggatatcttaaaagaataaaacataacaaatgatgcagaaacagtaagctgagtatagcaaaagaagatgctccttaactcaggaagaaaaaaagactttgtatcattgtaaagacttaccaagttttacacaaaagtagtgggaaaatgtcattttgagatataacttcaatgaattttaaacaaaaaaaaataactgtaaaataaaagggtgataaattcaaccaaattaaaaataagaacatttattcatcaaaatttaaaaagagtgaaaagatatgccacaaactgagggaagatatttgcaacacataaaggtaaaaattatataatttgttatataaagtgctcttcaatatcaataataaaaagacaatataacaacaaaaaaatggacataagacatggagttatggcacacaagagaaacatgcaaagccctaagcataaaacgatgttcaaactcattagattcatcccttactagtaatttgggaaaagtcaaattatgaatgtattgagatataattttacaccccaacgtgaaccaaaatttagaggatgacaatactaattgttggagacaatgcggaaagggattaagattatttctaaaatgttgctgtggaagtataaatagcataaacaatttgacattctgctacaatgttctacatttgcagcctctatgaccccctacactctaaagactcttttccacatatgtaccaggagaaatgtataaatgtaaataaaacaaagatgtcataaagtaagaaatgcaaaacaatgaaaatattcatgaatagaagtgtagatcctaaaatccttactattatttaatcactgacttagaaaattagaacaatctcagtttaaacatagttaataaggtcttaaagataaccactattattttttaaaggggaattttcctcctaaatcactacagaagacaataaaatataccagagtatatgtacgataaaacagaaaacagtaaaaagatttaaaaacaaactcataaaagcatttaacacttgatagaaacaaatttatcatttattactatgagtttaaatggtttccagtcatcaataatagactacatttttcacctggaattatatttaaattcaaacatacactaaggagaaacaagccagacacaagctgagaaatccaattaaagagaaaagcatagagaaaaaatatattaaataagcaaaaagaaaagccacaataatatactacccaagtatgacaaaagatacctctttggagactatccaacctaaattccctgaccagtcaacaactcttacttctccctattttatattcaccagtatctaaaattttgtctatttgtttatttctttattgttcatcttccttatctacactgtgcacactgtgtgatatgacttgttcaaacagagacctgacagtattgtttaaacaatgtaactcaaaaactcaaattaattggtatatgtcaaacataatatcccacagttaggggatatactttactctcaataaacattagaacattaaaaaataatgacctaatattatatcaaattaaaaacattttatagtcaattcaaaaaaggcaattattctatactttctcactaccatgtaagtgaatgagaaaatgataacaaatatagcaacaggaaaaacatgcccatttggacaaaatcatcacatcaatctcgaatatctactaggcaaaactgtaatacgaaaaatacttttcaaaaaataaaatgagaaaatgtttatacccaagacctatccaagctgtaatcattatttttttaatcttagtgatatattttactcaagaagttatgactgttaaagcaagaaatgataatagtgaaatataataataatgatattaatcattaggataaaatgtgatatggtatgcattgagggcatccagcagaggaacatgacctaggccacagattcagaggttaccctcccctttctttgataaagaaatgccatatgatcatcagaatatgaaaaaattacacacacataacagcatttatatctataaagtaaaggtctgaaaaagggaagggaaacagcagttactatttgggagattataaattggtaatgcctttctagagaataatttgtcagcattcactgtttaaaccaacaattccacttctaggaagctatattagagaaccatgcagatatatacataagaagatatatacagagaggtttacggtcacatgatttgcaatggtaaagactcagaagtagtaaatgtccttagaaaaagatgattaaatatataattacatatgtatattatagaatattatgcattcattaaaattaatggaatagatcaatatgtactgcccacaaatcagttaaattctgccttgtatgtaacaactagcagaagacttttctagaagtctttatacgatgaacaattcattataacgctaagttacaatgtgatatataattatatataatattggagagcaaccaattttaaaaaacccttcaaactagaataaaaataaaataattaatgcatgtaacacagtaatatagatctgtccagaggcaacttatctctagagtcttaataaagcatgaaggtgacattggactaaagctaatttatataaaaccctggaatacagaccagcctaatttggcaagagcactcactgatttcgtgtgaaagggagattctagagtcaataaatatttttaagcacacaataaaatgccaggaacttagtaggtaaaggaacttatatccttgggaaaaaagacaagtaaacgagcaatattaatacaatataagtaagttttaaaactgtataatgtgattatttataagtgtctgttgtctgtctttccgtgactagaatgagagtcccatgaagcaaaacttttggtctgttttgttattttccaaatgttaaggcagtgctaggcacttaataagccctcaacagagattgattaattgaaagaaaaaaggacaaagaaaagcagaagcgggcagagtgggctatattagagggaggctcagggggctgggggcctgggaaagattcattttccagaaggtatgaaatcttagttgaagcctgaaggtcaagattggattcagtaaacatatttgaatggtgattgttttcaggcctgagtcaaagagatgactctaggccactaaggagtggaattgatttggaagaaaggaagttacatctgaaagaagtctagtaggcatctctctcttttttctctctctctcccctcctccccccacacctctgtagataataaatcttgataagagaaagcttaagacagatgttagataaaaactgaggccaaggaagagatgggcagaaggaatactgaatagtgaggatggcgactcgagaagctgttctaagaagaaaaatacttcgagaaggaaggtatccacagtgccaaattatacgaagttctggtaaggaaacacatggaaatatgttcaccagatttattaatagtaacaaagaggtcatttgaaactttcataacagcagtttcaccggtgcagaggaggtgaaagccacattatggtggctttaagagtaagatatgagagcctggcatttctagagaatggatagtgtttttgaagcctgattctaggtgagggcaagagatttatttagctggttatatctgtgaatgcttctagttgtaataacatactttcacttttttttttgaagtaacaaacctaggctatgtgtttgtagaggaggaaatattgctgcagaaggagagggaaaaaatgtctactgccttgtatgtgtctgcttcttccataggctttgggacattctcaccagggggtttgagaatcaaacagtataagacaacttacacaacaagttggtcaggtaaagacttgtctgcctattatttggattttataggaaatttaaaataaacagctctaacaagcagagtaagcttgttgactgaaccatatgagatgcatttaatttttctcaccacaggtgttctcaagcttctatatactctgtgcttgtggttgttctaagataatatttctgaaaatatggaaatatctctggggatatttgaaaataatttatttcaaagaatatggaatgttaagacctaaaatccatgatttattcaatactgggtattcattcatttatgtgatggaaaagttaccatagactttccatctacattttcttattgcatcttgttctgttccttcaagccatcctccttcaccctctgattaaccacacagttccattcttctcacaatatataggcagtaaatttttttctaaaaataacagtaaatgtgtgtgtttaacagtataagaggtagatctcaaatgagcgtaaagatcaataacaattatgtgccaattatactatgaatatgtaattggcagaactgtatgggcagaccatgaagactgagcaacagcaattctgatcgaaccatgccctaaatgtctctgcctaaaaccccaggtttttaaaagaagcctaatacaaacaagtacctaaatgaattgaaaatatcaacactggcatatatttgaaattaatatatacaatacaacttctattttttcattattcattgaactattgagctataagtggttatatacacataggtgaaacaaagaagactaagacacaattccctaccctctagtaactcaaattatctttgaattaagaagagtttactatattgtgaggttttctctaatttgataatagaagagatggaaatgcatgcagttacatggccacagacagataacttccttacttagcattgggataaatcctcaaaaactaattccaaaagtatatctaaaataaacctctattttccattcattctcctaaccaccttgccatagactttgaagtggaagactttcggttcagttgagagatgccacaggacggctcgtgcagagcaattactcatgtggtggctaagcatggcttccacaagacagcttctttactggccttctgttaatgagttagaggtatgacaacagatactgatggatgtgtttaaagaagcaaatgaatttgaaaaaccaaactttaaatgtgaacttcaatttttatattgtgtgactgtattttttatatcattgattagatttgagatagtagcatagtttagtctctggaatctttgtttcattcatttaagtagccacgaggtgccaggtattgttgtagaccctgaagttacagttgtgaacaaaactgactaagctactgctctcaggaaacttgaaccctagagacggaaagaggcattaggcaaaacagtaaagatagagatgataataaattctgtagagaaaataaaatgtagtcaggagtaataaataaaatgtggttaggagtaataaggaatgctggatgatgaatgttacatatgatgttgcgtgttaggaaaattcacactgagtagctagcatgtgatgaaagtaaggaagtgcagtatgtatataaaacaacataaagaaaaggtagtgcaaatgccttgaggcagaaggccgcaggaagtgttcatgaaaaatcaaggaagccagaagacagtgactaggagcctgggaaaacaagcagcaggagatgaggataggggcttgtaggctataataggaccaggttttattctgagtgacacaggaagacaatggaaaacataatctattttaggtttcaaaataataatacagttgcattttttttaatgtctgaggacaaggggagaggcagagacatcagataggagaatattagagttcaatactgtcattagacatggataacagagggtcactttagagaacctccatatctcaaacataaacacaataaatttattaaacgagtgcctgcttctgtcagtctgatattggtattaagagctcacgtagttctaaactctgtcctaactctggacctcagttctcataaccaaccgttcagtctgcagtgaacactcctctacatcttctgtcttatgtactcaaaaaaggaagaaccatatgaataattgtgggttatgccactgttgatacgagaagaaaactgctttgaaatgaaggaaagatttgagttgtagaagcctttaggtaaatgaaaaagcaaaattaactactcaacaaaacactaacaaaccaaactcaacagcacattaaaaggaccattcaccataatcaagcattatttacccccaggatgcaaggatggttcaacatacacaaatcaataagtgtgatataccacattaatagaataaaggacaaaaaccataggatcatctcaattgatgcaggaaaaaacattggacaaaactgaatatcctttcattatacaaatactgtaatcattaggtgtagaaaaaatgtacgtgaacacaataaaagccatgtatcacaagctcacaacgaacatcatattcaatggtgaagagctgaaagcttttcctctaagatcaggaacgagacaaggatacccacttttaccatttctattttacatagtactgaaagtcttagccagagcaattaggcaagagaaagaaataaaaggcatccaaaacgtaaaggaaaaggttcagttgtgtgtttgcaggtgacatggtcttatgtatagaaaacccgaaagccaacaccaaaaatagttcaaactaataaacaaattctgtaaatttacaaaatacaaaatcaacatactaaattcagtaacatatctacacattaacaataaaccacccaaaaaaaaaagaaatcaagaaaacaatcccatttacaagtagctaaaaaatatataattaagaacaaatgtttccaaggagttaaactatttatatcatgaaaaccataaatctttgaagaaaacaattgaagaagagaaacaaaaagtgtaaaagttgtcagaatctaaatggagtcaacggcattaaataccttgacaaatggggccacagtaggccataaaggaagggttctcacatacactcttgataacatactatcttgataacaagaactatcacaaaagacttcaaatgatatctgtaatttattactaaaagataaaatattattcgaagaaatcaaagctaaatgattaatcatctgaattaccaattaccagtcattaccaatatttaggtaaaactaaaatattaataataaaaagtactacttagtgagcatttaccatgtgctaaactttgtattatacccttttaaaattcctcagttcatttaactctcaaaataatgtagttagattaccataattatcaagatttctatttaacagtgaaagaaactagagctagctagttaaggtgaagaatcacacccaagatcaagttagtaaatgtagagacgatttcagtttgggcatgtgtctctgagtcagagctgattatattataccctactgcctcacacaacttaatcgtaattttaacatatcccataaaaataaaacacctctatctaggtcattaaaacttgacatataccactgtgctccttaggattttttggttgtctatatctcaaacatgatttacatagtttaagccaataaaaagagtctatccaagagtatctcacaaaacacaaagttgcaaaactctccctacacaaagccatgagaaacctgcgcagcttctttttctatgactgcctctatcttctctctcctcagcctggccttttctgattttcagtacatgttgcaagtggaaaatggccaccctgcagcaccaagctttcattttattcctgctcaaacagcccagaatgaaaaagaatctcttgtcatagatatctaggagagaatctgatttccccagcctcggtcagttctctccatcagattcaagtggccagaatgagggccagagttaggtggtacaaagaaagcttcaagggtctatgccaataaacttgtggatttgtgtggtaggtaccttcagaagtatacatcacagtcaaatttatccagaatttgtgataaatattcctatcttctaggaaagaatcctataaataagaaatataataaacaaaggaaacaatccaaagaggctgtatgtgagggggtcagaatgtcaccgcaaaatatgtcaccttggtataaggaccattttgagctgaaagcacttaagaaacaacaaactgcagaaagagctctttgctctttgctctctccctatctgcctaaaagcagacataaatttccttttgtgaaggtgttcccctcccttcttccataccaggaggagaacaatcctttatcactggatacagaaagttggcaccaagatggatttgcacaaacaaaccttgctaaaatagcccttatcttccattggtatccctcatatatttatcttcccacaatttatcacccctagaatcccaaaccccttttcctttgtgttatcacttctgcacgatttatctccctttattaaaatggtatgtaagcccctgggtttaactccttctttctgtcttcatttctttcatgtgaaggtcttgtgcacatataaattaaaatatgaacatcaaatacaatgtgtatgcatgttttcctgtcaatctgtcttctgtcagattaattcacatgccccagccactgaacataagaggttaaaggaaaaggtttttcttcccctacatacattacacataaatgtagtatatacagttattgatatttggagctccatattcaaatattgatgttggaattttaactactgattcaatttgcaaatgctgaatagatattaacatttttaggataaatcacatgaaatattctggggaataggttagtaaaatctaaatagatattagaaatttgaaagaaaagagaaaataaaatattccattctgtctcactaatgactactgaatcaaagcatgaccatgcaaatagggtataacacattttttttgtaattaaagcaacttcaagataggtaacattaaaaatatcctggcttaatgaaaacaaaaatatgaaatgcagttaggatgtgtggatctttatcgtgttatataaaaatacaaatatttcaaaattcataaacttcaataacggagagctatgacagcagagttccacatttttgttcatattcattttaagtgcatgactgcaggaaggcgtttctcatgctatttctctgtggtccctgatattcaaagtagtacatgcaatattaatgatctcacttttgtgagtatacagcatacaccacattcccacctaaagaaaagctcctcaattcctaatcatttcaataggctctaatgtaatatttcctacattggaaatcacagcactttatttaaggaaatcagtttggccaagtgagctctatggagtgcagcctgcacagacgtcagttcaaaggatcagatgtcaaagtgctccctctaatgtcctttaatcatcactccgattagtgcatgaataggactgtgattaaaaacgctgctgccattgtctacctattcaggcctctagcattttacgtgggttccaccgattagtgtttgaataggggaacgattagaaagacagctgccattgtatgcccattcgggaaaacagcaaaactcacatatttatttgctatgagcaccaaataaatgttttgcaaaggtaaaatataccattagactctaaagacaattttgctgatttcttttgttcagagcactgtattttcccatatgcaaagatgtttcttatttgcaaatacagtaatatgcttcattaatatcttttaaaatatacatattttgttttcatagaaatagtcttaacacacatctgctttattatatactacttattgacctataatacatcatacaattccagtttaatatttatgattatgcaaagattttctgtgtaaacaaattcaatctatttggttccagatcttttggatcccttctcaatattcttggactaatacgtagtctataagaacaacttcttctcccaagagaaatttccttgtcagacacggagaataaatatttcactcttgggccattctaagagagggaacacatttcaggttagcagttagtagccctgcaggagctcacacaagagagcttcggccagagtggaattccccacgacaatacaaacctctatcctatgataaaaattctccaagaccaaggcatcatgttgaggctttttggagaagggagaaatacaggcaaaaaaaaaaaaaaatcacagaaaaagaatccatccatatgcaaatataagacagtgctcaaaaaaatttttgtggctgtttctctctctcttctttctgtttctgtagaaatatgctactaggaaatttctgggcaatagaggaaatattctgtcttccattaccatcctcagtatcttgctgctcagtacttctccatggtttttccatatacattgttctctatccactatcatgatgtgcttccatatgtagtaacagaaacctcggagcatcccccttataaatgctgataatgataagcaataatacttacataaggttatatatatgccaaccacgattttaagaatactatgcacattgactcatttactctatcaggtagatattattctcttaatttagagatgaggaaatggagacagtaatggaatcagaaatttactcaaggtcatactctagtaaatggcaaaaccaataattggagctaagcagattatccctagagcttactctcttaaccaaactctctactgacaactgagctctttgggttccactgcctgccctcataaaaacccaacctcaaagataaggaagctgtgaagggaaaatttttcttcttttgcaaataaagctaattgaaacataccttacacaggggaaagttttttccagttcagtttaaaccctgagtagataactatattccattaaccataaagttgtttaaaaaaatagagcaccctgcttaaccattattaaaatttcaaaccagtgaagaacaaaataaaagtaacaaggctgatggctgacaattacaaacgagtttaatttgtgtgtcacatggatgtggagaaagttgcaatcagtctgaaataaataattaaagcaaagcatttttgtaacagcctcaggaaattaagagttaacacttttcttctttttagtcaattatcatcttattacatatttctgcctggagaataaatctctgacaacactggtccatgtgtggaatgaagcactaggaaaaaacatacttttaaagagggatactaatatatatcaaaactctaaattacagcatatcacaaacaaagaatgtgcctttttaacatataacatgcacttctcaatgaaataaccagactatagaacttttcgagaaaaaaatatttatcatcatcatcattgtcactactctgtggagaggtcctcagcatcatctcttggtacttttcttcatgctccagtctacgacttcagccatgcagtactgacaccgtttcaatcccttaacttcaatcagtatgctcccccatcttcggactttcagatacaagttttctactctcgtgaaattcctctttttccttccttccttccctccttcatctttattttcagtttaaattctggttcctcagggaggccaaccttgaattctgagaccaggctacagtacttcagctgtaactcccatggaaggctgtactgacgaaacttgatcgtgaaatgaggttaacacctgtgcaaatgcccacttagctgtctgggcaaaaaccgttttgtccctttcccatgacttatcacagtggctggaacatgttagatcttccattaatatttagtaattaataaatatgtacaatttagattcaaatatttatactatataagtttcaaagtgaaataatttatatgtagtggtgttacagaaatactgaaaagtgtgatgcaataaattaattctttaagggggttcattactccagaaggtaacttatttccagcaattgaattaatgcccaaaaatattcaggagataatactcacagttcatacttcatatatatatataaacaacggaaaccaatcaatagcttcatattttacttgctgtttcagggtatactttgtattcttacagaaatctaggtgtatgttagtagataaaacttacataaaaattcttcaaaagaatatcaaaatacatttttatatatgtgtagattgagcaattcacttatcttcaccaagcttcgtatttcccattaataaaaagaggattataatcataataattaacaaaacaacagtaatagttctcatccaccagaatataagttttggaagagtaaagtacacagttgtattctcagcaccaaaagcagtgtttaacacacactaagatttcagtaaatattcaattgttatttattgcatacttactacatgtgtggcactatttcaggagctgaagatacagttgtgaacaaaataggtcttcacagaccttacattctcgtggggagaaaatgactaaacaaccaaacaagtaaaatatgaaaaatagtatgttagatggcaatatgttctatgaagaaaaataaagcaggaaagggagtataaggagtaaatgcatgaagtaatatttgcttcatagagttgttcatcaactaatttagttattataaacagcctggttcactatccaccatcctcattgtcttcatcatcaccattatcaccggtattatttgagatactgttacagagtacagcactgtgtcacacagctaaatcctttgttagatgcactccctacatcatagaacttcagaaaaaatgagtgaaatgtatttgcttctcagcacagagatggaaagaatatatgagaaactgaatcatataatctaaattaggtatttgtatcagatactcaaaaatgctttgtgtacattaaacatatcataaattcataaggaaggagaactacaaatattttacaaatcatgaacatttatgccacttatgtttacataatttacttgcagaactaggtgcatacagggtttttctcaaatcaagataccataagcaaattgatctctctatacaaatgtctaccaatattttcagttaaattaatttgggacaggaaaataatatatttgagaatccttaaaaatgatgtgattcagacactcagaggaattgctttttattctggaaatacaagacaaaattatcctaaactaagttgaactgcaatcttgcagttactaggactattgttcatatacctatgtttttattttcaaagagtttccttttcatgaatttccagtgctatggaaagctatcacatctaccaacaacattaataaaaattggagaacatttgcttcggtcaaaatattttctgccttctctctgtacatgctttattttatagtgccaaagacaacagagatttttaagatatgttatttttatatactaacaacaacaaaaaactgctaattaaactgatacaaactttcttatcagattaactataaaatgaatcttaattccagagatgtgaaactgtgataaaatatgcatcagagaattgatcaaatatggcaagtaccacaatgacataatgattcattgtttcatgcagaaatgaaaatcaaatggcataaaaatattaaatgaatgtatgttatacatttgagtcttcttttattctatgttagttacaatacagtgttgttgataatagcatttttagtgtcaagaattgccctgagttttcttgcctagatgacaaagtgattatttttgctaccaacatagcaaaagaaaagccaggcaggaataggcatgaataattcggtttttgacatagtcataatcagaaaccaatacaatatctaggtggaactatcataagaatcatctggatacagacaggatcttggatggagatattcatttggctgttaataaacacatagatgggcattaaaactatggagtgaatgtagctatcaagagaggcataattgagattttccactgttcccatcttgaaatctacaactagactctaaactttctacccaaaatgcctttgcataagcagccagttattattttaaaataaatacctgttgtatgtcagaattcatacaatgaaagactccacctcaacttcaaaattacaaggtctacaatatgtgtaaatgagctttatactctgaagggatttctaggtagtcacatttcacagtatatttttccctctctaatttttttccctctgctgaaattttaagctcgcattttctttaaagtgttattttctttaattttcctaagacacacacgcaaaattattaaatttacacattaataatatctaacatttgttagaaataagaaagctattgcccagtaatgatcacttaaaatatacttacttcaaagtaaacttttatttttctaattcattgcaatgttctcaacaaatgccacaggaaaattgtttttaaaatgtatgtatgccatttatgtttacataatttacttgcagaactagttgaatacggggtttttctcaaatcaagatgtcataggcaaactgatctctttattcaaatgtctaccaattttgagttaaattaacttggggataggaaaataataatatatttagtaatatattattcacagtaaaatcataccattatcaagtgttccaaaacactcaataatgcgtcatgactggtagtgcaattcagaagttaatgtaatgaccaggaaatcccacagagtgagccagcaagtacttctgactcaacctggacatccaaatccatctgggtcgctactgcggttttgcagttgctactgaagtttaaacacctgtggagacactactgggtcttgaggctggctggtacctccaggacagtggaagccctttgggccagtaacagggtgaagtaagtgaggcactgaggcactacatttaagttggcactcagttttaggatcacgcaagtaatgtcccagcttcccaacatggggttcctctggcattgcctgccctcgcctacctttctataatctttcccatcccaaataggaacttactctgccatctctccccactccaacagccttcatttgagaacttgctggatagagggcaggagatgatcatcattcatgataaattcaaattcaaaatcagtctttatgaggtggttgtagttttgctaccatcccttcccattccacctagaaatttatacctattaggcagagaagccactgggttttcatttcttgaaggaaataatataactacagaaagcagagaaacaaagggtgtttcttttggacttagaattttagaagtcacgttttcagaaaaattgaaaggacttcagtgattgacagtggatttaggaggaaatgggtgataagttaaaagtaacttttttcctccactcccatccttcccacccagtctatataaatatttaatggacagagagacaaaatgaggaccaaaagcaaagtgaagggcccagagatattggcagatcttggagaaagaggatcaatgcccagctccttaggctattctcagagggctgacaaataccaggtgtgggtaaatgaaagatggagaatctgtgactcgacaaacgaagccctgggagagtagattgaaccatgaacttctctgaaccccagtgttgagtggaacatcagaatgactgtcatcttttcaagaatggcttcaaagtagtagagaagtgagggatagaaagggttctaatgaatgaaaatgaaagatgactccaaagtccccatgatggtgaccagtgggaagatggcatgaaaaatcagctgggcttacctcacagcccacacttgccaccaaccctcataaaacttaggtatcagctcgcagaaataaggggtgagggggacaagcagggaaaaatgaatactacaagtgacacacaggtttccactctcacagatacttacaatagaattaagttcagttacaagaaaataaaagaggtcacgtgacttgcatgcctgagtttctagttggatatctgcatgctctatacaaacactgcatttttcacatactgaaagaggtatttagttgcaaagaatctgtttttatttttttatttcagaaactcaactactgtctatttttggaagaaaataattgtcaacaatcaaaaaagcaagctcatgcttgagaaagtattttcaaatatcatataacaggaggcaagggtagaacaggtattgctttcttactgggtatctggtgaaaagtttatttactttggagcttaaaaataaaaattcatattgtgaatttgatatgtcaatggagggacatatattctccatcaaatttaacagatcccagtagctggctatccatgaaagcgtgaatgagattgactgctagttgtactaattaagtggatttcatctcttaatagccatgtaaacttgagaaggaaaaatggtgccagcagacaagacaaacattaagtataatttccaaaagtataaaaattaaacgtatttggaacataagaaatattattagaaaaacatattaatctatccttcctccatggaagtcccctactatgctcttgtggttctcatctcacctctcatagtgcttatagctaaattctcatctctgcctgccttttccatgctacgttcagtaccatgctgagccacattggagcctgaggcaaaaggaaaaaggtgtgtgcctatatatatttattattattattgtttttctagattactgagtctttgttagccccttatattttgaacctcaggccagtgcctcacttgcctcactctaatttctgccctaatcccaaaggtctaacctgcaccctctttccactttacacactcttcctgggtaactctccccctaggcttttagttatttacatatatcctgatgattcaaaaattctttatctccatcccagaccctttactaatcttcaacttttgcagtgatccacaggcacaagacctcaaataatccaaaagtgagtttagtatttaccctcaacttatgctataaacaagtaaacatacacataaagtcaactcccaaatcatatgtgttttatctcctaaatcaattcaagctcatcctccctcctagtcttcatcacctgtcttccaactttctaaacccagtcccagagaccttgcctcccatcttttcattaaatccatggtccacactgaaagctagactgattcacctaaaggcaaatatgatcaactcacactgatcattaaaacgccttaactgttcttccttcaaaagagtattattattatttattggtatttcagtcttcttcaaaacaatgtgagaacttcttggcaaggcctatgtcacataaatttcaatgtggcaagtggcacagacaataaatgtgaaacaaacgagtgactgagattgtgaagctcatgcaagaaaaaaaaattatcaaaacccatatattatttagttattttcattgtctacaaggaaaataagtcaatgattttcttttatttccttattcaaaaaaattctactaaaagagctctctggcaattgcataggttcagtctctagttctaccattcagttgtggaactgtgaataggtttcttatgcttccatgtgcctcaattccctcatctatgaatggatgataaaatataatgtatacctgacagggtgcttctgaagcttaaataaattacttcacaaaaagcattgcaaattcttaatatacattatagcttattctcattgtatttttttttatggtgagcaccttgtatgtgtcatgcatttagaacaaatttgctataattcttaaaaacaagtctaataattggctaattggctgtctttaactgcctttccttttaattttcacctagcataagttttctgatttgtaatattttctggtcttcaaaaattgctcaggaaaaatgagtgcaaaatatttatgtaattaggatagttcaacattttcaaaaatggcaaaaataaacagcagttatggaacacctgcttaaaatatactggaaataactgcttcatgcttcattaaccagtataaacatgtttgccagtttaaatcccctactgaagtcagaatttccaattagtactagaagaatattaaactaccaagtgaagatattcctgggcaataatttcagaactgccattcttaaggcacttttaccggtcaaacacatgcttattttctaagaagcctatgatttacttattaaacaaaatttgtatctattttaataaacgattttagactacttattttgctagattttattcacctctgagtagcattcaatacagtgcctgaaataagatgcttcgagcaccaaagaaatagaaaaaaggaagaagaaggcagatagtaagagaggactatataatgcctcaagaaaaacttctataattgttgagtccaattataactctgttttgggtaagtgaacataagaaacatatagcctatatatagatagatatctatatatagagagagatatatgtatatatatcaatatatagatagagagacagtaatgcaggctagaaatataaaggaatcttcaatctaaagatagtattaaaagtaaggagataacgagataaccaatgtagtgactattttaaaagaaagaaagagagtttgagctctgggcactgaaatatctagggatgagaggagaaataatcaacaaagaagtgaagaaaaacaagaaggagatgtcagtgaggtaagaagaaaactttttcgtatctcatcagttactggttactggctagctagtggggataaaagttccagcatcctacttgggtctttatgaattgaaaaacaaaccatatgttttggtgacactttcattcaattatttatgccagcatgaagaggataataacaaatacgtaaggagcagcattattcaaccacaccgagaataactttcaaccctagcttcatatttcacttttgggaataaaccttactgctctgagaaattcatgaatgtcacagagagtcttcaaactaacagacatcagtgcaataaatctgatcttataaatcgagattactattttaacatagatctaaagctttcattttatttttctactaatactcattacagaagacctgaaatatacaaaagtgccaaaaaatataatcaatattaatatttcatttttttgttcttttgtgcatatatatataaaggtatggttatgtgtaagtgtacacaatcactattgaatacagtgatgttaaatcctttttccatgtaatgcagatagaatttatccagattattatttcaaaaacatcttaatgactgcacaatataccactgaattaatttactctaatttgcttaaccatgacccactggttggaattcagtgggatttcccctacatttgtctccattgagtaaataatgcctaagataatcctctttgtgcttaattctttatctatattcctaattctttccttcagatatgttattagaaaataaattactggtgcaagtgtttgataattttaaagtattgttatgaactgaactatatctcctcaaaaatcttatgttgaagtcctaacccccactatctcaaaatgtagctatatttggagagagagtctttaaagaggtaattaagttaaaatgaggttattagggtatgtcctaatccaatatagccgatgtccttatttggacacacgcacacccaaagtgaaaaactcagggagaagacaccatctacaagccaaggagagaggtcttggaagaaatcaccttgatctgggactcctaacctccagaactgtgagaaaataagtctctgttgtttaagccacctagtctgtggtatcttcttgtagcatccgtaggtataaatagcatccctaggtatagcatcacaggtccaaatgaatattgtcaaagatattgtcaaactgcttttataaatatttgggtcaatatatatttgacagagaaagtggacctcactgtaccttggttattatttttaaaatgataaaataaactcaatttataggatcacattatgagatacaaatgctaatttccataaaataacaacaacagcaatcaaaataaagaaagtctccatttcgaaataaagtcctgaccataaatactttgaaaacttataaatgcgagacattagggaagtcacatagtgtctcttgatcatagttctcagacctttaaaaattagagatttaggcttgatagtctttaagggctttctaagtttaaaaattatatcacactctggggactgttgtggggtggggggtggagggatagcattaggagatatacctaatgctaaatgacgagttaatgggtgcagcacaccagcacatggcacatgtatacatatgtaactaacctgcacattgtgcacatgtaccctaaaacttaaagtataataataataaaaaaaagaaaaaaaactataataaaaaaattatatgattcttttttcagtgttattcaattgctcttatcattaaactgcgtcatggcttgtaagtggcctattccttgaacaatctgaatcacactggtttccttttagagacctctactagaagcatcatgatagaaaacaaagctcccaaaactggaacaagaaaaactgaattcaaaatccatgtctgtaattaagtgactatgggatcttttcatgtaacattgtttctctgtttctttttcttttttcattcaaaaaaaattgcccagtggctggtgatagaaaaacttaaaattagataaatacaagcacacatgagcacacaccctcagtttccatcctcaaagagttcataatataagaaggaggaaagaagtacataaactaaaatcatacattctataagaaagtatatacacggttccaattgagctaatgttaaactaatactactgtctcactcattaatttgggaatgttaatttggggtaatctggggaaatcagataaaaagacatttctttcaaaatttaaaaacgtatataactttaagatggaatttctaacatcacctttaaggttgtacttatatccgatctatggtgtcagtttcagctctataatcacctcctatatacagttaaacaaagttctagcaataatctcagagaaatgctgttttgctcctacacctcacctggaaatattaggtgttcatagaacatctaatgttcatatattttgtgagggtgtatttttaaagtccacagataccagtgtatctatagctttcttcatttagactatatctttaacatgaaaactcttctgtatcattgtgtcattaggcaaaacaattttaaaacaaattttaaagattttgaaaaaagaaattttggcaccaaactaaatttacaggttgcatatcccttatcaaaaatgcttgacaacagatttgtttcagatttgggtattatgaattttcagatttgggttactcaacctgtatataatttgtatttcaggagattttttaaagcagtgtaattaaaaatacactttcaaactttttcaaatattaaatatttaaaatatttttaaaatcacggctgtactttaataccttatttctaagtgtatgtaaaatcttgccttacaatgtgtggagtgaggtaattttcagcatgaaatagtgtatcagtggtacttacaaagcagttcttatcaggatttcttttccaatgtttcttgtctaatttcttggccgaagtggaacgcagagttgcatgagtttgtgttcgaggatttaaagccaggatactctaaagacagcataaacaatgtgtaaatatatggaaatatgttggcatttgtttaaacttatttttattttatttttatttattttgagacacggtctctctcactttgtcacccaggctggagtgcagtggtacaatctcagttcactgcaacctctgccttccaggctcaggcgatcctcccaccttagtctcccaagtagctcggactacaggcgtacgctaccacacctggctaatttttatatttttaatagagatgaggtttcgccatgttgcccaggctggtcttgaactcctggtctcaagcgatccacctggctcaacctcccaaagtgctggggttacaggtgtgagccaccatgtctggtagcatttttaggaatcaaactttatctaagatttcctcttacaggcccctaaagaaagggttagccaggaaagaaaacttaggaatcacaaaaaaaaaaagatacatgtaaatcagaagaatgaccccaaatttgcaagattgtgtttaataaaatcaagtgaggaatcctatatttggttttccaaaaaaaagttcagtatgggaaaatcctaatacaatgaaaatttatatggaaaaagtgagaagatatacttgtcttagaaaaaatctaataatgttatcattgatataatgacatcattatatcaatgtatatcattatacattgacaaaaagctaaaatatatgtttaaaatgttgcatggctctcaaacagcttacattaatagactaatatggggcaaaatataaatcgagtaattgttattgtattttctactaattagccagaagcaattcttgaccagaagaaaaacttcaagaaaaacaaataaatataatcaataatgaacaacataccattatttcaccagagaggaggaaacatggtagtagcacatgcttctgtctaaccaaattaacattattacctaccatctttcaataatgattatgtgttgaaaagttagatgcaacagctgaagaaaagcctggagaaaagatctgggagagacacagtgtatttcagtaggtgaagaactttcacatggaagagagatttaatttgttttgtattaacacagaaccaaggctgtggaaattaatggaggaagatttggattcagatataaattaaaaagtggcagctgagattgtattagaaatcattccagctgacattactgcagtcattttaaatgatgttcatttcaaaagtcttcttccatgaagttacccctaactaatctagatccatttttctgtttcagatcactgaaacatctctaccacagtatttcagtctaaacagtaactgctgctttaagaattttcttcccttctaaactgtgaatgtgttgagttgcgggattcctgacttttcaaaaatctttcagtttatgatatacagtaccaggtaggtagcatatgcttattcctgtaaaatagtaattcaaaaatcataaatataatttttaattcctagtactcttataactttgagtaaaccattgatctttttgatctttgatttcctcacatgcaaaatagggcaacacctgaatcagaagtaaagaataaatgaaatgcatgatacaacatgttttctaaactacaaaaaccctaaaaattgaagtgtagtgaaaatggaatccagaggctatgtgcaacagtaatcctctgtccatgatttgttcatgtagtggccaagtaagaatttgaaggggacctgagaatgcaattcctactagatttaaccaaatccaagatcaccttccaaatctagattccatgattctttaaaaattattgggtcatgttcatcattttcacatataaaaatgaactcttattgagatccacagagaactatcaaaaagaccacaataaatgaacagataaaagaattattatactattaacaacagacacaagctaaaaatgttattttccacctctactaatgtaattccacaatcaacatatctaaagtaatcattttctaggtgatatcttagctgattttataagagtatcacatgctaatatgaagaatttaaaaatcataaatgactttctaaaataaatgttatacttagtattcttagacaagaataaaatcagaaaaagtcacttcatttcattctgcatttgatttaaagtggtaataacaatgctttgtgttttaagtttttagagtttaaaagttcaaaagctttcacatccattatgtaacttaacttacaaacagctactactctctcaatacttaggatgagcaaataaattgagggtgattaagtaacctgcttaagatctcacagttaatatgcaaaaagaattgaattggaactctgtttttctgagtatgggacttatattgaacctgatccaaagatgagggctatatttaaaagtcactttttgagatataaggtaggaaacatttttaaccacatgtttaaataatatcaatttgcacctgagtagctcaatgaaaaattaatttcaaaccctgtcttgagcaagccagtaaacatgaccattaagaggtcacctctggaatggtagagtaaggacctctgcagactgactcccataaaaataaacatataactgcaaaaatagtaaaaatgaaaactctttgaagtctctggaaatttgccttaaggcaaacagcaaatgaagaaacaataatacatgaaaatctgctaaaactggtaaaaggagtgaaggtctatggcatttgaagtataacccacaccacttcagtccagtgtgacagtcattctacctcagatgggtatagctcaaaacacagagctcgctctaccccagccaccagttgagggctatggtatctcccagagaggggtaagatgccagcatttctcattttctctctcccccatgctacacagagacaaaactgcaactgagtgcagctgagactaaagtgcagctgacaggtcaggagttctgttactccatccagcccccactcatagagccaaggttctacctcaggaatatcatgccaataacaccagggccctgattatccttgcctcacctcacttactgggtagagattgcacacaaggaagagcaagctgagaggactagaggctattgcctatacctagtactttgctcataaagcagaaatttaactctgagagaagtgggccattgtcactatcctcagctctggagcagtggcccagagatttttcccagaagacacaagccataagaacagagaggtccccccaaaggaactgactttatttgaacctgtatgcagggaagttcaaacctaagagtactcttataaacaataaaaatgttcatgtcaaacaattaagaagagggaggtagcttcctgaaaacaaaaaactgaaccataaggcaggtagttcataagggaaacccagggaaagaaacataagatgagttctcctggagttacaaaaaacctcaaggactcacctcaaaaactaccactgaaaaaaggcccaaatttaactgaatcacactgtggaacaactcatattccacagcaaaagtaataaagaaatcaaccagaagccactggaactaagatctgggtgtgacattactacaggcagacatcttaagagagagatcagagaaaaaggcaaagagacacctgataaaaccagggacacccaagaatgactgcacatatccaaggctgcaccctgtgagaatgacatcagcggttcacacagaggaaaatgtacatccctaaatagtatatccaggccaggcataatgggtcatgtctgtaatgccagcactttgggaggctgaggcaagtggactgcttgaggaattcaagaccagcctgggcaacacagtgaatccccatctctataaaaaatacaaaaattagccgggcatggtggcatatgcctgtggtctcagctactcagaaggctgaagcaggaggatcgcttgagcctgggaggtcaaggatgcagtgagctgtgaccatgccactttactccagcctgggtgacaaagtgagactctgcattaaaaaaaaaaaaaaaaaaaaaaaaaagtatatccagtcgctagtaacaagtcgccctcctctagagggggtttagtgtccggcaagaatagctacattatgtaagatgttcagtcttcaatttaaaaaagtatgagccatgcaaagaaacagaattgtgtgatccatacagacacacaaaaaaaggagacaacagaaactcccattaagagggcccatgtgtcaaatttaacactttgatatggtttagctgcatccccacccaaatctcatcttgaattgtagttcccataatccccatgtggtcatgggagggacccggtgggagataattgaatcatggggccagttacccccatgctgctgttctcatgatagtgagtgagttctcacgatatgtgatggttttataagtgacttttccgtctttgctaagcacttcttcctgctgtcatgtgaagaaggatgtgtttgcttccccttctgccatgattgtaagttccctcacgcctccccagacatgcacaactgtgagtcagttaaaccactttcctttataaattgcccagtctcgggcagttctttacagcagcatgagaactaatacacacttcaaagcagccattacaaggaaagtatgatgacaatgtcttagagagtacagaatatccatatacagatataaatcacttaaattattttaacaaaaacaacaagcaggcattctggtcttgaaaaatacaatagctgatatgaaacattcactagagttcaatagtagatttgaactagcagaagaaagaatcagcaaacttaaagacagatcaagagagattacacaatcagaagaccaaagagaaaaagaataaagaaaaattaacagagcctcaatgatatgtgatacaccactgagcaaaccaaaatactgtaatgggattacctgaaaaagaaaagacaaagcaggagaaaatacagaagttacactggcttaaaatttgcccgatttattttttttttaataaagtagaacaaggtatattacactataccttcaggaagctcaatgaatgtgaagtatgctaaatgtaaagagatccacacaaagaacatcagtaaaagggctgaaagtcaatagcaaaaagaaaatcttgaatgtagcaaaaaaaaaataattcatcatgtaaaaatagtttcaataagtttaacagtgaatttctcattaacaaccagagagaccagagagaagtgggataagacatacaaagtattaaaagaaaaaaaaatgtgaaccatgactcctatacccaacaaaactatctttcaaaaaatacattcccagaataacaaacaataagagaatttgttattagcagatgtgacttataagaattactaaaggaagttcttggccaggcatgatggctcccgcctgtaatcccaacactttgggagtccaaggcaggtggatcaccaaggtcaggagttcaagaccagcctggccaacatggtgaaaccctgtctctactaaaaatacaaaaattagccaggcatggtcgtgggtgcctgtaatcccagctactcagaaggctgaggcaggagaatcacttgaactccagaggtggaggttacaatgagccgagatcacgccactgcactccagcctaggcaacaagagtgaaactctgtctcaaaataaatagataaataaaaatgaaaataaaaagtgaaaaaaataaaattaaaggaagttcttcaggcagaaagtaagtaaccataacttactattcacacgaaaaaaacaaaggtcaacagtaaagtataggtaattatgaaattataatagtataaatgtatactgtcagactagataaaaagcaagatgcaactatgttctgtctttaggagacacactttaaattcaatgacacaaatatgttgaaagtaaaagatggaaaatgacatatcatgcaaatagcagcagcatgaaagctgcagtgcccatactaatatcagaacaacaaacttttaaagaaacaaaaaaatttactagaaataaagaggaacattttatcatcataaaggctcaatctaccaggaaaatataacaattataaacatatatgtgcctaacaacaaggcccaaaatacaaacaaatttgaaaggaaacaaatctttaaacaatactaattaaagacttcaatactccacattaaacagtggatagaacaactaggcagaagaccaaaaaggaaacagaagacttgaataacaactataaatcaacaagacctaacagacatccatataacactctaaaagagcaaaatacacattcttctcaactctatatggaatcttctctaggatatattgtatgctagatgaaaaaacaacttctactaacttaaaaatattaaatcatacaaaatagttctccctcttcaatggaatagaattagatatcaataacagaaagaaatttggaaaattcaaaaacaatatgatgaatactgtaaacattatgctaagtgaaagatgtcaactacaaatatgacatattgttgataccatttatataaaatgtccagaataagcaaatctatagagataaaaagtatattagtggttgctcaggctggcggattagggagaaatgagatggctactataaaaaggataagtgatttctttttgggtgaagaaacctgattatggttatattggcacaactctgaatacactaaaaaatactttgaattctataatttacattggttaattgttgatttgtgaactgtatatcaataaagctgttaccaaagtaaaaccctattaaattctacattcagtcgatttagccatatactttattcactgtaataccactaaaacttcctttattagctcaatataaatgtaacaagattatttttagtaactcctaaatattacagaaatcatatttcttcagtctctcaagttagacatctgtgtctttttgaagaaaaatatacaataaagctttaattttaagtggtgtattccttatgatgaaataatactaacaggacctattttacaaagccagtattagaagattcaagtaatctcatgcttatagaaaaaaagtgaaaacattttcttattccagaatataatgtttgcttatctattcagttttcaaccattactaatctcatccattaattcaaattgagaaataaaaagacacatttttttaaagtagttattctaacatttaaagcaaaccagccaggtaacatgcaagaaagatggctgcatttattttagtttttatttccataatccatattgtgataaatgatcatgtttatctatgtcagcatagcaatataacttttgagaataaacattctgaatgtaatttattggctacttatcacagctacttttctttcacatagcataagtagaaagcataacataacatgaaatattgggttaaccttttgcaaaaaggcagtgagttgaattcaatggatcttgggtaaaaataaattggattgtgcaaaatggttaccaaggatttggcttaataatatcccaaatgaaatgtgatataaaataaaaatacaagacatgagtggttcagagctgttaaaaataattttccaaagcaagactttaaaaaactaaaagtcaatatcatcaataactaagcagctgacagataatacaggagagttctaaattgcatttttcctaagaaatggccaaaggcacgttccaacaggtcacagagtcccctctctggatgaattgagcactttaagaagcccattaaccctttcagatacagggtacattacttatacagggagatttttctctcatcaaagaatttgacttgtttggctttaccaaacattttcagtaacacaataaagatacactggttattccagacgcagaaaaaaaaattagaaaaaatttaattgtactaattttacctagtttaagaaatgatggaatattatccagggccaagtataaatgaaatcaaataagagttatatattgtcaccgtttggtctgttaacactattctgtgaagcagtggaatgcggaaacatacaaactagaattatacatctaaagagagtttttctgtattaccattgagggcaaaaaagagaagcctgtattgattacaatcacaggccctcatgtcacaaacaaaatcactaaatcttaggcctaaaacattggagcttcagtattattcaagagcttgaattccaattgcaggaagctacttgaccaacatgtcctctttcttaacatgtggtattgttttatatcacaatagtaattatccaaacatagtgtaccattaagcttcctttaccctttgcattcgaacttataaacaaatttttcctattcaatactggtaattacttgctataattctgagccattaaaatgatacacatgttgctgacattttgtacttacatgcttaagatgataaactaagttttgtcttatttaaattatgcttacatttttctttaatggcttattctgagttctctataagttatctcctactttccaatgcatcaagtaaacaaataataataataataaacatgtttttcccatttctttcataattggacagaaatactttgatttcaatataacattgtgctgtggtgccaattttttatcaataaatattctcagctaacagaaaaacagaaatatctattgattaatgcttttgacgagtatttgttgccttatccaggtaacaatctaactaaggctggtcagtggagaactaaatttttcagtttatttgcttaacagtctcttgtttaaaagccccagtctcagccagttatcccacgcttctccatgtctctcattagtcatagtgtagagtgatttaattaatatctcagaaattcacaaaggtatctttggttcttgaataagctcagaactgatacggcccatctcctgctaggtagggaacagaagaggagagaatgcagctttattttgcatcctaggttcacacttgagatacaatcaaccttagagtctgaaaatttcagaaacccatggtaatcagtcctggtcaaagacttacatttacctaataattttttaaatgtacttccattctttgcccagacacaggtttctaagcccctaggttgttctacttttccaagtaacttatcatactttttttcccattttactagctctgtacaaaggccaattttccctttatgcacagtgggtaactcactgcagttgattaaaaatttatgaaggaaagaatctctgatagtcctaaatcttacaactttcattttgttaagtattcactaagcaatatgcatagtgtttgagattaaatttgggtttctatcttagctctactattcttgttggttatttaaactctcaagctctctactccttcaactgtaaaatggtgattagtaatagtacttaccccatagggttgttgtgatgattaaataagataatgcaaaagatgtttagagtggtgcatgcagtaagtgcttaccacatgttatctatgtatgtaatagaactaggttttagccactattaacccaatgtatactcatattcctatattgtcaattctgaatgtatacatgggaatcatatttttaagtacaggaatatagaaaaaggatgaagacaacaggtgagaaaatatctataaataaggtagtacaaaaaatagagatgtatctcagaggaaaccaaatcactgactgagtcatgggtctctgaacttatcattgccctaagccctgcaatttcaaaggcagactgcctgaaaatacaatatgctttttgcaaattaatatggcagtgtggaagggtcatgaaattcaaaaacagattttaatatccatcgcatatatatatatatatatatatatatatatatagcaatggagatatcattttataatccatagaactgtatataactcatgggtctttggtcccaacatgtttaggtaaatttacattacatttccttcccaggaagggcatgtcagatgaaaaatgatgaatttgtaaaacatcaaaaaatgttatcaactgaaaataaatgaatcccttcagaatgctcatcatatcgcctggaatatttgattcatttctactgagcatatagttaacacaaatagtttacacattttaaaatatcatgtctattatgtcactctcacactcaacaaggtaaggtgagccagaggaagctcttcgtctgtctttgcaaggcccagtgtgtgactctccttcacttctaaaatacacaccacacaacaggtgcctaaatgatctctatgtgaaaaaaaaagtctttttattgtctttcagaaaagattgacaattcaaacacaagaataataacatctgatattaacctcacaattcttaatacagaacagagcatgccaaaggtagtgactaattctgacatagacaatttagtctgttcaggcttttataacagaattccataagctgggtggcttaaacaacagatctttatttctcacagttagagaggctggaaagtctaagatcaaggtgcctgacaatttggttccaggtaagaatccttttccctcttctgactcactcacagccacctttttgcagtgtgatcatgttgcagagagagaggatgagaatgagagaaagctctctgtagtcttttcttataagaagcactaatcccactatgagggtcccaccctcatgacctcatctacccctagctaccttctaaaggctccatcttcaaataccacacattggaagttaagtcttcaacatatgaattttgaggggacataaacagttcataacagacaaggaaaggattccaccacctgtggaagtatgcaaatactattaatattgggcatcaacttaaagtcacctttagcctaagagttcaaatggtaccatgttgactgtaccattttattttatcaagaagaaacttcagaataaccaaaggagatattttaaagtattgcttaatttaagaaaagaaaagaaaacaatattaccaaataatgtaacactagctattaattatatatctttattctttaaacaatttaaacagcaaaacattaataacatatatactttatatatactgtttgtatatttttattataggaattgagaaataaagtgtcaaatgcaaacacttataaagagatatcaaaaatatataaaatgggataacctatactgtactttattttaaaatttcattactttaattataaactattttcaatttaatataatgtggcaaagcatccatatattacatatttaaattaaaaccagtatgtagaaaatgtgtaactatgaaaatacacgttggaatatcttgcatttgcaaaaagttgaacatatgtataaatttatacaaaatcccaagacagaattatgtgaaaagaaagttgatagggattattacgttaccaaaaaaattcaccagttcattgggtaagaaaatctatattttagcatttatactttttttcattcaaaacaaattagtcaatttacctcaaaacttgctttacagaaattgcctggctcctatgtaaaattggccttagagggcctttttcaagtagtatgaaaagtattatgatttacctttaatctagtaccttttgtgtataaaatactctcatttacaaaagacactgctcacaagaccaagggttattttagttcaaaagaggctaagtgtataccagcatgctaaaattatttaataccagtcaacaaatagagatgctggaaaacaggacttcaagggaaagatgaaagcaggacctgggctaactgagtttaaatgttttacaaattaagtaaatagaggaagtagcatgattttcaggttcacaaaactgtaataaatcatagcgtgactagttgcccttcatctatatggttaacagctaaaaggaaatatatatatgggctggcaagtgacttatgttaaaaataagaactgatatgataaaaatgagttttcatttctggattttattaattgaaggattatcatatctattttttgagaaggatcagagtagagcaaggagctgaggagttggggaattgggtgagttgaggagttggactatttaaaatcatgaaatttatgaatttaaagttcatgcatacaattactatttaagctacttttatttccttaataagtaatattttgtattcttaattaatacactttgtttcaatgcctagagagaatgctttccatttaaacagtagtattagctgtatatgcagtatggagtcacatcaagatatcccaatttttttaccaaaaacaacctaggaattccaatttaagagaacaaatatctcacttaaaataatttaagtttatacctaaagcaagatataaaaatataacacccaatcttacactgtaattacatactatttgacctaatctagcttctttccagggattaataaaattaacttggcatcttttttgggtccctaggatttagtatattagagttggaatggactcttagagattaacatttgatttcacgtcctatttagaaatcctgttccaaacactcattgaactatatcaatcaaattaatcaaaaatgacatagtgttagtctcttatataaagctcacataaatggataagaaaacaggaaaatattatcagataagctggaaaagggcatgaacagatcacagaagaatgcatacatatctccaatttaaagtgaaaaagagaaacattcagctacccactgagtcttcactttcctaccactactgcaaatgctcttgtcaagtctcaccgatgatgtgcatgttacccaacattctttgtgcattgttaggttttacttctccccgtctcatatttaagtgactttatttttttcttcataggtaaagtattacttttttacaatagctttattgagatataattcacttacacatgattcacctattttaagtatataattcatgaattttagtatacctacaaagctgtgcaaccatcaccatagtcaattttaaaacatttcatcaaacatatccctgccaaaaacatgtacccattatcagtcacttccagttttccccaaacctccagatttaagcaccattaatctactttctaactctttggatttgtctgttttggacatgtcatataaatggaatcatacaatatgttgtttttttgtaaatggtttctttcacttagcataatgtcttcaaagattattcatatagcattttacttgtatatgtgttataaaccccatactttactgtttaatttaaatgaccaattctcttaatgaggtttaaatagtaagtaaaaatcatatatctacctatgtagttaccatttttgcaattatgtaatccttggtgcaaacccctatttttacctactattgtttccttttgcctgaaggatgtgatttcctttaatatttcttgtaatgcgggtctgctgcttataaatgtttgcaacttttgtatgcctgaaaaagtctctactttgccctggtttttgaactctaatttcactggataatagaattctacactgaaagtttttgttccctgatactttaaatgtcttctcacttgcattatttccaacaataaatctgctattgctttatctttgttcttctgtatccagtacacctgtttttttcctctagccgctctgaagataaactctttatcactagttttgaccaatttgattatgatgtgcctcggcgttgttttctttatatttcttctgcttaggtttcactgggcttcttggatttacaaattcatttttacaaatattttcttcttctctcctcccactgcttcactctcatctctggggaaattccatttacatgtatatgaggccactcgaagttgttccacagctcactgatagtcttttcatttttttctctctctgtgtttcattttagagtttttattgctatgtcctcaagttaactatcttttcttctgcagtgtctaatctgtcttcaatattatccagtgtgtttttcatctccttacagttgccatctttagaagttcaatttgggtctcctatctattttgcacacctctacttcattttttgaacatatagaatacagttataatgacagttttaatgttcttctctgctaatttaacatctgtgtcggctttggatttgtctcaatacattaatttttatcctcattatgggtggtattttcctgcatcctttcatgcctagttatttttaattggatgatagacattgtgaattttaccatattgggtacatgatattttcgcattcctataaatgtttttgagttttgttctaggacataattgaattatttgaaaatgatttgatcctctcaggtcttggttttaagctttgtgaggagggaatcaagcagcatttgctctggggctaattatttcccactactgaggcaaaaaacttctgaatacccaatgtcgtatgaatcatgaagttttccagtctggctggtgggaggaggcattattcccagacccatgtgagtgctagttccgtcggactgttctttacgcagccatgggtcattttcccacatgcgtatactaatcattactctgtggagtactcaaggggaaccctctgctgatctgcaggtttctctctgagcagctctagcctctctgttgttctgttctacaaactctagcttccttggtctccctagactttcagctctgtctctccaattgaaggattccaccaggctttgtgtggtttcccccttctgatctgcagcctataaactctctcaagaggataaactagaaaaatattagggtttccttcatttgtttatgtttctcagggaacactgtatttcattgcttgatagccagtatcttaaaaataattgtttcatatattttgtttcttttttattgtttcaggtggaaatgtgtacaggaaagaacctgataggcctgagttgctcaaatcctgagcaatatggtttgactgtgtccccaaccaaacccaccttgaactgtaataatccccatgtcacacgggtggggctaggtgaaggtaactgaatcatcagggaggtttccccacactgttttcatggtagtgaatacgtctcatgagatctgatggttttctacatggtggttcctctgcataagctttcttgcctgccaccatgtaagatgtgcctttgctcctcctttgccttccaacatgattgtgaagccaccccagccatgtggaactctgaatccatcaaacctctttcctttataaattatccagtttcaggtatgtcttaatcagcagcgtgagaacagactaatacactaagcattcccaagaaaggcttgttttcagaagaagtggccctcagctcactcctaggaaccaagctgtgactattctgtcagacaagagtgttttgttttgtttttttttttaatgccaaaggccttgggccacgttgtaacagttggctagtttacattaacagtgtgattaatgatgagtatctgctttttctctggtggtctgaaccttgaataactgaagtcagtcacacagcactatatgtatacatgactaacacgcaattaaaaaccctggatactaaggtttgggtgagcttcccttattggcaactcttcacatgttgtcacacatcatttgctggaagaattaaatgtgtgccatgtaactccattgggagaggacaactgaaagcttgtgggtgacttcctctgaactttgacaaatgcgccttttccctttgtttcttttaatttattctttcaccataataaactataaccatgaatacaacaacttctatatcctgagggtatttatagtaaatcaattgtgcctggaggtggtcttggaacccccaatacaaaatgtacatctattccctagtgtcccaccttgagtgtatgcagaattccagtaagagtatcatactctagtggccactccttcacatggcttaattttatagagcacctggacaaacaatacagaaaaattttcaaaatggcaatacgtaatttctttactcacttttatataggaatcttaggtaaatgtattagagattgatacgtggtcatgggaccatgggctttaaagtagaaaaagttaacttatcacagatactcctgaataaatcagctgcatcagaatatctcagatttccctacacatctatcaattatacatggataggccttgggaatcaatcagtttaacaaatgtctgtggcagactttgcagctctcctgcctcagtatgcactccatccttccttcttagtagcaaacccctattacattttgggagccatagttctcagctacagactataattcccaggctttgacaagccattcagctaagtaccaggaaataatatgcatttagaagtgtgtatcttttaaggagtctcattaaagggagaggtataccttgtttttcctgttcttctctgcttttggagctctagctgctaacttcaacagagaggtgaacttgaggatatcagaatggaaagacagaaacctgttgacaacaaaaaggtgctatacgcactctagtatctatctctggacttcttttacatgaggaataaataaagttctgtcttctttaagccgcttttagcaatttttcccatgttataccccaacacctggtttttacagtgcccaaggtgattctggtggtcaactaggtatgggaaggactgatagtccaatcaacaaggcaaaatattcaaaaccagggtgcatggaaacttcaaaataaaagcatttggcttatgtacttaaaagataagtgggaaatcacatcagcttaagtatttttcttgaaatccatcaaatgtcaaaaatcctaaaccaaaacttactcatttcaaagaatgatcaatggaaattttattgtgccagcacaaaaaaagtaattcattttcatctccattcattgactgctaataggtttctccattttaactgacataatttttttacaatatagcataatgatgtgaataaaatatatccaatgctcctttgcaaactgttttttgaaaatctcccatgcacacaactccctccccaaaatccacacttccaaccagtctgttaaatccctccctcctatcaagccgcagtagataacacatttctgtgctcccaagatacaccatgcaaaacaccctatctctattaatattctaacttgatttctggatgtgttctcagtctaatatatacttcaacaataagacagtttagcaactttttatcaaaattttataatgtcttttattcgaaaaaaattatattaaaaaatgatataagaacattttttaatgttcttatatcagatgactatttggtaatacctgatgttgaatgagagcttacagtatgccaggcaccccttcaagtgtttttcaagtacagatgagaaaactaaatcacaaggagattgagtaacttccccaggaagtaacagagattcttaacccacatattttggcttcagattatggactgttattcactactctgtacttcttctatgggcagctaatattagtttcattttaatgtagtaactcaacgattgctgcatattcactgtaaatactgaaatcaattttgcgctggtgcagctacagaaacaagacctgaaataagtcagattaaagaaaagtctattatatgctgattaagccacaatatataccaaacttcctggtacacattgcttatatagtgttacttcaaatgaaaagaaagagacaaacctcagaaatattgttaaggaagctctagcaggacttgataacaatgagtataggttgtaaagagacagaaaagtaaatacacctcccatattaacaatttgtgattataaggggaatagtatgcacagaaaataaaagttgggatagaaaactggcttagaaaaaaatatttagtactgtttggctcatcacttgaataatggtgtcatcttacaaatgacatataagcagcaacaataacaaaaaactgacagtgaaatacagcatgtctccagtgcctttcaattaattgttggatttgaattaagttcacacatcttgtctaaaaagctaagatttttctttaattgtaaaaaaatcacagatgctctggtatcaaaaatacatttaccattcagaaatgtcaggtaatgctacttccattaaaatagaaattctgggtttaatatttatcaatttataaaatagtttacatatattattaaaccctcaaattcttgtattccaattgaaatccacatagtctaaaattctctgcttatatgcctgtctgccccactagcctttcagcttactgagtatgatgactggctattacccttctcagtatctccaggaacttatataaggcataaatatagagacttgcaataaattgaattgtatctccttagagtgtaagagccacaagggacctctatttacagatgcgcctagtgaagtaaaagaacaatccatattaaagactgagtcaagattagaaccaagtctcctaactctatgacatcaccacactcatacaaaaatatcactacaatgaggctcctgaatactttgaattatccatgactttacattgcctacgagcctacttctgataagaaaccatacttgaaagtagcataagagcaagaattagaagatgcataaataatatagaccagagaggcataagaggtcagaagttcagtgttttggatttactgggtaaaactggttttctttaatttccataggaaagattacaggatgcccacatgtcaagtaattctttaatcattaagtttgctgtttccattgaaatgttattcatctcaaagatatgtaaattatcaccatcactttaatacaatgcttcctacactttctctgtcattttaaagattaagactgaaaataaattaaaagcaggggtatgttgctatataataagaggtaatttcatcaaattagtaacattcagattctaatgagatttctttattattttagacacagaatattttcctaaaggagcatactaaacaaaacaatctaccttttaagacttttcttaaatggagcataccactagaaaacaaacagctattatttttcatttcaatctaaataactgcaataacttccaggtgtttagaaagaggtacctcccaacactacatagttccacgctttctttaaaccttcctaacacttagacttactcaaagatataaacattattccaaaggatgataaatattgcatcgtaattaaggttactgggctggcacagaagagaatttgacttaatgggagacttctgtgatggaaattaataagtttgccacttaattacaaacagtgtgggttgtgagcaacattcatactatttacacacttgttaagatttaagtaagaaaaggcttgataatacatctcttatttactacgaagcaaaattaaaacttgaaaactagaaacaatctatatttaacaatatcacaaagaatgaaatagctccgatttcttttgctttaaaatttgttttactgaatataatacatatttatttttaaaagttttaatccgaatgaatgataaccccctaaaatgcaggttatagagctggatgaagcatgtgaaaatttttagaaacgtatgtaaatggtgtttctcacaatttatggatcagttctgtctatcaattccaaatttgagtttttgtcataaccagaatcttgaaatggtcaaaacatgttggtctagcaaatcaatatctaacatggacaacgctaagtaaatgtccttggttattaagttaattatatattaacatataagtatgtttaatatcaacagtatctttttaaaactattccttagaaaatctttcttgatactgtcttacaattcatcttttttcacattcaggcccattgtttggtaattttaaattacttcaaactatactagaggaactaagaaatccaaatatctagagttttaaaatgttaattcaaactttaggcagccttttaaaaagctgcctttccaagactgctaggcaaatggccaacaacaacattttaactgtccaaaaatctgacggctgaataaaaatttgaattttactagcaaatgaattaagagaaacagctaaagtgttgcttctagaaagggaaataggagaagatggagaggggtgaggtgaaagctagacccagtgggcactggagagaggatagctaacatctatttccaactccctattcttagggagggcttaaaatcagcaacagaggctgtatttaccccagggtaatcaggaagggctacacatcaggatgtcccttctctgcaccatccctcccctaactcccatttactagtttaccatcatatcactgggaggaatagaaccactattccacaaagttgtttgtttatttttaaatgtttatgatatgcatgtactatcatgatggaaatcaaacacatttaaagatgtcattattaaaacaatggaataattcagaaatgattatacaggatccactgggtggcaaggtaatcataacatttcagtgacaatatcttaatcataatggaagtgtgggagaccagaatataccttcccaaaatatgaagggttattgcactgaaggcagttaagaagaaacacaggagagttctctggcctccctttatttgcctaaaagcagtagatagatttacaaagaaaatggtatcctgcccacctctctaccaaaaagaaaaaaggttaaccaccaaagacagctttagacccttatcagcctagcaacagtaccagaggaatttatattaacaagttttactaacttttgtctgccatgcatttgccttctcctcaagttgccatcctttgtcttttcagttctctaaaaatgtactgttctttgttgaaggagctatttcaaaaccacttctgggaaaactactcattctctgggtatctcccatgtacttgtgaaatatatatgttaatcagcttgtttacttttctcttgttaatccatctttcataataggggtatgttccaactaagaacctactgaaagttattactcccttacagtttgtactcaaaattccatatcaatccaaatcagttgccatgggtattaaaaggcactactgatcttgagtaatagcaagggcacctgcatagtcaatgtaatctaatttctccaggaaagttgacttacacaattaaagttaccaaacctaaaattatatttattttaagcccaatatatgtttttatggaagtatactattttagaattgataaaataaagaatttcatagattctggatttatttcactttcagattaactgagaactagactagaattgctttgttttgaacactgtagtgcaaattataattacccaatatgcacctctaactatttgctcctgtagcataattaattcaaaattatacaggactaaagatgcaaagggagcaagggttagactaatataaaattaaccttagatcatatccttgtcattatattttttcagtcctcaatatgaactggttttcttgacaatgacatcattatcattataaagtagaaataaaaagaaaaatgtccttcagtcaagggctccagtgaatcagttttataacacatctaaatgtatacagactttaaagaaaagaaaacacgatatagaatcccaaaaccaattccagtccggtaatccagtttgcctatttctttttccaaatttcccaacaaataaagattctgtcctgtcagctgccaaagtggccggcaaaggacaaaactggtcatttgacatgatgtagagaagtgattgatgatatctcatcagctccctccactgcaaccatctggcctgtggattagacgccattcataccttgcttcatttacacatgtgaaggactccttgaagaaccgaatattaaacatcttattgagaaactcagtgaatacatacggtcaggaaaaatgaggtaacttttgaaggacttcccacttctatacctctatgattcctaattttcatgtcatgtattttaatgtctgaataaacagcaatgtaaaactgagctcatattcatagattttagtttccagttcactactgactttaatcaaaccatttaacctttctatgtccttggtttcaccatttctgaaacggatacatctttttaagactggaaacatgttcttaagtagggaacaagaaaaaaaaatgctctgagtgcatagatccatgatgatccctattaattctaactctgccagctcctatacttacacctgcctcacacctgacccatttcagccaggacagccttccttcacctgtccttggaaaatgatcacctaattcattttctggcccctaaattactggatattgaggtgaaggtgaagggaaactgtaacaaaacttatatgaatttctttatcatttattaaatataatctaaataatggtgtaaaactaaattattaagttgcatgaatgtgaatttataacatgcttattttaactcttacaccataattctgaaccatcatccccaagtacttatgactttctgtcttgatatataattattggtgaaattgcctcatcttctgttctgtatcaaaagcacatttagaggagatgcatttatctttctaaccagactctaagtggtacttaatatagttcccaagatacagcaagtacttaaaaattacttataaaattgaactatggaataatatgttttgttggtaacttaagctttcgaaaaatgtatacaggagtccaccctaatccacggggatatgttccaagactcccccagtggatgtctgaaactgcagatagtattgaaccctacatatatatttgttttcaatgctttttccgttgtaactgagcacttctcatgaactgtaacttttacagcctgtggtgcaactgcaaaacttgcaagaatttctttttccttcttcacagcttcagggacagaagattcattcttaccatagatcttagcaatctcagtatctttccttaagtaaagaattttcacattttcacttgaggaagcactttactgcttctctttggcatatatgaattgtctccatcactactgttgcactctagagccattattaagtaaaatatgcgtttcttgaatacaaaggactccaatattgccacagtcatctgagaactagcatggttactaagtgactagcaggcagggagcttagaaagtgtggagaccctggctggacaaagcgatgagtcatgggctgggcaggaaggagcggaacaatgaaagatttcatcacattacccaaaatcgtgcaatttaaaacttatgaattatttatttctggaatttcacatttaatattttcagacctaaaactacaaaaagcaaaaattggatgaaggggaactgctgtgtttaatttttagtgtgggttttaaaaaattatctacctggttcttttccatatttgataacaaacatcttttcccttcatataaggactgtgcatatctggaagttaagcaacttcatgatagtaacagcttacatttgcatttgttcttaacttatttcttccaaacaacaacattataagataagcagaacaaggatcacgatctcgattttatagatggggaaattagcttaagttcacaaagctcaaaagtgccagaaccaggactttaatagcatatttaggattcttcatatttaggaatagtcaaccccaattacttccttcaactacaaaaatttgaatttaataaatactgtctcttacaaatgttagttatccccagtctcatttattcctaatatcaaagtatctgaggtcctcccctgcttcctcctccctcccttccttacgttctttgtccttcctctttccttccttcctttcttccttccacaaatatcccagctcctttgcagttcacatcaaaatttgtattcattttcttgggctgccattaaaaaaattacacaaacttagtggcttaaaacagaaatttactgcctcactcattctcaagtctagaagtctaaagtaaaggtgtcaaccttgtcatattccctctgaaatctgtaggggagaattctttgttgtctcttctaggttctggcaatccttgttatcctctggctggttgatgcatcactccaatcactgtctgcatagtcataaggctatcttttcatttttttcccctttctttttggagacaaggcgtcactctgttgcccaagctggagtgcagtggtgtaatcatggcttactgcagcttccatctctcaggctcaagcaatcctcccgcctcagcctcccaagtagctaggattacaggcacacaccagcacaccaatctaattttggtatgtgttgtagagatggggttttgccctattgcccgggctggtcttgaactcctgagttcaaacaatccacaccacttggcctcccaaagtgctgggattacaggcgtaagtcatcgtacctggcctggctgtcctttcttatgtatcttcccatcatatttcctctgtgttctactccctataactcagtgcttctgtcatctaccaaccccagggggttgccaccacaccctctacccagattcagtgagaatttaacatctaattctctatgtcttcaactccactcaattttttacaccagtcttagtgacttcaacagactcttggctcatttagcatctgcctctttttactcaccatctcaccaccaataattcttgttcttccaccccactgcagccaccatcacccttggttatagtcttgactttaccatgattatcgcactatctctaaaagctttatttcaaacataccactccaatctttacctctgacaacattccactttccaagaattatctgaccttcctgaaaccatcaatccatggagcgtatcactggtgttttcagtagtcatctcattctcctatgctgacgtccctcagatcagcttccatgatacactattatgacttcttcacaacatccttaattccctactcttctctcactccaactttattgcccaagcaaaactaatccacttaaacttatctctttacatcttatttgcctgaacccaagcagttaaaagtggatggagaacaatccactattatgttcactgctctcatgttcaattcttgactgcaagcatcaagtagaaaataaatactgcctaacaatcctactatacttattattttcattatcctactttacagaaaatctattcatactttcacctgttcttcaaacttttacagcctgttttcctctcaccctcagttggtaatcctgcctcatactcttattgagaaaattaaaaccatccattggaagagggaacttattttttgttccgccacccaatgtgccacctctgtctcaccacctattctaaaccttatattatcaatcctattccctctcaccaaaagaatccctttatacaagtaattatcctgtctatgtctttcaactctagtttccccactgcaactcttcccttaatatatgtacctgctctgttatccctctccagctacttccctattttctgttcccctttacaggaaaacttttctccagcatttcccaatgccattgtcttacttcctcacattctattttcttctcaaaccatttttattaggcttctttccccaatggctattgtcaagctcacactttttcaatgttactaagttaaaagaaatctttatgccctcaactaccctcccaacagcagacaagaaagttgactatatacacatccttcctcctcccttggtttcttggctatcttctcctcttcttaatgcctaaagtcctcagtcccttgttgagctacgctgtctttaagtaatcttactcagtcccaagactttaaataacatctttatgtcaataattcctcaatttctatctccagctacggcttctttacagacatccaaaagtttactttcagctgcctacgtggtatctttactgtgctatctaatagtgatttcaaactgaatgccattacatattaaatttgtgttccccacacctcttactttttttgtttaccaaagttcagtcccacctctttgatttgctttcatttttcctcaaaagcccctagcagacttcttatgatcttctagatttcagttcaaatgtcacctctacagggaggccttctctgactaccatgtgaaaaaagaccctactagccattctgcatcacattttcttggtttatttttacaaaagctcatgatattatctgaaattactgtatattaaagaaattttttttactattgttcctccattagaatgcaattttattgactgcagaattcttttctgtcttgtttgaaaatgtgtttacaacatctagaccagtgcttagcacattaggaaaaaattaatattttagatttaaaaaaagagagtaaattcctgtgttttaaagaagactaaaataacatattgtcaaagagataaatcactgaagtcaaacaataggtggtagccattattaataatttaatacctaatattaattgcatacttgccacatgctggaactattaaaaaggatgaatctgtagtattttcttcaaccacacaacaatcctgtaatgtaagtatgatttctatccccacttttacaatgagaaaactgaaacaaaaaatgtttaagttatttgccaaggtcaaaactagtaagtggcagagctaggctgtgaacattagcactctaattccagagtctatactcttaaccacaaatctatgctgtccttccactacaatcagactaaatattaattatctgttactcatcatcaataaatattataaaggacagaggttatcagtctactgctgtttctgaatttatctgaggtttggggagattttatgtttccaagataacattcattttgttgtgatctcatgatacattagcatctagttttcttaaaatctgttatacttctacttttcttatttgtattcttatttacatttttttattttactcttacattaaaatgttgttaaaataatttgtttaaaataaaacccaaaatattttaaaatgtggaaaaatgtttaaaatttaccaatattcaaacaaatacaaattaaacgaatcacacaaaagtttcacctaattgtttatttaaaaaataatttttattaacacttgaaagggtatcattttatacatactcatacagctgctagcagctatattaattagtagtactatgtagacatcaacttgaaaatatttcaaatccttaaagtagtcatacctaccattgatgattcccttctaggatcctataatattgtgatcttaagcataaaggatgcttaagttttgtttcttactgtccagtcttggaatgaaaggggtgatgggcactaattttcatgagctacatacaaatttttctctgcaaatgtttttatctctttcagaaaagacagagccttaagcataccaatgtctggagtctgggttgcaagtaaactttagctttaaaatgtagcaaaaatcaagagtcattttggttggcacacccaaggaagaagtatgttttgcttcatttaatttgtatgtgggagaaaaatgtgttgagtcaaaagtagttacactcacggaccctttcttctctgagtaccaggaagaaaaaaaaaagaaaatgtacacacacatgctagtgcatatgcacatgcacacacatgacaacccatacttcaaagtaaaggcaggctaggataaaataattctttgagaatctggtctgccagagtggtttgttcttggggtgagggtgagaaggctgggataatataaaagtttccatcacataatgagacagctgcagttagtattacatttactcattctagataacaacctgagatttatccattcacgacaataatctgaggtttatgaatgttccatccaagataacaacctgaggtccaaccttactcttccttttctcccagggcagaaaaaattaggaaccatgcacgctgtcaagccattctccagaaagaaacgctattatcagcactgagttaaaaggaagtcacatccacatcaaagggaactacatccagatgcctgcccgttctgttacctagaatcagtgttaggaagatgaggcaaacggttaaactggttccatttccattttgctccttctgtctttgcaccccaaaatggtccccttttccttttttaaaacatatttttaaagacacttaattcagttgaagcatgcaaacgagaacggcagaaccaaaatgcactatatatcattgagccaacactctcaagtgtatttccagcacaatgctttaagcaaataaaaaaaaattgtgctgaaacattgttcttaataactgactactaaaaaacaaggtaaatgtatgataataagagagaggcttgaatacattttgatatctccactcacaaggaatgttacgccgtgacttaaaactgaagttaatatgaatataaagaaatgcttttgataggacaagaaaacaaatatcaaattatatatgactaaaagtatttagggaaagattacctcgtgcacaggaaagaaatgtactacatcaatattacgtggatgacttgagtgggatgactatgtatctttggggtcatcttttgattttagttttttgtatgttttaaatcttctgtaataatcatgaaaaataatttaaaaatcaaatcggggaaataaagcataataaaagttaacacttttattacactaaggttacactaaaagttaacaggaatgaacattttgtggtgaacggtaacacacgttacccctagagatctgtaaggggaactgaatgcctttcttctttgaactgtggagaagtttaaatttttaccccagcactcctcaatatttggcatagagaaatatctgaaagaagtcccgcaaagctctcaggtcactgtggtacaaggagtcagattagtatagcttgaattctggggaccccattgcttatgccatggttttcacctacaatcatcaatcaacaaacacactgaagaaattggcataaagagtcccatctcctttttcgaatctctggtcttaatttctagttaaagacagcataatcctaaacatacaaaatgtaaatttgttaattccagatcacccttacacagaactccagccatatatagtacgattgaacttttcttgtattctcaggcgaaatttagatttagctacttcatcagattaaaaaagaaaaggcagcaagcagacattaaaaaagtttaaaatcaggtgaataagcacatgaaattcatacagctggtataaatagtacactcaatcctaccaagtatgtaaatcgaggagccaatatctcagcatttccttaatatgaacacacaccaggtcacatttccaaacaatttcaccattgccatattttatttcaaaccatccttaaaagactgatcaacagcaaactcactgaagatcagaaaactcttcacagtggctgaatgattcccacaaggtcagagagcaagggatctatggcatagagcaaaattatccccaggcttatcctgtatcttgggaaatgtacttattttaattaacaaatagtaaatacacattctactattttgctggcaattttcacacgaccttttcattaggcatggtaatgtttctataaattttaacatgctacaatttttcatgtcagtcttaaagaatttcataaagattaagatctaccgggtgagtcaattctgtgtaggtacactgagttgtaagttggaggataaagttttgggagagaagtaaaagtgctgggggctttgaggggttgaggtggaggagaaccagcagagagaggtgaggaataaaacatgggggggaggaggaagtgcagtcagggctccatccatgatcgcctcctatataaatcaggcctggagttgacatgtaattttgtgtgggtcccctgagaagtggccctcagggattaattattgatgaagagatttttcttcaaagtggctcagtcaagagtgcctcaaggggacattcataagtgcttataatatcaatttccaagcacctgggaggtagggacacagattgtctctttaattattatgatggaggtaaagtctagcaaaaatgctgttacacagccaaggtaaaattctcaaagaaatgaaattattatagctagtataaaaagtgtaatatatgagtcatctctcagtaagatcacactttaccttttcctggtgcaaaataggttatctccaaccaactgtttcctaggagctaaaagagttattcataagcaaatgcagtgtgtttagggatgcttaaaagtttagaaaaaaattgtttttgaagctaatatgtttgcttagaaagaagatgagtttactccagttagcacatggaaatacaagggtttgttttaattatgtaggaatttcttttcagaaaaaaattaatgtcaaatgccttctacatttctatgagaatgccaaaaaataattttcacctatgcattagccctgatctagtctcaaaaacactcagaaaaacacagaagaatcaatccatatgtatgttgcagtaaaaaaaggatggggctagcctggatttgaatcttattaacctacgtaatagatgtgaatagtcatgtataaacaaaacctaggccatatacttcctttgtaccatctgaaacttacaccagtgggctcgcagtacaacaggtactaaaaacatatttttagacagaaatgaaatgaaatgggtctctttaaattgatctgaatttcagaaactccccaatctccctcataatattgacaaatgttaattcagtaactttttcacaatagatatatgcaacatttataaatctataatgcacctctttcataatcttttaacttcattaactcctccctttctcatagattctaacagacttcaataccactagttgattactagagcaaaaacaaattcttgccaattgatgtttatataatgtacatgatagacgcagtaataacatttaaaataagtgtaaccaattaaaaaagcatatatttatgtgacaaatgctgtctgaagcattttgtgtatgtgactccaattaatccttatagctattgcatgaaatacataggattaaattcaattcacagaagaagaaatggcagtccaagaaagaagctgaccacagtcacacaaataaaataaaatagtgccaggattctaacccaggtctgtttaaatacaatgttttctttttgtactaaccatgaaaggaagcttgatttggggagatacaaaataaataacttcatataaaagtacttaattcctcaatacatataaatatatatgtattcatggtgaactggctaaaagttatatgttgagtttgaatgcagatgtttcatatgtactagtgtaacattttaattaaaagcaatggaagcagtaataattataaaccacaggaaagacataatcctattaagagttatctcagtagtataattggctccaggatatcagtgaacacccacatgactgatatttgaggccaaaaacaccttctgtcttgatatggaggattatgagcaaatgaagtccagaaggtaaatatgtcacattttaaaatcaaagtcccaattatagataaaggtgtaatcttacaatgccttattaaatatttttaattaaggtggaatataaacaaaataaaattttctttacagttttaaggactgaagggctctgcaacatatttgtcatgcattcatacagctgagaggcagaaaaataaattggccaatcctccattttgatctcctctttagctgtattgaagcctggattatatcaaatctcatcagattttctttgtcatgatattttacgacaatcttttttcagtctcattgtcttctagttttagtgttccaaactattacttacatttacgctaattattagaattctcccacagtgatcagacatctttattttactaggggttccagctttcagcccttgtgttgttgccagtttatacagagtttggtaagatgctgtattcaaatagttaaagaaaggtatgattgcttaaagatcttccataactgaatcagtattttgactctagatcttcttagtgtccttatcaattccttactgttaatattcatctttttttattattatactttaagttttagggtacatgtgtacaacgtgcaggttagttacatatatatacatgtgccatgttggtgtgctgcacccagtaactcgtcatttaacattaggtatatctccaaatgctatccctcctcccgaccccacaacaggccccggtgtgtgatgttccccttcctgtgttcatgtgttcttattgctcaattcccacctatgagtgagaacatgcggtgtttggttttttgtccttgtgatagtttgctgagaatgatggtttccagcttcatccatgtccctacaaaggatatgaactcataatctttttaaaagtgaatttttcttctagaatgtaacaaaggaggctaccaaattccagcacactttacaattaagcaatcagtcaacaccatttgctatcattaagattaagcagatccaatctaaaaatcaccctccatcaagatccatcattagtcattaatctcccagattttaattaaactaccaaaactattcatctgaattcatatgcaaaggatagaatttttctttaaactgcccacaactttggtgggccaagctgaaaggttcgcttgagcccaagagtacaaggccagcccgggcaatatactgagacccccatctctattttaaaaaactgcactgaaacacatatcaacacactcaactacagaaatatgcagtaccttaaaactacaggaagctaccattagaatcagtgactcctcaaatcagataatcagacacatttctactatccagctaaactccttagaaaggagaaacactttaaagtaaaactatggcccacaaaacagcttaaagtaggaagtacaagcatgttttcaacaactctaactcacaaaatagttttaaaaagttaaagctttaaaagtcttaatttatttaagaatatatttccaaaagatctgcagtgcccagtcaataaaaggaaggagaaaagaaatgactgatgcttacacattcagtaaaaatatatccatttaaatcaataaacaactcatggctttgtataaagtggaatctttattatcttttttggatccatgattctccttcctccccagcagcaaaggcaattatgataaaagatgttctgaaaatttttttgccatctctgccaatttataacccatgactttccttgtttcaaaatttgtaaagtccactttctccaagtctttcccattatgcttctattttccaaattcgctatttttaatctcattttcctagttaatcatacagaaaattcccaattaccttttcaaatgaatagaagtcacagtatcagtaattccgaaaccatttctgtttgacttaaaatgcatttgattttgtggacaatggactaaaatccctttttcatttagggtaaatgtgaattaagtttataaccctttaacattcactaactgatcattcaaggaatgggccttgtgattgtgactgtggtagcagtacagtaacagatagcaacttggtttggctacaaatatatatcaaaagtactagtattcaaatagttaaaagcttgctgcagctgcatacatttcgtttagatatatatactttcaaagtctattctcattatccttgccggtggaggggaacaaggtcttgaacaaaagagtactgtttcaaaataattctcatttcctttcaagtgtgcagatattcacaatatactggctgtaaattcaatctaaatgaagaagtgctgttaagttactgctgaggcctgggaaagtgaccaatgtccaatactaaccttctttgaaaccatcccaggagagtttgtattaaagtcatcgttgacaaaattcagactgtatccaaacagtacactcacaaagcaaaataacttctaaaagcatataactactattaacggactttaaaatgctaatcatttcattggaagtgattttcctgagaataagatatatttttctgttatctttattttttaacatttttgtcctttttcccaacaagatgctgtcaacttgtgacatttgtttattatccttagcagattttccatgtgcaattcagagaggctaacttgcccaaacacacagcttaaagttagacctcaatcagaggcagttggtttcagaagccaggctctgaaccacattaatatatctgaaaaaaaacatgatttctcatgcaacttctatgattacaacaacaacaacaacaattctgagtaatgagctaggtcctattaccaagtaacacatcctttccttgcctatctcccagcccagggatattccagctatggagtttggtgatctgattgttttccatgttcctaaccgtcaaatcctgatgtgatattggattcagactagaaattatgaagcaggcacacaaagcacctttatatatacctcaataacttttcccccagaaacaaagatatttcttggctgtttcactgaaacctgaggttctgtagttagctcatagggaaaagtcagtcactattagagtaggttgttatcatcaccttctgttcttttaacaattgtcaagtacttttcacatttatcaatgtgttcttatcacattcattaactgcttcataccaatatttttaaaatattacttgcttatccatgtatttgaagctaaaacaatgatcacaatcagatctctagacaatggttgtaatgaatttgttcaagaaaagcattcaaatttgatggaaaactgagcctttataattcattctaattcttcaacacaaaaatgaactttggtaaatcaataggatcaactgaggcatttatgcttgaatgtgctcccctaagcttaatgtatttttcctcactgcattatattttaatgattaatttcatgctctttcatggtattctagctcatgaatcacgggtattactttgagggaaaagtaaggtgctgtgagtgatgaaagatgttactgattaaagtgttgcacatatgaactacataagagctgaaggtgtttgaacaccagcaatctagattaaaagtaatattaggcaaactggccatatagactaaggttgaattgagtggagggagtgggaaggatgggcttcttaaatgttcttagttgaaacaatatatgaaatcaagcttggcattcaatgtttcactggcatctttctcctcagtagaatgtaagaactgatttcgaagacaactgcagagaaagaaatcagttaagcagataacacaccattctgaaattaaagagccaaaagccacccatcctaagtcaactccgatatcttaaatcaatactgccttaatactgtcagaagcttgtttttcgacttagtaaataaaattttttaaaaagttaagtcaaagtcacaaggaccaaaaaggaatagactaccctaaatgaaatatagaaaaagacaagtatctattatcctgcacacagatgaacaactatttgttaaatatatcatattgctcaatatcaaaaagtcaactctccaaaacagaaaccaaaagtaaactaaccagagatgtccacataatacactttggctcttgttactaaaatgatttttcaaaccaagttatggagcctggagaaaacaggactacttcctcccagaatataaagtttcttcaattacggaggcaaaatgtggcaaaagcagctattttgcaaacaggtggtttgcaaaacttttacttaagccgccaaaaggactgacgaaaggaaaattttgttatttctaaagaaaacacacacacacataattttctaccagagtagaagactcaaataaagaaaagccccaaacaaaacagaaaactaaaaatcagtttgtcttagctcaaaagtgctgacctaggtttagtatgtgtaaaatcactgttgataattaaatccttttcatcgcatatattaagatactagagagaaaggaaatgccatgtcgtttcaggtaggaccttatttacataaaaaaagattttttttaacagaaacggagtgcaagagggaatcaaaaaccgttgagaggagagaaaaatacagttagtttttctgagggcactgcatttttcatgttctgaatacttcgttccattctctccatgttaaattatttcataaacaatactatgactagaggcgactgctacagctgacacacagatgttttatttctatgcttcacctttgcaaatagcaggattcagctattggaaatgggggcagtggaggtgtccagaaacgacatacaggaggtgaaggggtagaacgtgtgggaaatgggcactcctaccccctagagtccacctctctggaactccagtgcttcttcagtcactgacattcagaggaggacaagacaggcttcctgaaatctcttccgaagtaaacaggtcccgacgcaaagggcaacccctccagtagcggaaagtcctcccctgagctccccgcctgcccacgcgggcctgtggctccgcgctcctccgctcccccgcagagctcccacgggggaaactttcccgcgtctctcactctccggggtgcgggggccgcgggggcctccccggcacctacccgcagagcactccccaccaccccgccaccaccgacgagccggcgcgaagtccgtacctcgatgtccgccgagtccttactgagcacaggggccatggcagtgcctacagtctcgagtctgccagtgacaaaccctccttgcgtcctcaagctccagccagagagccaagtgacagcagccggagcgcgagtcgaaaacaggcagactagggccggcggcgcgggggcggagc

SEQ ID NO: 2197 - DNA, 110 bp, Homo sapiens
tttgagactcgtcctaaaggcagaggcagggaagacagcgctgaagaggcgtcccaaagagattggacgtctgaacagtcactgcctgccccaacctctttcaggaaggt

SEQ ID NO: 2198 - DNA, 103 bp, Homo sapiens
ctgccgctggtactctcctcgactacgcgtattcttaagcaataacaacgtaatccgtattatccacccaagaatacccgtcaccgaagagagtcagaggacc

SEQ ID NO: 2199 - DNA, 61695 bp, Homo sapiens
taaataagataaatttattatctcacagttctagagaataatgtccaagattacagtaccagcaaagtagatttcactctgaagcctcttctgttttctcataggtggttgttatctcactgtgtactcacatgacctctttgtgtgcctgtggggtaagagggagagagggcaagctctctggtgttttctcttttcagggtactaatcaggaaggccccacactcttgacctcatctaaacctagttatctcccaaaggccccatctccaaataccatcatattagagattaggcttcaacatttgattttggggggacacgattcagtccaaagcaggtgcccttcctcaagacagtttatgtccatctgtaggcaatttgtcataataaactaattttaacagaacagggtgttccactgttatctgccagaaaatggttgtaataaatacttaaatctgcaaattgtaccatgtgaatgctcctctggagttacacagtaagcaacctgaacaattattcaccgtagtccaggttaatccttccttgtcctcaactgacaatttttatgtatggtaaggaaaataaatgcttcaaaaatctgttaaatcagaaatcagaggtttagataagtaaactatttactccaaaattattacaaagaaagaccatcttaataagtaaagaatgtagtatatggtttcaatttgacaagacacaatagtgtgtgactaaaaaactgggctataaatagagctttttgctaagtttgagtacagtaattattaagaaaatccgttatttaataaaagcagctgagaacctgtcagattcaaaatcacaaggttgaaattgactaaataggtccatatgtttgtaatcctgtttccagaaaggaccttccttaaatcgcccaaaataaatgaataccttgttaaatacagatgaacaattcatactataaaatatcttccctaaatttaatttcaatccatggtacttaaaatttaacttcgtttctcttgttctgtcaatgtctgaataaatgttgcagcaaatatgaagtgcctagaatgtggcaggaactctgtagatggcaaaacaaaaattaattcatgtagaacccttcttattaatgtatttagaatacttttcaggcttccttcttttctggcaagttacacttttaactttgtacaagcaaatatgaatcatcaactagttgattatacagtctgaaattttcttcttcaaatatgaatacagcagatcataatcttaggtttctattacaacacatactgcagacatgcaagatttaacaagaaagtagtaacaatgtaaatagcattgctttcaaatctacagaaaatggctttctaagatttgtgccaatcattcatttttaaaaattgggaatgctggccaggcgtggtggctcacgcctataatcccagcattttgggaggctgaggcaggggaatagcttgaatcctggatgcagaggctgtggtgagtcaagatcacgtcattgcactccagcctgggcaataagagcgaaacaccatctaaaaaaaaaaaaaaaaagttgggaatgcctagatttaataatttgaggaaattttttaaaaagaaaatgagcagtgccttttcatcaccatgggctccttttacctattctctttttcttaattatttcatatcttctaatcttttctcaatattttacaataattctttttccattcagcttatctacacataaaagtataacacataagaatttcccacaattatcttttctttctttccttcagattatttcctttgtcatagattattttagatatattagagaacttaatgtgtttggattacttcaagaataattgtacattggcccaattctgtattgactggttttcttcagttttatgtagtcctactaaaagcagatttttaaattttagttcttaacatttcatgtgcagaatatttgtgctatttcatggtagttttatttttaattatgttggcgtattttgtgtatttccagttttaaaattgtatagaaaaaaggatcctcaaccactgcactatgagagtaggaggggtgctcttattttcctggctcttcgtcacagccttccctcaggaatggaaatcatggtggcataactggagagcagctcatcaggcacacaagcttagggaatccaagggaagaatgcactggttaattgtgggtcagcatagaaaagaacatgatcatgtcctttgcagggacatggatggaactggaggctattatccttagcaaacaaactcaggaacagaaaaccaaaagccacatgttctctcttataagtgggagctaaatgctgagaacacatggacacgtagagaggaacacacactggggcctttaagagggtggagggtgggaggaggcagaggatcaggaaaaataactcatgggtactcgacttaatacctgggtgatgaaataatctgtacaacaagccctcatgaaacaagtttacctatgcaaaacaaacctgtacttgtacccctgaacttaaaataaaagttaaaaaaagaaatatgataattttcttaattgcatggaaatgtagtaagaacaaaaattcttaaaaacgactaaaatttatacttctatagcaattaacataaacattttttaaaccattcatcagtttattttcacatacccccaaaagattcaaaaagcgttagtcacacttaaatgatttgatttttttaagtgaatcaaacaacttttttttttttcctgattgcatgaactgaccaggtgtttgatgacttttagcagatgttgacaatatattgatattactaatgccaacacttttttttattttttatttttttgagatggagtcttgctctgttgcccaggctggagtgcagtggtgtgattttggctcactgcaagctccgcctcccgggttcacgccattctcctacctcagcctcccgagtagctgggactacaggtgcccaccaccacgcccagctaattttttgtatttttagtagagacggggtttcactgtgttagccaggatggtctcgatctcctgacctcgtgatccaccctcctcagcctcccaaagtgctgggattacaggcgtgagccaccgcgcccagcctactaatgccaacacttttgataaaatgttgaactgaggttattataaactcacctttcaatttctcattaaatatgaaagttcatacttatttccttgtttcttgaaaatattctttcaaactatgccaactctctcgaagtggaagaaaaaagcaaatttacttccttgactttaccagatgccatgttattcaaaagttgtttttctttttgttttattttgttttcagggaaaaacccatcaatctaagcagtgaaaaaatggaaagactccatgatgttttttaagtatagctacaacataaatgagagttattaatctgcagcacaccaatccaactcctaaattacataataaacaggttttctgtcacatatagcctcttctctttgttaacaccattataatactgctaatatctataacttggaaaacgaggcatacaaggttaggatgtctctgataaacaaaaaagcttttaagatggggccttcattgtttgtgaagagctaatcattcaacaattaaatgtttgacaagtttgacaacctaaaactagacaacgaaattgctgcttaaaataatagaaaacatccttttaggggaaattggtaaacctcttctaggggaaataagacccattttcatgtcagctgagttttaagttgccattaaagtgataatataaagggaaaataaacggattttgattacatatttaacgttaattcaagtgcctcttgatatctccccaaattagtttgttaaaaataaaattgcctgttgacaatctatttttataaacatttaggttatctgtaacttaattgtagtttttacttaagccataacaaatagtgtttgtagtacaaatgtcatttatatcccaaaatttacttagatttaaaaatattttttaccgatttatttgctgtttcttcctgaatcatattccttctttcttgatttatttatttcttaatgaaatatgtcctttagtattttttcaagtgaaagtaggaaattctgtgtcattgtgcatctttaaacttctttattccaccttctctcttaaatgtttaacttttcactgagatttatcttgtcagcacattgaagttactccttcattctcttttggtctttcctaatgctgatgaggtcttctatccacctgattgttcctttgtaaattaccttttatctctatttgatttcaaaattctctctttgtccttgatgttctgcaattccactacaaagtgactaggtataatttgggggtttttgtctatttaaattttcaaaataattactcattgctttcttcagttttcaagaaaggtttcagccatcatttcaaatatttcctcttccctatcaataatattatttgttactggaattattagacatatgccagggcttcttgatatttttttccatgccttttaaatttcctttaatatttttcttttctttttctctctctgttgcatttttgtatgctttgatctacctattcacttatttttctcttcatctacatctagtctacatactctctattattgttttatttcaattatttgtgattttatttgactgaaatctctttttggcttacactagtgggagcagggaacacaggattctatagtgttctgaagagataatgctataagtgattcgaaagagcaaatgcctctgataagactgtaagatgcacgagagaaaggatgtttcattatctaggtagccctactacccagtaaacagcctggaaaatagtatgttctcaataaatgtttacagtaatggattaaatataaaccaagtaaatgttaaacttcacaacgatataccttaatattaatatgttgtctttagtaattgtcagtagttcaagtacagtaattctcaaaccagagatattaaaaatcacctccggagaacactaaagtgtagatccataggtcccaccatagagtttctgattaattaggtctgagatctaaatatccgtattttcacaacatgtgaagtcacataaactataaattttgattctgagagccaaagaagtaccttgaaagaaatactgtctgagtgcaatcagatttagaaatggcaatgatagaaaggtaaagcaaagattcctctacatgacttggtcagcagatgggacaggaagagactgacaggaaggaaaagctatggaatgaaggagcaaaagttaaataataggagggaagtttgagaagttctgatgctgtcttggaatcctcctgttctaaaacaaagctaccttgttttaaaaatacacaagtaataaatatttagtcatttgctctagtaaattatatgcattttgcagcatatacttttttaacttcttcacatgggttcttttactaattaaagctaattggaaataggtagaaaaggttaatattgggtctgtttccttgtggatctattttttaagatttgcatttaattctgtgggatgatagaatgataatgtaatgtaatttagcttaatatctattttgtgttagatgacagttttattaagcagaaccaataatcatcgttattcagagtcataatggcccattataaatggtctcattttccctaattttaattttacctcttagagtatgcctagaattgttaaaatggttacgcttggtttctttcataaatatcattttaacaatcagtatggaaacataagtcatctagtagttaagtcccactattctacagatttgatacaaaactattttagtgtcttggtttctcttaattaaactttcagactaacaaatttcaggaaattaaattaccatcctttatgtatcagagccttaacatcgagatgaataggcttttgtttctgggataccacctttctgactcttgtgtttcttaggatagtgatgaacagagtagacaaaagaaggacttgtccccaacaggctgcagaataattagattcacaattctctcttaaaaaaatctcaacaaactaaggtggttttatgttcataaggcattttttcttttcttttcttttcttttctttttttttctgagatggggcctctttctgttgcctgggctagagagaagtggcgtgatctctgttcactgcaacctctgcctcccaggtttaagcgatcctcccacctcagcatcccaagtagctgggactacaggcgtgcaacaccatgccctgctaatgtttgtagttttttgtagagacagggtttcaccacattgcccaggctgaactcaaactcctgagctcaggccatcagcctgcctttgctgggattacaggcatcagccaacacacctggccttatcaggcatttttttcttaaggtgaataaatttagggaacagtcagattattttctgtcccaacaattgcaacaagagacgggaatttatagaagggagtaaatggagttatttgggtcataaatacatcagtggagagagggccttagaagttccctcattttaaggctcttttgagtgacatcaaatatctgtttaaggttgcacagtttattgagcattctcacttacatcctttcatataggcctacaccattcctttcaggggaagatcactattattctaaacttacaccgagaggactaagtgtagagaaattaactcacatccaagccagttacctggtttgagtggaggcaaagcgtaagcttttttcacaacatcagagtttttacagtcagaacacatcccagaggctttggatgcctgggaaaagaggcaaaaggtcaaacaagttcaaaaaatggaggttgaaggtcatctcaaatacaaactttaccagctttatattattgtccagggaccagcatgcaacaattgcttagaattcaaggaaagtcaactcctttcagcttctgtcatgggcactataggtggctcctgttgcttttgagtaataattctatttcatctatacatgattaaatagaactctcttctataaaatttgtgcctggatgaaccaaagatgcattttcaagcattcaagaatatgcaggaaaaaatcagatccactcatggatacgaacgtgaattataacctatgatgctattatgtaatttgatattttactttacaccattcaattatttattcaataagtaatcagtaagtgccagaactgtgttatgcactgatatcactgagaaaaaatatatagtctctgcccatataaagctcatactctggttgggcaagaaagcattgacaatacaacatggtcaataagatagaatttttagtaggccatgggaatgtggaagaaaagactttaaggcaagctttcgttatcttttgaaatgattgtttcaccatgattcatttacatgcatgcatatcagtgattgaaagtatctatgtatgtatgcagctgtactcgcacactttttaaaataacattcccaagttaaacagagaatccccataaagaatagtaaattagaagtgctttgattggccttggagtatgtagtttaacttcatagatattggactatctttaatatagggatcatgataagccacgctgagaatcgcatttaaaaagtcttggataaattaatgaaagaaatactttaatttttaacccaacagatgtttactttctgggttataaccatctcttaaaaccttagcatgactggaaagctgtaactacccatgaattctgccagtttagtaaagtctttaagataaagctaaaataactgagaaaatagaatatttctgacaatatgttctgaatatataaagctcttggtcaaaaatcatggtcatataaaaatccatgttctgccccttgagtttttaggtcaagtatttatacccatttattaatataaataatacaaattacataaattctagccaagctgtttggttatatttttgttatctttattttaaataaaaaagatcatggacttaagagtaagtctttgcaaccaaattcaatctttgccatctttgacgccggacaaatttttactccaagatttaatttgttatctagaaaataaagaaaatactaccacatagttctactgttagaactgagtccaacatgaggagtggtatagtacctgacacagcataacttcaatatcattgatagttcctcttcatgattgactacaaagcctatgctaggtcatgctttcgtcatttaaaagcattaaacactaaaaaacatcttttcacgacattccaccagaggcattgagtcaaaaagcttaatgatttctattcaacttacttatcttgtggggaaatcaaactcacctgccagcaattgggctggtccatgtgaagagaccactcaaaatattacgtggattgtgtttttccatgaagagttgagactgaccacgcatttttacatattttctcatagttatagtactgagtgatgtctcacattctatttgtaatgcacatgctggagtcagtacattaagcaggaattggggacgttttctcaaattcattaaattataaaagcatctgatgttaaaaattgattaaatatagattcatggatatcacatggatagcttagattagtttgtcagagattggtgtcgatatatcaggcctgagattcactctcccccattcaccaattacaatctaattggtttttcactcactgggttttttgttttgttttgttttaggctcactgactgactgcagctgtaacttcaacttgccaatgtacaccattgctcacaagaggaccagctgagagtgtgaatgaatttattgccagccttttcctactcctaaaacaaagcaattctgtagatttgttactgatgagtcatagcaccatcttcatatacaaataacaacatttcatatggcactattttcaatgtaaatgatagcagagatcatgaggagatagtacaaattatcttgggccattgtcttatttatagattaaagtacaattatgtttttcactgatttaccttctgacatcttagttaattaagttacttgtttcttttatgttcattctccccttagatctggcacgactattcttttctttaatattctttcccttgttaaattgttaattttttctgaggggcagaatacctttttatcattattttgagaatgctaagtatttacataattatccttcagagaacattggaagacaatactgttgaacaaatggataaatattagaaaaggattactggataattctgtcatttctggaagcctcagtgattgatttattctctttttaccttaacatatttttcctctaggttactatttttttcctgacaggttttcaagcttataattggtcattttctctgtttaaaaaaatattctgggagtgcgcaagcgctcagaaaaatattatctattagcaaactcattaatttaagaacctattaataaatttgctcattcatttagaatgaaaaatatctaatacagtatttatatttatatttattttttatatttatatttacatttattttatattttatatttatggcttttagtcaatatataacttcaaaagagaatttcaaatcaaatcttatgccagtccaaaaatcaaataactgatataaacaaaagagtataggcccaacacaaaacagtaagacagagataatttgttagtttagttaggtagtcgattagtcatctatcatacaattactgaaagtctactttgtgccaggaatttcttcagatacaaagatgaataagtcatagtacatcccctccaaaaacacctattctagcaagaaaggtgctacgtaaatgcagaaaagaatatcaacaatacaatgtggtcagatctattatagaggtatgtagagtcactgagagaccatctagcctaatggataatacaatctggcagacaatgtatgctatttctgttttgatttggaatgcattctaattgttgccaagcaattttgttttattaacttttgtgttaaattggctaatatttaaattactttaattcctcatatacatacaattaagaggtagaatgaatgatacactttgatgaatgaaagggtcacataagattaacatttgtaaaaaattaatttgaaaaatagaattcaatcctaaaatggaacagtgactgcaaaactagtgactgcaaacttagaaccatgttcctggaaacttagtagcataagcctggcattgacaatctgattcatggttctcttactatctactcacattgctcctttaggggaaatttgacaatgatgtctggaaaatgtattgctactttcaaagattcttgctaacatttgagcaaagtggaaagcagttctggcattttggataaatgttccccaaatcttccttgccagatatttcattaagtaggaaacctcactagggtaatatgggaaagcaatttaaatagaagtttggttcacaacatgatgctttttgtaaataatattctgggaggtcttctgtgtttttgattaatttaattttaattttactgttgaagttgcgtgcctcgtcctgtcttttgtggccaataatatctccctgccacctgtaactcattttcaaaaagaaactgtaagtaagtatatgaaaacatcccataatttacatgagacttcaataaattactgttatttctaaaaggattacttattcattatgttcccacaaaaatattctctaaaaccccctctctaatttgatggtgcattttaatagcaatattatagcctttcttttaaatactatattattataattgtccctctgtaattctaattcttttgctaaaagtggacccctaagagcaggaattgtgtcttattcattgtgtacatctttgtatctctaactcagcaccaaacaaatacatgtgcttgattaatatttttggagaagtgaatgggatgactgaccaatgtttgatacttgctgacgtctacttattttctagtaaatatatatttcaatctaattgtcttagtttaatatcctcatttgttgaaactggatgaaaaggatcttgagtaattcttctctctatctcacttgcctttgttctggtgcatattttcattctttcttggttggacaacagaaatagccttcttactagctacttgacttaagaatcaccacctcactatgcctgacatcactcccaagtgatctttccagactcaaatctgcttatgtcacactcattctcagaattcttccatgcctgccctgccttccactgtgaatctacattccaatgttattttgcatagacatagtaccatatgtttgacaggtctccccatcttttcatttctgtcccccaagtatcttggatagtgttcattaaataagctgaataaatgctgtttgattgaacgaaggaaggtggctccagtagcccacttgtaccaaagtatgtgcaggagaattagttcatagaaatttccatcggagctctctgaaaatggagatgggtactgtagaaaagcatttctcacagatgatgcctgtgcataaaaattacctgagatgtgtttttaaaataaaagatttttggagtcagaatttccaaagtaagacatgggaatctttattttctaaagcaattgctataatttgttcagggagatttgggagagagctcttagaatagtagttaatatttggaggctagatggctactcagtgtgggaggctgaactatgtgaccctaaattcccttccatgaagttttgggtgctatgattctagtggaggtcatagtatataaatgtgtagaagcaggtgagtgctttgagacgtaactagtgcagataggagggatttgggggtaaatgactgagtccaagtgtcatcagatctagagagttatgaccaattttcaaggattctaataaaaatcttgctctaatccccgagtttaatcttttaacaactatttactgaatgcctactatgtgtcaggtacagttctaggtgttggggatatagcaatggcaaaacacacatactctctgcttttgttcaattggtttgtctagactcaccacacttgtctctaggactctcccgtggttaagagttattttcatagccacttgattcttacgctaactgaaaatgatcatcctcaaagtcccatcgttatccttgttaaaaaataagtgtcagcctgggcaacataggaagacctcatctctaggaaaaataaaaattttagctggatacatgctggcacatgcctgtagccccagctactcagggggctgaggcaggaagatcacttgagcccaggagttcgaggttacagtgagctatgattgtgccactgcacttcagtctgggaaacagagcaagaccctgtctcaaaagaaaagaaaaaagtgtctgagattttcagtctggctggaaactccaaaagtatcctatgtcctctgagggtgtaataggtgagttcagattatcagacactacttcttatcttgtgagatctatatatgtcattggccaaggttcattccagatctagccttgagtctctgacctaaatgtccccatcattttaagtacaatgacatgttatttcttattttcatcttttgaactgggcatttttgtgctcatcttgagaaacccacacatatttcaagctctgaaggtaagatggtcaagtggggataattgtgggctttggaaaccagattaactaaattttggctccacttactaactattgaaccatgaataaattacttaacctacccgagactcaattttatcagctgtaaaattgggataatagtccctatttcacaggttgtgaaattaaatgagatataagacagtgttatatattatagtgcctggtatttaatacttacacattaaaattactgtgtaatttatctgcataaaacagcacactaagagagagagttctgaggtaactaagataacttacaaatatgcacttatggtaatagagaagttttttttaaactttgttaacttttcagaacacctaatatttttatgaaatgtggtgagtgaaaatgatgaccccaagaaaggcaacgttttccactactactttttatacaaaaatccttcatcatagtcaagaattagatttcttgatatttcatttctatataaaactattcccattttaaagaacagattttgtacatacatacaataaaattgccacattttcataagaaaattcattcaaagacaaagtctactaaattaaatccaaggacaggacaagaccatattgaaataagttacatttaaaaatagaactttgcacatgcaaaaactgaaaacaaaataataagcatgtgtgttaggtttttttgttttttattctgttttttcttttcagtaaaaaagttttataagtgtgaatgcattagaaaactgaagaattttcaagagccaagaatgtcatggtgatttctgtgaacttatttctaaggactacaagaaacacactggttgctaaatgtgaattaggaaacatgaactcttgcatacacaacaaccccaaagaaaagcaaaagaaaagactatcttaattttgggtccaaattccacccatacctatagttgcaaaataaaacagagaaaaatggcctttattagcagtggcttaaatgtccatggggtggtgcaattgacttttaaaaatagaaagccaggctatcaaaataaatatcctttttctcttatttattggagtgagggatattttcactaatcactgtgctataaatttaagagacttagagcattttacagtttcttttattcgtcacctttccctgggatccttggaagatgactttatcaaacacaaacatattttttaaactggtagattaaaaagagaagttatttcttttgcttccaggggttttatgagccccacatttatgtatttatcactgtaatttggataattcccaacactaccatcaacaccaccatccaccatgtatattgtacagtaggatttcttaaatatttccatattatggcactcattgaaaatagtatttgtgtacacgctggggtaaaagagaagggtttgtccagcagacattggaagcaaaaggctgggccccacgcctaagctctgagagctgcaggaatcactattgttggcaaacctgcagcctgtttggaaacactggggtatattagcatgccaattggaaagctctgtgtttgatttcaaataatgcatattagtagtaaagagagaataatacccttcatcccatcccaaaaagaaggctgacaataccaagtgttagagacaatgtggataaatcattctactacacattgttagaggtaaattgacacaagtgttttcaaaaataattcaatattatcttgtaaagctgaattttcatgcattctacaatccagaaattcctcctcaagatatgtgcatatgtgtgtgtatgtgtatacatgtgtatgtataagaagacatgcaccagaagatatgtacaataatatttttagcagtactacttgtaatagcaaaataatgccaactctaattctcattgacaggaaaatggacaagtaaattgtgatatatttgcacacacacgcacacacacaacgctatatatatatatttttgaagtttccttgagcctaaagtttagcagaaagtatttccgtattttgtattgcatcttagctttctattgaaatagattgttttcaatgtctatgttgatctcaggcaagtatttgagccttaagtctcaagtaaaggcaattagcaaatgtgaacctgtttgtactgaattgggtttttccttttctgaaattgtcaatgaaaaatttggggttccaagtagcaaattaaattcctgagcaattttacctgcgtaaggtaattattcatggtttgagagaaaggaataagattgtatacctatgtaactgatatattttgtcttaagcatgttttcttttagagtttaaaatataatgcttaatgtttctcatctaacttgggtataataatgacaatcactaaaacagaatgcagcttgtcaagcaatttaactttagaaaggaatgtctttaaagaaattagaaaagcaggaaggagaggaagagattgatttattagtctcccttagtgtgttcaaaatttaacaattcttcctgtctagaaattgttatatgtagctttaatctcttctactacaatgcaacttcattttctctttttatgtcttggagggcagagggccccaagagtgtaagagaagttaaagaataaccagctctacaaccacaattgggtagtgttgacacgactataaaatgaaagctattccacttgttctatcacccttaaactttggaaatagtgtccaatagtggaaaattaaaaaaagaaaaaaataaagcttgccttgttttccacaggaaaaggatcatgagtctgtctctccatgatagattagatcaattgcatttctttcaaaatcttttaaaaacaaaagtgaagtctaaaagttttatgtcatcattgtgatatcagtaacgtgtgacacttaagcaattgattcctatgttcattttgctttattaataatcctttgtatattttctgacacattatcctgttcatactttcataatcacttcaattttgaagatagtctcatcgcaacatgtactcatgagggccagtttcatctgttggagattgagatcatgtatcaggaataccctttgagttttcgtgaccttaaaagcaatgtgaaattggatcacaattacagaaaaatacccagtctgtaactatttgtctcagacttcttaatggtagctcttgtacttgaaatgagttagagaagactgttcaacattaaatcttttctgtggaacttattgaagtacatttgaagtttattattctcttaaaagtcctaggaagttttagagaaaatgctggttccaagtatgtactgtctctcacatgacatttctaatgatcctcaataattgtacagggaatattttaaatatatcaatgtattcactatttatgaggcttttattgcaaacaatgaattgatttaaacatagtaaaatgtctagaaattattaaaaacaggaaatatacactattattattccaagttttggggaaaataaataaggcacattggtgttatgtcacttattaaccggcaattattattcttctcagatttttatgttttagttgttgttgttgttgtttaattttagagacagggtctggctctgtcacctaggctggagtacaaagatacgatcatagctcactgcagccttgaactcctagcctcaagcaatcctcccacctcagcctcccagacagttggaaatacaggtgtaaaccaccaggccccacagatctgtccaaattaatcattaaataaatcctgagtagtagaagatttgggagaaaagcctttctgcttttgtgtgatccctgaaagtctgtctagagaataaatttccagatgccacacatgcacaaaaaaatttacctataaataaatttataagtttttaaataacatttgcaaataatgtttattaccaagccattttataattttgagttgaaataaattacattgtttacattgtttgtgatctatgattctttttgcaacaatctcttaccaagtagtaattacatacattttctgaattacagtctaaattttttttcaattagaccttgctaattttttctagattcttgatttcaaatatcagctaattacaacactacattttccatgaactttgtaggtccaacgttttgtctgtaacttgataaccaatttgaattaatttattttggcatcttatggaattagtgtaaatgatctttcattaaggtgatatcagtttaaatcacaaaatttaatttcaggaatgtagctccattcatctatttaattcacttatgctaatacctcaacatatggaataataagcaaactattgttcattaaaaagtagaaaagtcaaaataattttctgatctaatggttagtaatattgctataagcttttactagtttctacacagaaagtgacataaagcaaagtcatatcaagataaggccttttctttttaaactattgcctgaaattctttccaaataattcagcaattagtcagaaaactactagtttgatggaatgtcatgttgcaaagataattatcactattacatctaaaaattatttctacagtatgaatagattatgtctctagttgtctactgaggaatcttcatctataaatttatgagtatattttaatataatgtctatattttaaaggtatggacagaaaggaattctgtcctggtctatgcacatgggaagctcttttttctatccccagagggttcatgggttttggaggtcaagtccaaagcatgtgctctgtaaaattcccagacttgccctgagctccctctggaagtctagttatacatttataagtgagaaattatagccaggccaggtcacctgcaagaccccaccatctactatgagtccctatctttaatgcagctctgatttcctccttagaatatgggtgttgcacatttaaacaacacatgattccatttcccagctatcaagttagcaatattttactgaaattggaacacatagttgatataaatacaatagaatcaacactttaaaatatgaatagtggcaattaattgataaactctctaaaaatcatcttggcaagatgcactgaaaagcttaaaatgtttgtatcatctgagacaatacattttatttctgggaatatatcataaaaaactagagtactgactaaaagtgtattgaaaggtgtttatgacagtgacatttgcaatattaaaatataggaataacttaaatatccaacaaaatggaactgggtaaataaattttagtatacctgtacgaggaaaagatattacaaataattaaaatttataagattattcataacatgggaaatgcttttaaatcaatgaaaactgaccattgaaaaaaaatctttaaaaaagaatcacataactttaggaagaattgtatctctgtatgtgtgcatatctgtatttgtagctatttctatttttctatctaactatatttaaaacgcatgacagctatcaaggagagactatgaccagtttgttcttctaaatttctttacacttctaaaatttttcaaaattgcataaaattagattacattatatttacaattacaagaatcttattaaaaaatagactcagcccttggtagtggaaaaaggagtgtccttcattaagaaatgtatccctgtctgaaatgcaccaaaaaacactatcaaactgcttccatatactagaacattccatctcttactcctgggtgacaaattttgatacatttgataacttgattcatataagtattatcaataattgaggcacttagattcatgtataacaaaatttccaatacttcatttttgtcaagtgtaaaatgatatgggtaagctgagagtttaaaaaaacctcaaagaaggtatgaaaattataattaagaaataattataaaatcatgcagaattagacctttataattcatcaagtatagtataaacaatttttttctgtgaattttttttcaatgtacattttacatgccttcttacaaacattattgactttggaggacttgaatatgtaatgtttggaaactaaacaggagtttattagtttcacttagagtctttcaaacgaagtcttggagttgttaaaagatctttgctttcatcctagaaattattgtgttttttttatattgacaccaagctggtaactttgaaaatggaggaatgtcttaggataagcacaacttggaagcaggcctaactgctcaattttatccaaataactaaagttagtggaaggtaaatggtttctatggggtgattatgttcatggtaaacaccacttctaagatatttatttcaatgctttataattgagtaaatataggtatggaaaacgtttatcaattaattgtattgacttaatatgtatgaagtttgctcaacaccagacacatggtagtacagtgttctgcacataataggatcaagttgaaaagaatgtggaaggaatgagtaaatgaaaggcctttaatgaacccgtttccttccttttcatctctgttgattccttaattgatagctaaatcaaaaattcaaatctgcactgtgacatggaagatttcatgtttataataatacaaaacaaacaaacgaaatatatttattttggttaacataatttaaaaactttcagagtaaaacaaattcagttagtaggcacaatgctggtttgttaaattcaagtttcaggggaaatggaaattcttacatgtgcctagataataaccctataatatatattttcatgattacaataaaattacttataggcccctacagttacactactgagagctgcaatcacaatgaatttgcacaaagaatgcaaatttcatttttgccagagtgatatgacttacatcacatgtggctgttatagttttaatagatgcttagcaactgaatctatagcttttgtttggtaatgtctattttaggaaaagaagcatattcaaccggaactaggaaaaaagcttgtttttatattgattgatgcacattaattgtttaagaagatatttaaacattccccaagaccttcttttgaataaatcatttgctaaatcatagggatataaagcataatagaagggactgaaattcaacaaatgcttataatttgagttctatgtgcattttagatatgtgtttgtgtgggtaacagaaactgaataatatatttatcttgggatagaactgtcatcagtaagctaagaaactagaaattgatatctctgcttgggttaatttgaagatgatgttgtgtttgtttgcaaataatttttaaagtaatgaactacccactacactacctataggctttattgaaaactaaaaatgcaaaacaattgagataatgatcattttcttaagagggaaatgagaaatggttttacttttcgtcaggatgccattgcagattaaagaaaaatgtgatttcattgtatgctacaaaggaggatgacatcaaagtgtcctcttggtagcaagctagctatataaaccacaaaaagagagctgcattaaaaatacaatacattgaaacagtaatttttcaatgctatgtaaatactgtggacattttaaattcaaagataagcagaatcagcagatagtgatagttttaaatttgctaaaaatcaatagaagagcagtaaaatgcaattttcctaaaccgggctgtaacttcaagtgagctgaaccattctgatgcaactgagagatttttttttttaaataggacttaagaaaattgatttaacattgtttcattttattagtggttgagcaatataaatgtgaaatgctttgaagtaatctgcattatatttttattagcttcagagcttctatatacgtattttatattcttttcaaaagcttaaatagtattacattctaattattatttgcagatggtatttgtttttcttgtaatgaccagtcagaaatcatttgtctgaattgcacgaaaaagaataatttcctgttgagtagcagttactcagtatgcattctagctcttgctatctcagagggaaagatttaaataatgtatggtgggttcctttgtaatgaggtgctcttttcttacgttttgttgtgattttgtcacgttagaggaaatgtcattaaagggacacaaatcatatcaaggattttatcaatgctatataattgacctatatatcttttaatgggtgggtgaatgtcattcaaggctcttgagcatttaattcaaatactaaatttaagaaccacaagcatattgatgagttaggaaaagacagaattgtgtggataaagcaagacctgggtgaacaatctttctttctttctttctcattaaagattgatctaaagatttttttgaggtagacttatttgatagccatagtcactttttggttctcagagtggtaataaagaaatcgctcaataaaacacaatttcccttttctctgtgtctggtattccgtttctcttcaaatgcagctgttttcttcatgcttctttcaaatatgaagaccatgagaaaaacaaaacaaaacgaaacagtttcagaagagcccggtagctttttaagccttgaactgaaatcttgcttttaagcattatttctaaaataggcaatcctgcaataataaaaatgaaaataaaaagtctaatcaaaatttaacaaaagagtaggctccctaaaggtatccttcactgtctgtcacctcttttcttaaatgtttcctaaatgtgaaatctcttgtatcatctagcacacttgatttcttcagttatcgatatttattttgtgcatttctttttattgcctacacattttgctattatgtcatgtcaggcactttgtcaattgacagtatacgtagccttgtatttggatacatatctaggaggcataataagtagtagcaacccatagaacacaaatcagaacttcctatgccagaaaaaaatgatttaccaaagttctatgatattctcttaaggtaaaacattagcatgttaattttacctgttttccaaagagcatgccattattattgacatgctactggctttatggtcccaggatgcatgaattattagtgttgcctgacatttttaaattcctaactctatagcctatagcagtacttcctgttagctattatgagctttaagagtgcatgctagatgctgatcagtgattgttcagtaattcagaggtgtcaaattctctcgtgggttaaaaaaaatgttggttctttctggatttttataagacaatatataaataaaattttaacacactgaatctgatatctagaggagagccatcctgatttttgaaaagaaactgcactttcctaccattatttttctaagaaataaaaccatactattcaaatgcatttatttatttgattgtagtgccttttttctcaaaacattacaatgaaatattataacagcactatatcacacaaaattgaatttatctcatttttttaatccaaaaagtccacctaaataggaaaaataatgaggatatttaatttatagaaagttatggtatatttacaagtttttaatgtttcaagaacaatattcggatcttttattagactgagtttttaaatggttgtttgttatagaaaaatacaaacatttgaagcaataaaatattgaaatagaaatatcaaagacatatacttttatctgaaacaatttttatctttttttatattaacattttcagtgtgagaagatgttaatctttaagtgaatcaatgcattctcaaatgcatctgtgtttggaatttttaattggtaaagaatcacaatggaaatatcttattttcattttttccctttaatatctattaagcctgccctatcagcaggaagcacttgcaattaggaaacctgtaatgaaactcagcacaattaattccctgttagtctctcatgctagatttctacttctggatatgttgctaagttttgggtttaggcacttgccttatatagactgacacccagctcgtcaaaggacgtattacaaaatcccagtgattagttccagtgattagttgagaatcacattttctagcactctcctatcgacaaacccaatggctgattttaagctcttgtctcaacttatctctctaaagcatttcaatctataggaccatttcctatatcttgaaatactcttctcctttggcttccattcttcttgttctcatctcatcccatctgttcaacaatccttttgaacttcctttctgggtcccttcccatttcccattttttaggttctattcttggtactattctcatttatccacctgtagaacatttatgaagtatttactatatagaaaattggctgtgcatggtggctcacgcctgtaatcccagcacttttggaggccaaggcaggtggatcacgaggtcagtatttcaagaccagcctgaccaacatggtgaaaccctttctctactgaaaatagaaaaaacagctgggcgtggtggtgcatgcctgtaatcccagctactcaggaggctgaggcaggagaatcgcttgaacccgggaggcggaggttgtggtgagccaagattacaccactgaactccagcctgggcaacagagtgagactctgtctcaaaaaataaaaaagaaaaaagaaagaaagaaagttgtataaaaaactctgagagattcaaaactgtatacaataaggataatatcctgaggactttgacatttaatgtgtaaatcattccaactggatatcaatgcttgtcttctctgtacttcaattctacctggataatctcactattctcaagacttcaaccacagtaaatagtgaccatccctaacacttctatctagagctgtgctttcagctccttactggacatctccgcctgcttgtcttctaggcagttataattcattgtgttacacattaaattttccctctaccagcgctctttcacatcccccaaaatcctggttcatctactgaattctcagtcttcaacgctgccacatgttttaacacttctccaacctcatactgtctaatttatccttgagtagtgccttctatttcctcttttatattgaattcattaccccagtttgctgatttttctcaaaaaattgtttctgaatatcaatcctcatcaccatcttttatctcggtcctatatcacctctcatctggataaatggcaaaagtttcatattctattttcctaccacatttagtagtggaagtataaggggctttggaatctttcaaaaatgattaaatgtacatgacttggtcatgtgattttggatggctgattgttctaagcttcagttttctcacctattaaatgaagtaatctgtgcatttcaaattcgttgaaaaaattaggtagtatcttgctagaaagtgattagcacaattcctggcacatattaaacacacacacacacacacacacacatttgttacttgttcactgcaatttatcctggacaacactgtaaaaattgtcttcctctaaaaacttatttttctatttaaaaccttcaatgatttcacattgcctacaactcacaattcacctggatattctaacaccaatttacttctctgacttcactttctacccctccactccacgcacgatttgattcagttgcaccaaccttctcatcactcagagctctctaatccctgtgaacactctacaccttacgcatactgttcctactcacttcctggaaaggtcttctcccacttctcttggtaaaactcctactcatctccaagaaccagctcaaatggcacatcttttggaagacttccctgaatcatccaagaaggaatagttatccttccacttgtgtttctggatcactttctttgcaaacataatagtatactactttcttgtgactttccctatatgagtttcagtttgctgaacaacaatagtaataattagcatttatagagtgcttactgtatgtatgatcttaaagaataaatttatcttgctcatctcatttggtcttcactacaacacagtgaagtagatgctattttattcttattttaaagataagcaaaatgaaacttaaaagtttgcaatcaatacaaaagtacatctattaaatatcaacaaaaaatttaaagtttgtaattagtctgggatgaataacttacatagatctgacttcacagttcacatataatcacatataataataaacatatataatcatagattccaatatcttatgtttgtgcacaaacccctttgagaatataataaaagtaaaagaaaatgcaattttcagatcatgcagaatttagtatacatcaggtagttcatggatcctctaaaacagttttatagacacttagaatgccattgatctaaagataggacactcttctttacagataaaatttttgattatgtaatctgatgaaaaagtattctcaagcttttttatttgaaaataacatttatggttaataactaattgcatattttcaaaaagctaaaagagaattctgaatgttcataacagaaagaaatggtacacatttgaggtgatggatggactaattaccctgatttgatcattatacattgcatacgtatatcaaaatatcactctgtattccataaatgtgtacaattattacatgtcaactaaaaaaatccacatttcaaataccaaccttcagttatccccataaagtggcccataaggaacttctaactttttacattctatggaacaaagcttgaaaaccactgggctaaggtagtgacatgttcaatccctcagaaatgtttaattctctccaggttggacagcatcatgaactgtgcctgacttaccactgtattccataatctgctttttaaaggatgatttacacaatcaagctgttatctgaatatttaaatgaggatgggatttaaaagtggagtaagatatatctccacaactgaggtagatagggcaaattacttttcgtcatgaaaactgagtagccttggcaaatagctgacacgaatgaagatatgctgatctagattattaagaccaccactggacatatttggatcagtgctcaagcatgtgaattatgagttaatcagtaaataaaatgaacaaagttgtgattatatgtgggtagcagaggttgcaaattgcctgccagcagactcaatttggcctacaaatatgttgtttggccagcataatattttttaaaaatttaagccagtatttaaacatcaggatatttggtttttttacatgaatccctgagtttccagctttctcttgaaaatttggaagctctgacaatactgggcccacattctcacatggtgacaattggctagaactgaaagcagctgtttcctctacacaagacatgtactttctagtacagcacaactcccagtagacccacttcacacatatacctgtacctgcttgtcccccattaggcagttgtaaccctagaagactggcctaaaaatttgaagagtttataggaaactgctattttaaataatgcatcatgtgctgcaatgcccccccaccaaaaaaaaaaaaaaaagaaaacaaaaaaacataaacaaacaaacaaacacctcttctagagtgtaggctggaaacatatacttctaggtagccactgaggctgttatgacccccaagaaatgtgaaaacagaaaattttcacctctatttatttggattcatacccgttttactacggagaaacaaaaggcttgcattttagcctatcagtcaaaggcaaatcagttctgcaggtagtagtgaaacagcatggaagtcaggtactctatgatgtgtgtgaaatcaaatccagaagcacagtatacttttggtgaattaagttacaattagatgtaacttttagtattacactataagaaagaggatgaggttgaggtggggttcaaacttcttcctattctcttcatattggtattctttcatttgtgttatcactgttgaataagaaaatataatataagcaagcaaagcaaatgggaaaagattttataattccatgttttctggtttctatctggtgatgatgaacatggtatcattaaaatggtctagtagctatagtatttccagttattctaatccttataattctacaaggctttgaaggaattctcttgagaaaaaaataactatatcacagtttaattgtttatagtgactaatcaacataacactaaatttctattcatggtgctttcttgaatcttagactagactatgtattggagaactgatttgatttaggaggaatctgagtccttaaattattatggaaaaaccagctcacatttctttgatgtgtcactcatctttcagtagccctgctaatattagagcacttcatttttttccaaagcactttcacatactggaaagttgccttcaggtatttcaattaagtcaattttaggatatttagcctaatggaagtatgaacaagggtagctcaaatagaagggcgactgattcaggacttttctttctggttcagcagtacttaaggactgctgagagatttaataactctggtaagtagtgacaggagaaatactatctaggaagactccagaaatatgagagttgtcatttatattagatctttgccgtttatggatttaccatttgaaatctgactagtcacgagctttccgaaaagtttatgatattttaaagctatggtcattttttcaaaactccaaatttgaattattttcttttaactctggtaatgtgaagaagtcacttagctagtaagtattgtgagtcactgagcatcatgctcaatgctgcttgtccttctccaaccatctctgcccatacaaaacatttctcttagaactgtttaaaggaaacaacaaaactcagttcctttgtggaaagaaaatatcctcaaaagagagaggcaaaagcgattaaatttcagtgaaaggatttctcaactcaaacaagccaatgctgcgctagcatttctatgtttgtaaacttggaaattgaaaatctcaaaaactgaaaattttaggagtctactatcctttataggtaccctttaatacttgttctcttatatttcaacaatggaaatcgttgagcttgctaaaaggcaaatttaatcttcacttagtcaaacaaaaaatattcattgagtgcttatttatgcatgtcatgggattacagagattaaaacaaagcattattacaaataagtttccttccagagatactccgctccctcttgatttaaagatctctgtatctgatcatatatgtgattgtctgactagattcttttcaccccacgctttttatggtgactattatttttttaaaaaaacaaggctggccccagtggagcatccctctaatcccagtactttggggaggccaaggcaggaggatcacttgagcttaggagtttgagaccagcctaggcaacatggtgaaactttgtctctacaaaaaatacaaaaattagctgggcatggtggtgcatgcctgtagttccaactacttggggggaagagacggaaggatagcttgggccagggaggttgaggctgcagtgagccatgaccacaccactgcactccagcctgggtgacaaagggagaccctgtctcaaaaataaaatcaaacaagcaaaacaacaacaacaacaacaacaagtgtttgcaaaagtgtggagaaactagaactcttgtatactgttggtaggaatgcaaaatggtgcagctgccatggaaaacagtatgaaggtgttcctcaaagaaattaaaaatagaactaatatatgatccagcaattccacttctggaaatttatcaaaaacagttgaaatcaggttcttgaagaggtatgagcacttccatgttcattgcagatttattcaaaaacccaagatatggaaacaactcaagtgtccatcaatagatgaatggatagagaatatggggtatatatatgttcaaggggaatattagccttaaaaaagaaggaaatcatgaaatatgtgacaacatggatgaacttcaaggatataaagtgaataacaatatcaagtgaataaagttgctaatcaatgggctaaagtttcagttatgcaagatgaatccattctggagacctattgcacaacattgtgcctatagctaacaatactgtattatacactgaaaaatttgtaagagttatatcttacattgtgtttgtaccataacaaaatgaaagataatagatgtatatgtgtgtatttatgtatgtatacaatgtggattattttttaaaaatacccaaaagctattttcttctgcttttgaaaaaaagtttcattattagaaataattggtcatttattttaaattaacactatagcaaaagggggaaaagtttttttaatactagaaatctgaaagatttattgaacttgaattactctgaccaagtatgtaattgtaacaatttgggaaatgtttcaaaatttgaatataaattttacagtttttcacactatatctacataaaaccagcagatgttggctgtgtgtgtttgtgtttatatactttacaaataaatacttagcatttatatagcaccttacagagcagtcaagcatcataaagtcattcattttatcattaaaggaaatagatgtcaagaataacttagagtatattttttatgtcatcaaaagtctaattctataaaagcttgcaatagagaagtgggagggaaaaggctgctcagagaagcagtctttaggttttcataagttagggaagtgtgactgttacttacagttaacatagaacatataagaattttctcccctatgtgatcttggagaatattgtttccatgaataatagaagcttagaaaaagaaagagaaaagtccctaaacacacccattatctgactttacatgctaagaacaaatttgactgtcggtttatgaggcaagagtcagatctaagacctctgccccaactgtactcaggatgtcaattgtcaacatacacatagtcacaagtcgagaagtggagtaccacagaccttagcatctgcatgcaaagtagctagatatgacacaaaagtggtttctttcttggtttttcagctggtaaaggtagattttataaattaaaaagcacatcccttcatggttgtagtagactttttttagttcatcagtgtaataatatctccctatcataaaatattaattttattcaatccaattcatatgtgcttttctcattcatagctggaattcagctctccaggtggaaagagttaatatttgaataagtgattccacccatttaaacatgaagaagttgtcttaatctctacattttcatggttgccaatattttgattaatttccatgacttctattgactctgatgcttgaataggttctccagatctgtaatataagttattcatatagacctagaaattatcagtatatctcctgtgaagaaatacttcatgtgaatgttaaaataccttaggaatgtggctggtcgtggtggctcatgcctgtaatccaagcactttgggaggccaagacaggcagatcacctgaggtcaggagtttgagaccatcctggccaacatggtgaaaccccatctttcctaaaaatacaaaaaattggctgggcgtggtagtgggcacctgtggtcccagctactcgggaggctgaggcaggagaattgcttgaacccaggagagggaggttgcagtgagccaagatcacaccactgctctccaacctgggcgacagagtgagactctgtctcaaaaaaataaaaaataaaaaaataaaaaagcaaacaaaaaacaaacaaaacaaaacaaaaaataaacaaaaataaaacaccataggaatttattgatcagtttatgagttaaaataacactaaagttaactttcttgaaagaacaatatgatttacatatgccaggaactctagacacattaatttttttaccaaactcttaggagaaatcagttgtataaaatttcatacagaagtaactaaatcttaatgttagttaccaaaaagcagacatgactccttttaaatgtgctttcttcattttgaaaaataattagcactagaatgttttaggtggattattccaaaggaagcagtatagcatggtgatgaagttcaaaaagtgctcttcagtcagattgctttttgcaaagccatgctctgacaattctaatgttttctcttgggactgttttctatatatcaaatggaaaaaaataataatgccaatctcacagagtggattgagaattaaacactccatttaagctgagcattgtgcctggcacatggaaaatgctccatacatttttgacattagaataataacaccattaaaatcgaggtagtcgtagtataaaaataaattagactttatcactttggggtttcaaatttttacttacaattggtttggggtgtttgctttaagaaatgttgacagtatgtgtgtgggagagcatatttctgacttctttctttcctgtaaagttaaatgtgggatttcagttgtttgcatagcattcgaacaatcatttatacatgtttctaagatactatctctgaaaattacctctagaagcttcctatctgtttcctgtagcttgtagtctacaccaatgtagatgagataagtgtagtattgcatgctaacatattctgcaaaagacagcatgggtttacaaagtttcattgactcaattattattggagttatctctacatatcatttatagtaagcattccaagcagcttcgtcataaaattcttagtaggaagaagtaactaacatagataaggaaaaatcaaatgctcctatatctttttttttttttagacagagtcttgctctgtcacccaggctggagcatagtggcatgatctcaggtcactgcaacctccacctcccgagttcaagcgattctcctgcctcagcctcccaagtagctgggaccacaggtgtccgtcaccacacctggctaatttttttgtatttttagtagagacgggagtttcagcatgttggccaggctggtctcaaactcatgacttcaggtgatccgtctgccttggcctcccaaagtgctgggattacaggcttgagccattgcacccggcctgtatcttgtctttacgcatacatttatttcatatctacttcagaggtctgctgtcttagctgaggtttctaatatttgcatggggtgcacaattagtaaagttggtactgatatatgtttcagaggttaaaatcatgcaagaatatatctttatagagtcccctgttttgctggagcctgcccaagactttttgtaataagtagcaaataaataatttgctatattttacagagaccccattctgcaaaaaaacccatgaaaaacaaaacaaaacaaaatcttgcctatagcatctatgagattaggatgtttcttagtgatagaaataagtgagtgttacataatactataatccaaataattctaaatagtggacttttcaacaaattttgtgttttaggttgctttattccattgaaaaatttaaaagtaaccatgatctcaaatattctaatgttgtgagatttacattacaatttagagtgtttgcatttttattaactttgacttaagaaaaataaattcagttgaaattaactcaatatgtttcaaatattttctaaattacttttattttactatttcatgaattatacttttttaagttttaggacattgttgtgattataatattctaaagtaaattattttagaaaacagagaacttaacaaaatttaagtcagctacctcctgtcagttaacacagtagctcttagtaccctaagatatcccctcttttgttctcttaagaaataggtgtccctcaaatatctgcatttatctctgtccatatggttttgaacaagtggtgaaagtattcactatttgctgtgtacccacacttgtatagttcagctggaataccatctggtgtggtactcttcccattttcctcattttgattgctttctcaatctggaaaatggtagcttgatcgtccaacgggtctccagatggctgctggatcattctatgtagtatccatcaacaacatttgatgggttatttaaagttcatccaaggtatttgcaagttcattattcggtcataaaatatcagaaatttcaattggggaaataacataatctcagatttcaggaatgaaatcttttggattagtttgaggaaagaaataagaaaacacatttatatctttctaagaagcagatggctactcttacagtgttagttatccaaaattgtttctatttttacccttctatattggctaagatgacattttagcggaaacagcatccttgcatacagaccatctttgttccttgaaggacaactgttgaaattaaaaagcatatgagattaaatttctgcagaaaaatgaggcagaccaacatggctataaggatcaattagtgtaaattgaataagatcataatgacaccacaagatagatgtgatctgaggcaacagtgtatagatgtaagacaatggtgatgtatatccttatgtgaatatataaagcatgcttaaaggaaatcatggtttatcaccctcttttttttgcctccctaccaaagcatgccaaactttaatgaattttggagcaccaaaaatttatagtttcttaatgtatcatttaacagcctccatttctccatgttttggtaaataggatgaaagaaaatcgtttttcccctctactcagctcctgttttatgtgtagctgattttaattttatcttggttacatttcctcattttctcttctcattgattcatttatcctttcatttcacagttaccgagtctctaccagagatttagaagagaccctttacagtgttagttatccaaaattgtgtatgcacggaattctgcatgaagaagacataggtctgggaatcaataattacatttgatgtcataggtaccataaggtcttcataaggaaatatgaaactatggaaagacccctagtcttccaggtgggttccatgtcgatgacaccttcatattttcctcaggtactatctgcatataaaaatttgcttcatttgatctttcacacaagaattactaaggtatattcaatgacatcatttgttgtgtaagtagaaatacgtctagctggctcaaaaccttaacagtaaaccttaactgaaactgaaacataattttcaacttagttcatttgtgtaatacctgtataaagtgtatctgaatgaattgttcccttcttctaaatactatgtaaaaatggaagagacattcatgactgtaatctggtgtctattcattctttgggcaaagctttattttacgacctctagcatgtgaccagaatttagctttgtctttcaagctttagcctttaagttaaactattattgcatgtcttattttagaagcttactgagaaattctttttatctccaacttttacaaaatccttgctctagaatttatcttcttcaaagtggatttggattgtgttacatctatctcagaagagatggtttggcttcctgttaagctttaaatttatttcagaactgattgaaaatgatatttaactgatacttgtgctgtagagtagtatttgagtgagaattagaggccaggcatgatacctcatgcctggaatcccagcgctgttggaggccaagtcaggaggattacttattctcaagagttggaggctgcagtgaactatgatcacaccactgcactccagcctggaggacagagtgagaccttgtctcaataaataaatgagaattatacctgtaggaatcattctgaagattgagtggtaccccctccaagtactaagctaaagattaatagaatataccagttttagtttacatctggtagcattatcatttaatcaggaaatgcaaagttattaaactaattcaatttttatttaattcttgtcactcagtaccagtcaattaagaatatttgaatcaaataaaatttcagaatggccaaaaaaagacacatccttacattatgtacataaaatcacacaaaatttcttttattttttatttgttatggagttatgtaagtatatgatgccattatcatgaatttttgtgtcaattgatcaaagtatactttcataaaaaaatctaaaatggctttagaaaacattctttaatttatttttgcaatgtaaatatttcaagacaaaataatgcactctctaactagcacctatgtataacccaatgataggatacttcattaaatcagtctttgagctgatccatgtacttttttttctaaaatgatgagttcacataaaaataaggtatttttgacaaataacttctattttttctgacttcctcaaatatagcatatattttggaaatccaacgcatttattgagaataagaagaaataaataagaaacagttactatgctaaggacaaaaaatcatcagaataagattcacactgtataaaaacaccttgatctttcccacatgctattacaaacacagaaagttcagagatcattgctataagagattgaagtttcttaaaaacattatatccagtgaagaataatattttaagtattaagtattttcccctctgaaagctatttttaaagagtaatttctttatttttccaaattactacagcttttcaaaaatgcctgatatctctttggcaaatctttgcacaaagagtttgaattttcctgagaatcatgctcattaatgaaactgaaggacaaagcagagaatgtattcataaaatattttgatatgtttcaatgtctctgtacttgaaattaccatggcttagaacactcttcatcacgcattagttttatttttatcttttagtatctcagaaagatcctcattctaccttatctaaattggcctccctaatttatctctatctccttgggtgttaacttcctctatgaaagttttctctatttgtaatcactgattctctttattgatttgtttttgcatctctctcatcatactgtaagcttcatttaggtatcaactttgtctttttttttttttagcaacgccattcagtgccttgcatagtgcccggcaaatagtagagctcaataaataaatgttcaataaataaatgagtgaaataaaacttaaccatactttttattgcttacttgctcacaatgggcaagtgacatattcgtatatgtgtggaaaaaatcctattttccaagtgggagcaattatttattattatttcagatacaacaattgtgaaatttagtcaatatttacacaatagcagtatgagagcacagagtagtaactttggaaagaagtgataattctttccactttgccatcatttacatttttgtcaactttagaaaaggagaaaatggtgagaaaaatctgtaaaaagtttacacacaaaagaatatttcaatgaaggaaaatatgtcagcttactataccatattttgttctttcaaaatattacaaaattgacatgggacataatggtgtttgatgttctaagaaaaatacaatatgtttaggagactgtatatgtgatgtggatgcatcactatgagaactatataaggaactgctaacattgcaaaagcacagattttcagaatggtacgtatatgtgcttaaaattgctggtgtgctatacttaatttttattctattttaaagggtcattcatttatcttttatagacaattttcacagcttatcatgaatccctagagctgctatgattaagtcaatacatttacataaatagtatgtaaatgtacttaagtatagtgttcttgatatagcctaaggtgttttatgtgaatatatccaacattttgctttttgaaggagaaaaatgtatttttatgcttcatcacacatacagtaaatatcctttatgcttgtagattcccaccttgcttcacatcatccatttaattttttatatatgcagcataataaattcatgttgctaaattcaaactttgtaagagtctgacccattgtaagtgaatttcatatctttctctgtgcttcactgatctggtcagaatatggacttccttttatattaatgaggattttgttctgtgtttgaagccatgaaatcggatgagaatgtgggaaataccagaaaaatactgttcagtgatactgttactatgaatgctttaaaaaagattttctttctcaaaaaaataataaactgctttgagctttttaaaagtcacagaaagttaaagctagttctatgaactaattctgtagaggagggaaatgaggtactaagtgttgaacctatagtcacatttcagctagtggtaaaagcaggaatagaactcaagtctactacttcgcaaactgatgtttttctcagactcatctctgggaactcagtttttaaacaaaatttagaaaataataataataatacctcacataagattgttttcaggaggaaatgaaacgagataatagatactatataccatgcctgccccatggtaggcattcaataaactatagctgctgttattacgatcatctgcaattggcattatttttatagttaatcattactactacaagcatgaataatcttacagcacttcagtatgagacaatctcaggatgggtagagctcgcctatgattggaagaattcagcactgttttggcagaccctggctgcacccagtttaaaagtaattagtcctactcaaccagagtaatctggaaattggctctcaaaccatatttgcaattttatgtgaaaagacatgattcaatatacagtaatggttaggtactttcagtgttcaacccttaggtccttgtgtaaagaggattgttgtcaaaatggaacgaagttttgcgtgcaaaataatggcaggagaagccccttaatcagatttacacagaaaaggaggggattgtgacatcatgtgaatgccaacaagtagatgcactgaatgtgaaaatcagttatttttaatgttagtgtacatattagcattaataactggacatagagttgtccttccagcctctgtgtttcataaagggaaaaagaattcaatgtttgtcatgttacatttgaacaatatatttacttcaaataaagacattaaaataccttgtaaattaagtgagttccataagatatccagtggtcaagtaaataatgggaaagttagtgataaactataggtgaggaagaaatattttcatgataataatcacttttgtagtaacaatcatgatggtagtgacaaatgcttgataggtcaaaccacatgtgtactcaactgatccatgacttcagagttactactatcagcaggacttttactggaaaaagaaaactgtaatatctctaagctcagtttgtcatctttaaaataagttggattttaccaaatgaccacttaagtctcttccaccactaaactctcaaaacaattatattgctgattcaaagatacccgtttaaagatagagccttcatacatatggacccagaatctatcaggactgaggattgaggggagatgttccaccctgtgaggttctattataataggtcaaattgacacccaggagtattggaggatttggcagtgagcccagagatactgtttccataatcacaacctattttgttcctgaccccccaggacagcatagacctagttttgacttcaacaggaaatcccaaattcagagcctgaagcagaactgcactgttttgcagaaatgggaaatcagttgcagtgtgctgacctattcccttagtggaggtgatataagtggcatcacaaaatcagcttccttttttaatgctcacatatcttgacacttatagcttattacatcacatattatcctccatccagatattatctggaaggtggtcgaaggtattccgtagtctttcagcctcaggattccaggttttcaaaattttaaagagaaatccattccaaatttcctttgtttaaactattccagaaactgaagtgcctctaagtataaatgacaggataatagaactttaagtcttccttgcagtgactattatgctttcattttgcacagtagagctcaaaatgcctcactttatgctgatggtgagcacttttagagtttttcatcttcctacagttaaaacatatgacaaagtggccatttgaaaaagaaatgaaggggaaaagtgagcatgaaattcacagaaattgagaccataataaatactaagtaagtacacttccatctacatctacttgtagataaaatttcaaatatgctacaccaagagatttgcattgacagattactttttgtttaaaactagatactctgggaaaaaaccaatattcatagtaaagacagattggaaatataataatcatcacaaatcaatgtaaatcaaatacatgtatgtatgtaaacatttaataatacataaatagttctgtaaaatatataactaaaggaacttaaatattaaaaattaatgtttttatttcaaaataatttctatatccatttgggtctggacacagaaagcaaattattatgtatatagcaaaataaaaataaaataaaataaatgccctttctgaatatgaactttaatccttaaattagtgtaattttatattataataaaggtaaaataaaaatttcatataaatgtccctcttattaaaaaatggaaagaaatcaaaatgaagctaattcttttagaaaaaaattatataaacaatataatagatttttttttaccataagtgtactttctactgataaacatgtaaagttaaacagacaaaaatgaaaacagtaatcatcatgtaccaaatatcattttgggaaatcatattagaattgtttaaggcaaactacatttttaactcttgattaaaaataaatagtggcatctttgacataagtggcctagtttttcaaataaattattaaatataattaacaagtgaaagattttaaaaacgttacattttaaaatgtatctaaacacatataactaaagaaatggcatctgtgtgagagatgagggattccattttaaagatcaagaaacccacatcaactagggtaaaagctaatgaatcagtacagaatttaaaacttgattcaaagtttcttttaagaaatgtatcacataatgtcgaaatgatataaatgataattctttatattttgtaattgtttctacatcaggctaagatgctaaatcatcctaaagattggatattttgtaagtggttatgttatactaagagatgtaaaagcaaaagcttaattatcatgtgatgatcttttatcatagctcagttttgatttgtaacatttaatttcgattcatttagctataaaatattttatattgtattttgatatcttttaagcattacaaacagcattagtaatagaaagagattaaagttatttgaatacctggctttatcatgatctagaagtgctttgcgattcgttttcctgctttattaacatttatggaattctttgcactaaaatgtcagccccatagtttcatgaatcattgcaaaaacatcagggagtatcatttataatgtacagcaatccattttgatacatgaaagtagacctggttgcagtatgccatttttggattcgattttcatgtaatttgaggtaagtgctaaattatgatcttgactgatacttactagtgagccagtcgtggcattaaagtcgatatggatcaaaatgaaagaacagaaaagaaaggcattagaaatactttgatttaataaacaggttatacataaaattttgtattttggtatgctaattttaatacctggacttaatacctgaccaaagtgtactttcacttttatttccttagtaagtctttcttcaattatcttttcctgtatggtcaaacattccaagtttttttaatgaaaatttatatcatataaatcttatttgaaagttttagaagatgaaatataattcagaattcaggagaactatgaactcctatgtcaagtatctaaaaattaaaataattttaacttaattattttatgaatatatagatttagcatataattataattgcaacagttttctattataaatagatattctggtaatacttcttaacctaatgcaatccatcatgcatttttgaatggtgatttattaaaaatatactaaatattgtcttttttaagtgtaagatttcacatactacaaactgcaaaactttacgtaaaaattagagttcaataagtataaaagaatacatttttaactgagtaatttagaatcttttctatcataaatctacttttataggcatattaaaaatctaaatagcaaaggtaacactctgcaaataaaatggttaagagatatgaataaatcaactgcgtaaaacatgttgagctttccagaagagaaatgttaaactgttaatgttttattgtgaataactaataagctcacatctgataagttttccagctcttaatataataacttgtgttatgggattatcagtgatataggcccacaactagacaaaagatgtagccaaaaaaacaaatctataaattcacttgagaaagatcacaatgggttttgtgatattaaacaactcttttcaaactttcctttataaaatgtttaaaataacacttgttaatataaaaaagaatatgtaaaccattaacagcaaaacaattactgagtacaattaatccatcatacaacttaagataaactaaagataaataaactgaaacatttaattacattgcaagagacgaataagctggttttgacatttctgaattttaagtatcttctctgcctaaatataagctacttggtattttatttgcatctttttatacagttaaaactctctttgtttaagggttgaagtagtaacatttaaattagtgtctatttaatttaataactaaatccatcaaactataggcctattaaaacgatttcattttccttgctggttaatctaaagtgcttaatcttaaaatgttaactgtcaaaataatagaccttttttccctccataagaataacttgaatttcttacatatttcctgtcaatcattccatctaaactgggtgtgcataaattgttccaccactgtgactctctcttaagtttgtaagtttggacagtgttactcacccctaccacaaaaaggaaataagatcatattctgaaatggatttacatttctatgcttatagtcagaatgtatttttagtgaggggaagatctgttacacagtcaaataactgtttgagaaaacagagtattatggaatacatcaatgtgttagggataggaagtaaaataccacagaatttattaatcaatgttacacatacttcttccttaggtgaattttttgctactcaggccattaccttttgtgttcacatattagtaaaagctgcacttttacttttttttttcttttttggagcaaaaactttaataggcaagaaaaaagaaaggaagaagaaagcagctccctcgtacagagacgggggggtggatttgaacaaagagaaaaccccccaaagatgcacttttactaaaaaatattatcattaattctttgttatatatcctggcatcctataatgtgtatgactaagttcatgcattgacataagcaaacacagtgtttcattaatgaaaagaagactttggactgagaaaaagcccactgacattgtcagccagttacttcagtgttatattcgaggtggtttgatattattttttgtgtgttaaacacaaaagccaaaatgtaaaagtcacaggactactttaggtcttacaatccagagttacatggtctcaacagttgttcttttctattttaatttaaagcactaaacaagaaactattcactaagttttagagctgcattttaaacaggccagcctttgaatttctaatgtttttatgaaagcttcaataaaaagctgtggtttgaagtaagaacatattatagttttgtaagacaatttccagttggtataatgagaacccatataatctaattgcttaaccagtaacattcatttttactattatataatcacctatgttctaagtaaatttttattaaatacagttccaatacagatattaggaaacttattttatgctactgtaatactagaacattgtataagtgctcaaatagttttgtcagggcaattcccttccacgggaatttaaaaattatttgtgtcatagatgaatgagaaaactttaataataatccatgagacaataacacatacacacacacacacacacacacacacacacacacacacacaaatgatctaaaggtcttattcaatattgtatgccttttataaaattaagctgattctcctagattgtaaactgggatataattaaataccagagtaaaaaattgggacagctactggaattacaaaaataataataaattaaataaaagaatggtttaagtcctggaaaaattcaatctaatgttataattataaagatagcaatgtgagcattatataacactaataagaatactatgtaagttttacataaatagaactcaaaataggggcttaaaatatttcccaaatgtagaatttaccaggtaagtaaagtgataatttttaatttaagatatctggtttaattaataataataacttgtaactttaaatctacaagagagcctaaaatgggtcagcactggatcagtgttgcatagaacctgactttaattgtcattttaaaaaaatcaatagaaagcagtggttctcaaattctagcaggcatcagaattgggcttgttgagactcagattagggttcacagtttttattcagtgggcctgttatgtggtctgagaacaggcatttttaacaagttcccaggtgacactcaggctactgctaagaaggccccattttgagaaccactttctgaagtacagcataatgcgttcagcactttcttttataaagcctatcatcacattctcaaaagacacttattgactctggaatcaaatattaatgaatttgggaattacatgcaagcactatcattttataatcactaaaacatattttctgataactatggatacacgaataatttgtcctgggataatataatcatgtttcattataaatggtattatataacttataattggttatacagtaactattgctttgatgtgaaaaagtgagtatgttttccttttcctaactggtgcttccttagtctactcagttctgaaagactttccatactttaaaggaaaaaagagaaggcaaatctacttctagaaagaacttattactacatctgtgacatgtaagtatgttctggtgaagagacaacagtaagggcttgtagaaacaaccactttcatacagtttaatatttaatattaacaacatcctagtctgctccttgaaaggaggatgctgctttacattcctttgacttccccaccaagtctccaacagcctgaattgtaagaggtcccgtacatcatggatgcttcaagggcaaggtctgttaattattcctcagtagccccagcagttagaagaataccagttgcatagtaggtacttaagaaatgttgacagacctggacacaaacctcatgaatagtacatgcataatggatatttaatgatttactctgaaagacatcctagttcttttgaatatacaagttgctttttctcagcaagttcatcccttgctataaaataaaagatgggctagtgtaggtgtttgtatattaaggcagataacttcacaagtgtccaactggccttatgctactaagtttgcccacgtctatgatacaggaattttaataaaaatgttttaacactaaaacaagttttattgtgtactttttaataatttagatatgactttgtacacataaaatatatttttaaaatatgcacatcatcattgttacttgtaatataagctataggtttaatgagaatagaatggtgggagacaaattttactctgttatggctgtaagaaggagctttataacccagtactaggacttctgaggcttaaatcgacttgtatattgcccctaaaaatgtttctactaatttctactcctaaagtatattaatttagatattatctttgttttttcatcagctctgagaattgtatccaaaaacatacgagggaattaactgcatccattcagtgacaactgcaccattacaaagaaaggataggcataaaactcaatgaccaaaaagctatgaagcagttccctccttctctcactgaccggtaacccaaacacccaggaaaaaacaattgcagaatataggatatgtgacaggggtgaaattgcaacagcatcataagcccaaatgtctcgataaaactaaactaattttttcctaatataatatgaaagaccactaatgacaaaacacttgagtaatagaagtcattcagagactcagaaagaaagaaagaaagaaagaaagaaagaaagaaagaaagaaagaaagaaagaaagaaagaaagaaagaaaaaaagaaagaaagaaagaaaagagaagagaagaaaggaagggagaaagggaggcaaaaaaggggaaataataagagaaaaaaaagaacaaaaaaagaaaaagtcctactgctctgcctgtttttaatactgacaccccataaacaaatctgtccctgggatatgatacagaggcctggagtctgtgacctcctttctgaatctatcaggagacacagcccacaccaaaacaccaggagtgttgcttctgccaaatatcctttactaacttcaaagaaagaacggggaaagagctgtaataatgcttaacacgaaatactgcctttctgcttcctttcctttccccatagactgaatgaactgtcattataagacaacatactgctgagttaatgtaacttaaaaatttacagcaggttgtatgcctggaggcacattatggggccacctgtaggcatctaattccagtgaaaataataaataattgtggagcattcctcagagtctagagagagtggataagaatcgtgttgcttgttcactccaacatggattctgttgtggaggaggattagagaactgaactctctccaacaaatgagtaatccttctccccacaaaagagtccgctaaatgctacaccagacacctgggtgccagatctacacagccatttttgtgcacttctgataatccacctgcagaaattgccacttggcaattgcttaatatagcacgttgatccatttgaggactttttttaaacagtaaagaaagctattttgtttgtctctctgtatgctgtttatctttttgaaactcctcctcacattttggcaaagatagtgacagtaagaatatctgtgatatgcctccaatcacttatttgggagaaattagtatgtgtattttagcaatgctcagcaaccttgacctttttttcactggaaagaaaaataaatttactacagagctgctttttttttttaaaaaaagaaaaaagaaagaaaaggccaaaggatttgttatcgtgcttttgccacaaggtaggtgggttagtatttatcctgtgactactcagagtatgcatgttgtttattttagataagataaaatattctaagatagagaaattttacatatatgtgtgtctatacatatataacatgaacttttattaagcaggtttcaaaagatagtctaatttttgttcagttgggttataaattacttataaactttactaatgtagtcctcatcttacagccactgcaaatacggtttgggtttaaaatctatgacaacctttgatcataacaatcacatggtttggaattaagaaaactagattgaaatgatcatgtaagtaagtagtgaagattggatgctcggtggtattcaggttcacatttcctttccatttgtactacacgaagggttaataaggtttgcataaccttattctttgaaggctttttggcagaggcagactatttaaggattgctgccaaaacagattttaacccttttaatcatactgttaataaccacattgtgcacggtacagagcatactgcacataaggcaatatcactctgaacacagtttgacctgatacccaatcaaggaaaggttcctagagacgcttgccattttggttgctatggtgagtttcatattttgtggaaaccactgctagatgtcttaaaatagaactttgtcaagaaaaacattggtccagtggcatatgctggcagagcctaccaaggttgctcaaattcccttcctttgtttttcactctccccactggggcaactgttccaagcatcagcccactagtctggcaggcagagaatccagaaacttgctgctaattacaatgttgacaattcccaacctgtttactggcgccagcaatcaaaccgcatcctctcgagtgaaccaaaaagcacttgctggctttagcttcctgaggttccaagctggctatattaattactgttaacttaaaactgtatgttgtacagaagaagcttaattagctggtatgaggattaatatctatcctttacacaatttaaaacattttgttcttggccaaattatgtgaatccataaaatatttttctttggacaaaatattgattattttaggtgtggcttctcagtgccaatttttccactggattattttcagttgagcaagacaatagattttaaaaagttagtctgtctgtctatctacctacctatcttgggattatatctacaacctttttaaaaaactttagaaagagaatgaacatagttatttacagttattgtttataattaataaaataggaaaacctattaaatgggattaaatggtcaaaaggatatcaactttctatcttgatgaatttaaaacaaagatagttacaccatttttctagtgaaccctcaatgctatgatagaggaatgatttggtagtcatatggcacataatggtgtatgtatcaatgacaggctagatatacaatggtgatcccataaacttgtaatactgtattcctactataccttttctatatttagagtgtttagattcacaaatacttaccattgtgttacaatgggctacattattcagtatagtaacatgtggctgtacaggtttccagcctaagagcagtaggctgccatacagtctaggtgtatagtaggctataccatataggtttctgtaagtacattctaggttgttactacaatgccaaaattgcctaaggatgtgtttctcagaatgtatccttgttgttaagcaacatatgtacgaggagcatgcttcacgattgataagttggttgaacccacagtgcaaaatcaccttctcaaacccctaaattgttagcattgcaagtaacccagatgtggcagtggcagaccacaatgcaattttcataaatagcacaacagaagtgaacagggttcaattgcaaaattgagaattttactttgattctgccctaatccaagagctgatctgtccctgtttatttaacaagatatctttgaacatttaaaaagtgaagtaaaagtaaatataattttaaattgtatattaaaatgtgattttatttctgttatttggtatgagaacatcatggggtcactattatttaacaatgtcactttaaatttttcattgaatacactgcattacaaatgtttttgaatccaatcttttagtcaacatttgcatttggaagcttattaaactgagttgatgtaattgtgattaacatttcccttgttttactgaaatattttcaactagggtaaaaggtcaaattattcctttaattatgattcatcttctgtttctacattaagatagcctataccattttccaagatttaaaaaatcattagtacaagcacactagagacctttggaatctgttgatacattcacatctatatatacaatataagaatttttgaaaagtttagattacttgggtaaaatatcactgaatagtatgaaaaatataagaattattctcagataataggaagagtaatgtgagaaaaacttcaacatttagtgaagttttagtgtgatgtattagaaagaaaacacccaacaaggacttagaaaatgggttccaaatattatctgggtgtccatggagaagttatttggattctctgtgttgtgaggacttcatatgggaaacatgggaattgtattacataccaaagaactagatctgagatagaaatttataatgacaactaactatcatatgagtttactatgagcttatcaaagacttttgaaattttgtattccatgtggttataggaatggaaaatagtcatattaaaggcaaaccaatgatcaggtggaaatgttacgtatttggaaataaaggccaagttagacaaggacaaatgtgtcaatcttctctatctttatcatggttaactaacaaatagatttcctctctaaaatctaaatcaattaagtgaataggaaaaactaaactcttggtatcagtattttatatcaggaaatactgtcttaacaaatcctcctaggttactttacttctagagcataaattcaagtatcacacatatgttttctaatagaaaaactgttaaaaaggctgtctcttttaagccatatccccctaggctcaattttcagaagtctgtcttttcagactgatgttctttcttttatttgagaaacatccagatttcttgcctttctcaattttctacagataagctaggcttactttattcagagtttattgctattttaattgattcaaatttctgtatcagagcatgactttgaaagcaagaactctgggatacacttgtcactcatactgtgaaagaatccttctacacagataaactatatacaatcaatattgaacactacccatcacaacagggtaaacggtaccatataaagaacaagacctcttctaatgtttcctaagatttatattttttcaaggtgtactggtcccagccaccaggaatttcattattgttactttaatacatcaccaaaatctgcacattcttcactccagtccacatcattaacattgttacttgctatcattgtcccttttctcttgtcaaattcaattgttatctacacaaatcaccaaatgtaaatgtgaaaccgcctcaaaagtttaatgtcactcactatttttaataaacatagcattcacaactaacaaaaacctgcttgtttgtgataaagaatctccttattttgactctgttctaatatataatattaaaacaatttcaaagctgttttatggacaactacatccaacaacaaaaaggaacatgagatattttaataaaagtgtgaataaatggcttccaaacctcacactcctacccccagatatatatttgaaggcaattacttttgaaagatttgtagaatttttattgaacttattctcaaagtttttattttttaattaatttttcctccttaaatctctattctttttatgcttgcttccatttagcacacaaatcagagtcaaagttttcaatggacataatgttttatacccataattaaactgagaatggatagtatgtaaactatctgaataaagcaatagctgataaaccatattattttaatttttagaggatgggtgtattattttgtgatcaaaaagtcaatttatatttactataaattgaacctcccagagagtcacacctttcaaataaaattgtaacttagtctgttttcctagtaaataattttttaaaactaaaaaacttacacagatctttagctttgaaagtatgcctatcatagtaattattatattgcacaatgtgcatttctattgattacttcttaaaactttataaattcttacaaatatttatacatttaatattaaataaatacattaggtaacattcacatggactaaaattttctatttcaatagtagattgaacagattcttggagtttcaaaaagaatatcagcttgaaagcaatgttcccatggatttttccgttatttaaaagttatatcaaataatcagagagaatgtattttccttcttggcaaagaataactgcactattagtaaacaattaaagaattaaattttatgttaacattaaattaaacaaatatatgctgtataacaatcattttatataatagtgactttaaataattatgaaaaaatgtaaaatttatattcacgtatgccccaaaaggatatcactgctttcacaaaattcataaatattttgagcacctactatgtgccaaacactggactaggtattttaaaagattaaccattttagaagaattaaatatcctcgacaattattggtccttttaacagaatggaaaaaaaaaccagtaattttcatgccgttccaaatattgtaattgaatttaatagcataaacatttacacaaggagtaaacatttttagaggccaagtgttcatgttcattctttatccactacaatcatatacatcaactttgaatggagttgtttgtgatttggcctcattaggctaaaatgcttatgaagatagatctgcggtttgagtagcttcaaatttattatacagatgtacatatacgtgtactcccatgctaacacattagaatgaatctgtaaagcattcttttggggcttttttccctactaaaacttcaaataaaaaatgaagcatgaaaaagcaacaaatatttccatgtgtttcatgctttaagaatttaagtaaaaatcttaaggaccattttattatttaatactaagacaaaatgttggtgaatactttttaaaagcttctgtcttagttgtgatatcagttggcccaccatctttacatgaaatgaagtgtagaattcatacaaaaaaaaaaaaaggctttctttgaaatggaatcctaaagaggtaaaaaggccttaagcgaatctaaatctagcccttctcatggatgagacaagtgaagaccaggcaagctgtgtgataggtccattgtcatagttcacaacagaatctgtactcgaaaacagattttctagtcttattccaaagttctttctaccacaggatatacctcactccttaagtatcatgtaattgagggacaaaatgaaatttgagatttctccgtgtaagagcctcaattctcaaatttgctttgtctcagtaaacaccaaagcctatataaataacagttatggaaaaaaaaacatgaaactggatccataaagtaatcattctataactttaattcctgtgtagttatctgtaaaacaatccaggatatttggaagtcttatcatgatatatttctattacaaaggaaaaggtctttttcttatatctgcttctgacagaatagtaggcatgaccttcattcattcattcattcattcattcttcttggaatccaaaaactaatggactatttggcagatatataaaaaactattttaaatgagtaatttttagtttatcttgagacttctttgaaacagttattgaaattgactacactagcttagagagacaaaaataggcttcaattaatactcactcatgtattgaatacaaattttaaaaacaaaattgcaagaaatatcaactttccaattaaaatgtatcatttttataaaaataatcttttcagaaaaagtgtttccaaaaagcacatatttcattcaagtttacaaatagaccctactttcaaattatgcaattatgtcactattgtaatataatttgtcaactttttaaaaagcatattatagtacaaatttcatttgaactggaaacatagtattaatagattccagcaatatgtcttttttagtttgtaatttaactgaatgagattcagtattggttttaaattaataaaggcaataacccttatttaaaatctttgaactgcatgttttagaactcgtaggtttttaacatttggttctagtttgatctactatatatatatatattttcaaatactatgagtctcaaagggcttttccacaaataaagcaaatgaagtgttgtctttacccttgcatatgtattataatattttaattgtgttggagatcagactgccttgcttagctcacattattattagccaggatgtaacagaacccagaactcacaagatacagttggtaataaatttttaagctggtcaacaatacaaacatacagatacactgattttattgttaggctgcactcaacaaactcaactaattactgggtaacaaacacatttcaagaaatttaaaatattatatctttttagcttatgttttttggatgaactgcagtgtttcctcaactaaaatgtttattttatacaatcatgcaaaatgttttctagacttaaatgcaagacttgtaagtcaagatttaaagtataagcactaagataaaaatctgaaaacatttaaaaaacaaattgtactacaaagctatttgcttaaactctacttaccatttgtgtatatagctgtacagctatcaataactaaattcaatagctaaatgatttaaaagtctttaaatattctgatgtcattattatattttttcttcttacggaaaatatatccaaaagaaatttacttttaaacagtaagtctcccatgcagaatacactactttccaacacagtaagaacatcattctgtcatttccgtgatacaatggtagctgcacctgtacatattgacaagatggtgaacaactgtgatggccttatgctgtctttccttctatgtccttagcacttctcctctgtcttacataaaacacaaaaatgtttcccaatatacccatcatctctaattttgttgtctatttttaaatttgaaaatttctcatgactaatgtggaatataataagacaaaaattgataatagggtttttggaatattccttccatcaaaatgctacttcatcgttgcttgcctttgcttggactttcactgggacctctgttctggttctagattggcattgctctgacaccaagaaccacatcattctagggctcacaatggcctcagggaaagttcatggggttgtcataatgctctatggatctttaaccacgaataccatcaccactccccacaattttattcaagcaacaacatcagaacagaattcacaaatacaaagaataaaataagcaaattttctgaaaaatgcagtttctatcaagctacttacttgggactcagtagcaaatgaccaatcaagatgatgtttcttatgcttattaatgaatattatagtataaaattgaccatttatagacattatataaatttaaatgggcgacctaaaatatcccacttatatatcataaattgtattcataaattctgagtatttaagcaggatttattaaagtaaaactagtggacataagtaattttcacaatttgtctccctcctcctttactgtgccctcagtattgtcaaatgaacagcttaagctgaatccatgttccttttttcaggaaaaatttctatcacctttgtaaagcaaaagaaatattagaaaaggctgcttacccttctagtcttaggacatcaattgaaaagccatccaaaaattatgactacttaacactacttggatctagcatgaaatgcacaaacaagcattttgtacttctttaatcatggctatggacagtgacagggcaaaagcagtcattgactagtggtgacataatttaaaattactttttctgggaataaaaaagctgtctttaacaataaaaattaactccagtaatttcaacttaataaagttttaatttttcccactttcttatcttaaaaggtgtgatgatggaacattttcacccctaacttaagtaagaaccagttcagactgacacctaatggaaactattataggaaaataattctgcaaaggaaagaaagcaatgagataagtatttaaacaacaacaacaaaaatactttcagttaactatgagtagaggtttcctttagatttcatcactagcatttgcaattattccattctcaacattattcttcctctatgaagcaactgcaataaatttgcacaaaactgaatagaatagcttatttttcaaaagttcttcctcatctcctcaacaaatgccagagtgttacatcttctgtttctcacaaactctgtcaccaggacttcagctctctttcttcctttcaaatcctaaacacttattatttagccaaccagcatgaggccaactttccagagaccacctaggaactagagtatgtagcttctacttttctaatttcccaaggaaacaatgccaccagtagacatattgcattttgttaaatacataacaagcataatatttaaaagccctaaatcaccaactggtagatccctagagaaaaaaggtaattcatggaataatgaaggaaagaacaggagttacatattctcttgctggtgatagaatgtcgaatgcaaagacagcatctgtgttttctttcctacttcaactcattcttaaaatggactcgcccccgggagcttctgagaagggctccacccgttccctgcagacgacaatgttctttgagcgcaaaagctgtgagtatagataccctgggagtaattgtgggatcagacacaatggggtgggattaggggtaggcagagggtgtgtgtggagtacccttcactgggaatcctaaatattagaagaaaggcgaaaccctaggtggggaagcatgagagtgtgcctgcttccttcaagacacctcggtgtcagcctctccagggttcagactgctcttgtgggcaagagcccagtggggcacacgcacttcgtgcctgagaaaggcccatcctccagggggagaaggtatctgagatgtagctcagcttagagcggtcccagagcgacaagagggagagcttcacaggcctctaagtttatttgatttttctcctgcagtttccatttctcaggaattcagtcttcgtgcgtagcccgtgcacaaccaacgaccaccacgcagggaggaaacctggtcttagtgtttggccgcgctagtggaatcttctgggcgcctggtacgttcttgtccccagcactctgtccttccacctttgaagcgccttgataggacggtcccagatgcctcacaagaaggaaaggcaaggtgcaaagctggcaaagctgtgtggtccgacgctggcgagagctgagacctggagccccagcccacgccttccactctgggtcatccttcccagcttcatcttgggcatgccaactcctgccacgtccgattgtccccaggagtgcccaggcatgcttgaggggtgtggtggcggtggcttcctcttcgctaggaggtgacaaatccgtgttgttttatcgtccattaatatttgaaacaaacaaacaaacaaacaaacaaaaactctaagtagaaggagggagaggctctctcttgctcccacgccttcgcagctgacctgagaggggggacgtgccttgcgtttgttggtgtttgagactcgtcctaaaggcagaggcagggaagacagcgctgaagaggcgtcccaaagagattggacgtctgaacagtcactgcctgccccaacctctttcaggaaggttccaggtctgtgccacactgcaaccaatccggttcccatcctgtttctccaccccttctcggagaatccgaaaagaaaatatgcgttcctgagagacccgccacacttccgatctggaagttccgcggggacccagcccccgggcccccgccccctccccatctcggccgccaagtctggttgcggagcagcgcggccggccgggggtggggctccggcaccgccccgggctcgggattcgcgaagtcacgcgcttccgcaggcttgcgggggcaccttcgcccacggacacgccctttctgcggaggcagcccccagcgaccctctgcccagcttcggcgcctcactcgcgacgctcccaaactgctcaaggcctttcagtcgttcccaactttagaaaatcgccccgtccgcgtctctccctccagccgcaccccaccgtggagaggagaggagcggactgggaacgccgaaccgccccgcaggctcggggaaacggacccccttccgctccccgcccatccccttcacctcgccccccgccccctgcgcgaacccattttccagtcctggtcaccagaggcgcagcgcacagcctttccggtggaaccagtgcgaaaacacccgaggaaatgaaaagaacaagaaagtgctaccttggcaaccacgggcgtttagtggccagctggtgggctggggagggcggccgctgcccccctgccgctggtactctcctcgactacgcgtattcttaagcaataacaacgtaatccgtattatccacccaagaatacccgtcaccgaagagagtcagaggaccaagctgccgctgccgctgctaccgctgccgctgctaccgctgccgctgctactgccgccgccgccgccaccagaactcttgctgctcgctgagcccgcccctgcctggggatgggctgagcttgaccgggaccataaatccataactcgatttccctaaagaaggatccaaagctgtgctcggctgcttcctgcccaaatccaaatggccgctctatttccaattctgaaagacaaatcacaaaatcaaatacttaacacagaagagtgctgtctttccagtgaggagggaagatgtggcaaggctttttgggcacaagtgggagtgacaagtaaccttcagtttacctggtgctctcccagtgctttcctctgcacttctctgcttggtacccagtctggtctcggccagtccactctaggtggtatgattgagtgccatggcggccagagaaccctgtaagagacgtgaatagttacccacacaaatacaaatatatttgcctagacggctttgggaagaagtgaggcttaaataaagataggtcatgcatgggtgaaattttcagtagtgtgttttggaaatgcacttttctcaagcccaagatcatggaaaataaacactcattcaatttactacttgaaatcaaatacttatagatgtacaaaaataggcgtctttcctttgaaggccttatagctatacaacataatgatttttaaagaaaaaaaaaagcttgaaggcacacagtaattaaacccattttccatagtgtcaaaactcactgagttgacaagctggtagactttctatgatttaagcatcattttatatcactacaatgtttaatttcatagcacacttttaaaatatatactataaatgcattgctgtacagctgttgtggacacctctacagaaaaacctttgaagctctgtgttcataaatattattttaagaagaaaaagccaataaaaactcatttgcaaagtgactgtaattttggcattcagagagagaatctctgtgattctttgatgatcaatatggctcttactggaaaagctttgtcttaagatcctgcagtggatattctgataatgggggtttattgttcactaaataaaatggacaagtgcaacgtcactacccaagacatggtgtagcttccttagaaagttctcaatttgctttcccctttactctcaaatacatgaaagtacatccatgtaaggggaatgggggggaatatggaaacatggcaatagacattatgatttcccaaattatgtaagtgcaaatagctcttcatcaaggagtaattatataacagaatctctcccactaccacaactcatctctaactgacctggttgcaatttaaggtgcttaggttgtgtttgctcttatttttttaaaaattataatacttctccgggcacaccaactcatcattttcttgacatgttacttacagatggaaaaatcaacatgaattctaggttttatgaatagatgtttaatatataatgtctgaacctaaaataactagaaagaaaaccaatatagcccaactaccagactgttttacattattttcagataactcttaagtacaccacttacaaaaggacagataccaataaaacaaataaataagcactattttctgttgttacctaacataggtataaagtggagcttttctctggtgctagacaaaaaaaaaattcagaaagctgacaggttctcttcagcttgaactcctagaaacaaaagcccttagggaaagtaatgcaatagtctatgagcaaagtgtacatttgcttctgcactcttctatttaaatctcaactaatattaaaaggaaaacaagaaacacactatacagataggcttggatttagtaaatggaacgttataaactcaaaaggatggtcaagggaggcacacacacacacacacacacacacacacacacacaccccaatacacagggcatcagaatcacagcataaatacccacacagcttttcaatgctttccaagtagtctccttcagttttgcttcctcacaattaaaataaaatatatacacacactgacccacagactcgcacgctttaagaaactagaacaacgcagttgatatgctttctttctacccaagtagcagtgccagccttttccctacctacccaatgttccaccagcttcagcacctggacgaatggacagctcaacccgggccgactgccggcagcactcgcagcagaactgacgctctgagctctaaccaaagctctctcgtgcttgagcggggcagcctgacttacgagaacaccatttcctacgagaccactgccgctgggtgcatattcaattcaagcctccttaagctgtcggatttcccccacccatccaccctcccccccttctccaccctccacacaaaaacaaaaaagggaaaaagcccaataccatcagggcgtttgttgatcaacttacacttcgcttttgaatatttagatactgctagcggaacaatatcagcggaggcttaggtccgcattaagtacctttgttcatcgactcctgcaagccatgtttattagaatctacatttctctcgcgccccaataactagaggtgtgttttgcgggcagggggctttcagcaccttttgatctctcaaggccaccgcgactgattgacggttcccagtactttcctatgctatcccccatactccaacacccatcccagttaatcgcttcgcaatttgcaaccaaaaatacataaagaaacgcgacaaagcaatgggtttgaggaaataagccaattaagctaaagctgaaatgcctctctctctctctctctctctctcccccccttctccctctttctcttcccccttgactccctccctctccctctctccttccctctcaagtagaaagggggaaacaccaaggagagagaaaaaatcgggaggagggtggtagtcgactcttacagtcaatggaaaaagagtatacacatctttactgaataatactctcgttctcagacaaaaagaaacacatttttcgatgtaaacatagtctgcctctgccatacatcctacatcctttacgtttgctgagatttgtcttgctgtatggcaaagtaactgtcacaaatccatctcgattgaagtgcttaccctctaaatccaggtttcaagcggaactccaactgtgtgtagaagccagggagtcatctgatgtgcagtgaggtaggctctgggcagtgtgagctgcttcttctctccgagtgccgggttacagtgttaacaagccttgggaagggacctcggcgcctcgcgctggctgtgccccagtgccttcgcgtggtggcggcttgctcatgcttccgaggagtcccaggcgatagccttcagctgatgcgagcttccagaaaggagtggggaagggaaaaaatcatctaatgcaatcaaatcgatctgatctacaccatct

SEQ ID NO: 2200 - DNA, 310651 bp, Homo sapiens
cgcaatactcagtggataaaaggcttgcagtcccagctgggaaaaagagtcccattatctcccagctgcatagacattccatacggcttggttctgcctggacgcacagcatgcctggctgagagcttgaaacagagttctgcagaaaaactgtaaagatcccgagacatttccctggtaagatctgtaagtacaaaattgtgctgtgtctgctgcaatgagaatattgctgggcaagctgcagcttttcttcctttcaatgtctttgtattagcataacaggtaaaagctggggttgggggagaagtcactgctttattgatgctgtgtttctatgatgctgatgtttaaaatgcatttattccttgtgtgggagaaatgtattgaatctgtattccgggaggttaggatcaaaccagggaaagaaagactacaggtatatttctcagtgtttcactagtctttgctgcagtaaaactaatgggcaagacgggatgacagtgctaattctgggactttcagatggctacacgccctttctgtaacggcagatgggaaaatgtgatcgctaaatgttttttgtcttttttttttttttaatcaaagggatgaggggtggggtttgcagttctcaccggatgatttaaaagaatggttataaagtttcctaggggagaatttggtaaggggagcaaagcaagactggaggtcatatgggctcaccaaattttgtctggcattttgctttatacccagcttctagataacagcctctggagtttcctttaccatttacaccagttaagttgtcagtattaaggttcttataatactttatgaaaactttcagaagttgatgacttgggaacaaaacttttaagagctctgagattagccacgtataacccattatgttaatgggatactgtaacattggggtttggggggaaaattggaattcatagtttttgcttctccaaatgaaaactacttatgtttaaataatcagcatcctgactatgtcctctgagaaacattcacagaatgactaaatagaagttatactgagaaaaaatagagtgaacagtagaatcacacagaatcaatttggaaaatgaggtattcataattttatctacagtggcaatgttttctgaagatgtctgtaaaagaagaagcatatgctgaatattgaattgcttgttttgagcaattttcatttatctgatgggtttatcatctttttatttttgttgttgaaggtttcaccaatttatgtgcattgtattttataaggaaagaaatgtttaagcagactctttttccctcctccttcacacacatgtgtaaacatacgcatgttcacaaaacaaacataaacatacaaaaatacttacacaatttgtgtaaaaaaaaagaaatacagaagcatttcatctttgatgtttcagtggggtttctttttctttttttaagcaataatcatggctgtgcagtccaaagatttcaaatatataaatgtggaaacttttatataaagctttatgtgaggttatataaatgcataacttatcacatcttagcaaaaaagtcaatcatttataaatgacttcattgcattacttcctttgaatatttgtagtgaaggaccagaatttttttttagaatttttatgtagctttccttaatgaaaacaaattcacttgtttacttagaaaaggatcacatattttctctgagtttagaaccccctctaaaaaaaatcaattatgttgtgaaaaggatgtgtggtatattaaattgattgcatacttctgggttttttttttagtaagtaaaaatgctcagtagtataatagtaaatttgtaccttttaaattcttttatgtgaggagaaggaatacaaaatatttgcttatttattcactgtttattttaataacatattaattggaatgcagaagtataagttctacctattaaaaatgactcaaactatacataaaagttcaaaagggaaaacccatcacctgtaaataacaatcatgaaatttggcgactatcattggagacatactggtgcctaaattcagataagatgagagataaatacttttgtaagaatggtttcttactatacaccttttaaaaaataaataataaatatttagataatatagtcaataatagatactcttctgtaagaatgagatcttatcctacacttaaaaaaaaacagaaatattggccgcgcgcggtggttcacacctataatcccagcactttgggaggccgaggcgggcggatcacgaggtcaagagattgagaccatcctggccaacatggtgaaaccccatttctactaaaaatacaaaaattagctgggcgttttggcgtgtgcctgtagtcacagctactcaggaagctgaggcaggagaatcacttgaccccgggaggcggagcttgcagtgagcagagatcgcgccattgccctccagcctgggtgacagagtgaaactccatctcaaacaaacaaacaaacaaacagaaaacagaaaacagaaacattgagtttaatttttgattttagattttaattaaactgaaaaaagagaagttgaaacaacattgaagaaattgttaaatttcatgtatagatttctctccaatggagatattatgtccagaataatacccttacagttaagaccaaaaattttgaaaatagaaatagtttgaagatttttttggatgcacgtttaaatagtaaacaaacttttataacccttgttatgatagttaaatgcatttgcaatgtgacttgtcatcaactccacccataccacctcaatttaaactacatcagttttacattactgagtacatacattctggctgaattcccatggtctcagtttaaacttatttcaaatttgtaaggaattatcctttatcaacaggcttttactacccaattcaccatttctgtgttctttattttcaattattttttgggttgttagatttcagtaagtagtacctctccaccaaagaaatagtcataggtgctatattttctatgagtttgcatcttgaacatgtatttcttttgccttagacatgcaagatacgttatctttcttggatcaagcttaattttttcttttggaaatgtgtaaatgtttaaacatttttggagacccttcctgtactgaaagttgttttgcaacatttttaggtctgtctgcaatttccgtcattgaatgtgacttgctttttttctgataaatgcctacatgattcttttgttgtgtgtgtgtgtgtgagtgtgtgtatgggtgtttgcttttacagaatattcctggatttgttccattttcattaactttttttgaggtttgccccattaatttaagattcttttattttaggatttgttgtactatttcttttttgtcccttaactgggcgtggccaaattgtggttatcttgcttctttcttttcttcaggatcaccaattttgtacatgttgtatctcatttgtctactttccacatctttcatatccaaatttcttttcaattttaattgacaaattggttatcttctttatttgagaaccacttgttctcttgtttgccacttgaatgaatagtatagcttgcaataaacctattaaggcacaaccttctgtattgtgatcttgtaaatacatgtttccttctcttaacactctagcaatttcctcagctggcaggtttttgggcaatctgtatcctcctgaaagtaagagaaaaagaaagtactgatcggttttctctgatgtcccccaaaggtccatgatttttagtatttggctacagtggaaatgggcttcaagtcgtgttttggggttttgtccactaacattttcactgaagacggagggtttttgcttcgttttttatctgcaccacgaccactgccaccttttatatttctctttattgtttctgtgggacaatagaggacatttaaaaatctctttatttaaggagttttaaatagcaatctttcagtttggaggaattctttgaatgaaaattttattagaatgttgttattctcagtattcatattgaaaagagctgttctagttaagactgagttcatctgcatgatgtgttgtagtattaaacatttattacggtaaaggcgtaacacaggacatagtagaggaaaaacagagccattgggcatgccttctgataatgtcccctattagtttatattgatgaagtctgtggcctacttaactattttgcaatgagtcctaaggtaatttacagaaacgttacatcatagtaacatgaatcaaaatctgtagactcaaatcctttttgaaagtatactgagtagaaaacttatatgtattaggtttacaattaaatgaataaatgaatgaataaataactgaatttccctatatttcaaatccttaaaagaggcaataaaagaacatgatgtgtcgtatgaagtattataaaaaacgaatgatcttactaaaaagcaaatagcaatttctcagtgtcaataaaatgatagtgagagcaagattcaggaggcaagctcttgagctgaagtgccgcccattgtagatttccttccctatatctagcacagaatagctctgtggtcttaggcaagtttcttagcctctttgtacttcagtttccccattcatagtggagataatattagtattgactttacagtattttcaagagaattcagcaggtaaatatgtaaaaaatcttggaagaaagcctggcaattaagaagcactctatgtgttagttgtttagttattgttatattattattgctattataacatttatatatgagccttaggatcaattgggtaaaaataatataaaacaatgaaaagactaaaattataattatcatctaatcaattgtattgggtatttaatagagaattaaatttggagtgtaaatcataagtggatattaaaatagagctcaggaaaaatggtgagaagatatagagatgctggtctctggatccaactagattaaaaatagaaatggtatttctgtatacaccaagcaattggacatgatcaagaaaaagggtatatttgcgggggggggagggatagcattgggagatatacctaatgctagatgacgagttagtgggtgcagtgcaccagcatgtcacatgtatacatatgtaactaacctgcacattgtgcacatgtaccctaaaacttaaagtataataatactaataataaaataaaaataaaaaaaagagaaagggtatatttgattttttgattataaaagcaatgaacagaaaagcacgagaacaaataagccagaatttctttcttcaaagaaaaacatcacaaatacttgtacatttctttcctgttgttttatgttgttgttgttctttttttatgataatgccttaatcaagtaatgtatgcacctggaaacaacaacaataaaatttgaaattatagagaaaacaataaaataaaaaataaagacctttccatgatttcctgtcttatttcacagagatattttctatagtttattttattgtaatgttttccttctggccaccattatacatttgaataatatatttgacttctattgcagaatctataaactcaacatcatgtctgctgactccatttttttaaagatgggcagtttttcctattttcacactttcacaagacaattttaggtgttacataagtctttgaattcttttggcagtaatgcacacacacacacacacacacacacacacacacatatatatatatatatatatatatatatagtgggaaattttaagtattcaggtaaggattaaatttaataatgaccaattcccacccccagaattaccaaatgctaaattttattggagatttaacatcttcagtattcataaaatgaaaatactaatacaatatataataagggcctacgttgtaactctacctagtccattcctcattctacattaccatgaattgtatatttacatataattgttatatatgtatgcctatataaaatattattttaaaatattatggaaatagtatattgaaagcaaacttatttaacttgtgtaactcattccatattagactatttagactcattcttataaataaacacatttcgccgggctcagtggctcacgcctgtaatcccagcactttgggaggccgaggcgggcggatcacgaggtcaggagatcgagaccatcctggctaacacggtgaaaccccgtctctaccaaaaatacaaaaaattagcagggtgtggtggcgggcgcctgtagtcccagctactggggaggctgaggcgggagaatggcgggaacccggggggcggagcttgcagtgagccgagattgagccattacactccagcctgggtgacagagccagactctgtctcaaaaaattaattaattaatttaaataaataaatacagttctaggatatatttcaccttatgtgttttatattcttattattcattcccttattgagggatatttaatttattgaaaatattcactattgcagtgttctattatcacatacattgaaaacttatacacattaagtgagattttcattaagaatatcaagtccgtgctgcatgtcaacaatttcatgtttgttatttctggtctcagaattcctatgtttcaacaaatgtacttaattcatccgcacctactatgatgttgatgaagttggacttatttcttacttcttacttcatattcaaccaaagtgttttttagtaaacagtcttttattggtttgaggaaatattctttattcattttttcaacttttattagttaaaaatggtatactccctttatcgtattttagtaaataactattttaacataaaatgtacttttatattttcaaataaagactaaagatagtgtatatatcttcttcataaacaggacaatgacttgtttaaatttactctgagatatttctcccagtgctcatatttgcactatttatttttaaactgcccccaatatttttgtcaaggtttttttagacttatgacgtgatttcctgagttctttatttaccatattcttgctatttatgtgcatctcctagattctcttcttgtgctctgaagaccattttaaggtcattcaaaaattgttttaaactcccttaaaatttatttgttgaaaatcgcttatgttagtcacattctaaaataatactgtagttcatcagagcactctatgtggaagatacttttctctcaacaatttttgcatattctgttccatgatcttctggaatataattttgctcatgaggggactgtttatgatgtaattatcacacttttgaataaatattcgtcttttcactcggacagattttaagaatttctctttgtcattgatttcttcaagttcactgcaatgtatgtagttgtggagttgtttcaaatttatctcatttaggcctctgcaagctcctaaatctttcttccattctgaaaaattctcagctattatatatttcaatcttgcgtcttttaaatccctttattttctccttcaggaatgctcattcattatttctaggcttctgtctttgatttctttgcatttctttcattttctagtgttgcagtcagtgtaatttctaccaatctgtattttatacttttattttttaaaaaacagttttaatttctataatttatattgctcttttaaaaattatcctgctattctgcttgttcttaatagtttctctcccattcttaagctctcaaaaaaatttcagtaagtttattttagattgtgattgttttactattttaatttttagagtcaaatttctttattacttatgtctgctggatttccctcatggtggttcattcttcctggtgctcataatttttttatgacaaattcaccttcaacagatgttgttttctatgggagaccaaccttgtttgagttgtgtatgcttttgcatagcatcgcattgctattgattctacagtggctctacaaatatctctggttctggactattttatatgtgaattttttggcttcaaattatattaccatatagacagaatgaatttgggccctacaaccaagcatagtacacattctgggttctgattgcctttttcggattcttttttctaccagatcaccaagtttccataaggtcagctatgtaatgcaaaggacccctttttgggaggttattccaactttacaatctccttgccagtctgagtttctctccatttggtgcctctgagggcttacctctttaacatttaacctcggctatgtgtacttcttaaagagttttatacttacatagcatttacatgtgtttgtagtggaaaagaaatccctcttcacgttgcatggtgccgtgtacttccctatacttccatgttggctggacttgttcccatccgctttccatcatttagaaagtcatcaaactctcacttgctggtattttatttttatcaggtactcttatggtttcatggagttattttgtaataggcaatggaacatttgctaatttttttctggaaacattgtcaagtctcaggtatataatctaataagaaatggttaatgtcaattgtatatgtctttccattggctccacaaacattactgtaacaaattaaagtgcttgttttagtccaatgacagaatatgttagggagctctagaatttagttagaaaagcaagccagtggatgttattagtttatatattctttgggagtggcagctctattaattccttaagtttaatggtatgcaaattcttaaaatctagaggcaattattcaaaaactttgttagcacagcaattcctagtgacacagtacaagctgaatgctaaacggaccatatttttaagatgatttctgctgaataaaagtgagaatattggatgggtccttttaaaatccttttttaaaagtcttcttttaaggcgggaaggagagatcaaataagatatttggtgaagtttctagtaatttatcattcatgcatgtaagaggccaacatgaatgagctctcaaaagaatgtagacattttattttcaatgccttttttgcatattgtttcaaggtttatttggtttcccatatttgtatgtctaatgtggttgtgtaaggagctctatatggagaccgctgagctatctttctaaatagcaggagtgcaatatacttgctggaatagagcttttagtgaaagaacatgattttcctctctggcatctatcagggtctcccaatcactaaagcacagtaaatgaaagagaaactcagaaatcaggtgtgccgctaattttctatcaacagagttaagaataaattaagaacagtcctgccgggcgcggtggctcccgcctgtaatcccagcactttgggaggccgaggtgggcggatcaccaggtcaggagatcgagaccatcctggctaacacggtgaaaccccgtctctactaaaaatacaaaaatgagccgggcgtggtggcggcgcctgtagtcccagctactcgggaggctgaggcaggagaatggcgggaacccggggggcggagcttgcagtgagcagagatggcgccaccgccctccagcctgggcgacagggcgagactccgtctcaaaaaataaataaatacataaataagaaatagacatgcattaaaataataggtaggctatataatacacagaaaacatttatacaaaattaatgtccaggccgggagctgtggctcacgcctgtaatcccagcacttttggaggccgaggcgggcggatcacgagatcaggagatcgagaccatcctggctaacacggtgaaaccccgtctctaccaaaaatacaagaaattagccgggcgtggtggcggcgcctgtggtcccagctactcgggaggctgaggcaggagaatggcgggaacccgggaggcggagcttgcagtgagccaagatggcgccaccgcactccagcctgggcgacagagccagactccgtctcaaaaaataaaaataaaaaaaaaagaaagtccttaaagttgtgctgagatgaaaaagtttctgttattctagacttgatagaacacacttgtttaaagtggaacatgaaggtgttttctaggcatttaatgtcgttagtcaattcctaaacatgctcagttgtgaatctgtgttgctgacaggtagaattttgacagccctatatataaatttaccacaaaagtatatgctgaaaatggttctattagaattagccggtgcttataaaatataattttttcagagttgccgactttccttttttgttgtccctttgtgcagactgtgcctatgcggtttgtagaaaagagaaggaagttttctatctgctttctttagggcacttaggtggcaaaagtattatttttactgacttcactcttattctgtcttttgtcatgcagatgtacggagtgattttgcaataaacagaaacaactttctcatagaaaaagagagactggagtttaaaggaaaataatctattcgttatgcgtagttcaacataggaagccaaacagcagtttttaagaaattacacacacaagacacaatgcctgagccaattgcttttaccattagggggctccttttacttatgaggcaaaagtcatttttccaaagaaacatggaacaaaaattcattttctgccagtgaagtttcaagattcacatatatctttaggtatccaaaaataatgttagtctttgagtattagcccccggatgttattttcttttatgattttttttctacatgaaacggtcttcaattcgtacaaaaattctagttaattctgataaataatttaacgtactaaattaccaatattaataatatttttattcaacaatatatattagtaataattccacaaatattggctgaatacttactatgtaatagatgctatttcaggcactagtgatgcaactatgaacaagacagagaagagttctgctcctgtaaaattcacatctgatgcgtattcttgaattcaatgaagtatacaactctaccaggtggaaaggggggctaacattgttaattttcggtctcacctgacaaatgagcattagaagccattaaattatttaattccaagatgattattttagtaaagtaaacttgcatagtgagatgcaccaaaaagactaaataaaaagaaacatatatttactaagaataataattattcctctgtttttatagagagtgagatattctgggtttttcagaggattaacaaaaataggatctcacattatacacatgtttatggaatttcctaatcacagacccaactctttccctgaaaggtattcattttcgtcaagtgaatagtaccagtggatttactaagaaggtaaaatttgttcaaaatttgcaaactacactaaattattgaataaccttggtaaattagtacgtatataacaagtgaaggaaaattaataaccaacagaatatcatttaatacatttttccagttataaaatcatatatgtttattattacaaaatttggagaagacaaaatatgcatagattgttattctattactctgcatgtggcatcctttcagtcatcttgtatatgtgtgtacgtgtgtgcgtgtgtgtgcatttaaaatacaaaattgaaattaatgcatatgttctgctttatagcttgtttttattaattaacatcttataaacattctcaagtatcattaaatattctcctaatgctgaaggatttttcaccagatgggtgttccctttttactcaaaccaataacctattgttagatatttatcttttacacaatttattgaacaatgctatggtacatatccttgtacctgaatcttttaatatgtgtctgattatttcttaaaaacaaattcctagtagtacaatttgcatgtcaaattgtgggtttttaaaaatgtgagtgtgtatattactaaattgtcctttaggaagacaactccctctgtacttgcaggcaggtgagtgctctttgtgaccatccttgttaatactaaatattattaattgtaaatactctccgattggattacaaaacaaatacacagataacagtatttcagtattgctctatattacattttttggaaaatgcatgcctgaatgaatatttcatgagtgtttgaaccattcatatctgctcattttgctgaagtcagcctctgtcctttgtttattcttttgatattttacattttttcttatgctcaggaagttcatcagatatcggtgagataacttgtaattttcacttttcttcaagtttataagacatttaacttattacattttaagtgtgaaaccttgaaaaatgttttataaattatttgaacctcagttttcaaatgtacacagtgcagccggtaatacctgacctggctttcacaaactcagaatggtcagataaaaactgaaatagttaatgtttctaaatgtatttttatagctacaagtgatataaagttattgttctagtcttattaaagataaatcagtgtttgtccctaattgcacatctggtcataagcaagtctacaacttaaagtttcctaaatataggtccagtgttatcaactttttacctccggcacctagcattgtctggcctgtggtgtgtgatcattaagtgcctgcttaatgaatgtagattctaagtatactagagaaacataaattaaatacatctgtgctcattccaagtatgctattacagtgtcatctaaatctaatggtgaacaaaatagcacatattaagatgatattaatgttaaacttcaatttatgcctctgcccttggtaaccatgataatccactccatgatgaagcagtcaggaaatgtaagtagttatttatttcatcactacaaattgtatttgagacctgtgttttggaggtaatctatattgtgggctcttcaggaatttggtatgttaggaaaattcaggactgcataaggggaacaggaataggtttgagggtaaaaggaaattgtaatcatccctgaattaaaaaataatttatatgttacagacaggtaaagtatacacaaggtgtgtgatattttcttcttcaaaaaccctccccaaatgtgagatatataacttgcttttccagatagtcagaacaagaaagaacttcttatttttgttttagcttgcatttacgttgccataacacattatgttaatatttgatgttatttgactttggcagaacataatgaaataaggtgtttgactttgccaaagagagtttttggaacaaacctgtgtttgatttagatctgaggccaggtgttcaagacgagcctaggcaacaaagtgagacccctgtctgtaatacacacacacacacacacacacgcacaatctctctctctctcaaactttggcatatttagtaataaatattaaagccatgaaacaaacatattttacttatagcttagaataatcacctttataaatttcttaagtgatttgtagtacactgtggacttgactgttacttttatatcaggttataagtaatgttggctagacgtctatccaatgaactttccctttcacttcacatattctctgggctcatggttagccagaacaatttagaagccaaaaacataaccaaaattatcacatgtatttttactgcatggtgggattattttgttttattgacatatatcattttggtcaataataataataacaataaaacagcgttgagttactcaaatattagttggggctcttcagagaaatagaacgaatagtgccacattatctatctatctatctctctaaatatatgaattttccctttctccattttctgttttattaagggtctcaatggattacatgatacctacattggaaatggtaatctactttactgagtcccctgactcaaatgctagttttatctggaaacaccctcacagacacgtccaaaatattatttaatatgggcaaaccatagcctagtcaagttgacacataaatgtaatgatcacaatgatactagtaagagaaattcagttgaccttgctgataaataggtatttttcacacaaaagccagaaaatgatcataaaatatgtcatatggtttaaaattataattgttgagtacccatttcaaaatatgattgttcatttgaagaataaattttaagttggttcaattctatagataattatgacatgactgaatatttattcatggcaaatccaagagcattcatttgcaattgccattcatgtagatgtcaaagatgccactttttattgcacatattgtgagagggtaaaacaaataacctttcctccttaaaattagattgctcattaaatgtgtcattaatcatattttagactccaaaagatcaaagtaaaatggctctgaattttaaattttccagggtgacaaaagctgaacagtttattaatgtttgaccatgctccaggtgtggtggctaatttctgaagatgatgttcctctcctttcaattgcctttcagctctcatggtaggtgctaatgtgtataattagcatgatttcagagttgtgacctgaacgacagaccaatatctataagggttgtggtccagccaggttagaataataccaaattgatatgcaattaattgagcttgcaaagaggttactgaaaggagttaggtctaaattgcagtttcaaaataaatcacccgaaattatttaagagtataactgggactccccaaaagttacctccatctgaaaggtttagatttggaatctccagttgtgatgataaatataattataattaaggctctgggtgttaatgtcagtgttatgcagaaaattaccctagacatagatagctcccagcatctacatcccgttttcaattttatttctaataaaaaaatttaatccatttgaggtgacaaaattccttagagaataaatgttttttaaccttgggtagtagaataaaatatagagacaatgacatatatcaaactcatggtattagaagttgtgtatcccttatccaaaatgcttgagaccaaaaatgttttagagtttgaaattttctgaattttggaatattcgcatatatataatgagatatcttggggattgggacccaagtgtaaaaacaaaattcatttgtattttatataagctttatacatataacctgaatgcatttctatatggtatttttaataattttgagcaggaaacaaagttttgactacattttgactgtgatgtgtcacatgaggtcaggtgtggaatttttcagtttggagtcctgttggtgctcaaaaaattgtagatcttgaagcgtttcagattttggatattgagctcttgagtgctcaaactgtaatatcattgagctgtttagaattaagtttgtattaattagaatagtttctacatgtttggtgtaaaaagtgcttgttatatttaaggctctaaggagtctttgccagatttgatttgtatttgcacttttaattttgtaaataaataactgattttagacttacccgtttaagttgaaaagtactgtatataaaaattaactaactttttagaaaaagttttgaaatatttaaaagaagttaagatttactattttgtaagggtaaatacaagaattaaattcttaggtttttcttgttaaggacctactgttgatttgtcagactgtttagacactttaagagaacataataattcaattttagaattaccatttaaaatatttaaagcaattgtagtaaagtaagtcaaaagtcctgattgtttatgtgtgtttagtctgttcaacatgaaataattgaattttaattgtggcaaaagagaagaaagtttttcttgttttaataagattataaaaagaataacagacatataaatgaggctaaaaattttaagggggaaacagcgtttgcatttgaaattataataaatttgatattatgatccccgatgagcactggggctctaaggggattcaagggacttgcccgagactacagagcaggaattcacatacagattttcatatacgaatgcagtggctgtggtttccacattcattctcaaaaactcaatgtacctttttggagatgcatgcaaaattgtagaggaaaagaaagtaatatttagaatatagtttctaatcttttattgttaatcttcttgtttacaatttaccaaggcaaaaaagaaacacttttaaaatgtcaaaataatataaatattatctaccattgtttttctattcccagtttaatagacaagtttctctgtgtggcaataatttttaactctaaacagagccagtagctcctctattactttggactttttaaaagatatagttattttgagtttgcattcacacatattctaacttagaacacacaaaaatttacattatttattttctcttaacatatttgcaaagatttagttatatctgcaaaaatgatatattttttattcttctatttttacccaagttgttgatgatcttctgagatccatctgaacagaaaaggaagagacacatacttctatttatatacacactcatattttgtgtgtgtatacaaccttattagcttcttgacaaagaaactaaagagatttaatttttaaatgcttcttcccatactctatccttttattataatttttaagtctttaattatttttacatatctcttctatatacaggtctttatagctgggtccctactgctgactcagttttgaactacccatcgatcttatcttaaaattgttgtctagttagtggagcatttatttatcagcttttccatttgcttgaatattttacatggccaaatatatatctgaccaatgtccttctttaggaacagtgctttatgtttttcacatctgatatttacatcaggtgcattcaaaaggcagtgaaccaagtcctataaaaacagatagaagaatcacttttaagtattaatgtcagaagaagagaattgctttttgatttaggaaatgtaaatagtcaatcttattaaaagattgactttaaaacatatccaactctgctaaacaatggaagaatctaatctttttttgattgaagaaaccacataaaacaggtataccatcatggggaaggtaggtactttctgtattactgtcaaaagacaaaaattgcctcttgacttaggattccataaacttttatggaggtgtgcatggctggaagacatcaataccatgcattgttccttggatggtgggctaggcacatattctaacctttgaacatttctaaaatagtatctttcaaagctggcaaatttggggaaaaagaaattccttatacagacgaagcttgaaggaaggtgatgtatgttgtaatgggtttgctaagattttcacttaatattcagcagccctgagaagttttcttatcttctactctaagtcagtactttgaaaaaaaaaatatgaggagcaggtttgacaatgttgtcaggattgtgattgagatgaagctagaacgatgtgcagttgaagtcctcccaggtcctgattcaaatctacatctgatttcatgacctctgctgcattcctctgtcatgagaagagcagggactcttagtccgatgacagaatcaaccttaccctttggttaattagaaggggcagtagtaaagaactcgaattttagagccaggcacacctggatttgaatacttgtcagatgaaccacttactacatgattggccagagacatacactttgatttcactggcctcatttttcctatgtgtaaaattgagaaataatagttgtcccacctcatatgattgtatggaggattaagtgagattattgaatctaaaagtcttagcacaatgtctgacatacagcaactagtagtgaatttcagccagtgtagcattattgaaattattatgaataagggactattgtagatgttatgcggaaagcagtagtcccctggggccatatagtgaaccccagtgctatttagctcatttctattgtctacgcattatatacagttcaaattagtaacaatcacaacaagaacaaccatcaattgatatagtttcaggcactttctttagtactttaggctaacgtatttaattctcataaaaacctcaaaggatatgtggtatcattccccatcttatagaaaagtaaaatgagattcagagatgtaaagtaaatcggttaaatagaaaaaacagttgttagattgtagagtcagaattcaaaaccaggcaggcttttgccaaaattaacgcattttaccaccacattcttaattcccaaacagagcaccaagcaccctaggatgcaacagtgaactcagagaaggatcataggatgtaattaaatattctggtgaaacagtgatgctcaacatctgtcaattactgagtgtgaggtagtttcatttcaacacatatcttattatatttctttcaatatcatatatttattaaagctgggtttccagcggatgttgtggtaaaaaggaaatactgtgtgaaatcagtgtagaacaggaaatgaggctgggcaatcttattccaagttttgaaaagttgtgccgtgcccagtggtagtatgcttgttgtaagtagaagtgggtacttaagaataaaataagaatgctatttttcctctaatatatacatattatatttttaaagcatcctgtaagtcacttgaatataacttctttgagccaaaatacttaaaaatggaactattatgtagttattttgccctaggggtgccataaaaatgattgatccactaaggagatcatgatacgaataagctggggaacctctgaactatattattcagtttatcagggaaatatgtaaaacttaaggatcagttcatcaaacctcattaaccacctgttacttctcaagtacttagagattcctttctaaaagagctcacagcatagtaagaaagatagacactgtgttagtcagggtcctccagagagacagaatcagttaagtatgtgtatagctattatgacagaagtttattagaaaaattgagactctcgattatgcagactgaaaagtcccaggacaggccttttgcaagatggagcccttgggatgctggtagcctggctcagtctaagttcaaatgcccccaaaccagggaagcccatggtttaactcagtccaaagccaaaaacctgagaacctggagtgcttctgtgtaactccaaaagctggagtttcaatgtcggaggcaggagactagtgtagcccagctctggaggcagagaccaattcaccttttctgtttttgttccatccaggcccccagctgataggattgtgcccacccactttgaggacagatcttccccttagttcactcagactcacatgctaatttcttctggaaatgtccttgcagacacgcccaaaaataatgcttcactagttccctaggtattatttaatccgatcagattgatccctaaaattaaccatcacagacacaacgtgcatactgaaatatagtgtgtgaaccaaatttccaaggggccagactcccaggcaggtcacataaatattcaaaaggccatagcattaagaagtgagaggaagttgtattggggagaaaagcaaacataagaaattttccagaagagatgaatgaaagaggtccaaatgcatgctatttatagaataatgagtatggtaataatggagcccccactaattacactatcacttattaaatacttgttacgttccaggcaatgcattaggcactgggttgtagagatgaaagtcagagtgactttcctcaggctctgacgtctcttgaggagtctgacaagaaaaaagtacattcaggcaaatgataagagatgagactggaaagcatggctgtggtagaagtaatatattgcctgtaacttctaaagaggccagggacttttagaataattaacacaaggtctaattactttggattaactagtaaccaaatgcattcacaaatattgatgttattcaaatttgcttcatcttactaaaaaagatgctgtatttgtgtattcttctgccaaataaatgagaggcatatgtatatttttccagaatcatgacttattcagtttatggactaattattggttgagaagataagtaaataacaaattatcatatgaaaaatgtgagactgggagtaattaatgcaataaaatagattgctcaatatgcgaacaacttcattgtaaattctaggaaaagggcctgatttcagaagaaagataaagtcatcaaaagtcttaaggattaaattaaaagataattttaaacatttactgctgtagtatttaaatttaatgattctggcaatgagactattgaatatatgctgtgttatatgtttaaggggatggactcaggtagttaggatgtgattattactgtcctacgccctctagttaaatcctgatagaattctagttttaactgaagacctctatttaatcataggctgcatcaagttgcagacacaattcatgaatactcatatataatggcatcatgctactaaaacacattagttaaatactctcactcactcaaatggtagaggagaatcatctttctaagatatctctccatgactacagtatgggcacagagcaaggacaatcctgtctcctacatggtcaccattcctttatttattcattcagtagagattttcgtgcacagaggcagctactgtgatagcacaagtattacagaattcaaaagagaaagagatgatttccagctcggcaatcagggaagtctttaagaagtaggtggcattcaactaaagaatacactcttcggttctgtgtggcttgatgagtatacaccattataatcgcagactttggcagaacgggagggttgaaataagataaaagaaaggagaagagcagtggcaaaggcagaatgactggtaacattaattgaagaattctttatttgtattcaccagtgtgggcctctttcctatttagccatcacttgaatgcacgttgtcattagcttgctttactcatcctatgaatcaagccttggagatgttgagaacccagtttctgtgtgtggcagaaaagtaaagagatgaatagaagtaatgacatagaatagcatcctcttgctttttccactattaattctattctgccagcagatatttagcagcttttttgtgttaagtcctatgtggatacaaatttaagaaatgacacattttctttctcaaggggatcacaggtcaataggaacacagggatctgtcaaagatcatgataaatgtaataaataagagaacataaatgtggacatagtaaaatggtagaccagaaaaggcaaaagataattattgatgatggtcaaggaagaatacttcgcaaaagtggtatttttagtctcaagacattgagcaaagacattttttttgctctggtcatcccataaaatgactctcaataatgaatagaacaagaaacaaaaaactaaatttcattttcaatgaaacataggagaaaaaagtcacactaaagtgctttcaaaggaggacaactggaagaagcaagtgaattactgtgcagactcccctagaaggctcagaagctgggcatcttaggaggcagtggtagaaatgcttaaacctaaaatagagggctcatctgaaagtctgtcacttagaccttctttttctctcaacctacgggaggttggaaaatatttgtaggtaaattgagctgcaggagcagcacaatttcagttttaagaccaaaaaaatagcagaaagctgggagtttatatgatccttctgtgtataaggtgaaagacacataaatataaataaatgtaacatatgcacataggctcttaaatacccatgtttagaaattccccagtaaaaaccagagttagccttgataacctaagaagaaagcccacaagtcaacaagccacaatgatgagcacagataaatgaatgtattgctagggttatcacatttgaggagtcctcagtaaaagaaggtaagaccccaactaagtaattactggcattatgaagaaagattaagaacagttccaaaacatcaccattttcttcatagagattttaaagcctttttcaatcataaaagggaagcttaaacaataaacaaaagggccgggtacggtggctcatgcctgtaatcccagcactttgggaggccaaggcaagcggatcacaaggtcaggaatttgagaccagcctggccaatatggtgaaatcccgtgtctactaaaaatccaaaaaaaaattagccgggcatgaaggtgcatgcctgtaatcccaactactcaggaggctgaggcaggagaattgcttgaacccgggaggcagaggttacagtgagctgagatagtgccactgcactcccacatgggcaacagggtgatactctgtctcaaaataaataaataaataaacaaacaaaagaacaccaacagagaataagaaagaatttgaggacgtttcagttatgatagccagactcacaacaaacaaaaaaggcaacaaaacaacacttattacaagaattgtaagataaaattgaataaattatccagaaaggagactggaaataaaaataagttgatgatagtagcagtaacgtcagaatgctaaagaatttttaatcctaaataaaatgatccatatcttggaaccatagtgatacagaggacaccttcagcaaatatgagagtaaaataaaaatcctttttgtattccaaaattatgtaaaatttattccctgtaatcagaaatctgaagacatgctccaaaaatcaggaatacacaaaggaagctaaagacaaggagtgtaaaacaggagagtcaacaaggagaaggattaagggaagtccattaataatagcagtttagcaggcctggagaaaaacaaatgtgtattgtagtagtgtaggaaagggcttcaaagaaataactctagcaaaatcgaaggaatgagtggattatctgacaggaactatcatgaggaaaattgtatcaagacgattttatagagtacttgaatagcaaaaacaaacaaacaaacaaaacctcttctgtagatgccaaaacaataaaagcaatgaaacttacaaataaattattaactcttaaataaaaaagcaaaagttgtttacaatgaaaatgtgatcatactatttgaatcttcagtggacaacatttgtataggcttaagcatgaaagtactgaatatggaatatggatggaaagaaaacctgatatagaattatattggaaaactgagtggagaatagagatacaagagggtcgtattgttacctgttaaaattggatgccaatggagaatgccaagtcatcaaatcttttttttttttttttttttttttgagacagggtcttgctctgtcgcccaggctggagtgcagtggcataatctcagctcactgcaacctctgcttcccaggttcaagcgattctcataactcagtctcccgagtagctgggattacaggcgcctgccaccacgcatggctaatttttgtatttttagtagagacaaggtttcgccatgttggctgggctggtcttgaactcctgacctcaagtgatccacctccctcagtctcgcaaatttccctctgtggcttcacaggcatgagccacagcacccagccggggaatgccaagtcatgaatcaaagtatcaccgtgtcatagacattatttagagatatggaggtaaatgccagggagaataactggaaaatagagtggatgcttacagggaatggcctagggaagagatttatattgcctttgttgttctcaggtttatttggcttcttaaacacacgtgtgcattacttttatataaatataaataattgcttaaaattagaaaaatgaatctctgacaaagatttggagtaccatttggtgtttaccaggtggaccaaggacagaagaacatggtagccagagaggtaagaaaggttaaaaacaaaaatcagaaacagtaagtcctgttcagggaactgcaggtggtttgatatggctgaataattaggaggcagaaaagcaatgtgttatagtggttatgggttcaggctctggaccctatctttctagttttgtttgatcggtatgtgacttactgtgtgaccttactaagttctttaacatctctaagcttttgtatcaatttctatatgtgaaaattgggaactttaatttgtactgcaggaaatgaacctacaacctgttagtatgcatttaagttcacctgcagatactactggagagttccaagcttctctccttcaagttcctgcattgctccctgcatctttgaggttccccagaacttgctaaccaatgcatagggcaaaccagaaatgctgactggaagtagcaacaagtgatttaatgttcccagaggtattcctgaactgatgaagtaaaagagtaggttgataaatataccaggttctccatccctttatacagcaattctaaagtgtatattatatagaacctcagtgggtctacagagaaactgagcttcagttctttgcagtgtgattcacaccattctgcacattttactgaattttctcccttccctgtctcactttctccacactctgatttgtgcttctggtaatcacttcccaaataagcccttgcctcaaggcccgctgttgaagaaaggcaatctaaacaaatacctatgccatgttttcaagaggattaaattatatgctccgtacttagtaaggctaaatatgtaactctgctgcggtggttgttaaatgccagcatacgaggaaagttcatttatgcctgtattatcagttaagttattatcctaaaggtgaagagaagcctttcacaaaatgagttcaatccacaggactcggtgactcactgaacacgtgtggtgaggagcggggctagggaaagatagtgctctgaatgactcacagctttctaacctgtatatgacctgtacggaatagtaatgctcacaagcaagaagcataatagaacaattacagttttatttctaaacaaagcctaaagtcctggtttcataaatgaagaaaataatgctgtctaggtaaacaatttggccaagattcacaattcactgatccaaagtcctaagtcccccaataatgtcctttttctgtaagttttttcaactatcattcatctttattattcttgtctcttgaggtcatgattggtgcacaggtggtcaatataggtaacataattgctgaaagaattaataaagatttatttcctaaatcgatccaattcatgttgttttcttctattcaagtactggtcacttggtctttcatatagtcatgtctctctaattcataatttaatggaaattattttggcaactccagcagacatctgagagataagcatagcttttgtattgttagtgttttctgccagactgaagaccttggtgttaataagatggctgctttccaatacctcttaaaaaaaaaaaaaacaaacaaaacaaaacaaaaaaacaccattttcctctctcctttttcttttatttacaaatgtaatctctgatccatgaattcataaggtgagaacggtgagtggctagctttttatgggaccatacataaagggctaaattcagtgatccatctcccatctttctaactacttagggaaggaatttgaaaagaagtcaatgtggcagatttgaaggagaggctgttggaaagtgtgccacaggcttttttacattctgtcttcgagacaatttgagtctgcattttttaagtgaaactattagtaacgtagtgatttcaggttttttttttttaagttggtagatgtaggtcataataggactataattttatttatttattgatggtctgattttaagcccttagaatattaatgtctaggaacatttgagaaagaataacagaaaaatcgtgtgtgtgtgtgtgtgtgtgtgtgtgtgtggagaatgtctctttggcccagataaactcttcgagctttgacatcttaaaaactctatgattaccatatttttatacatagtcagatacatataggttcatagtcctgagaactggttaaactgagttgtcttattgccagggtctgaggaaatttgaaagagagcatcatagaagacagtgtgttgaacactgttaggctagtaacaaaagaatgagagccacaagactaaaagagaattccacttgtgcgtaaacagaacttcagttactagataagcatggctttttcctcatttttctaccctttcctttattcactttccatcaccccccttagttccctccaaaatatgaaattgtcattgactttattaagatataactcacatataacaaaatgcacacattttatgggtccagttaaatgaatttgaaaaacgtgtatgcccatataaatccctgttcctccctatcaaaatacagaatacttatatcacccaagaaagtactttcacacttttttgaagtcaatcctaccacatttcttgcctacaatgactgatctgattttgatcaccacaaattagtgtttttctgattctagaacgttatataaatggaagcatgtagtacggtgctttatgttggacatttagttcagcacattgtcagtttcatccatgtatttacacaaatcactacctttttcctttttattgctgagtagtattccatatgccacaatttgtttatccattcacctattgatggatgtttggtttttttcaagtttgggcttattatgaatcaaattcctattaacatttaagagcaattctttgggtagatacatgttttcatttgtcttacattctactttagagaggaattgatgggttatatgtgatgtttatcttagtaaatgtttttgaaagtggttgtgtcattttacattcctgccagcaatatacgaaaggtttagctgttctacctcgtcatcagtgtttggcatggtcagtctttttagttttagtcattattctgggtatgaagtgctatatctcattgtagctttaatttgcatttccctaatgacttatctttttatgtacctattgactctacatattttactttgtaaagtgtttatgaaaatattttgcctatttgcttctttttaatattattgttttatatattttagacacaaccttctatcagatatatgtattttgaatattttctctcagcctctgaagagcaggtagtcttaatttttataaagtcaaatttatctatatttttatggttggtcatttttgagtcctaagaaatctttgcttatcccaaggtcacaaatattttctcctatgtttccttccagaattgtatagttttagtttttatgtttactctgtgatctatttaaaattgatttttgtggatagtgtagagtttcatacagatatcttgtttttctgatgtcattttttggaaagatcatattcctggctaaattactttctttattacaaacttggaaaagcctttttaaagcctcttagcttttatctaatggtagagtacataaagtcttctaaagtttgtttggagattagcattattcctttgaatattttctacatttctgattttatttaaaatatgaacatagtagataggacacatactacataatgatcattgtttaataatatagaaagtaaattaatatagccaagtcactgagttgggaagaaagtgtgtgcagttactggcctctttattttctatgtaactccctttcctttttctgtgtcttcatatgtatgtaaatatttcttgagaggtatgtagtactgagctactctattggaacacagagttaaacaaattgacaggatcattattgataggagcttcagggaaaacattgttagaactaatcattacaagttttttgaaattgaatctcttatttataaaaaagcacagaaacatcagtattccatagctcctttataaggtctttgtgttatgaagctcatgttgcaagatggatattgagtagtttgccatattaattttgatttgtatttatttgtaaatatgatttcatcacattaaaacaagagctacaataacagaactttaagtaagagttaaaaatattcaccaccaatctatttctcctaccttactgatttcacttgcctgtattcttttgctaatctttgtatatagtcagaatgtttatataaggataaccatactacagaaatggtttgcctttctgattttttttgaaacatataagattacaaatatttttcatgttgctacacagccttcatatttatccattttaatgactacgaagtagtctagtaagtgatggatagtaagaccatcatttacctattttattactattgttgagtttaggtaggccacacatttttgcttagagctgactccaaacatgagaaaacacatgtgtattgccttttccttctttgtataatttatatttagaatatcagcataattaagtgcttgagaataaagaagctagatttttgtattgaaatcccacctttgccattttccagctatttcactttgggcaggtgttctgatctctctagacctcagttttcttatttgtaaaatagggataataacagtgcctgcctcatatatttttcatgaagattaaatgaattatttttttgcaaatcaattacagcagtaaaatgaatgtaaaaactatataaatgtcttcttaaagttctggttaatggaactagtatattaatttaatttatattgtccctgaatgtatgtgcatatccagatataccacagtatgaccccaaccttgcaggaaatatacatttacaagaaaaaagaaagagagagagaggaaaagaggaagagagaaataaataaaggaaaaaaaggaaagaaagaagggagggcgagagagagggaaggagggaaggaggaaggaaggaaggaagggaggaatgaaggaggaaagaaggggttctcaaccagcggtgatttaaaaacacagtttattgaagtataattcccatgacataaaagtaaccgttgtaaagtggacaattcggttgcatttaatacaggcacgatgttgcacaaccaccactatcctcttggaaaacatttgcatcaatccaaagaaagaagctcttaccaattagtaaatttctccccattttctccctttcactttccaggccgcaacaactaccaatctgtcctctgcctatgtagatttatcagttctggatattttgtataaatggattcatgcaatatatgacctttgtgtccagcttctttcacttagtataatattttcaaggtttatctacgtttcggcgtgtgtcagaacctcattgctctttatggctgaataatattccattttatgtacatatcacaatttgtttgttagttgagcatttgggctgtttccaccatttggctattttgaatgtgctactataagcatgtgtgtacaggtacttgtttgagtgccagttttcagttatttagggtatatacctgggactgaaatgatagggttacaaggtggttctatgtggagttttttggaaaccacaaaacgtttccagtaccacactgttttgattatcatacattcatatttagctttaaaactgggaagtataagtccttcaagtttgttctttttccaagttattttggctattcaggcccttgcaattacatagaaatttgaaaatcagcttttccataaccgttttctaaaaaagccattggaattttaacagggattgccttgaatctgcaatcacatgagtagttaacactgacatcttaaccacattaagcctcctaatccatgaacataagatatctttctatttattagatcttctttaattaatgtcagcaatattttctagttctcagtgtacaagtctttcactttctctgttacatttattcatgggtattttatccttcagaatgctattatacgttgatgtttttttcttaatgtgcttttcagataattgctggcatataggaacataactaatttttgtccttattttttatttgttttttaatttagtttataaaactaatttttatattttgatcttctacctacaactttgctgaatttgtcctttagtagctttttggaagactgagatttttatatgtaagattatgcaatctgcaaatggacatggttttgttatttattttcttcccaatttagataccttttattcagttttcttgcctacttgctctggttagaacttccagtacagtgttgaacagcaatggtgaaggagactattcaagtcttgttcccgatcagagtgggacagatgtcagtcttttaccattgagtatgatgttagttgcaggtttccctccaatgtcctttattttgagaaagtttctttgtagtcctagttttctgaatgtttttatcatgaaagtgttttggactgtgttaaatgattttctgtgcattaattgatatgatcatatgaggttttctctccccttcattctattaagatggggtattcctctgattgtttccttatgttgaaccacccctacattcctgggacaaatcccgattggccataatgtataattcttttaatattctgttggactagaggtgattttggctcccagtttatattagcaatgtcaagatatttttgattgtcataactggaggagggtgctactggcatctggtgcatgaagacaaggatgctcctggatgttctacaacagagaggaaagcgttcctttgtctcacaacaaaggattagccaggccaacgcgccaacaccacccagattgagaaaccctgaattataccaaccctgctactattcttggtataccccacccttatctctctagcctgtcattctgtcttttcccctccatctcctccaaacacataactttgtgtttcagtactccaaccacactgaacctcacttaatttcttctcttagtcaagttacctttggcctattatcttccacacctgtactttttctaatccgaacatcctgtcccataagaatgatataatcgagtttggggactcagggttgggggagattgggagggacctgagagataaaagaacacatattgggtatagtgtacactggtctagtgataggtgctctaaaatctcagacatccctgctaaagaacttatacatgtaacaaaaaaccacctgtatcctaaacattattgaaattttttttaagagaaagaacatcccttccgcttcttcactccccaacatcatcacctggttttacttattatgattcaattttcggccacttcctccatgaagattttctgactttccttagaccaaatgagttacttgtgctgcatttttcccaaacaccagcattgcccatgccatagcacttatcagagtttattaaaatcacgtgttaatttctacaaggtctgggagggtcgtattattgctcctatttgctcactattgtatcttcaagacccagatcagtgccagtcacaaagtagtcattttgttattcttgtttttaagttatagaatgaatacaagaataaatgaataaatcagcctaaatttttctgtatctggaacattcaggaaatgtgatagttaagaaatatgttaatgttttatgtgtgtacacctcagatatgcctgagaaacagaaataaccaatggaaatatttttattttagttatctaaatctttacttatctgtcttggccctaattgactaaaactatatctgattttttaaaaattctcaaatgtttgattcagtatctgtgcagactgagacacagacccaaagctttacagtgtgaatttttaaaactaaatcttgaataaattatcagatacataagcaaaatttggaagggaaatttgggacaaaagaaagcagttcattttagccttttacatcaatgggcttggaacatgacttccaaggaattgctggtgttccctggcagtgcccaatttctgaagaaagaagcaaaatgtaatctgcacacagtcaaatgccagaggcaatgtgagtattatgcaggttcaaaccaggtcagaataaaaatgactactaaccagccattcagcttgtaaaatgatagaagaactagttcttgcttattgcccttaacaaatattaaaaaataagtcagagtgtcagctactagatgcaccaagttttagtgctgctttatgggctagaagtgtttcaagtaagagttggctgtgatgtgaatttctgtaaattaaagcttagctttccacttaatctaatcaaagtaccggtaatatattctaatgatgatatgacaaccacagacatattgagatagtatcattttaggagaaaagatttgagacaaaagccaactccatgttatgatggtgaactagataatgttctgcttttcgggcactgtagttttcagtttgcttttagtttcagtttggctttagtttggatttatatttcacaggatttttcaaattgtattctctctttccaccgttaactataccccaaaacacgctagaatcgtaggaattctcctaggcctaagaatcttctcaagcaatattatttaccccagagtatttttgtctttcccatatgattgtctaaatatttaaatcaatgactgattttgagaaagttgctggttttattagcttattttccttgaaggctttctaagcctccattcctcactggaaaatggaaaggtataccgaaagttgaatcagtatgtgattttcaaaaacatgtatatacatgtattcaaatgtgtcctaattataaatgtttattaaaataaatatgattctactggttaagataaaccagattctctaatttccctcctttgtcttgccatgtagaatggtgagagtccatttggctcagagaatgttcagtttgaccttttccagtcagtttatctaaagcagcagcaatgatttccaatctcattataccccaggtcactgtcttattatcacatttattcccctcttcatacttatcacaatctttgttaattgtaactctgcctattttcctactgtctgtcaccaccatctttagaataagagctccatcatggcagtgagcatgtttgccttgttcaattttgtatcactgacatgaagagctcttagcacactcatcaatcaatatttgttaaatgagcttttcttggctgcagacaccacattttattgactggaaacaatgtcttgagccaagcctgaagagaagagaaagtcataatctttacattcagagttacttcctgtgtcccttcaacgtgattcttccaacatcaccaaggaacttcctacatgattgaagaaaagatagaaagaaagtcatctggagagttaacacatttcccattggtgctgaatattatctcctaatattctgaagatgtcatcaccaggtcaatggaatctcaatatcctaagttatatatagacatctgcatacatatgtacattatatacaaatacaatattatttaatacaaattatataaaagtatacaaattatataaaagtaaatttagtttttatatattttatatgtgctatatataatttatacatgcttctgtaaaagtgtttactatttcatttacgagcaaaatagaaaagttgaaaatgcctgtttttccctactaagggatgtggaaatagggttgcttcaaagacacattctagcacagtttaataataattactcaatcaccacagacaggaaaaagttaatttatttggaaactcaactttatataaatgttactagtatataccaatgacagtattacataatggacaaaaggataaatatttaataagtttgatacttcaggtacagtaagtaaaaatccatttttaattacataaattctttaagtttaaagttacctagtcaaatttatctgtactgatagctgctgtcagaattacatgtaaacgcatagacctctctaagtgattatgttgtattcttctataacaatgagattcagtaaaagccgtaaatgataacactagccaataatttgattcaaccaacacaaccagaagaagcctgtgaagtcaataaaccagttccatgtcttatatacaaaaataataggttgattgaatttttactttctgaatctgttactttgatacttattctagacattaaatatattttgttgattgaatttttgcacactgagaaaatacaatctaaatatagctggagggtcttttctatttttttccaaatttttcaggcctttcattcggccaaagcaacaattgatgtggtattttctaatatctgatacagcttttcaattttgtgtgtgtgtatatatacatgaaacacagattgttcaaggggaacagaagcctatgagatatagaaaccaaaggatatgccttttaaattgagtgagcacagtctttagggcctacagtttcaaagttttgtattagggaatggctgaccacagaaatttttctaaattaagtgcataccaactagaattacacaattggcttccgttttgctacttgaagctcccaccttgagctggtttcactcacttattgttgaattatagagacagttgtaactaaatttgactcttttacctcatccttttgaaattgtgatctttcttccatctccaaatataattttgcagaccatgaccttcaacattacttctgcatcataaatgtgattttggcatcttgttgcagaatgcctactctgaggccttaattctcacatctgatgataccctgaggatgacatgtgaggccaagagggagtgaagcctcatccccactttgtgcttctttattaaccaggtaacagttatagtgttctttgtcatctggtcaacatcactaatttatcctgtgcacaattggaggatcacctagtccaactgcctccccactccacaatttgtcaaagagctaacactcaatgaagcaaagtacattccaaaaatcacacagaaaattaggcatggtacctgcaccaacacttaagtatataaatcaacgattatctagagaagcctggagtgatgggatcattgagtttagaaactaagaacatagctgtgctggttttagagaaataaagtcactattcacctattctattttccttttccttttgagtgccaacatcctcctgcagatgcatatatttatttacagagcaacatgcttgtgttagctgtttgtttctaaagtttttaaaaaaatgacattagaacttccaattttctctttagcaacccaaacacatttaaattataaattgaaatatattgcacttttaatagttcaagctttctgagtactattcagttccataaaaccattttggataggtaacttttttatttcttatcttctctaatcttcacttcaatattggaacaactagatatatgccttcttttgtttgcataatttttctttttagtgtttatgtaaatacatagaaggtaaaaattagtgaactatattcaaggaagggtgttagaatactaatgtagctaatgctgtgcttgggaactacttagggagaaatagattggtttaaaaaggaagttatagaatttaatcaatcttgagagaccagcagcatgctattgtggaactataactttagagaacatctatatgacagtatgatcaccaaaaacttcagcatatgctgccaagataatgtgcatattttaagtgcaagttagagggctccaccttccctttttgcctgtggtctcctgattatagcactcaaagtattgcatctgggtaatcctccattcccaggcgacttgagaaatttgatcccgttggtgtgaccaaaatttccaagtgaaatacagaaattgtaccgtcttcatgcatataggcacaggctggggaaaggtttgggatgacttttggctttgccctttcctgttttgtgacctacagtaaattacccaactttctgcacagtcactttgcattttttcgtaaaatgtgaataataatgcctttctcacacttattttggagattaaacataaatatgaatgtgcaatgaattctaatatgcaaagtgctatatttattaaatataagatgttttctgtaactccagcaagtttccagtgtcaatgttggtatatccaacacttcctacatgacatctgctggaggcacatgtctataactgaaagttaaatgtatgtgacttctacatgaatttaagtatgaatttctatatatttatcaatagttattgatttcacgtctcaagtcatgcttttgaaaactatttacatcaagactctattcatttgtataaaatagtttgttttttaaaaacagtttttcaagacttttataaaataatatccttttgaatagatacatacatatacaggtaaatctagatatatttttaatgttgagtttaagaagtagtttaaaaagcaaatctttaatttttagtgtgatttatctattaaaagtcctgtcttctctatattctctctacttaatgaaaaagccgattgcaaaacaagaagattgattaggggtaataagcttggtattctagtaataaaaatccttgccaaagtccaatctttacacaggacattgactttatttcaaggccaatttctaaccctatatctaaaacatggcaggggtttaatcattgtagcagatgctgtctatgcccttagtgaatctcctaccctcactcccttcacccctaggatttgccactgtaaccctgaaagataacacggtgaaaacctaactaagtatccctgactgaaggctattttctggcctaggaagcgtgctttcctccaagcaagaaaaagcagaagtgcctgagagttaatgctccccagagcaactctcaagcaattatagatggggaattgataaataaatacccatctttctagccccgttgttgagttcctgagcattgttctgcaccaccttccagtggtccccagaggaactgagatccagttgatgacactggcaaatggcttgataacaaaccttcactggcttcattctctttctgagtaacccactatcctagcaatgtttcttgggatcccaactaaacttgcattcaaatccttgattcagaatctattttgggggggatctcaaatgaagacaacaatgtttgatcagtacatcaattgacatgtatgaaaaaatgtgcacatatgcagacaagaaagcttctgcctgtctgtgtcaaaataggaatgatttgtctttctttaacctggtttatagcaactattagaaatggaattcaactaagtgttgcaagaagtccatcatttataaattaagatggaacttacttactgtactttgtctccagagattctttgagtgtaaataacatagacaaaatcatggaatattaagaatggcaaaggaactgagaactctttctcacagctatcaggttgttccagcgaaataacaggcagaccctggagatgttccataaagctggctgctgctaaggtctgctctgatacctgctatgtgataaaagttcctgacacttagcaggagttgatgtcctggtattccacctgcaaatggtaggtctgcagggcacaccaagcacgatgatattcatcctggaaatgtagtgctgagctcagaagtaagtagggtgttaattatccatgactagtcacataaaatcatgtcttatactcagttctggcctggaatgcagggtacacaaagggaggtactcattgataccagcaggagctatatgcaagcttccaaaggaacaattagtccttcagtgcctcattcaaaggctgcttagggggttgctctccttgaccttgagttaatgggagtatgagtgttcaatgaatggagattagccccagaagacagggaagcaaattaaacccctattttgatttgaattgggagtgaataaagtgttcactgctcactaaactcaagtgaagttaacatgcaggaatgaatggagactaacttctctgtgtggcaaggaagacctcaaggcagttagcacctgggaacctccagggatagagctgagacagaggtggtcattcatcattctctggggtgataagagtttttcagtaaatgctgtatcaatgtagataaatcttcctagaaccaataaaaatgccctttgccttttctatcttctgttacaagtaattgctattcaccttgttatgaatatcttgaaagtagtcacagagtacttggagtgcctgcgggatggaaagtttgaaggaaaaatgtagccgtatatcattggcattcatgagaaaattcagattagatgtttgaaaggcaggtccccaggaggcaatagagaaatcaggaacaatattgtgccaaaaataccactctggccaggacatcagggagtttatgtcaggtagagtgaaggaaagcaatttggaaagaaaagatatatgtgcttttctatatgcatttagtttatttatatgcgtacatcctctgaaaaactagtatgttctgggaatcgacaagcagattgggcctgacacttctaaaatatgtaactgtgtttatgtttcttttactctaaaaactctgaataacatcttgtaatatgatcaatactttttcaaactcatgtcttttaaaaatctgtttgcaaccaataagccaaaaatgggatgtgctcaaatatcattttacatttgggaggtcaagtttatgccattggactttacgtgcagattacaaaatattttttctttctaaagacacacctactctggtgtcctaaaaatcagttatctcattgatgacacaccagagatatatgttttttaaaatgtgggctgggtatggtggttgaagcctgtgatcccagctctttgagaagctgaggcaggaggatcatttgagacaaggagtttgagaatagcctgggcaacatagaaagaccctgtttggggcaggaggatcatttgaacccaggggttcaaggttgcagtgagctgtgatcccactactgcattccagcctggataacagagggaaactctgtctaaaaaataaataaataaataaataaataaataaataacgtgaagatgttgtggatgatatcatccttgctgggggtcactttactgcacaaagaatttcacttctttccctcttctagagtgtttgaataacagtcacttgacgacagttagttcagcttaagcctacttacttttcttcattccctttatttaaaaaagtcttatgtgtctgctttcaaggagactctcctgaattctatcaagataacaagaagaacaataactcaaaattattattgcttctgagaggctttttctataatatacctgaaatacatttaaggcactcataagtagcaaccaatcacccactcattcattgaataaatataagttagtgcatcatgtatacaaggacacatacacaagatcctgaaaaatacaccaagcaatatgccgaaaaaggagacgtgccgcaaatattttgtttattcattaaagataaattgattagaagttgaaaggaaagtggaagtacttttaaatgaaggtttaatgaaaatttcgtagaataaggtcatcgaatcttgacaatgataaaaattagagaattccaaggagatggaccaacataaacaaagataagacattcttcaaataacttgatcttttcaatttggttgttttgtacttacttttgtagtaataataataataatagcagctagtatgtattgagagtgcagactgcctataaaatattgttctaagcaggttatatgagtaaacttatcctcaccttaaatgtggaaagtagctaccattattagccccattttactgatgaggaaactaaggcacagaagagttaagtaactcacacaaatccttcacctagtgagagccacaggtcagatttaaacactggcagcctggctgtatagcatggactcagctgtgactgccccctcttgaggcgctcatggagccagtcagtgactttattttcttttccattttcctacagacatgggtagactgacaaagtcaatgctgtcttggatatgtgagctcagggccatgcaagataaactcctagattaggttggtagctatgctctagaattaggacttctgattacatcatgcagggaaaaaggattactgttagggaaacatgtgttctcatattcttctttccttcctcggatcctctaagtctaatcagtagccatcaagactgaagcaaaggcagtatctggagcaacagcctgctgtggatctcactacagcccttcccttcctggatgttttctcaaaagtaccttcacaatcaatcggcctcctgtgctgtaagccagttaatcttttttttcagactaattccaaatacatatatccaggtagctaacaataatactgtgcttcctgtaaataatatggaaagaccactcactgtgaagtcaaaagatctgggtacaaggccccgatcgaccatataacgtctatgtgcttttgatccgttacttgaagtagtgttatattacttggaagtcggcctcctccttttggccacagcatctcgacttttatacttgtcgttactgagttgcctgctctcccatctcaatttggaaatctgagaccagagttgttgctccatttactcaactaatgttgctggtgatagatagtagggctgtcacggagtcctttggattcctggcccagtgttctttccactgagctagtctcctacagtgtgctctgtggaacctaagcccttggggaagctctgcagaaggtactttttcttccctctaaatgtgattttagcatcctgacataatcccctccacactgctagtagcccgtgatactcttgcctagacctggatacaaattaagatcacagttttgtcccaagtcacctacattcagagggtccaaaatgtaaaatgatgcttttaaaagaatatgaagaatttatcctctgtggttacaggaaagttagctaatctccctgaacctgagttttgttttttttgttttttgttttgttttgttttgttttgttttccgggtagtttaaaaaatcaaatgagacaatttatttaagaaagcatctttcacattataaatcagtttacaaaagcagggtactatttatataaacatgaattccagatattggaaggtggcaatgtctgctgttagtaagaatgcaggaagcacacaagcagtgtggaaaaatcttagataatattttagtcccctgcccttggagaaatgtatcatgaggtcagtgggtgaatttctttgcctgcaaattgtatctcctttggatacaatttgcaaagggctgaggaatgaggttggacccccatgccccatagcacaaagtatttctgctcagcagtcatgtattttgcaaaaataacccacccacaacgaagtattgcctgatttaaggttctgcaatttctaaaagccagggcacttaagatactgagatgaaataacattccctgttcccaaatgaataatgcattttctcactcttttttatttttattatttcaaaattcttgcctctcttttgcagagaaatttcccagagttttacagcatcactgttgacaggcaaccacattttcctcccaaggcgactcctatttctgtgaggtcaagattgacaatgggagcacatatcaggggatgggttgatggaagagaaggcaaaaggtccaattgtccaggggctgggtggggaccgtgaaccttagccaacagaaacagaatggaatcagtgtacatcctgctgtcagtgctctgtgattattttcccctttccttctcctaatggataagcttggaagaaagtgcattctttctcaggagagagctcagaactgcagggttttactgtatttattgtgctacatatacatatacacacacacatacataaatacactgtatatacactacatatatatattagtttcaataattctttcctaggtaggtcagaaaattcacattgctatgcattattaaaaagaagttatgaggccaggtgcagtggctcacgcctgtaatcccagcattttgggaggccgcaggcgagtggatcacctgaggtcagtagttcaagacctgcctgaccaacacagtgaaacgagtctctactaaaaatacaaaaattagctgggcacggtggtgagcgcctgtaatcccagctactcgggaggctaaggcaggaaaatcacttgaacctgggaggcggaggttgccgtgagccgagattgcgccactgcactccagcctgggtgacagaaccaaactctgtctcaaaatagaagaagttatgccatcgtgtgtggttagagagtcactgattggcatgaaagcaattaaaacccacccaattttcctgaccacttttataagacagagaaaatttaataagttaatcccttatggatatcttgggctctttgaaatttagagagctctattacatcctttattaattgaccctaaaaaaattaggagcagtctgtgtggtaggtagtatggtcacaagatttacagtgggcaacccaagaacagagattctaagacttactcaaactacattgttagctattgacacgattaggactctaagacctctgttattcttgtccatggctctttccccttgattagactttcccaaagtgtgttctgtgaagcgttcactgttggaaaagcactacagaaaaccgaatcccatgatcatggaagtttgggaaacagtgcaggctatacccctgtcttcaagttctgtaatgtacactggccctggagagatacagaaatcctgcaggaaaggaactgttttgccttatttagccttgcattttgcatattatttagctgcatggtgctttttttaagccccataaacacactgtaggaagccttaccctgtgccatctagctttataacaactcagggtgggagtcctcaatttgcacctctaataagtagaaatgtttctctttcaaatgttcagatttgagcaaaatctcccagagtaagctttcggcaaaattgtaaagtctgtaagattggccatcgggatgaaaaacatggactcaggattctgatgatactggtcaaatgagggatttttctgccacttatcatctgtgtgcactttgtccagttacttagttcctcccagtttcagtctcttcacctgtaaaatgaaagcaataattgtatacctcttatttgactgccgtgaagatgaaatgaggcagtgcatgtaactcctggcatagaatctcgcttctgttgggtatttgaaaaattctattattactattattctcattatcttccttttcagcctacctcctggcaccccattctgtctcttcctcctcctatttttctatcttgtcacacaatcttaaaggactctgcttccagctatcttgcttacctggtatagtgtagagatggtatacacgatgccttccaagactgggcaggtaatatgaaagagtgaagggaactaggtgtgagacaatagggggtgtcccccaaactatggcaaacacttgtgttaaagggccagtcactccggatatttgttgttgttaatgcctttttgttgtacttttaccgcatggaaatatggactagtgatgccaaattttcagataattaatgagaagtcaaatgtttatttttatatgtaattttccaatttttaaacactctttttaagaatctgttagactaccagttgatgacccctggatcaggggatttttagcatcctgttcctatatagtaataaagagctgcaaatttagaagtgtttaagaggtcatctagttgaacttcctacttgatcagaaatattatttataatatactagaaaaggtgtcatttatctattcctagtcagagagaactaagcatctcatggaaaaaaacattacactttgtatgtacaaactcactgaattctcttatgaacctcatgaggtagatgctactttttccattgtaattatcatgtcatccaggctcagaaaactaatttacttcttctaaagtcacaaagctattaagtgtctggtagattttaagaatggaattccagactgtttaggtttcaaagccagtgcacttaaccactggctaaacaattctacttgttaaaatgctcagggctgatattaagctgaaatttgctgccctgaaatgtccactatttggtcccagttttgctctcctgagacacaaataataagtttaatctttcttccacaagacagcccttcaaatatttgaagatgactctcctctgcctgctaaatcctctcttccccaggctaaacatactcatttcttttcactgaccctcataagtcatggctttcagccacttcatcatccttgcactgctccccaggagagtatttcaatttgtcaaagttcctcttaaaccgtgatgctcggaagagaacacaatccctctgtgtagttacacaagtgcaggtcaggatggaactagcacctccctggttttggccaccatgcttttattaatgcaacctaagtcatgccagatttttagcaactatgtaaaaagaaaagcaaacattgaatattggtccaacttcacactatagaattttattctctgctttttttttttccaaacttgaattgaaggaaagccacttttactcactctactcctacccaatatatttaagcaggtcatttttaaaactcaaatacattacttagtatatattcttattaaataccatctttatttatttactgttttggccgatactgatctgttttgttttttctttaatttgacaattatagcaaaacagaagagaaagaaacattttctgtagtgtgaccactttttcttaaatacattaaaaaagggttttttcctctaccactctaatattgctcacagataaatctatttatattttcccaaaaacaaaattttagaaagtgctttgcacacatttctgttttaataggaccttgctatattattgctttgtttagttttttaaaaaatttggaatatatgaagaagcaaaaacactgaaaaaatctgctgcttgccattttacttacatatatgtattatatatctatataattatatgttatatctatttgtatgtatgcatctaccttttcattcttttcattccagatatttccgatttctgctatctgatatactcactatctcttctagctttctgtgattctgaggttaatcaaatattcagtaggattgggctgagaacttaccactagaaacttctctctaggccaacctttagcccaggggtgggaaaactatggccatgaattaattattcttcacctgttttttgcaaataaagtttttattaaaaaaactgccacttccatttgtttatgtcttgagtaagactagttttgcattctaatagtacagtttagtaatggcaacagtgaccaggctggaagtatttgctatctagtcctttatggtcttttacagaaaagatttcccaatctctgctttagtcattagtaagtagtccctgcattctgttattgaattcattgctgagaattgaaactagcataaattcctatccctgtactaaaccgcactgaaagcaaaaataatttagctacttgcttcaggaaattcttgcttctagaggacaaaacttacttttcaagaccaacatcatcatctgtatcaagagcctgaccttcttgtactcatcaaattaaaactattatgccctaatctctacccacatttaatcagctcctcatcttgcaagaacaaccttaaaatcacctaacccaggtcacgaagccctaaaaatattgttttaaaaaaaaacttcagctgaattaaattgaaaggagtttaattgaacaatgaacaattcatcaatcaggcaacccctgattctggggcaaaccccagaatcacagcagatttggagagactccagggatacctcatcatcagaacaaatttgtagaaaataaaagggaagtgacttacagaaatagaaagcgaggtacagaagcagctggattggttacagattggcatttgccttacttgagcacagtttgaacactcagcagcgtatgactggttgaaacatggctgctgggattggccaagactcagctattgtttcaggcacatgttcctaagttagattttcaatcttgtctacctattaagtcaggttactgttggtcctcaaggactcaaatatagaaatatgtatttcttcaggccatttctagtttatattaacaatatcacccacttatttctccttctgagaaagtattacaactatgccaagttgtattctccctgactgtggaaagtctagcaaacttagatttgtccaatgaataagtatttcttgtcacctttttaggaacggaaagtcaacactacaaatcctcaaagctatagcagcgtcactcatccacattcttgtattctgatttatataaatacaaagagcatttctataagatataattacctgcatattgcagatagaaaaacaggtgcacacagaggctggagctatgctttggtgatgtgtgcagtgccccagatcaagaggtcacatagtagggggggaccctcaatcagggatctgccttcaagtcccaggtctcgttctaggtcatggactaaattttatttagttaactatcacctatatatgtaaataatggcaactacttatctcctctaggcctcagtttcctcagctatgaaaatagaaagctgacttctattatctatatagtttctttcaattgtgaaattcactgaaagtatgatttttcagcagtcttaaaactaatttcttcacactagtatctttcagcaagacttcatggcctcaagcaaaaggcatatgagagatactctcttgatgactgagttaagttctacagcttggtttctctgattaaaaaaaaattgtagaaatgattctgactatttccataacaaacatatttgcatttatttcatgctgttaacaacttaacatgtaatcatggctcctctaggaaaagcagtactgcttcttctatgatcacattaaacacgctgtgttacgtctttctactaatctatcatctattatggctgcctattttgagagcttggcataacaattatcataagtgatagcattatattctgaaaacaaagaatttgatggcacaatttatcttgctacttggcctaacttaatggtggtggggtttcctagtctgtactatatttttctcagatcacaaatagttcactttttaatttattattgatttagcttaaaagtaaataactccgtgaatgctaaagttggaaatctgttataaaaattattaaaaatcttctcttccttctggccatggatgtttatcacactgaaatcaaactgtggagctacctgaacaaagtgaatttgagatttttaatttatctggtgtaattaactggtcaactaaaaacaaaagggcaattagtgctgcacacatttgttctgatgatgaacatggcaactgaaaatggatcttgatcttcactatgaaatcctttagtatcaaagcaatgttgctgtaaataaggggagaacgaagcccgtgaggagtcacgcacttgcaacaatgatgtcctgataaactaaatccacaccagtaagacaactagagagagaagttggccaatatttcaaagtaatattcctccttgaccattctactgccctgtacttgaacagcaataaccaaagccttttagtagtagtttctacttttcctgctaccaatgtgagaaaatcatttcatgtactgcaaaagaggtaagaaaaaggtataatttgtaattgacctgaggatttccataaacagtatgtattaatgcacataattctccagcgtccaagtccatgtaacctagatgtatttatagaaattaaaaagcacaatgttgacagaattggacaagaataattttctattttcccccaccatagagtaagatgttttaaattattttagacattctctgtagcttctaagttaggttgggaagtaccaacccttcatgagcacctttcagaagcttattacagagctatgcatgcacatctactctgcctttttattcaagaaattgaccctagttctcactggaaaaaataaagttggaaaactcctctgtaaaagatagataagagaataacagaggtaccatctctgtttaggataactctcattgtctctcaagcctgccggacaaaccaaggtttaacatggcagccaccttccagaattttcctgatgcctgaggtccagccattatttgacttacacatttattcctggtttactggcaattgtgcacatttatagactgacgaatagttttagagccaggagatggagtgagtgacaattttccattcctaaaaaaaaaaaaaaaacatgattattctgaaccaaacaaagaaactcttaatgttgtttgggttaagcataattagcactgtgtataacctcactgtcacagcaataattgctgagttctttcatctgccttctgggatcagaagcaagtcagtgatacatggtgagaagaggtcgtataaaggcagggctcacagtctgcagctacttcaaaatacaggactgcatctttttctactacatagatggtattcttgttgagtacgtatacactgaattagaaaaatacagttggataatcctttaacagaaatcttcacagccaaatatattttagagtttagaattcattaaacgagagatcagcaaaagaaaattccagaagctcgaaagccagaaagggtcagataataaatattttcagctttgcaagccatatggtctctggagcaactattcagccctgcctttgtagcactaaaacagccatagacaatacatcaataaacaggcatgttgggttgcagtgaaattttatttaccaaaaaaaggcaaagagccagatttggtcagcaggctatggtttcctgacccttgttttagcctttagaaaggcaatggggtacgaattcgtatgtatttctatatatttataaatttgtgtgtacaaatttatatgtatttttatttgcatgcatatacatattatagacagatatgtacattaaagatacatataaatttgtgtgtgtgtgtgtatatatatatatatatatatatatatatatatatgtatatgcccaatgaacaatacacttatcatcaaccaacatctctgtttcagcagaaaaatacatcaatatttataataagctgggtaaaaagatctaagcaaccacacattgcttggtgtgtattgcctggggacagttctctgccaccaaataaattttgctaccaagctttcatgtaattttcaactttcagagattctttttaattgcaagaaaagtgattatagacctgtacatactctttccttgaagtgtttgaaattattacttttgtactgagcaatttcatgcaagaaaaagtaaatacacgttagtttatgaaccaagatactcactgctctgggccaaattatcatttaaaagacctcatctaaaacaaaatgctggtgatacatttttgagactctttttaggttctagaagtttctttaagttagatttatatactggttttcctttattacaccattttgcctcaagtgacctgtaggattctaggaacctagaattaattcctgtggctattttgcatgtcagtgactagcagaaattttactcactgaatatttctactcgattctgctgtgagtaaataactacacttttcttaactacattgttgtcattgagccagagtattctccttcctcaggcaatttaaactttcacaaatgaaacttttacaaatggcaacccatgcataaatattagctatttaggctagcagtatagaggaatgccaaataaaacatctttcgggctttggcctcattatagtatgctgataagcaatcagatgataaagggcaacatttgctatgaaattatacactggatggaatcaaaccatcttagaatattagagctggaagaaacttgaaggtgacttctaggtcaaacccttcaattttcaaaggaggaaactgacaatcaatgtgattgtacatgaatcactcaatgttactcagctggttaagagaaagagacaatagtagaagcaaaatctctagattcccaatgtagcctttttctctgtaccaccaggttgttcagctgtcaaatgcaaacctagctcatgcttgctgaatagctatgagctctgcattagacaccacgccgagtattacgagtaagtgttacacatggtgtttatcgtcaaggtaaaatgcaaaacccttggcttttggagtctttggtaagtgcaagccttaagagaaatacattgagtcagtgtgctctagaatctttaagagaaacttcatataaatttgagataaacgatacaggggactgggcactgtggctcacacctgtaaccccagcactttgggaggccaagatggacggatcactggacatcaggagttcaacaccaccctggccaacatggtgaaaccctgtctttactaaaaatacaaaattagccaggtgtagtggagtgtgcctgtaagcccagctactcgggaggctgaggcaggagaatcacttgatcccaaaaggcagaggttggagtgagccaagatcgtgccattgtactccagcctggacaacaagagcaaaactccatctcattaaaaaataataataataaaaaataaaaaataaaaaaagaatgaaggggcttggggcttgtcggattacttaggtagaaggagacaaaaacaaaatacaaacaggactaggcaaaaatttgtcttcttggctcaggtaagatgtttcatgattctacggtactgggtatgattctaggttctttggatgatggaatgaatcacagtaacactcagatacagaaaaagcagaactctgcttcttacagctccaaatgaggcaaagggcacacaggaaattgtacccaggaacagaactacagcaagcggggactgttggaggtagcttgcgaatggaaaatggcatagagatggctaggctttgcaggcctccggaggattgggtattttaaataattttctagcccaaggaagtaggggctgtttttgggtgttagagatttggagatctgtggtatttgggtctatgtgtattataacccaggattattaaagcctaataagggatatatttggggttgagtcttagcaaactgtccatgaaggggaactgaaagtttttagctgtagctgcaaactttcgtcaagataacagttgtgagatataccagatcaacgggtttattatctcttgatgacttaatggagagattatacactttttctgataatattgacagaggtcctggcttcgactgccattggtttcaattaagcaatatgctgaattttttacaaaatattatagccaaagaaatagataactgattgataatgacctggtcatatgcttgtccctggagcaagaaggtggaggcaaataactccccagctgtattgtctgatggtacatagggagatggttcctcaaaagaaagtcacagaccttttatcacaagaaggagacagaattattgggtaaaaaaataatgaatatccgttaaataagtgtaccatgtaatttacgttataagctgaggcttttttgagaaaaagagtctattgataattctgccatgacaattggatacatggaaactgtccagtgaaaacaaagatttatggccatgctaccattgtataggtttttagggagatacagaccctaaggaggaattctatgcaaattaaatgacatctatatagagataatacataatgcacgtgcacaggaagtagatctttgtcactagattggaaatatttagtagtagtctccttggaaaaggaagattagaaacctattgtgcatagtcttgaatatcattccaaagactttggatgtttgtgaaattgaaagtgattaaagtctccattgcataaactggcataattggaccaatctttgttttaggaagaaaattttggtggtaatatttaaatgagtagaaaggacaagagatttaaggcaggaagactattcagagatccaatttttttttaatcttcaaagccactactctatttaaaaccttcattattcctttcttgtactacaaaagtagcctttaattactctgtataattccagtttttactccatctctttcattctccacggtagccagagatataacataaattttgattctgttctgctcaacattctcaattatgatctgaaagtacagcattcatatgcattaacatgacctaaatgtcttgtatatttcagcctctttccctttctccaaccttgtctcatgccgcagttcttctgaatatcaaaccggactttctcatatctttgaacaggcaactcaaggcttgctataggacctgagcccactgtctctcttttgtttaggaagctagtctcatccttccttcatacctattgtaatccctacagctctgctgttttcatcccatgtacacacactctttgcctggcaaagagctactcatatttcaagcctcagctaaaaaatgctaactgaattccaccctataaatctcatacatattacatttttctttaatattatcatatttactacacaaatattttcctgtgtgcgtaaggttttttttgttttgtttctctgtttttgttaaatgtctcacaagagaacagtgcctcaaaggtagaaatgaaggattttaggctcaccattaacaccatagtgcccattgtcttgcaaagaatgtgattatataaagaaacaaacaaataaataaatgcttatgaaaatataattaatgaatgaatagatataacatatgatctaatttatgtaaggcattaaaggctgtggtatcaaaaggaatggaaagatgatgtcagatatgagaacatttgagaaaaacattgactcaatacctatgttgacccctgaatattgtttatttttcctgtgatttttatcctttgattaaatttggaaagcatttaacttaaattttatttaaacgttaagtataatcaatgtttttggtttaagatgaagtaactcatgacagaaagaaatgatttttacaatttaaaaatacatcaagaaataaaaattttattatttattatcatcacacttaaactccatacacttccaataaatatttaaggttgcaagaaaatatgtttccactatgttaaagtttccaaaggatcttatcacttgatatataatagttttatcaaatgtaacctactacatctcttgatagaaaagctgcaaaattataccataaaaaggccatagaaataataaaggcaataatagtggctgtttttgtaaacaatcaaccatagtctgttacaatcatacagttcataataactgagcttaattgtcaagattaattgttgagcttacctacatgagttgttacagaacatggacatagataagtttattctgagcttattctaaatttttatgagtttaggagtttttatgaacctcttattagatttctcttttgggctaaaggccaaactaacattttatcttgatttcatttatcactgcatagcttaaatgtcaaaataaattagagaaaattatgatgcaacccccttaggaaaagcaagtctcgtacctgaaagataacactgctagaaattgatttcttgcagaaattttgcagcacaatattaatttttctcttgtgatattaggacaaataatgttttctaatatttgaggtgtgaattgaaattaagaaaatatgagctgacattactggaactcgcagaacaaatgtatgtgtagaaagcatccatttaggttgctttattttggataataatattaatattaaattgaattaatatgcaacaaaaatatgcttattaaaatattcgtgtttgtacgtttttcatttcatgacaattttgtctttttcagactcttgagatactgactggaagatagactgttttgttccacctgattgtatgggagaaatttttgaccttagaaagtggaaatgaggttgctatggaaactggtaattctgctgccactcataaactcttctgcaggtaaagtgttctattattataagttttgattgataaatatattggcattgtatttctttctatgggtgaagcaattttcaaaatgcacaatttgtatgttatttgaatgactaagtgataatgttttgaaggtaacttctatgactcagacagggaaagtttaatccttaaaaatgtatcaaatgccagttttaaatggaaactaacattattacatttataaattggcaaatatgacatttttatacaatgtaattatgtaatatttaattatataatatactatgacattttaataaaagaatgtaattaaatatttttatcaccaataaacagtgaataattattcttattttcattatagtgaagtctttaaaaaattaaaattaaaatacatatttctctcatgtttagaaattgatatggcaaaaaaatcaaagctatattcatttagaagaaaagatgatatagaatgttacctcagaactagaaataaccttagatatattttctttttaattattttaaaagaatagacaagaacatgttcttttattcaacttgaacatattaatatctgtgtatcagttaacttttgctttgtaataagccacgccaaatgtgagtgtaataaaatatcaaataatcatgtatttagttgacaaatctgtgggttaacaacttacgatgggctcaaatgggtcttcttttggtttttgcctgggtgcactgcaacttcgatgagctgagtcatctgagacatgactagtctagaacattcgtaactgagacaactgtgctgccatggctgtggtccaaatgttaccctctgtgagtctgggttcttttacatggtggctgctcagggttccaagaaaacaaaagacagaagaatgcagcatttcttgatgccaacgcttggaactgctacattgccatttctgtgagttattttgacaattataagtcacaagacaagttcagctttaatagatgtggaatgacactacatctcttgatagaaaagctgcaaaattataccataaaaaggccatagaaataataaaggcaataatcgtggctgtttttgtaaacaaccaaccatagtctgttacaatcatagagttcataattactgagcttaattgtcaagattaattgttgagcttacctacatgagttgttacagagcatggacattgattagatcatatgattatcaaagaagcctctcttctaccataccatgcttcttccccccgactatgtgttgataggtactagtgaagtttcacgtacttataacaaagcagtaatacattgacagacatgcaggaataaacataatttaaaaggcagaaacacagtaattgtaaaggacatatattttatagcaatcctgagaaatagatatgctgatcttaaaatgaatgagaatgctaaaatatgcagaaatcaaacaggagaatcagaaaaccatacaaataaaagcaattttaccactagcaaagctagcagctagaagtgccatagttatatttactcaaagtgattacagtattttgattggtgacacctctaagtctctgtaacaaagatttggggttaaataatagtgtattctttttttggtaatagattaagaaaagacagagaaaactcatcaaggtgcccccaaatcatatatgtgtgaataagaattatattcctacccttaagtttcatcttcctgtcaaaattcaacattaacattttgccctttaaatatgtatattgaattagcataggatctctaaaagaccttttgtgttaaattaaaatgaattattagtctcagaacacgtatcaaatctgagaaatactccagctcttatattaacttttatttatacaaactggatgtgattcaacatgtcctgttgctttattctgatgggagaaatcatcatatacccttggtgcacaatttcattgtgaaagaacagattggatctattaagtagccatagctacttaaatgagataatctaagctaaacattgctccagaggtaaggatgttgataatgacatacacaagacaacactgctttaaatctgtttgttttgttagacgtttcatggtgtgtctccctattcgcagatactattttagtttagaaaattagattgtctgatgatagagttctgtgactatgcatagtgataatatcttgtttttccaaaacatactttttattcattctgaaatgccagcaaatctttcacaattacttactttttccttgctatttgaattattataatttttctaacaggttgatactttaaatctccctagactctaaattaaaacttaaaattttttgacaacctctcccctcattttctaaaaattaactacaacttctagtgcttttactatagtcatggcctcataggcctttacaatgaaacttaatccatacagtcatacatgattgattctgggacacttttaaagttttgagtacttaaaagtttaattgttctattttagtatttttaaaatattagaagaaaatgaaggcccatttaattaggaaatacagttaataattatatactttttaactgtttcattgatatgcatgacaggctaaataatggccccaaaagatatctaggtcctaatacctggaacctgtgagtgctacttgatacagtaaagtggattttgcagatgtgattaagttaaagatcttcagatggggagattaaaatagccctggactatccagattgtaagaaggaggcagagttagacctgacagaggggaaggcaatgaggcagcagagcagagggagacgtgaagatgctgcactgctagacttcaggactgaggaagggatcatgagccatggggtgtgatgaaggaagctctagatgctgggaaaggcagggggacagattctcccctctatctgtggactgagcatggctctgcctgcaccttttttcagccccgtgaatcccattttggacttctgacctccaggactctaagaaaataaatatgtactgttttaagccataacatttttggtaacttttatagaagtcataagaaactgaagtttcttcctcactatgctttaagcttccagatggcagggactatatcttgctggtacttggtagggattcagtaaatatttgttaaatgaatgaattaattaattaccaaaagttaatgttgtttgttctatttatgttatcacagtagaataaatttagtcatataatatcctctggggaactgttagtctggttcattcctttatggttgccagtgtgtattaaagttacagtcataagtttctagaaatagaattgtaataacgttttaaaagttttaaatcatgccgtatttgaaactctgtgagggcaggaaatttcatctggtttatgctttactgattctccatcccctaatacacagattctaaatatttgctaaatgaataaaagaaagcagcttcattcacttcaacaaatatagaaatatattagaaactatgatgtgccaggcaaggagcttgatgttgaccttcaacaataggtccatagtccctgccctcttcaacctgacagtctaaacagggaaaccagcaagtaagtccacttaaactgagattctgccccttgtgacaaaaaagttcttgactaatacagctttaaaaatttggttttgaggttgagttagtaacagaactctgctgggataaatgcttattcactaatgaaaatgaggaaaagagcaaataaaagaattttaagaagtcacaataattcctggaaggaaaaaaaaatcaagaggtttaatatagactaagaacgtttattctcagccctgagttactgaaaaatctacatttcttaaagtagaaaaaatatgttaatgagataatttggataaccaaattaataaacggagaaaaacttataactgtaagtctactttttgtctttgtagacaatgcacagattgttttcatgaggaaatattttatttatttatatatttgtttgtttgtttgtttgtttgttttttgagatggcgtctccctgtgttgcccaggctggagtgcagtggcgtgatatcagctcactgcaacctccacctcctgggttcatacaattctcctgcctcagcctcttgagtagctcagattacaggcacgcaccaccatgctgggctaattttttgtattttagtagagacagggtttcaccatgttgcccaggctggtctcaaactcctgagctcaggcaatccacccacctcagcctcccaaagtgctaggattacaggcatgagacatcacaaccggtccagaaatattttattttttaataaatactgaacaatgtcagtaatgggtagaagctgaaaaaccacgtagggtcaaattttgttgaccctagaatgtcacctgcctaagaaacccaagattaactgatgtgattaactgtcacattttcccacagtgaaaaattctcagaatgcacaagatgattctattttattaaatctttcaccttaccatggcttttatgtacaatttgaaaaatattagacagatttcaaaatttagttccaatctttaaaaatttgataattattaaaaatgtttaataaagacttgatgataataggttgaatcgtgtgctatatctgttcttatgagttaaccagggttagagatagcacaattttatctgcggactattagaagatctgcagtccttaagaagagtgtcagtgagtgtcaatggctgctattataactcaaacataataaacaatagcagaatagtagttacaaggagtgtgattttcctgatactaaatattcatatcatcttaagaatttctgcctaatgtattctcttttaacattcttattttaactaagtactactatttaaatggtagtttataaaacattcacttggttcataaatataaccacttttttgtcatttgtgtttgttttgccatgggttaaggacttttatatgtattttatgaaattacggactgaatacctatttggttagtcctgaagaagtaccagttattcagtatgagacttggttttatcatgaagaagtgcaataattcaagaaagtcaacatagagctagtcacatgtattggcagactagaatcaaagccctccttgagggattctaattattgtgttatgccaacagggcctaatgagctggtttctcctactgtattaattactcttgaagaataaactgagactcaaaattataataagtctttgcagccatcatttttatgtaatgtttgctgacaaatgtggttatattattttcaaaacttctcccaaagtagttgacttttaacactaaaataaagttgtttttagggctgatacccataaagaaagaaaaaatctattttgtcagtatttttacatagcttacttctttataaataacacagcctgaaagtgaatctgggagaaactgtcactctttctaaatactcacagtcaggcacctaggaaaaagggacattggaaagtatttatgattgcttgaatttcactctatttcaaacatagccttttattgaattgagaggcagagcaaacgaactacctgagagagaaaaccagaagaatgaaaatattcactatgaccaagatttcttcaaagacaacgatgtatcacacagcaaatccatgaaaattggcaggtgtaataaacctgctttgctcaaggatcccagaagcacatactggatattcctttgggtcagagtgtgaatgaatattgagtacgtcacaacccacactctgcctacggtcttgtttggatttattgttagcataatagcacctttaagaatggaacaccaggctgtatttttaagccaagtgacatcttcgcaatttctaatagaaatggtccaatttagaaatgctgaaaacaccattttcatgcaatgcttactgataaaggtggttatatgattatcaaaccttcttccaaagtaattgattcttaaaccttaaatgaaattgttaggactgataagaatgtaggaaaaaaaattatgttttgtcagcactggggggaaatgattggtatgcagactggcatactataggaaatgtaggctcttagttgaatggaatgtgagtaattgtgttttcaccatgaagtctttgaaggagagggtcaagtatgctatggaagtaataacaccaggtcatattttcactttaagggtactcaaaaatagctatgctatgacttgaaaatagcatggaaggattcataatatttttcttttcttttctttcttttttttttttgaggtggagttttgctcttgttgcccaggctacagtgcagtggcacaatcttggctcactgcaacctctgcctcccaggttcaagcaattctcctgcctcagcctcccaagtagctgggattacgggcatgcaccaccacacctggctaactttgtatttttagtagagacggggtttctccatgttggtcagactggtctcgaactcccgacctctggtgttccgcccgcctcagcctccctaagtgctgggattacaggcgtgagccaccgcgcccggcccaggattgataacatttttcttcccccgatttaaacaactccagatgcttaaaatcaaactccttgccattccatcaagtcacgaaacaatctggcttcttctgcctacctctttcatctctacttttacttaacttccctttgctcattgcattagagtcacatttttttcttatgctcatcaaaataccaagattgttctctgcttagggtctttgcatgtgctgttcagtcgtgtgaaacactcttcacatctttctatgactggctctttccattatacccatctccaatcagtcacctccatagtctgacgttcccttaggaccttgtctgggtaagtagtagcttatcccactattggtcctagtcactcttgtcaaccttttttactgttttcaatgagctcgtcgctatctggaattaacttatttatacattgtttaccagtgcactttctgcctatacctagaggaatataagttttatgtagttaaaatattgtgagtcgtataagtggctgcatcactgatgcctagtacagtgcctgacgcatggtacgcactcaataaatatttaaaataaatgagcacgttattgacctctcaaaataagaccccaagactgcttagggataaaccaatattcccaaacacctttagcaattgaactggttcttgttagaatctacttttaggcataaatgttttagtcacaatatatcttttgggcttaggattttttttttaatttttaaaaactatgctgtatactgaaagtagaaagctattcctaatttttgaaacgaatacagtttgcttagacacacttgacctaggcaggggtaacttcagtgtggtttgttcagggagtagaacatttaacatacagccagtgctgtttcagtattactgggtagcaaatacacgttgactttgtgtcacaaataatttaaatatttaaacttgtgggctgtattttatctcaagatgtatttttttattcctttttagttctgtcattaccagtcaagttgatccaccattgcctctccccccaagacatttgtaccagcctcctacagtttctctctattttgaggcatcctctgtgtcctttccaagacttagcttattgacacagatgcctatgcagagaaaacttcataaagcacggctgattttgtcattactctatgtcaagacctttacagatcccatctcctataaagttcaaactgtctaatcaagcattcaaattcaatttccttcaacaaatattggaagttctccaattaattcaattctacctgtgtcatgagccatgccttcccttactctccttcatgtatcctttattcaagtcagactgtgctacttgtaagatctctgcactttttaaaaatccccaagtctctccttatatcattgtgatattctgcattgttcttcttcagatccatttccatttattaaaggcaaatccaatctttaacacacttattcgaatgctatgttcattctgattaatcctcccagtaacatattcttccattttctcctgaaaccttgattctgtgaagaagaattttgtcatttccacactctttgcttagaatcaggtcatttctctcaaatatatgctcattctgagaaatatatagtatttacacttgttgaatttgtaactgtagaattcttagtcttaaagggaaaataaaaactcaactcaaatatttgactcgttatacctcataactagtgcattcgagtttataaagcactttatgaatagtgtttcatctgatcttgatagtgggcaaaggaagaaacgatatttgagtctcagactttctttctttctttctttttcttttctttctttctttctctttctttctttcttgctcttgctctttcccttccttccttccttcctttccctccctcccttccttccttccttccttcttctttctttttctttctttttttccagtctcgctctgttgccaaggctgaagtgcaatggcgctatcaaagctcacttactgctggcttgacctcctaggcttaaacaatcctcctacctcagcctcctgagtagctgggactataagcatgcaccatcgtgcctggctaattttttattttttgtagagactgcctctcactgtgttgctcaggctggtcttgacttcttggcccaagcaatcctcctaccttggcctcccaaagtgctgggattacaggcatgagtcactgcaccttgcctctttttttttttatttttaattttaatttttctgtgtacatagtaggtgtatatatttatggggtacatgagatattttgatataggcatgcaatgcataatcgcaatagggaaactggggtatccagtcccttaagcatttatcctttgtgtcacaaacaatctaattatactcttttatttatttatttatttatttatttaatttatttatttatttatgtacttattgtctctgttgcccaggctggagtgcggtggcacgattctggctcactgcaacctctgcctcccaggttcaagcgtttctcctgcctcagccttccaagtagctaggattacaggcatgtgccaccacacctggctaattttgtatatttagtagagacggggcttcaccacgttagctagcctgatcttgaactcctgacctcaggtgatctgcccgccttggtctcccaaagtgctgggattacagatataagccaccacgcctggccctgttattttcaaatgtgcaattaagttattattgactagagtcaccctgttgtgctatcaaatactagcttttattttttctaacttttattttgtactcattaaccatccccacctgtccccctcccgccgtcccagtttccttcctagcctctagtaaccatccttctactctctatctccatgagttcaattgttttcatttttacatcccataagtaagtgagaacatgtgaagtttgtctttctgtgcctgacttagcttaatgacctccagttccatccatgttgtttcaaatggcagaatctggttcttttttatgactgaatagtactccattttgcatacgcaccacattttctttatcaatttatctgttgatggatacttagattgtttccaaattttggctattgtgaatagtgctgcaacaaacatgggcatgcagatatatcttcgatatattgatttcctttattttgggtatatgcccaccagtgggattgctggatcatatgggggccctagttttagtcttagttactggatcatatggtaactctagttttagttttagaggaagcccaaaactgttgttgatagtggttgtactaatttacattctcaccaatggtgtatgatggttccctttacttcacatccttaccagcatttgttattgccagtcttttggatataagccatttcaactggggtgacatgatatctcattgtagttttgattcacatttctctgatgatcagtgacattgagcactttttcatatgcctgtttgctatttttatgtcttcttttgagaaatagctattcaaatcatttgcccattttttaatcgcattattagatttttccctatggagttgtttgagctccttatatattctggttattagtcccttgtcagatgggtagtttacaaatacttccttccattctgttggttgtctcttcacttcattgattgtttccttttctatatagaagcttttaaacttgatatgatcccatttaaagattgtttcttgacacagactcaattttttttggcagcgggcaggattttcctctgtcactcaggctggagtgcagtggcaagatcatagctcactgcaccctcaaatttgtgagcttgaactatcttcccacctccacctcctgactagctgaaactacaggctcataccacaatgcctggctaattttatatatatatacatatatatacacacatatatatgtgtgtatatatgtgtatatatatacacacatatatatacacacacatatatatacacacacatatatatacatacatatatatacacacatatatatacacatatatacacacatatatatacacatatatatacacacacatatatatatatacacacacacatatatatatatacacacacacacacacatatatatatatatagacaaggtcttgctaattcttaaactcctggcctcaagtgatccttttgcttaagactcccaagtaacagactcaaatttatgaaacagttaacctttaaaatctgaaaccaatttaaagggggaaatcacccagggccttgtaagtcatactaaggaactggattgtgttcaaattaccgcctaattaccatagtgggggcttattcatggaggatatgtgccaatcctcccagtggatgcctacaaccatgaacagtcccaagccctatacgcattatgtttcttcagtctgataacagagccagctactaagtgattaaaggtgggtagcatacacagcgggggtgcactggacaaagggatgatttcctttctgggtgggacagactggaatggagcaggatggtgtgggatgactggagatttcatcacactacccagaatgcaatttaaaacttatgacttgtttatttccaaaatttagcgtttaatatttttggaccttggttgagcatggtagctgaaactggggaaactgaaaccacagaaagtaaaactgtggataaggcgggactattatatatagaatttttttttattttggcaaatatactgtcattaattttatttctttttatcttataaaaataaataccttaatatatttatctagtataaattgacagaacaattaatctatataaaaataatctggttctcaaacttaacttcacattggaatcacttgaggacatttaaaaaatactgttactacaatcccacttagaaatttagagttaatttatctgtgttcaatgtaatcattcgtttgtttttctttttccccccctcaagacaaagtcttgctctgtcccccaggctggagtacagtggcgcggtctcagctcactgcaacttctgcctcccaggttcaagcaattctcctgcctcagcctcctgaatagatgggattacaggcatgcgccaccacacctggctaatttttgtatttttagtagggacaaggtttcatcatgttggccaggctggtcttgaactcctgacctcgtgatccatctgccttagcctcccaaagtgctgggattacagacatcagccaccacgcccggccaatcattcagtttttaatttttattaaaatccaaaatatctcagtaagtataatgtgcataaattgtgtcagttcaatgaattttcataaattcaacctacccatgtaagcagcacacaaatcaagatgcaaccatggctggatcccagaagccctttccaatcacagctgagacacagaagggtagccattatctgacttctcatcacacaatttacttttactgtatatatatatatatatatatatacacactacctatatggtcatttagtgtgtattctttcatttctggcttgtttcattcaatatcgggtttgtgagattcatccaagttgttgtgtataatggcaagtttgcttactctcattgctgggtagtacattattccattgtatgaatcttttacagcctgcctttccattctactcatgatggaccttggtgtttttaaaaggacctaagtgcttttaaaagctaagcaaatgattctagtatgctgtttctgaggttgagtatcaccaatgtagtcataaatgtacgtaaaaaaaaaaaaaaagaaaaattaatttgatatcccattaggcttccatagaatttgtggtagtgtttttaaatttgcataattctcatttttatttatctctagttgaaaattaccgacatatttagccagggtgtgctggagctgactcgtagcagctcatgaaagctgagtgttagtttcaggaattttgtaagcaagtcgtttaaacacagctattattaaaaattaaatagacatccaattaaaataattatattcaaaatttcataaatatttaaaattcattacttccaaattattttagaatattttcctattacttatggtcttgaggttgttcatatctattgtatttgtatggtggaaatatcatatcatggaaactactgtgcatttcttcccaaattatgtcatgttattatctggaaatcactcatgggtagtatttacaccacagcaactggcaaaagctacaaagcaggtcctcacttagtgttgatgctgaaagagtttcagtaatggatataatttgtatgacagtgagaaatagtctaagattatattgcatataatgatatatgattatatatatatgatatatatatatatataatgatagcaaatgcttactgggaataaagttagcagcagattgggatacaattccaattgtcaggtcatggttgaactgcaactgaagcttagctagagacataaatattcaataaaacttagcaaaagccttctatgaaaatcaattgacttatggaatttgtaattaattatgatattatatattttattatttttaattgtgggctacacatcacatccattgcattagtaaatttgataataaacatgtgtatatacatatatatacatttatatgcacacaaatatatgtatccacattcttttcagagacatggttgttaaataactgctagcatgctgctctgttgagctatgttttattttttagccatttttattagtggaagtatgccatgttttgcagatttattcggtacaaaaaacaaggtagagaagtaagtaccaagaccccatggtgcccttaggaatatatatatatatatgtatacacacacacacacacacacacacacacacacaaacatatatatgttctgtacatgtatatgtgtgtagatatatattttctatacatgttacattacactaaatgatattgtaattgttttgtctattttagcactaatttagattttgatattttatttttcatacagaattagtactaaattgaagaacaaagataacatatttggactcagttaaaaaaaaatctcaatctgaagatacctaatagtttaccagaaaacagatgaagagtttctttcctccctcataaaaaatcaaacttggtttaccgaaccttgcagctaacaacaggtgctgtctgctcactttgccagaagctcacaatagaacagattgggtacacacagaactaaaaacaacatttgagtaaggaacaaaaccctcccaaatattctgaccagctctataatcagttcttaatattgagcctggaaacaataatgatttctttaatgtcaaaatgggcaaagaaccttgtttgtattgttttgttttgttttacctgtatttgtgcacatgggaatttcagaaagcacttataatcaaacacaaaagtgctacatttggggttgtacagctcagaagggaggggaaaaaaaaccccttcttcttcgtaaaagtcttacagagaatcaccaatcacagagggagaagtgtgttctaatatcaaatctgtgtggctgcaccatcccttcttaattgccaattgtcttttccactttgtcctctttctgtaacattgctaaactgaatctgaggccagggctttaacttgatatatctaagttcatggccatacatttattttacttactcaaacacttagtctctcaaatagaattgatgatttgtcaaatgatttgttgttgcataatgacatagctgtggaagccggatcttgctttatgtttgagaacacatttccagagtccaaaagcacgtgaggattgatggcacagatgggcttgaagaactggtttcagaagtgccatcttctactcaactgccagtttttctgtttatcatctagctagacattctgaccctttgtatcctcccattgcttatatttttacaacgtcaaaatcactccaaatgagaaatgtgggaacagaaaagcaaagcaaagagtattcagaccacagaaaatcatctgtgcctagggactggcctggcagcctcttgttttctgtttgtcccttgaagacaatggaattgtaatccttgtaccaggagatcacaccatcctttccagttctgattacccaatgattctaagatgagaagcgttacacagttttacaatttcttaatagttctgatgaaagaatatatgaggacaacgcagcttgttttagctaaaaggcaatttgggactcttctgtgaattttatttatccatcttatgctattcccttgggtaattatgagtgaattgctctgtgctgtgtttcatcaaactttttctgactgttattttgaaattattatcaagagcatcactgaaggaacatagtcacaaatggataatgcttattaaactgcagtgttatatttgaatgccactattctatggctaaggttgtgctatgccctcatgtgccagccttgaaagctcattaatttgtttggttctgccagtcaggctggagtgcagtgacgcgatcatagctcactacagcctcgaacccctgggctcaagagatcctcctgcctcagcctcccaagtagctgggactgcaggcacatgccaccacacctggctaattttttaaattattactactttacagatgaggttttgctatgctgcccaggatgatctggaactactggcttcaagtgtcttcccacctcagcttccctagttgctgggattacaggcatgagctactgtgcccagcaaagctcattgattagtctgcctgtctgtcaatgcggtcaatcagttaattcagtgagatactcagacactccaaacaaactattaatctgaggagacaacctgaaacacatgattagcagctgatgtcgtaagaacataaacacttagccaatctgtaatcaatggattcatctcaatttaaactactgcttcttttagtggtaaacattgaagagcaggggaaatctgcaccaggaaacaacaagtttcactagactgacaaccttggctgagctagaactatgttttcagaatttctcttccctatccagatctggattagagatgaacaaaaaggaaatttgtgtgagatttggaaggtggaaatgatgctactctgtgaaagctgcatgtaagtttgtctggtgagaaagagacacaggttaacagagagctcgtcctctgtttccttcttcatatccaggttttggcccaactggtggcactactgaccaacattgaccttaggtccactccagttttagaggcaacagttcacaaacgcttccccttcacatgcccattctggcagctgaacttgctggcttccttgcaagatctgacttgaccacctgctccagtgcccaagagggcttgttagcagtatcactgtgatatttcccctctcacttttgtaccatcatcttctcttacaattacataaggtcttcctcctaaaatgaatcctctattttacatgattcacagtagttttgctttcctgattgaaccttaactagtatctgtacagttcaaatttgtcatacatgacaggggaatgatatccaaatcactatactttggtttttcctatgatagctggtgaatatggaggctttggaggggctatagttttcatgtagaatgtgattaggatactgaagaaattcttgacatatattaggactcagaagcctatgcaacttggcataggtattttttgtctcttcctctgtattgtgaagcctccctgtgccatttagtttttaggcagcagttcctgcttaccatccaaaccccttttgaaccttacagaatccccaaaagtcagccttggccttaagtcccacagtactgtgctttacctagggagcatgttaattcatgcataaaaattaaggactcaaggtacattatatcactgtacatctgagtggatttttttgtggcttaaccttgatttttagtgctataacccaaataaagaaaaatgcaagcatgcattggagggtattgggctgtaataaggtaataaagactgtttcagtggtatcatatatagtgctttacagaatatagggtattttcacacctcacctcatttacagttcatgatctctcatgacattattagagggtcagagatgttacatgcttgtccatggttatttgtgtggcttggaggaaccagaaaccaaccaagtgttcatatcctagtgttcatttcactgaaagatctggctttttaatgaagccgttggctcttcccattcccattctcattaccgctcatctaggctgttgcggaagactctgcaatcctcttttctcctattatcagccccactcttcctcccattacaccaataggaaatcataatagttttatgtttctcattttgcaaatgagtttcaatggtccatctgcttggatcaaacgcttcaagtgctgtccctttgctgcagaaccagatagattcttctcaaccttgtattgaagctctagcaggattccaatgagctttttcaaacttttttcctacctttcttctataaagacactttgtgctggccaaactgagtgcatcacccccactacacacacacactcacttctacaaggacttataataataataatcacaacagctacctgcattgaccatttagtagctgctgagtatctcactagttctttatctatattacccaggcaataaccatgagatgtgcattactattgtttccatttgtaatgaagaaatcaaagctgaagaggttaagtgacttactcaagataacatggcaggtcagtaacagaagttgtattttagcacggactgaattttaaaatggcactctcaaactctctgtgccactgcctttcttcgagcactccccatttcttacagtgcctgatccctctgaacacacattttcatttcttccttcccttcaagggccactccaaaatcagtaagtcttccatcatctccacattaccacttacccacagaaagtctccctctcttgaattcctacatctctgagaagatgcatgaggaaagagaagtataacttatgagtcggtaacattcagtgctcatttctcagtgcgttgcttggatcctggcatgcaggggcagctcattggcatcaactgttctaagtactggctaaacaagagacaagctctgaggcatatagtcacaaatatgggcagtaaggagttatcgtgggagtggtgaatgtggaggggctctgagtgggaaatagttcaacctcattttatagatcccacatctaggatacaaatcagttaagccacttgcccaatgtcattcagataacacaagagtacccgggagtgctgagatctgaacccaagtacacatatattcttcctgcattttgccaaacacaaggcaatttctaggcttagtggagttaatgatgagcaaaaaaaaggcacatcctagaagcttctggtcaaatggcagagatgctaagatacagattaaaattttttttaagaaaatacaagtttttaaaattgttttaaaggaatcaaactacacatctcatccagatgacagatgctactggggaaggaagcacagcacttatctatcagtagggctagggagctcttaagctgattaaggacacaggctccgcaattaaagacacctgtggcacatatacaccacagaatactatgcagtcataaaaaagaatgagttcatgtcctttgcagggacatggatgaagctggaagccatcattcttagcagactaatacaggaagagaaaaaccaaacactgcatgttctcactcataagtgggagttgagctatgagaacacatggacacgggaaagggaacatcacacaccagggcctattggggagttgggagcaaggggagggagagcactaggagaaatacctaatgcttgtggggcttaaaacctagatgatggattaataggtgcagcaaaccaccatgacacatgtatacctgtgtaacaaacctgcacgttctgcacatgtatcccagaacttaaaattaaaaaaaaaaaaaagaaacagtggttgtgagagaacagtgcagtagagtggtagggatgaaagacaaattataaatggtggaggagtggggagaataaaacaaaaacaaacaaacaaacaaacaaaaacaccttggttcatacctggcaccttactacttgtgtggcagggcaagctactgaacccctctctgtcttacatactgcatgacaaatgatacacattcaagtcacactagttttcattttttcctatcagttgccaatttcttgtactagagatctttacgggaggtcttacctaggtgttaccttccttttcacctagatgacgtatctgaaatgttgcccagatggggatccatatccaatgtatctttttactctgtctccgaagtacctaacatggctttggtaaatatcttttgtttagctagcaagcacatattaaaataatgaagtgccccgtgagtcacaatgatcatcacaaacagccatacgacatttcctatgcacttttacactcttttaatctcccaggtgattagatatatagcttaaacataccgtaagtccctcaggtgggcaaattgtattggccccattttacagatggggaaaatgagggaagggtaagaagcttgccccaaggtacagagtgagccagtggtggaactgggatttgaatgcaggctgtctcgctcctgaatctaacttcttagctgctagattcaaccgctgttcaacagagtgaagggatgctaacacccaacatatattgagcactcatatgtgctttcaaataattccatgagttaggatctcaaaataatttgacgacataggaaatgtcattctttttttcatttcatttatttattttgagatgaagtctcactctgtcactcaggctggagtgcagtggcacaatctcactgcaacctccgcctcctgggttcaagcacttctacttccctcagcctcccaagtagttggtactagaggtgcacgccaccacgcctgggtagtttttgtatttttagtagagagggaggttccccatgttggccaggttggtctcgatctcctgacctcaggtgatctgcccacctcggcctcccaaagtgctgggactacaggcgtgacacatcgcgcccggcctggaaatgttattaaccctgtgttttaggttgggctcctccagaagccgactttcagaaaaaaatatgaatgaaagtaatttatttaaaagataatccccaaaagccccagtaaatggtaagtgagacagggtgagaaaggatgaggtttgttattgagcagtgcacatctagtatgactgagactctgtatacaggaggtagtgtagaacacacctcagtgtcttatcagaatgtgactaagggaccaggaagctgggacacttgcccgtcactgccctttcatcactggcatcaactgttctaagcactgactaaacaagagacgagctctgagacgtatagtcacaaatatgtgcaataaggagttatcttgggagtgttgaatgttgaggggctctgggtgggaaatattttaacctcattttacagatcccaggtctgggataaatatcagttaagccacctgcccaatgtcactcaggtaacacaagagtacctgggggtgctgagatctgaactcaagcacacatatattcttcctgcattttgcatgttctctctaagcacagagcaatttctaggcttagtggagttaatgatgagcaaaaaaagggacattctagaagcatctggtctaacaacagtgatgctaatatataggttaattttttttaagaaaatacaagttttgaaaactgttttaacggaatcaaactatattgctgatatagagaataactcaggtggacgtgagtgggaagggtgtttaaaaaggcgtattcctggcaagggaaagccaaagtcactcatccgtggagacaaagcaggccagaatgactgatggggatgcagtgagtggcagaggaaggatggtatgaaatgaggaagaaggaagggaaaaggcagacatactagtctcagaggccctagtcatgctttaggatttaattctaaaagcaatgagaatttatcaaagagcatgcaattggcagaggatttgttcttctatttagcctaagaggcctccagattaaatgttctttctaaatacttaaaaaaggtgacatagtctaaaagggagacagcaaaccagctagaggctgtggtcaggtgtggggaaggaggggacattcagcctccttgttgtattcaaccgccttcctcagctctgtcttctcttttctgattctgtccacattccactttaatcctcaatgcttgtgagatgatccagagtttgactgcatatttagcttttcagggatactgcagataatgatgagaattattcatctttcttcagcataaaccgtatttaacgaggggctagaaaaataatataaagaggctttatggtcaagtttcagagctgagttaggaaagtaattccaagtagtagagtttcagcatattttatttcctccttttacttctctaaattttccaaatggatttatactatttttaaaataaaaatggtcaagcctttaaacatttgtgccaattatgtagatagcctgcaaagctgagacacttctcactatgctaatcagataactggctcaggctttctattttatttgataaactttggtcattctgaatttccaaatatcaccaaaaattctgactttgataaataatcaaatatttagctctattgtgtattttcttacaattttcaagtgatatgggtggcccatattatattcaccttaaattttattagaaaaagaatactttcgccggttgcggtggctcatgcctgtaatcccagcactttgtgaggccgaggcgggcggatcacttgaggtcaggagttcaagaccagcctggccaacattgtgaagccctgtctctaccaaaaatacaaaaaaattagccggatgtggtggtgcaagcctgtagccccagctacctaggaggctgagacaagagaattgcttgaacccgtgaggcagaggttgcagtgagctgagatcatgccactgcacaccagcctggatgacagagtaaggctccatctcaaaaaaaaaaaaaaaaaaaaaaaaaaagcaatacttttaatatgcttactcacactattcaaagatctttaattataatcatttaaaaactgtgaggtagaaaggacaataagtgttattctccccaatatacagaccaaaatatgggtaacgtaagctaaagacccacagttagtagcagaacccgttgaaaatcgagtgtctatttaaataacaaacctgggtgtctatttggggataaaacacccaatctctacagccctttgatttcaaaagaactgatatcccaggaagatagagaacttaacataaataagaataaccaaagtgaagcttaaacatttgtacaaaccttgacaatttcattttttgtattgtttgtattacccaagtcttatcacaggggacactgagaaccaaattaagtgtgtcaaaaatcaaaaggaaagatacataagccatctcctctgaattttttcctccttcccttgtttcttccttataaacactgctgggtacttaacttttaaaaacatgggctttgaggaaggacatagctgggtaccaatcccatctctgctctttaagaagttgggttacctctgacaagttacaaaccttgcttagcatctatctctttacctttatattagccacaatacccactccatagagtgggttttatatattactatttgtacagacttgcaagaatgcaaagtgcgtagaaagtgctcgataaacagtaactagtggtgactggggtaggggtagtgccaatagttgctttaagaacagttgaactagcagcaatggccaatgccattggcaaccaaattgtgctcataactctatggaccagatcttaagactccaacactgggaaatttgctgtcattctttgatccctgggcttaaatgtctacttcttaatgctatgagctaaatattcaatgttaaaatggacagggggtcatgctccatctcatttatcataagtgaataactgggttattttgaccatagatcaaactccaaaaatttaagcaaagaaataatatgtgtaggttccagaaagagatggggaaaatgtgaaaatacagctaaaataacccacaatttaaattttggctacagagttaatgtcctatttgtaaaccagaattttataatctcaacactgctgagcagataactaatcatattttgaaccaaataattatttgctgtgtgagcctgtagatgtttagcagcattcctgcctgtacttataaatgccacttgtgccaccaacccccggttgtgacaaccaaaaactggcttgactcccaaatccactggagcaaaagtaccttcgattgagaaccactgctctatactctttttttttaggcagagtctcactctgttgcccaggctggagtacagttgtgtgaacaaattcattgcagcctcgacctcttgtgctcaagtgagcttcccacctcagcctcccaagtccctgggactacaggtgcatgccaccatgcctggctagttttttaattttttgcagagacagagagtccccatgttgcctaggctggtcttgaactcctgggttcaagccatcctcctgcctcagcctcccaaagtgctcgcattacaggcgtgagctaccacactcggcctgctgtatactcttgactttagaatgctcataattctaaagaaccatgttgcatcgtgccttctcataaagcctcagccttcaatttcacaccatccaaacccattgaagctcttgagtcccttgacatggtaactcctatccctctcccatcagaccatctcctcatggaggtgacagacaattcaggaaaatctcccattaaatccactcccctaaagccctcttggaagagtaactatatgaactttatacttctctccctcccaactttgtacctactttctcagaggtgcttaaaaaatatcacttctctgaaccccagttctctcttttatcagtttcatgtcttcaaaaatagcaggattatattgccctctgcagatgctactggtgataaagaataaaaattgaaactgactttttatgtaacagcagtgtatcacaaaggaggaaaacaagaaagaagggaattaacaatgattaaacacctaccatgtgccagcctctgcactaagtacctataatattacttcatttaatctgtatagtgaaactttcgagtaaagttttctgagatcaaaagaaagtgcatttctgacattatcttttaaataaatggtcatttcagattgttccgcccactttagtgtaccatttcccaaaagcatccaagaatccttgtgaaaagtgaagacagtctgcaataactctctgtgtgtgtgtgtgtgtgtgtgtgtgtgtgtgtgtgtgtatcacaacttaacccatagttttggaatgtcagtcatctcaccaaaatccggaatgaactatgtcccagtggatcacatattcttgaaagggcagtcagatttctgataagcaactcatatacacgagagcaaaggcaaggttctatctatagccctgtcatgaggcaagctgtctctttttgaaaatgatttagaggcagctggcctctggtctgctagtctgttggtgtctcacttggctattcaacatcagaggcaggaatctctgcccattttcacataatgcacatgtcttcctactggaagatctttctccaggagtggagggttcaggtcaaggtctctgctcacaaaataaagacagaactcagcactatttatatcacaccagaactgactcagcgccattgcccatttaactcacttgtcttgctatttggagatgttctctctcttctggcttttctgccatctgtgacatctctccaggcataccgtaaggagaggacattttgaaggatcactctatttgtttcatcctagaaaagtttatatcagtccaattctgctgctaactggacttcgtctctggcttcttcatttggaaatctacctcttatgctaagtgcccttatatcacctggcggtttgcaaagaggtgagtgtgaatgctccagtaaaaacagctgcctttactaagctttacagcatgtgctcgatattgagctaagtgctttacgtgaattatttcatttaatcctcagaaaatcctctaaaggacaggaagtattataatctccatttagataaaggcaactaattaagataagttaacagctgccaaatttcatacaactagtacatgacgaagttgggatgtgaacccggacccatccaatcccaatgcccaaggatgttccactttatcacaccacctccctgtgagcttctgttgagattatttttttactgcctgatccacaatattattgtcatctttatttggcttggcggttgacaaaatgaatgcatttctagaatcttcaatgacgtgaaaattggattacaaacaaaaccatctctggaactgcctgtttcctgtattttccttttggggaaaaaaaaaaaaaactaaaataatgagctagacgagaattctgatctcagatatgccactacatgctcctgcacaccagagcaatgatgtacctctcgagacttctgtttctttatttgtaaactggtggggttggaattatgaattttaaattcctttctatctccaatacactgtgattttctgatgcagtgggtattactgcctcacaaagggcttacaaaatacactggagaaaacaccagtaatagaaaactctacattcattgctacttaactttgtgctcattcaaatatcttcatagtgtctctctccagagactccaagcacttacttaatttaatatagccctttataaaatgggtcttctctgcaaatctcagcttgaggcatttctctggtacccacacaatacattcgcttttacagaggctttattttttcccctaagaatttcctgttcatttagctacagccagaggtaaagctaacaaatttgtacatctcttcagaggcacccaatttactaaatgtcttttaattggcataggagctcatagaatgtcctctgagaggtcacgttaagagttattttgttaaatacaaaggtatagaggaggtattttcagatggaatctgaaactcaaacggaaattttttagcagcatctcatggaacttctcagttttcttatcacaaatgttctcctgtcagatcttctgtcgtaaatatgaccctgtagactgaacaatggaaatgacagccactgaatccatctctctttctcttttctgcatttaaaattcaagattataattgtagtacaaagtatgattagtaactatcagtgtgaactttggagtccacactaatctcctaaaatttcagtcatccattcaacaatactcatggcttcacccacatgctcacttctgtgtcccttaaatcagtggctgacacataggaagaacccaatgaataataatgctaaattgatatgccaagcactgtgctacaggtaaagcactgaacaaagctgacattgccccaatccttaaaaagtttatagtccggaaataattgtttattcttatatgcatgcgcccacacacgcgtgtgcacacacagacacactcccaagcacatctataatcagtgtattaaaacaaatatcttggcagagtgtggtgggccattcctgtaattccagcatttttggaggccaaggtgggtgatctcttgaacccaggagtttgagaccagcttgggcaacatggtgagaccccatctacaaaaaacacaaaatttggccaggcatggtggtgtgcctgtagtcacagacactcagggagctgaggaaggaggattgcttgagggtgggaggcccagactacggtgagtaccactgcactccagcctgggcaagagagtgagactttgtctcaaaaaaaaaaaaaaaaaaaaaagacatatctttaagagcatgtaaaaggaaaattccacttgatctaaggagttcaaataacactaccataaaaaattgactttctaactaaaatgtgaataaaattttaccaatgattagatacagtggagaagaggcatttagggtataggcaaaaacaaacaaacaaaagatcaaagtgaggtatgggagaaaacacagtctactcaaggctaacagcaggttagccaattgcagatagcaactgggagcacagcagatgaggcagcagggagaggcagggaccaaactatataggactttgtaggtccttttacaaattactaaggatactctactatattgtaaaacaatatgaagttattaaagactttctagctgcaagagggcagtagagcaggagaggcaaacaacaaagacattatctgatttgtatatgcaaaagaccccattggctactctttggtgaatatattgtgagagtggaaagaatgagaattaaaaggcagtcatagaaatcaaagccaaaatagcaatagtgtgatgcgggactcttgctgtagcaacagaactatttgaatagatttaggatgtaattgaagggttaaaagtgagacttggtattgcattttatatagatacaatggagaagaaggaatttgtcaaggaggactcttaggtgtctaacctcagcaattggttcactggttgtggcattttctgaaataaaaaaggagagaactaaatctggggtgagattgtaagtgcttccttctacattttgatttgaaaagctctgagtttattgtccctgtagaaatattgagtacaaacagtggatgtttgtggaataaaaagaaggaaaaggagtcagagttgtgatgaatttgggaatcaccacaacatgtataacaaaatatagtagaaatattgggaggccggggcgggcggatcaactaaggtcgggagtttgagaccagcctgaccaacatggagaaaccctgtttctactaaaaatacaaaattagctggatatggtggtgaatgcctgtaatcccagctactcgggaggctgaggcacgagaatcacttgaacctgggatgcagaagttgctgtgggccaagatcgtgcaccgcacctgggcaacaagagtgaaactctgcctcagaaaaaagccccagatcaaacttgaggctgtttgattcaacctggttagccgaagagagtggctggtagagaatgactagcatgcaacggtgatggagaaatattagccacaaagatacgaggcaaactagggagtatggaatcacaaaaagcaaagaaaaagcaagttttcaggtgagggaaaaatttataactcttgattattcaagtatatagagaagttaaaaatatctacaggtatcataacaagcatgtcacctacaactttagttgaactatgtctgtttatttaagagataagtaaaattgaatttactaagtggaaagtgtggaaatagaagcaatagatacagacaacaattcatagatagatgtttagctgtgaagggttttaaaatgtttatgctaataaagtattaatgagtcaaaatgtactacacatgatctctaaatatcactccacagattatttcttcattacaagcagagtaaaaggcctcctcaatgctaagaggtgcactttctactacaaccaagtgatcaaattttgcatcactcataatgagaccaactgaaataatacacctctggatgacaaaagaaagcatagaatattactcatgtccttttcttgccataatgtttaatcttaatctaatcctgaggaaacaatcacaaagttccaactgggaacccttctccatggcctgggatcttcaagaacgtcaacgtgataaaagtaaaaaatgtgaggaaaatgttctaattaaaagaagcgagagattgcatagtaaacacaatgttggtttgatattttaaaactcagatataaaaaattttggggggtttgttgaataaacttgaacatagattataatgaagtattgtgtctaccttaattttctcaagtgtgatgttgttatgattattgaaagagaatagtctttttctcagaaaataatgctgtggaatttagggatgaaatgtgatactctgcaacttctttcaaagcagttaaaagtaagaaatttaaattgtatttttgtcttcatttattgcatttatagatctcttaatttccttgtcaagattcaagattctatctagcatcaccttttttctgcctgaagaaatttttaaaatatatttcaagttcagctctgctgacaatgtaatctctgaatttttgtttacctaagaaaacctttatttctccataatttttgaaagatactttcactgggtatagaactgtgggcagacagatttttttctttcagcactttaaagacatcactatgttttcttcttacatgcatgatttctgaagggaaatattctttactttttttatttttcggtatatatgtataaattttttttctttattggtaagattttctgtatgtcttgatacttctatttgaatatgacttctgtcttgactggtgttcactgagtttcttaaactccccctgccctttccattttttttttttttttctttgagacagagtctcactctgtcacctaggctggagtacagtggtgcaatctccgctcactgcaacctctgcctcccggattcaagcaattctcctgcctcagcctccctaatagctgggattacaggcaccaaccaccacgcctgattaatttttgtatttttagtagaggcagggtttcaccatgttggccaggctggtcttgaactcctaacctcaaatgatccacccacctcagcctcccaaagtgctgggattacaggcatgagccaccacgcccggcctcccctgcacttttcttactttattcttccaggattccaattacactcagctcttagatgctctgttctgctttattcactctttctctctttgtgttttagtttaggaattccttaatgacatcttcaagtctaccaaatctttcctttgatatgtcaagtctactgataagatgaaggtttcttcatcactgctactatgttttccattcctagatttctacttgatttttaccatctatctattgaaattagcctgctgatgatgcatattgtctgtgttttccagtagagcttcaatatatgaattagagttatttcaaattctctatgtgatagttccaatacctatgtcatatctgattctggttctgttgattgctttgtctcttggtagtttccttccccccactgttttctcatatgcttaataactttttgctgaagctcgacattttgtccaaaagagtggagactaaatagtttctaaacctaagaataggcatgtttttacttctgataggtcgttagtgtggaagtttgagcaatgtagtcagtagttgtgctgggtttgggtttgttatgcttgcactctaccactggcttccacttcctttggttatacttgtgtttagagtgaggactggtttgccagagagtagtctgtttcactcccatctttagggtaatctcttcacactgcaactctctgttagtccatttgcattgcattcctatgtaaaaggaaatcctgaggctgtgcaatttataaagaaaagaagcctattttggctcgtggttctgcaggctgtacaagaagcacggtgccaacatcttctggtgagagtctcaggacacttccactcataggggaaggcaaaatgggagcaggagcatcacatggcaaaagagggagcaagaatgacagggggaaggtatcaggctcgttttaaacaaccaaatcttgcataaactcattgagtgagaacttactcattaccacaaggacagcacaagccattcatgagggatctgccctcaggacccaaactattcccactaggcccacttccaacactaaaggttatatttcagcatgagatttggagatgacaaaacatccaaactatatcaatctcggagtctctacccacacacttttgtaactctcaaagctcttaatcactgttagatgtcactggaggcttttcagcccgggagcgtggtggtaagaggagcattgctgttctaattaagccttggttttaggcgaattatgtccttaggtttcagaaaggtggctgcctccgtgttccagtgtttcccacagctgtaattctgggaagggagtagagttttatttttaatgcttcttatctctagctgcaatggctgttccctagttccctaagacacttcctcctgcagtttaaagcttttctcccaaggagaattaggggagggtgggatacaagcaggacttcttgtctttcctgcagtggctgctgttctcctccccatgttttgtacaatgaggattctaccacagtcatttttttgtgtgtgcatgagcttctggtggggcccaaggaaagagcctattctgggtgcaaatttccctgttatcttgccccaaggttttctacagtgagaatctacaagccagttaaaatttgttttatgcctgcagccaactgaaccacattccttctttactaatttgttaccaggtgagcaaatgctagcttaccctctctccccataggcacatatctttttttaggttttaagttagttggtattcctgcaatcacagctctctgactagttcaagaaaagttatgaatttgcaatttgtccaattcttttttaatgctgagagtgggcataatacttttttattccagctttgttcatcccaagcaaaagttggaggtctctgaaacttaatttcaaatagttcagcaaaaaaaatgaaaagaaagagaaagagtaaatgaaagagaaggagaaagagagagagagacagtgagagaaagatacataaagaaagagcacaaatgtggcaacatatcaagaattaatgaatcaagatgaagtggggatgggtattcataatactttccatttctgtgttgacacacaggcagtgctcaattaattaccttgaatgtaattaagacataatttgctgaatgacagtattattcttgttattagttcccaccaaaatagatgaatcaatttttttccctttctagtttgacattgttaccctaagatactaatcctgctgactctatttttaaaatccaggtttactaaatattttatctacttatctgtcagcaatgtttcaactagaatagaaatgcttttgcataaattcatcactcattgagggatcagctaattggaaagagcattagatatggaattttgaaaaacaggcttaaatgcaagcttattcatttcaccaatatttatggagatcttacagtgttctattgattgtatgagaggtttgggagtgaatagtagctctgctgcctctcagtcccttgcacctgcacacatttatatggtttgagccttggtctccacctctgtgaagtatggataacaacgcctccctcatttgtgagagttaaaatccctgttatatgataaagtgctttgtgaatcataaacaaatgatccaaaagcatattattctaattctcttttagtttcttcctcacttgttcttattttttttacttttttttctttgcatttttgtaatgtccttggccttggtttcttactttattttattatgactgcttacactgttgtagtcatttacaacttcatgttaatcaaaattgtgaatttcggcaaaggcaacagtccctgcctagtgtatgaccttttttcccctttgatcttggcatctgaaagctttttatacattctaattctcttccattttaatagctctgtgaagcagtactattttctttgactgataagatcattgaaggtgacctgattttctctagagatgcacaatgaataaaacacattctccactacacaactcacttactcacatcccatgaagggggaaaaatcctgaggttgctctctctctataaaggtcacagaaaaaggagatgacttctcagatattgtgattatgcatgtatcatcaaattatgcaagctgcttattattccaaatcttaggggtttttttgttatttcatcctgttttacataaaactgagtagcaaaagtggcaaaacaaatatagcatttgtctttgtttgtgtatttttaatgagccgaataacacaaacaccttaattttgagggtgcatcttgttgagacacaatattatagatacctgtttgtacttgtgtgtatgtgtgtctccaggtattacatttatgcagttttcagttggaaaggtgacctctttctacggagtatgtgccctgcacatagggtttatcccttgtgactggtttgtgtgttaaggattcatggcttaaacagctaggttattcatgggtgtggaaaattgatatttgagagcattttattctgctcagtcaggctgattctttataaggaatcaaaacagtgataacatttaccaaaaactactgaatagaatattcaatgtgtatctatgccacacattgtttctttccatacactccatcataaaatacctcctctgcctatcatcgctctgacaacgtcactgccaaacccctatcctcatacactcatcacagaacatctcttcattttgttcagaaactgtgcttttttttcttaatcgttctgcttttcaaagctttattctttctaggcattcaatatatattgaataatttcaaggtatttttatattcattcattctactaatattttcttaactattttcagctactcttctaaacatcttgttcaggaattgtggaagaatctactcactgttttgtcccaatatccaagggagaaaaataaaactagctcaacatccctgtgcatgaacttttagtaactttatttccccactagaactggaatctgatgatgagcatctttgttctccagatttcaaggaggtactccaggtagctgactttccacagagccctagaaagtaaatcatggaggtgaggatactgttctctgaaattaatatagaactatagttacttggtagtttatcttgagcaagtcttgttaattctactgtaattcaaaatggtagtatcatcctaggaaaggatgacaaacatgtagttatagtgagtattctcttggtttaaatcacagcattaatcggcattctgtattaagaaaaaggcaatcatttgcccacattctccttttccttagttttttttttttaatttttagcttcagaaatgtaactcatatacaaagtacgcctatagttataccatgtatcacacatttcatatgagtaaaagaacagaaaattgatgaaacatgcctgaatgcttgtgatataaaattatatttcagttccagctataaaagtgtaatacaattgaaatgtttatcatgcatctatgaatattttttcttgcatgcataatggtgttgcatgaacaatttaatttcttttttgaaaaaagtcatcctagagaggtctattctataccttttcgacagattcatctaaagaccagctctataaatgtccagattgaatgcataaaatgtattgtctcaagtgattattgtttaaaaaaatttaactgtattgttaacttactgaaaagcactggcataattccgcaggcatggcctcttttcttcttatcttcatgtgtgtgctaatgttgtgatctttttaaaatgccaagatgaactgtccggtatacgaagataaaagattttaaaggcaacgcataatgccactgaattcctattgaaatttacagttttcaaagaaatagtattcattctaacatcaaaattattgtcagaaaaatataaacatagtaaaataaaaggcacctgtgaatccgaagctatcatggttcaaactcttctatgaaaacacaatggcactcaaagacttactatggcttaatatctattattaatcaattagtatttttcattgtatgaaaaatttataactaaaattttaaatttaaaaagaaatggattgattagaggccaggtaatcaggctcttggccatgaccatatttttttttttcagtattagttaagtaccaaagtatttcacaaagtccagtattcaattgattgcacaatacacaactagatttcatatttttgtaatccttggcattacttattttctgcacattctggacacattcctacatttttatttaaatggcttttacatcttataaaaagagtactttttggattcaaatcccttattccatttctggcaaccttccaagagaactctagtctgaatcattgcattgattttctgttgctgtataataatattaccacaatcatagtggcttcaaaaaaaaacacatttattatgtcaccttttctgtgagtcagtagtctgggcacagctcatctgagtttttgcttcaagttctcatccgaaagctacaaccaaggggtcactcatgactgggttgtcatgcgatgactcgactagggaagggcctgctttcaaactcatttggttgttggtagaactcagttactgattgttggattgagggcctccattcctagctggctagcggctgaaggccattttcagttccttgcaattagggcctttcctacacagatgcttgcttcattacagtgtgcaatttgagtaggtagtagagatactctctcacaagatggaaggtataatcttatgtacctggtcatggaagtgatatctgtcccattttctgtgttttattggttagaaataaggcacaggttccacctacactcaaaaacaagggatgtaacagggatatgaatgccacgaggctggatcactgggggtcatcctaggatcttcccagcacactttttttgttttacatttggtagtttggtaatttttccaaatgaatactataaaagtgtaatagaagaagtagtatatgtcattgaatgtagttctaacccagaaattacagtgaaggtaacgctcatatgataggatgggcagtttcattattatttgtcttgcctgttaccaagcattctaatgatgtttcattgagaagactgttctttgagattagtatgtatcataaaaatgcctctctttaactaaattgtggatatttgtctatgaagttcaggtatttgttttcataataggctgtatttgaaggacacaaaaatttatataaaaatactaaacaaactgaagcccaaatttgttactagttctagtgcaccaccatgacatattgattacactgaaatacaataatgactctcaatatggacatctgaaaattaataataactatttgattgtcctaggaaatgatctggatagctaaatatagtctgactgaaacttacgtagcccaggcattaagtacatatttgaatgggcaaatcttatgaaataatgcattatttactagaacattttccctactggtattttctactagaagtccaaattagggaatcatatgaggatataaaattaattcaaatatataaaaatattttggctgtgtttacagcattaggaacaagctgtactcattctagcattacgttaatgtacacttggtaggcattagaggaataaacagttctaactacaagaaacagtaaaaaataagatatatatactcataagtcttctcattctgttaagagcagttagtaaagaattatttctaaaatttgtgaaataattattgctcataaaatttttagctaataagaaacttcagatggttcagaaggtaatagaatatgtcctatttggttcaggaaacttaaaattccttctccttaaaagtgttggattaaggcgtttcataatttttgaaaaattttgtatttattggcagtggtttttacacttagagattcttatttcttccacagtgaaattgtttatttaaaaaagatgtttctaaaatatgtgaagagaaaaaatagtgcaaaatattcactttgataccaagaagagctttgattatacagatactctaaaaaggtattaagaacctccaggggttccatttccacagtttgataaccactgcattagcacaaatccttggaagtatgaaacactttgtctgtgtttggtataaaggccactgaatgtgctaatctatgtgaccttggcatgtagtcagcatctgttaatagatttcaggatataaatgagatagtgcatgtaatgtacttacaacaattaatgacacaataaatattatgtgttagaaaagctacatgtagcatagtaattgagagtacggactgaagactgcattggttcaaatccttgctgtgcccctctgtaagcttgaataaattatttaatccctgtacctcacttttcccctttgtaacattgagttattagtaataacaacttgtgagtattatataaatgaaaaacacagtgcgttgatcacattaaacactatgtaatttaaaagatcattgtaaattatttagttcctagagacagatgtattcttaatacattttaggcctttgttactttcagtcatttaacaaatatcaattaattcacctactacatccaaaacaattcaccaaacagtatgaagaatacaaaagggaatataaatgtgatttttgtgatggaagtgtttattgtttaatatagaatataatatattcacatataagtagcatatggaagaaaacgaaagacagcacaagaaattaaattctcagagaagagaaaaaaagtaacttctatgtatttatgaaagtcattttaagaagtattcagaaggttgttagaattgagtcacagagatggctgatgttaccaagggttacttatcattggaaaagagattcataggtacatgtttaaatatggaaatctttcatatcttcagacgttatcgtcagctcaaacccgattttcacagatggcttcacacactgcaactactctctcataattacttatgagagaaaatgacctgtttccctttggccattttgagaaactttcaggaaaaaaaaaaatctttaatttagaataacttaaatattgggccttacagattgactggcaaagtcaaatccaaatgcaagttatttcactactctgcatcccacttaggtgtttttctttcgtgaattatttcctgggagttagggctctttcatcttttatttgcaaagtgaaaagcaaaattgactcatcttaacttctaatttagctttctgaatcggaaagacaacctgaaagtggctgtggggaggagcgctgcttggtctagctggctggagaccttttacagtgtggatggagcccctttctcaatggttaagtggctgccacactcagtagcctttctgaagtcgcttggtcccattctttttatttttttctttttttaataaaggggttaaaagaaaaaaaaaaagaggtaagataaactgcccttgacagtatgattcctttcccttccctctgcccaaatacagatagaaaggaagtctttccatctatataaaggcctatttcatgttaccaaagaggaaaagagaagttgagaaatgcagccaattaggagaaatgagagcaaaacaggtagtacctccgtgtgtcctagcaaatggcccaacacgaggatttttacctattttatccacatagaatggcttgcgaaaagcctttgttgttgttgtttttacaattcatagacttcccactgataaattccaatggtcgattttccccttaaagtgaaaaccttcctttgggaggcaagcaactcaaaaaaaactgcctgatgcgtaatgaagtatgttttttgtaacccacaccagttctatccatacatactttttttttttctttctgacaccttcacctcctgccttacgttcctttgagctatggaagccaatgaggatgaaataattaaagtttgtgcctgctgtacaaaaatcattctccataggctctgtttttatttgatcttttgtagaaaacatagcgtctttatgtacacagttataggcccatggtgtcaggctacaaaggcttcatttcctgctatccagagtcctggtgttattctccaagcataaattctgtagtttccctcctctagcccagcaggtgtctgggtttcatttttggttgttacagttttcatagggaggctggggtggtctgaagtgtcacagcagggatccagcattgcccctacccaaaatttgctacataatttgtgaggccaagggaaaaatgcaaacgcaggacctcttgttcataaatcattaagtgggtgtttttaaacacagtgtgctgtgaagccacacaggtcagatgcccaagaagctggctctgcccctactgtgccagtgcctcctgggcacatggatggcagggaccctgtgtgttgcccttctgtgaaacaagaagtctgtatggttggttgggcaccgtatggttggttgggcagtctgttctttcctgtgcacttcctgtacctcctatggtggtccacacctcgaaagccccacactgcaccaccttccttggaggacaactctattaaattctgcacacccgctacccctgccaaatcttactcttttttttctatttaaatgccatttattcacaccccctgcaaatacatacatgcaaaatccttcataatgacccaatgatgcaagcaaatagtcaagcaatgcttaatagcaattgaaaaaccatatccccacctcaagggtagagaggactgaagtctttatgaactcaatggctagtctgcatccccagaactggaggggaatgcttgcatttcttcatttaagacttctcccctcctcctttccagaatgaactgaaagaattcttacaaggcaccacctcttataaccctgtcccccaaaaggagatttttatattcaaaaacattgtacattcatgtattaaggcttttagaattagcaaggactttaactctttggaatttgcagaagttgataatgcaattatattttttaaaagtttacattgtaattgctttagaaaaaaaattagtgatactgcatatacggaattagccaagcctgtgtacacttgctgtttctgtggtctccatggactggaatttggttaaaaaggcaagtttatcaattgaggtttttaaaaatgcctgctctttcaacaaacccaacaataaataatgaaaaataattaacactgtaatatcaaaagtgaatattgccaaggacaaagataaatgatagccaaaaatacagtgaaaaatctcaatttaaatataggaaaagagaacttggcttctagagaacagcaggtttcctcccaagcctatgctgagtaatatgatatgaaattgttaccactgcttttctattagaaatcttccaattcagttttctttattgacccaattccctggtgtttagggctaggctgcttttttctgtacacatgtgtgattgcttatccgtctagcctaggcttgagttattttatttgattggtaacacagacctggcagaagcttcacctttggcatgcagatgtccacaggtgatgtgaaaagagattgaaaaaggcatttgctgataaaaacaaaacaaaacaaaacaaaacaaaaaaaacaagctcagcatgatttgattgccatctagctacaaagtgtagctagaattgatacagtaggccagaaattataattatatccgccttacaatttcagaacagccatgtgacccaagtttataattgttggtgccataagagacaaaatagctgagtaaaccactcctacaatgtttttgaatataaaaatctccttttgggggaaagggttataagaggtggtgccttgtaagaagtctttcagttcattctggaaaggaggaggggagaagtcttaaatgaagaaatgcatttatacaaaacattatacattgtacattcatgtattaaggcttttagaattagcaaggactttaactctttggaatttgcagaagttgataacgcaattatattttttaaaagtttgtccaattccttcctgaatcctttaaagtgcttaccacattcacttgtacatcctgaatagacttagtatttgtttaataaagggatatatgaaataattttggactgttagagccagaactttagattatatataccttgactggtattacattgcctccttcatgtcgactccatttcattatctgtggatgcttgcatttagtactaactgcaatgagaagcctttgaggccacatctgaacccaatgggaaagaatcctgtgattgaatagtaatgtctgccaaacccaaggaagagaaaaaaatgccaccatctctactataaagtgactctcctccaccagaatgtgttccatcccctctttttacaggcaaacaaattggggatcagagtggcaaagcattctattgcatatcacaaaattagtagcaaaatgatgatatgaatttaggttctcagactctggttgtattagtcagctcagtctgccataacaaaataccacagactggctgtcttaaagaacagacatttacttctcacagtcctggcagctggaagtttgagaccagggtgccaacgcagtgaatctggtaagggctctcattgatttgcagacggcagccttctcactgcatcctcacatggcctttcctgtgtgtttgcacaggagaaagggagagagaaagagaggggagtgggagaaaggtctctgatgtctctttttataagcgcactatcccattcatgaggaattcaccctcatgacctcatctaaacctagttactcctaaagtccccacctccaaataccgtcacatcgggggttaggaattcaacaaatacattttaagagcacataaccattcggtctataacgttagtcacatgcactttatatgtcacaatgtctcttctcctattaggctgactctagttctctttttactgaaaccgccttgctttttgtatcatcgttttaggcttggagaattctaaacagcctctaggaaatatacatggttgagttgtttgacaggttatgaacacattgtgatcaaatgcagtgactgtttataaaatgggtgccttgcagaggagagtttaagcaaagtttaagaattgggaaaatccttaatcacatctctacagaaagaaaaaaagctgtaagagaaagcagaatggtacaggaaatactcctcagagaacagcggtgagggagggataatatgaactacctataaaatatgctcttgaccaaccatatatcaccttcagcctgttctttttgacgcgtgactcactatctagggatccccttctgttggctcacttggcagcctctgagattagttttcccaaagcaatttattacccaggtggtgggtacatgttacataagtccaaaagtcatttctcaccacttttcttgtcttccttttattattcttttaaaatatatgctacttctacttcattattttcaaccatctcagagcatgttgaaagtattgacatgtactttcagcatgaggaaaggaagttactgcagataacataagaagaaatatgtgtttagtctctgtccctggttctaatactgagctcctaaaactcttacaatttccttagtgatgagtgctatgagcatcttttgtcctagtatttgttttttgtccctggttcctgacacagaactctggagctcctgattccagagcttggaatttcctggatcataggagtgtcatttgttctaatgatgtgactcatggtgggctcctggatagcttcagaatgggagctggccactggaaagcccaagctgttagtagaagcttggaactttcagtcccgtctcccatcctccaggaaggggagattaggttaataattaataatgtctatgtgatgaagcctcaacaccagtccctagcctatgaggtttggaaagtttctgggttacaaatgcatccatgtgccaggtgggtggtgcaccccaactccacagggacagaatctcctgcacataggacccttctggatctctccctaggtaccttttcagccagctgtttattcgtatctttgtaaaaacctgtaaatgtgactaaggttacagcaaattatctcatcctagagggaactgttgaaactcctaatttgtagccaagttgagcagaagtgtggacaccctgggtacccaatacttgcaactggcacctgaaatggagggtgttcttgtgggattgaactcctaacctgtgggggctacacttactctaggtagtttagtgtcagaattgaattaaattgtaggacacatccaattggcatttgcagagaactggagaattacttgctgtaaaagaaaaccccatacatgtaatgtcaaaagtgttgtgagtagaataacagctttcttttactctaaattataattttttgaaaaatcactgttacagttcacattctgatcacaataataggtaagcagagcctcattttgacacctacctactttattgcggtgccgtgctctagtatttagtctgtatctcaaataactcttcaatctgcctcgtccttttgatccttttaggtcagtccttcattatctcctgttagaagtctcctaattttctaatggataagctcatctagtggataacaatgggataatattcaaaattcttacatggccagaaagccttcattgattcttttctgtagggtaccaccaattctcacttttctgaagtgcttatctttcccaaggcactaggattttaatttctctacatcttttttacttgctagtgcctcttcctagaatttcttcccttaccgtgtatttctagcaagctactactaatctttcaaaacttaaaattaatatcttctggccaggaagctatttcctgtctagcattctggttgcaggaaactggagcccacatggaccatactatacattatttgcagcatttgtaggcaaaggtgcctcatttgctgcaaatgtataatggaccctgtgctcattgagctccatcttcagtctacagagtccagaactgctttcagaagttctgttcttctggaggtaaataaatggaacctaagtccaaaattatttatacattgtcacagatgcacacctgctgctaggcctcacatgtgcaccccaacaacaaagatagcaatgacaaccacacacacacacacacccctgttgtgctcatatatgtataaatacactcattgtacagaaagccttaaaactgcccttgaatatgaaaataagatatttctcttttatttttgtcctcccttatccagcttagaattagtctaccttcaatgcatccattattgcttcctcaacttagctcacccacacagcaattaaactccacgtatttgaacaactcaaaaattccatgtgtgcaagaggctaagtgcataagaatcctagggcctagatgacaagaattactaaagaaacgtagcccactccttctcactcttttgcagttttgtatgttatatgtacattagtatgttacatgtacattaatttgcctgaagttgctgtgttggcttaatggaacaccattgccacctgctagccatattgagctattaaagtcctgcaattaaccaaattaagcgcaggttaacacaatcaggttttgctgtgctattgttttaaataacttttacgtatttaaatttagagtgcacagtgtgacacagcttgccatttaatgactcagcatgcatacagtaacctcagctaaccagcattaagtggaagtattatgtcttggcactgaagaatatagactgacatcaaaaataagagtttcaaggctcagttccaccatttgttagttatatgatctttgataagtcacttaacctgtctagactcacattatttaaaaaggtaaaaatagaataatagtagtgccttcttcatagggttgatataaccattaatgaaataagaaatttgaaatgcttacgtgataactaccatatggtcacaatcaatggatgttcctgcatattatttctctagcgttattacacctttcttctgattgccaaatatgtaaattcaactgtttctctgggcctccattttctcatgaactctatggtttaatttataaatatgttccaatgtagtttcatttgttttataaaatacagtccactacaggtagtgctccatttgttcaaccttatttgtatatgatgcagtccactctgtgaacatcagatttcaatcatcattgccttcccactgcactcacttttataaagtcaaagcataatttatagtaaataaaatacagtgatcttaagtgttcagatcaatacgttttaagaattgtatataccatgaaactgccatccaaaacaagatatgaaacgttttcttgtatgtaggaaatgcctcatggcttttatctatgttttttttccccaaagcatgtgttatccttatgcaggccctatgctaatctctgcatcatgtccattttagttcacgcaaccaaagtagacatgacacattgcaattctgatcacctctctttttctcacaaatccagtagaaattataaagaagaaaaagcaacaattaatccagaaatgctatttagtcaattgaagatcaacacattctaggtgagcgctgccccaagaatgtttaaagggagaaatcttttaaaataaaatgcaactataacattattgatatttttaaagggagacaacaggatatctcttagagaaatggaagtacctgtacagggcatcatgttctcagactcctcacttcagaatctgattcttagctctgtggacttgggagactgggttttcttagcattctcagagtggatcagatctttatggagaaaaacttgcaaagaaaatttagaaaacatttacatataaatcagaaaaatgatatatttacttacattaatatattaatatgctaataatgtattattgtaatctgctgttttcttttttcatttaccatatacttacatctcttatctaggattccctgttctcaacctttagttcattatcaccctcctctcctcacaaaggagacttttgagaccactgccaatgaaattttgatactgcatttgtattgtttatctgtatatatctgtttatgtatttctgtgccttatacatggaaagtaacattttctttcatttctcccaataccccagagccaattttcacctccttgggggtgatgtcaactccattgagaacatgtatcttattccttttttcctgctacctggcagcatgagatgttatattaatcctgtctttttattttctgtacttttgatgctttgacatctagggacttgctgactctggaaagactgccctttccaaagttaggcaattcttagagattaaaaaaaaagactccccttccagcatccttttcatatgcctttaataggcaaatcaaacaatctactacccacatcccaaccatctcctttactgatcctttacactccacgccaggttcagcttgtcctaattattccggggccaggttccagacaactaaagacagcctctgcaccccagaatctgaagagatgatccaactagccatttctaagccttcttacattgtattcttttccatggaaacctctatacaggctcttgcctatgtttttctccactttctctgcctctaaactgagcctggtgattcctctgaaaccctgcatggtgggtcctgccccctcctcttgggacctgtgaataataaaccatcttttcaatggtaatcttctcctgatttcttgggttcatgatacctgaatagtaataaaacctaaatttaaaaatacctatgtatcagggagttggttggccagtatggaatatgaataatcttgagagatatttgttagagttttgatgaagacttgtaaattccccctgttccttagaaagagtgctgtgaaaacactaccaaactcttgttctttttacttttacttttcttttctgggtctatacagacatctttatagttaattgactttttagtaaagagtaactgattaaactcatagcctttgtttaggctccacctgattctgccttcttagtttaccttttgaatgaaactgagtgtctccaaacattttcaggcatatatttatagtcaactcttgtggctattttgacaggtggttgacctcattcattatgtattgaatcttactattctcacctttagtataatcttatttctacatttttgggacacatcactgaaaccttctgtgttccatacgagacctgtaccagatatctctgcagccaaagagaagttttttttttatttttattttttcatgagctaacacaaggcttgcacaaaactcagcagcaagtaattcctttcttgtccagtatgaaaaagtgctgtctttgtcataaagcaaaaagagacaatgaaaggttaggttcttattgccccatctcattattgttaatgcaaaactagactaatttgcttgtggttatggaaatacctcctttaaccttggtgactgaatcagaaagaatttgttttggagatgggcattgcttaacagcatttggcatttgctcaggctgagcattcatcgtgagagtaagagccttctttccttctttagtgtagtaatctctgcagaaatatcacatgaaatatggtgcagaaaaccttcagcatagtggctgggatagaggcagtgtgctttgagtaaggctcttcagttggggcctgcattttctctggagccaagatacttctgacctcagcaaatggcttaactgctctgataaaaagtggatgataatgataacacttccttcttttcagatccataagaagaagagatttttttgtttttgtttttgtttttgtttcatctcctgctgtatgcttggtctctaaaagtgactggcagagggaagacaataaatatttgttgttgaatgaatgaagtgttatgatgagggttaactgacattataatgcaaagctcttggaccaagacctgacttatcataggccctcgaaagatattccttccaaaaacaatgacagcaaaaacaaaataaatgcttcatactcaataaagtgtctggtgatgggtttataggaaatttagtaattttaatattaaaaactaccatttacatcatctgattatttattcgccaaatatgtatcaagcaatcactaaataccatgcattattgcaggtcttggagatttagaggtaaacaaaaatagccacaagtaaaagctgtccacctataaaactttctgcccagcctagcgcaggttagagttcccatatgtctatcagtgatcaatagctgtgggagaagaaacctgtagaacactgaaaaaaataaagcattcagatcattaacttttttattaatcttttgccatttgtggatctgtcagcttctctaaaactcttgagatacaaaagcattatctctgagacaagagataattcccaagctctcctcttgattgcccacgtttgcctgagagaatttctcaaccagttgtttcaggttatagacataattggctattagtcattgcagtgccattgttcattgacatacctctcagcatcatctctcacccatctgcaaagcaaggtcctggtttctgattaatctttggctggtcattgaggatactgaagcagctcctggttaattagaccattttgtctctaacctcatccattctctggatgtaataatagggatagaggtggcagcaattgtaagcacagccctgaaaacttgctaatcggcctttgtgatttgccaggggtgccattgtttaaattgttaaagccaaattgttgtgagaggcagtaagtgggcatttttatctccaagtcaattacacacatttagtgaaacctaaggagctcataaattaaaagtaaataagtaaataggaaagcagcatctacaacacttagtgatgtaagtcacacacatacacaccacatacagggtgataaaatagcaaaatgtgcacttatgtggagaggaagcccacgtagtgataaggggtgagggctcctgagtttaccagctgtgtgaacttgggcaagtaaccgctctctgaaccttcttatctgttaaatggaagtaatattaaagcctacagggacatcaaaaggattaaattacattaatattttatgttatttcattaaataagattttataaactatctcaaagtctgctctattacgtgtgctaattatctggtagttactattattctagaaaagcatcctatcccccctaactcatgcaaagaaacaatgaacgtttccaatacttcacattaaaaaaattactttgacagtatccacaggaaatcaggtaaaaagcaaagacagacaagcttagctctttccactggactttgtgagatgtgtctagttgtactagagttcaggcgagcattctaagagatgctggagggcagaaaatgaagtgaacttcattctatgaagcacttgagacttgtctttcccagtatttccccatcatctctcaaagaactgcctattaataaaaaacaaacaaaaaaaacttattccttggtatgctaccaaaaaaaatattcttcattcaagtaagtttggaaaccactgagtattacatttccctgtgaagaatcataatcattattttggtgttaaaaggcctgagaaatcaggaaaagctctaataaaaggaataaaaagaatagctttgaatcctttaacctaatttttcaaaaataccccacacaacatgtgttaccacacaaattgcattttgaaaaaatgctggccaggcacagtggctcatgcctgtaatctcagggctttgggtggccaaggcaggtggatcacctgaggttagggattcgagaccaacctgaccaacatggtgaaacccgatctctactaaaaatacaaaattagccagtcatgggggtgcatgcttgtaatccctgctattcaggaggctgaggcaggagaattgcttgagcccgggagatggagtttgcagtgagccaaggttgcaacattgcactccagcctgggcaacaagaacgaaactgtctcaaacaaaaaaaaaaaagaaagaaagaaaagaaaaaatgctgagctacaacatagtaggttgaagagtgtcctccaaagcatccgcacccactcagaaactaagagtgcgatcttatttagaaacagagtcttcgcatatgtaatttgttaaaaatcttgtaatttgttaaaacctggattttgactgggccttaaattcagtggctgatgtctctatgagaaaagaataggacacacagattcagagaagatggtgacgtgaagatggagacagagattgaaatcatgcatctacaagtcaaacaatgccaaggattgctggcaaccaccaaaagaaaccagaacgtcatgggatggtttttccttcagagcctccagaaggaaccaaccctgctgacacctcggtttcaggctgtagacttctagactcctgaaccatgagagacaatatatgcttttttttttttttttttcctgagacaaggtctccctctgtcactcagtctggagagcagtgacaccatcacagctctctgctgcctcagccacctcaggtccaggtgattctctcacctcagcctccctagtagctgggactacaggtgtatgccaccatgcccagctaatttttgtaatttttatagagacagggtctcaccatgttgccaaagctggtctcaaactcctaggctcaagcagtccccccaccttggccccccaaagtgctggaattacaggtgtgagccaccacacccagccaaatttgttgttttaagccacctagtttgccaaaattggttgcagcagcactaggaaactaattcatatttagtatttttaaatggctatttgaaatgtaaaaaaaaatgccatgaaatatattgcaattaaaaactttgttctctctgctgcctatttgttttggttccattttttggcaatttgaggtagaggaattggaacacagacgggaggagataagaagcactctctgctaagtgagtgattaagagctcactcatggctcaaaaggaaactctccattatattttctattatcacttgtgttcttgtcaatataagtacttgccacttgtgaatcattttggcgtttgcaaaaactttcttaaacagtcaatttcttccattctaccaccaaaagaaacaaataaaataaacaatagacaaatgcaatagcaatgtttactaaaattaagtttttcactctgcttagctttgaaatctgtatggaaaattaagataaaggcctacattttcatagataaagcggtagaaaactttgtttttagacatatatatatgtcttttttttagacatatatatatattttttaagatgaagtctcgctctgttgctgaggctgtcactgcaatgttcacctcctgggtttaagtgactctcctgcttcagtctcatgagtaggtgggattacaagtgtgtgccaccacgcctggctaatttttgtaccgttagtagagatggggtttcaccatgttgaccagactggtctcgaactccttgcctcaagatatctgccctcctcagcttcccaaactgccaggactacaggcgtaagccaccgtgcctggctcagcatgtatttttaattcagctctttggagagctgcatctactgagcactgcgtgggcttagtctcactgtgtagttgaatcttggtggatggaggccatctgtggtacctctaaagctacagtaagaacagccaatgccatggcatcaaaggaagccagaggcatttggaccttttggggtctggcaggcaaataaagaaaagactagatttggcctgagtctagtttcttctcatctggacactagctcatagctcataactgggctctcttttttaagctccataaatgcaagcatgacatgcatatgtgtatacagaatttggacatgttttccaaattgtaaatgtgatcacagccttaagtaaaatttatgtctcccaaagccctcaggattagttcctcattctttaaggaggctcaaaataacttcatgtcactttggttatctctctagccccatttcttgtcaactttttccttaagaagaataacttgacttctctaaatactcctttatttctctcagggcatatgcatttacttaccctatactctttcttctttctttccctttgtttctttcgttctttttttctttttttttttttcccaaggtctgattttatcgcccaggctggagtactgtgacacaatctaggctcactgcaacctctgcctcctgggctcaagccatcctcccacctcagcctcctgagtagagtagctgggactacaggcaccactgtgcccagctaacattttgtgtgtgtgtgtgtgtgtgtgtgtgtgtgtgtgtgtgtgtgtgtgtattttttgtagagacagggtttcactatgctgcccaggctggtctcaaactcctgagttcaagtgaaccactcaccttggcctcccaaagtgctgggattacaggagtaagccgccatgctcagcccctattctctttctaaaagaatccatttgctctttttttccctatgattgggttagcatcatggcttccaatgtttgactgaatggttttaaattctaccctccatgaaacgggaaaattagcttttttttctcatggagttttgttgagatttgaatcagataataaatgccaagttactacatataacagagagttgtcaaaaatatcatcactctcatttttcatatcccagcttaactatcattggaactgaaaaacactccctgaacctcacaagattcgattagataaaattagctgtaactattagaacaaccccaacatcaattcccttatatccagtagttccacttctagaaaagtttgctaagaaagtaattctaaatttaggaaaaacttttattattgcattatttataatagaaaacaaaaatatggagctacccaaacattttcacttcatttagacttatcagtcttgtgatggattgttagggaccttctgaatcatattattccattaaaaataaaaattcacaaggacaaattaatagcatagaaattcctatgttatattgttaaccgaataacagcagggattaaaaattgatgggatagtatagaaaaaaaaatcctggaattacaggtgcaaatatcttaacagaattattttgtaatgtaataattgggtattttttctctatttttctgagtcttgcaaatattccataataagcatccattacatttataacggcataaaataataaccttaatctttaaaaaatgctagtggagtaaatgaaacttttcctgcattttcttgccagttcatgtcgctggggagtgtcacttatttctcttgtctgtttccctatggtgaaaaacatagaaacatgttgataaagaacacaaagaaagaatgcatgactaggaatgaggagaaggaaaagcttcatgcatactcagctgtaacatgtttgggccgggcgcggtggctcacgcctgtaatcccagcacttcggaaggccgaggcgggcggatcacgagctcaggatatcaagaccatcctggctaacacggtgaaaccgcgtctctactaaaaatacaagaaatcagccgggcgtggtggcgggcgcctgtagtcccagctactcgggaggctgaggcgggagaatggcgggaaccccggggggcggagcttgcagtgagccaagatggcgccaccgccctccagcctgggcgacagagccagactccgtctcaaaaaataaataaataaataaataaataaataaataaataaataaatacaaataaaataaaataaaatttttacaaagtcaatgtaacaactcagggaaactatttgtcttcaaacattgaagtaagaaagacaggaacccaaattcagaaccagctgaaccttgaaggaataaacagtaaatgtcaagggcttttctcacacagggaatgaaccggttttcctgctcataaaagaaaacaaaaatattgagtatgagtctgaaaaatatgaacttcctcatgtttgtcatctccataaactatccctgtcattttatctttttactgagaggaagataatttagcaaaatgaagcacgggctgctatttcattttcttattacatatttgaattcagtctagtataattatggtgtttatgaagtttaaactgatgtagcaagagagtaataggaagaataagtgatcatccactctcaacatgataaggagcatttcttgataagaaagttgactttaccaagtacaggaaatatgtaagaggttttatcagacaataattttaatttatgagatgctttcattgtgttccactaagaaaatatacatttatttctaaataagttagttttaaagcaaagtgagaacaacagtagcaaaaatgtctcacagttacagacacaggcaaaacaaaaacaaaaatacctgcccccatctgtgagaaaagagctcacaaagaaccaggaaattataaatgagcagatttgcccttggctgtaggcaagatccctgagacagtaataagaaatgaggttaccaaacatccagagagatatgagctgataaaacttaatcaggctagtttcacaaagggcaaatcttttctgacgaatttggtggcatttttgcatggcacatggggcaggagaagtacgtgacaggaatgcgggatagaattcaactgaagaaggtagaaagccatggatgatacacatgaaaatgaggtacggtcttagctttccgaagaagagcacttgggagacgtttagcccaaatgcgttgatttcatgaagatatttatgttgacaataaacatgaagcgtggttgatggactggcatgcttagcagtgaaaccacggtagcaaaattatgtctgttatcatcaaataatgcacgcttggggtgcgtatgtatgtttgccattccagattttttttagagtattctcatcagttatttgcagtcatgcactgcataataacattttggtcaatgaccgactcccccctatgagatggtggtaacttaggattataataccttttctatgtatagatatgtttcgatacacaaatactccccattgtgttacagttgtctgcagtactcagtacagtaacatgctggctgtgcaggtttgtagcctagaagcaataggctgtgtaccatacagcctaggtgtgtagcaggctatactgtctaggtttgtgtaagtgcactctgtgatattcccacaatgacaaaattgcctaatgacacatttcgcagaatgcatttccatggttaagccactcatgactgtatttactttttccaaatgtttatgttattagtatatatagagagagccaatgacatttcagagagacacactcttatctcaaagaggaaccaatgggccacactgcaatatctcaatgataataataggttttacagcatttctagcatctttactctgagacatttttaaaaaacgcttttagttgttttgtgtacttgacagtaggctgttatttttcaaaggttaatgttgaagtgttctaaaattgggaaagtaatagggtcaaatacccagaagttcaaaagaaagaatctgagtttcctgcttagttggtccctcagcgtcaatgtacaaataggcttgtctctttcatcttaaaaagataaataatccaaactgaaatacatacatacaaacaatttctctacctcctgctgttgtttctgctcacctctcccttctctttgctgtctgacttctttatagagcaacctgtacaccattccatagttttatttcagttcccagtttatctcaagcttggcctttatgtctcaattcatcttgatttgagagtgaaatttctcccaaagaagaaacaaggactttctgatgatcaacattagtgccttattgctgttgctcttgtttttcacggttactctctaacatatataactcttaacatgtgtaactaatataactcttaattacatcctccttgttaaaaactctcctgttttggcctcccatatgatggatggggtaggcagaataatggcccccaagatgtcaatattctaatccctggaacatgtgaatctgttagattacaagacaaagggaaattacggttaaaaatggaattgaggttgctaataaagagattattttggattagctggggaggcctttgaagtagaagagggaggtagaaaaagggccagaggaaaatgtaactatggaggaatagtagagtaatttaatgtgagaaggactcaacatgctgttcctgattttaaagatagagaaaggtgtccacaatccgaggaacgtgggcagtctctagaagtcgtataaggcaaggaaacagatttcactccagagcctctaggaaatgcagccctgatgacatcttgatttgagctcactgagacccattttggaattcaaacctacagaactataagatagtaaaattgtgttgttttacaccattgagtttgaggtaatttgttacggcaacaatagaaaaatagtacaatggtgttctggcaaaatagtctcaacttctcatgcagatcttcctcagaacattgggctgttttctttcttttgtcaattccctagatgttgacagtccttggttttcatccttagctttctttttattcagttccatgctgttgctgccttttacaaagcaatgccatcaaactcagtctctttccccaaccagattcctgcttgtagctacctatctacatctacaagtccctcacaaaatccaaatttaacatgctttatgatagtttttaaaaaggcaaaatcatcaatttcaaagaaatgtaaatgaacacatgaaagattttctttaactcactgatcaatgaagggaccagtaaaatgttgcaacttgttcaaagaagaatccaaagtaccacacatgtgtaggtgataaggaatgctaaaataaatgtataaatagatgcagaacaggcttaccatgggtaaattggatggtatgtgaattatattttaagaaagctgttacaaaagcaaacaagcaaaaagtttggcttattcattagggaaaaataggaaaaaaatcacctgcatttcattggacacagtttatttgcatttcaatgaccaaaagtcatttgcattcttaatagttttctcctctttacattgttgcaaagtagttaagagtcattgaaaggcagggttaatcttataatctgcaatctgcaagagtacctaattgcagggtactctgcaatctttccatgtccatattgaaattttcgcaagttttcctgatatgtcctatcacatatctctaatccaaatactttctcattctcctgaagatcatttcacacatacatccctcttaaacctcccatacttcccctcctatcatctgtctcagctgatgatcttcctacttcccaaggaaataagagaaaaaaacagaagataattttaacttgctttccaccccacatgcatcagtgtattttccatctgtctccacttactctgccttccctcctgttactgtggatggaagctttctttctaaggccaaccactgcactgtgaactcagtgcctccctgtcaccaccagggtgtcactcaaggtattgtcttctccctctcctgtatcatcatgttcttatgcaactgcatcatgcccagaatcatgtcaatataatgtagtatcccatctcaaccaaatgcaccattgaccccatgtctttctgtagtacaaacctatttctctagacccttttatgagaaactccttagaattttttctttttcaaattcactgtcttcaattcctctctttacatactccatatcctcactccattcaggatgtacactccactcagcaactcttgctaggtccttagtaacctcttccacattgctaaatgcagtggaatgttttttactcatcttatttgcctagcttccctatttgtcaaagctgaccattcagcttctttaattttagattctagtccatcactctcataggacactcctacaacattggctattgttcctcagtccctttactggttcctcctcaccagtgtgatctttagttgttgctgtgtcttcaggatgggtttggggtctttgtttgtttgttttgctttgtatacactcaatccgatgatcttcaaatgcatataccttcagttcataattatctccagaactccagattcatctattggatgccaccttagatatttcagtagaaagtctaacagaaacctcaaactcaacatttataaaaccaaagtctttgtcctcctcccaacccccagcacaagccagctgttctacttgagtgttttctctccccagaaaatggaaaacctatccctccatttccttaggctgaatacctgatactcattcatgatttccaaatttttctccaacatattacaaatctcattgctttaatatacaaaaaaagatctagaatccaattattatacatctataccacaaatactttggtcccagccaccattattttcccttaaattatatcaatgctttcagtctcaggggtttgacgcttgctgttcctctgcctagaaatttttctcagtgcatgttttattatccacttttcttttgatctctgttcagatgtcaccagaccagtgatgccttccttcactgccttttataaaataacacctgacttcagcatttctagctcccttaccctttatttctctccatagcactcacaacaatctcatataacttctgtttgtttgttcatttatcttatgcctccctcaattagaatacaaacgctgtcacagactcaaagttatctgttttgttcattgctgtattttcaggctctaagatggttctcgcacatagtaatcccacaaataaatgattgttcagtaaatgaataaaaaataaattaaatttatatctcctctctcatcttctttcattctcactgctcctcatctttctcttctcctcttcctttaacagctaaggacttcaacatacatgcattcttccattcatccctaatagctaactcagagtaatctctaatgctgtctttgcctctttcctcacatcaaatcatttataatattttgttggtattgtgcctacatactccaaaaaagctctcacatcattcttgtcctctttattcctactgacaatgcccaattatctcagtggtttcaaacgtttgataaataatctccttgatctgtggtttctctttccctatccttcctcccgtgagtcatggatctaaacatatcataatcttgcttaaaactgaaaacacttccatgttttctaactgtttacaggtcaaattcaaacctctgtcatatcatttaaggtccttcaaaactgttctaaatctgccattccatctttttatttcatgactctcctaccttccagactagttatattcttttgaatgacaggtattttcatatctttattcaagcttttcttcttcttaaaacttccttactgtaactcctgtttcaatgccattcttattttcattcttttacacatagttcaaatgttgcctcttttggcattcttccaaaacctctaggtagaattaattgcttccttctctgggctcctttaaaattatatttatacttttggtgtagtacttatcctgtaatattgtagttcgttaattgttttcttattggcttccctttctggagtataaatcatagtgatttacggtatgagttctggagtcagtttgcctagactcaaaattgagcctcaccaccctttagctatttgatattgaacaagttatttccattctctaaacctcattttctcatctttaaaatggaaatattaaaatctgcctcgcagagttcttgaaaggaccaaataagataattcatattacaagtttaacttgattcctggcacttactatgctcccaaattattatttgagtgtcagcttcttgaatgtaatccacttatttatttttgcattgtcagtgcataaagaaggttcaacacagagttagagctaataaaagttggtcgagtttacttatgttggatttatcactgtgtgctggcaatatctagataagcaatgatgtagaattttattttggtctggctttaacctaaagagatcaacagaatgtgaaatatatgctaatgaactcttcttattataatttactttatgatctgcatgccacttccaatatggcatatacattttaggcaggtttaatgcttaatctcaaatcacaaggtcaccatagatgtctgactggactgaaatacttcatatttcatatttgaatactggatcttcaactttataccatgtgtataccattagttcattctgctagagtaacataaagataaccagaatgattccattatgtgaaaagcagctttcacattaagaattgtcttctcaaatgtctactgcatgtaagaaataacaagcatggccactgtcaggtgactgtgcagcttctcttcttcacatctttggtgttacctagagtaagaggccactgagtgtccagtccttagacacagtctagctttgcatcttgtgaagtgagtgctgatttcaagtatggcttgaatctaactgatgcttgatgttcaagcgttattgaacatatacttttgaaataattccaaatacatttgttgaaagtattattatcaaatgattattacaatgaaaatttatttttattacaatttaaaagacaacaattcaaaaatcagtctcccatcccagcccttaaatactgagcaacatcagtgtctccagttgttggttggacaggtaaaactgtgagccccagcaccatcaaaatcagtatctttatacctgaattagtattttttcctaatacaagcattcctcttttctttattcctctattttgaaaaacaacaaatatctgagcaatctttaatgtttccttttcctttaatcatgctcccacattcagttaactggcaaatcaccttttacctttgctttcaattcttgctcccaccaccttagtaagatgtatctctctacttagactagtataagaatttcataactatttttaaaactctagctttatcatctttatttttgaacatagctgacaaagtttacttttttccttttttctttctcctatgaagtaagtctgacatatcttcactgcataaaacccttcaaaagataaacatcaacaggcagtgggatctcagttcagagcttgatcttttgacttaaagctccggtctgcctctagttcttaagtaggacacttgacctctctagaattacttttctgttttattttttttctgtaaattaggtaaacatttctctaagtattttttctattttaaaattttgtgacttgacaggaagtttaaagaaaattggtaaaagataaatacgtgtggtaaggggagggagaaggaagaaagaagggaagtgaagggaagggaaggaaagggaaggaaaaaggaaagaaaaaaaaaaggcttaactctttatagaacctgcattccaagaaagatattaagtgagtttagtctagcttaagctctacaggttaaagagtatgagtttgaaaaactaaggtagaagcttggtaatagaagaaaaataaagccagggagggtagagcttttatagtactgaaagtatgcagaactcaagtggatgtataatttgtgtcactctggacttggagtcaaacctggatttgaatgccagctctggactattaatagggatgtgattttgagctaattatttaatgtctttaagttttagtcaggttcaactacatcatttgcagaccccagtacaaaaggaacatgtgagccccttgttcaaaaggcagaaaaaaattgccattaaaggcattaaaatataaaatgttttcttacttccctggtatctttcttgatctggaatgatgttttttatttgctttttaatggcactttccttttgggcatgggaatactttctcagcgaccctcacatgacctgggggccttgccccaccattcagtgtaaatgtgactcactgctgacccactgacttccaggttctccctttcatcagctgcctaaccaatatgcagtgccccagctcatagccccaactcacactaatggaaaatcctcaaaggctttgcaacatttgtgcaaattagacttctgcggtagaagatattctggaggttccaggagccacggtggggaaatatattgggagcaacaaaattctaacacagaaagatctcaggtactttatatctgggtgtgatcttggagctctctagtcttatccctgggtgaaacctgaaatttacccaggctcatacaatgtgattcaggtagaaccaaaaataatatgacttttagttctgtgttcttttagatacaggctttctaatgtatgtgagtttcccttgtgatttcctctaaaagcccaggttgtctgcacttttgtagttctggagaggaaaagcagccaaacactggtctctttctatggtttatttaaagctatctttctcaaggctgttttagttgtaagaaacagaaaccatacaattagtggttcatgtaacctagaggcagatctcactagaaattgaaaccaaagatctaaaaattcagggaataaagcctctctcctctaaattactcattctctccatcattctgttcccccccaccctctctctctatcatctacttatctcaatttctgcctttgtgtagactggtgttctctacctcctcatgagttttatggacgatggatattataaaagttatgaacatcctcatctctgctcaagcaaccagcagagactagcatctcttaatattatatctaaattcttgggagagagaaacaccagagcccaagaagaacatattcacttctcatccagtcagccatggcccaaggaatggcctaaagcagattgaacatgcctttaaggatctccacagtttaagagctacttctccatgaaatggttcatgggccattcagaaatgccagaatgtcactgcattcgaataaaaagttctcagtatttagggaataataatgaacgttagataccagtaggttagatgtaatattgcagtcagatcatggaattaactttttaattccatagaagataatggaggaagaaaggtagggcagaaccctttatgcattttcaacaatattgtacaattttcatataattattacttagaaacatttatttttcagtgtctacctattccaaagttcttgccttactgccaaataaaacttgttttttttttttttttttgagataaggtcttgaacttctgggctcaagcaatctgcccgtcttggcctcccaaagtgtggggattacaggtgtgagccaccatgcccagcctctctaataaaacattttgtagagagtaccattataatcattggtgattacaatgtatagtagtatgtatacacatatagtttttatatgtgtgtgtatatatatacacatacatgtgtgtgtatatatatacatgtgtgtatatatatacatatgtgtgtgtatatatatacacacacacatatatatgtgtatacacatacacatacagtagtatgtgtcttcaatacaattactcactgattgtagcagtggctcaaaaataccaacaccattctttttcccaaatacattcttaaagcacaagtatttgaaaatgcattttgatttcttgtttttgatatcatattgtcacatgttttcagctgttcctatacagaaaaccaacattgttcttgctttctgattgtatagacaaaacaataaagacttgctgttatttcatcatttcattacagtatgagaaaaatctaacaatttaccaaaagatattaaacaattagttgaaactagactttttacttatcaagtggtataaattcaagctcctaaaaagttgataacaaatataaatgaaaaaaaggaatgatatcaactgactgatgataattcaacaagacctaacttctgtgtctttcaaaatgacctaaagttacttagaaaaatgtctttaagtttctcatctatcaaatgggaacagaaatgtgcatctcacaaaaggcatcacagggatttaatttggaaactgctgtatgtatatattttttgaaaaccactaatcattctcacaagtataagatattattaagccaagttatacccccaatttggactacatgaagtttaaaccagacttttctctgagtgaaagtaaaggaaagcaaatgaattagcatttgttgtgtgcttgttttgtgcctggcataatgtatgttgcttaatatgcattatttcaaccaggttttctttttttgtgtaggaggtagggggttggaaactttaaagagattttatggagatctgcaaaaaagtcattcatattcccaccatcaaaaattaagttaccatctcagcgtatttatttcccatctcttttcttcattttttaaaaaatctgatgtttctttaatataacgcatttttattttaatcattcaaactatgaaatattatgcaaagaaaataaaaaacctatctccaataaaactttctctaaaaataaaaattattaatattgggtaaaattatagccatctttctatatatataaatacagaaaagatatactgtattcatgtatagatagataatagcatagaagaatacaaatattttataaaaatgagatcataccatagacgttacttttaacgtcaagattaaattttattttagaaaacagaataaaacaaagtaaaaatgataaataatttgaacttctaataaatgatttgagacaaaaaaattttttaaatgatttctctaaggttaaaagatacaatgaatgatacaaagaggtcagagtgcctttgtttgtaaatacaataatattatatgtatatatgtgtacatgtatgtatctatagactttttgctgtgaaagatgatactagcgctcatactagctaattatattccctcattcacttctcatttttctattttgttgtttatcttatcgaggttgtagcatttatattctgttctataactaaaactagcagagttcttaagtgtaagtttgtgtttgaaagtattctgtgtgtatcccattattcctctttcattctcaagatctgcatattgattcatatttaattgaatggatttcattgttaagtgatctctttaagaataatcatctgttatttttcatattagcttttttatattagtttttttaatgttcaaattgttcaaatgtgtttgttggatgtcttttttttttttttttttttttttgagacggagttttgctcttgttgcccaggctggagtgcaatggcgtaatctcagctcactgcaacctctgcctcctgagttcaagcgattctcctgcctcagcctccctagtagctgggattacaggcgcccaccaccacgcccagctaattttttatatttttagtagagatggggtttcactatgttggccaggctggtctcaaactcctaacctcaggcgatccacccacctccacctcccaaagtgctgggattacatgtgtgagccactgtgcccggctcagatgccattatatttgaaagatatattggtgataatactaaagtcatccttccatttggaatatttacagacttttcttcattgacttctggtataaaatggtactgtttaaaatcccagcttattctgagttttcttttttactctgtgtatgtatgtgtgtgtgatggggtcttgctctatcacccaggctatagtacagcagtgtgatcatagttcactgcagcctcaaatccctgggctcaagtgattctctcacttcgtctcccaagtagctgggactacaagcacccaccactgctaatttttcttttctttttgtttttggtagagacagggtctccctatagtacccaggctcggtctcaaactcttagcctcaagtgatccttctgtcttgatctctcaaagtgcagggattacaggcatgagcccctgtgcccatcctttcacttttacttagcttgctatttctgtccagtcttcttaaagaagcttcctcttgatgttcttcaaatattagtcacttaatcagcaaacgctttggtgttgagtattcactctttcaaatatttctggaacatgttctttccatttatagtaacttttcttaatggtatttactgagacatgtgtttgattctataactcggtgacatcaaggatcttaatgttgaatcatctttatctatgtttctaatccattaccttctcctcattgttttattatctgtgcttttttcacattatgtgagataattacaatcatctcaaaacattatagcagtaatgtgactttcagtgggtatctgttttgttgcttgcctattccaattgatttatttgttatttattgatgttgcctgggttacagtttgcatccttaggttcatggtctccaaatttatctggttctattgtctgtgtatttttttcatattgacattgttatattatttttaaaaactcatgctcttattctatagcataaaactgttttgaggaattccccaggttttcttgagttatgttttcttttagattgagtattttccctgtcttggtcatgccatgttttactcttttattgctgcaatatatttgcatagttactattccatttcttttcatattgttcatgcttgagaaactgtgtacagaaaattcattttacttaatggggaaatatattttttgaattttatttttattatatctgggaacaattttttttctccttcttagctccagtttggagacaggatttatggcgagtacccacattttgtagcctgagagaatgatggggccaaggaaagttcagcctttttaggatacctgggtgcttctctctatcctaagatttctttttcaatgaattgtagccagattattattggaagagacttcagtatacttcattggaagatgtagcacttttctaatgggcttcagaggcttcacccctgagtgcatgggcatgacattattaattggttaaacagagtcagctttactatccatatttccccactttacttttttttttttcctagaagcccttttcattgctcttcagccagaaagaggtaaaagaaaaagataagacctttccatctgtgtacatacaaatctgcttatctccagatttagaagttataatgagaattctcagaatgctgttatttcaccagtaaatcctatagggtgtgaggacgacattaggaaatcaagaactccttcccttctctgagcctgaccagactgcttttactccacagttgtttttggtttttttctttaagtaattttgtcaggatatgttccttttcttttcaggcattgttaatttctgtttgtctgttatttgtacttacaacgtctcacacatttcattaggcactgatactgatataagaaaactcactcaaacatcttcaatccacttgctcgatcatcatttacaggaacactaaaatatatgacatagcatcctcctttaacagctgagaaatcagagaacaagagtggtgaagtaaattgtccagcactggggagccagtaattgaccaggctagaattaaaacctctatctatctacacttctaggtcactgaggaaaggtgcctaaattacaattttaagatgaggttaataaaagaacttattttacccaattgcaaatattttagaagactaatatgatggaagcagatctgagtggatggtgaaaacaatggagagggaatcaggaagccaaagtttaatttcttgctctctcttaagacagatgttaaatttggaaaagatgattcaacttcctgggtttcaatttccttctctttaataataatgatggatgatgatgatgatgctgatgattgtcataatttgatgactatatatctactcattgtgaggcacaatgtgacatattttataaacaatatattattaaatctcaaaacaaccatctgatatacacattgcatctattttaataacaaggacacagaagattgcttaaatcccctgaggcccatttgattccagagcacacgttcttaaccagtagctctatggtctttccaaccaagaagtctgacctgagtggtctgtaaaagatcttccagctttgaggttctctagtgctgtggttggtatagaaggaaatgactatgggttaacataggagaagcaagctcacacatcactcaagtacaattattagagttacagactggacttcaaattaagtcctaacatgatcaggtttacgcttgatgttgtgcattgcactggaggggagaaaacataatttcttttatttccctttttaggtttttagttgagacaccctcctacaaacaaaaatcaaattaacaaaagaaaagcagaaatgtattaacacatgctggacccatcatgccgagagacatcaattcaaaagtatttttctcaaggcagtggcttggggtgatgtttcaataatattttatcaaaatgccataaattctgcatagtaacaaggcaaaggaaagaacagttttagtcctttaaaaggtgagaaaatgtgagaggatagtgaaatctgttctcagattcctctggtgcctgctggtgccttctctgggctgataacaagtgctgtctccagtaaggaagcatggatgtcctgccatcaagcaaacagaggctgaggccgggtattctcctgccttttcagtgcctttaactcaacaatcctcaatatttggggaagaaatattttggtttctttcaagacattaaaaaataaaaaccacagaatttcaccttacacatgagtactaagctcttcctcatcctcttccccttccctttctttcatagcaatttagtccaaatgccatgaattggagctgagtgaggtaggcatccatgtgcatgtggaagaggagagccacagcagtccagcctgaggtgctggaacctgagagaggcgagagaggcatccatgcagggcaggggttaggacagtggtgacttggtgtgagtggcagagcccaagtaaggtgagaaggccatacctgtggtggggtggcctggcagagggtatcagagcctgaggaaggggaagagggttccattgttaggggagggtgttgaaggcagaagcctggagtctggtgttggagccaaggagaaggagggtggtttctgggggaaagagagctcccgtgtgatctgaaagatgtgagaaagcgagaaagctatccatgtaggaatatgtctgtgtaccaagtgtcagagcccgagtggggtgaaggaggacatccacactggaggcagaccctaaacagggtcagaatctgagtgaggtgaggagggaggaatcacccagctagtggtgtcagggcaggtataggagtaaaactgggagtggacatcaggacctgagcagggggaagaggacgctgacagtgatacgagactagtcacatacaggggaagtgagcaaatgcataaatatgtcaaagataatgggcaccagggttctcacagcctaaatgggagttgcaaatataaacagaggacaactgtaaatcaccataaatgaacacatcacacacgtataaaatctacgcacacacacaaatttgctgagaggctctgggcaagagcacctcaaaaaaaaatgagtacggtgagcatcctcatgatggcttctaaataccaatctctaataaaggaagccaggttgttttgttttgttttgtttttgtttttaacaacaacaacaaaaatggctactttgctggcagagcaggtgaaatacaagatgatcctggaactctctcttgtatcagaaaggaagaattcaaagaagggtaaggacatgccaaaggcaagccatttgaaagcatcgaataaatagcaaatgtattataactcatttaccaaaataagaaaccttggattcacaccgataaaacagatcatcctcatagaaatatatgaataaaaagtttaaatgtccagtgaggcatatttgcattgtctaaaatccctagccacaaaacactaattataaagaaaaaaaagatacttacttttatactggagaagtctgacaggtaccaccttagtcaaatgattatttaacttcaagagcaatgggacagatagaagtcttaaccttctacctgacagaacgcagcataaagagcacagcatcctgaatcgaattgtaatgaaagtggtttattacctccaatggtgtatccagtgaaggaggagaggatagagggaaagagggcaagacaatgggatcagtgtacttgctggctgggagaagccttttttatagtgatttttaaagccaatttttactgcttttattattatttttgaacatctttatagacccttttattatatgtgcccttggcatatagctcctaccaatacagggaagagtctgtgacttgccattgatacctgactattcagacaagcccaaatgaggtgaaactttaccacataactgccttgtgatctaaggtgttaaagtcagggaaatcaaggaaagactgtggaattgttgcagattgaaatagactaaagagacataattaagagaggccatgcatggtggatcatgcctgtaatcccagcacattgggaggctgaggtgaatggaatgcttgagcccagaattttaagacaagcctggcaacatggtgaaacaccatctctacaagaaaacaaaaattaacctggcatggtggcaaaaattaacccaggagggctaggtgggaggttcacctgagcccaggaggttgaggctgcagtgagctgtgattgtgccactgcaattcagcctgtgcaacagaatgacaatctgtctcaaaaaataaaaagaaaataaaaaagaaaaaaaatatcaactggattcttttggtgtaaaagattttattgggggccagacacagtggcttaatcctgtaatcccagcactttgggaggctgaggtgggagaatggcttgaggtcaggagtttgagaccagcttgagcaacagaaggtgactccatatagccaggcatggtggcaggcacctgtagttctaactacttgggaggctgagatgggaggatcacttgagcccaggagttagaggcttctgtgagctatgatcacactactgcactccagcttgggtgacagagtgagacactgtctctacaacaaaaatgaaacaacaaaaaatagaattttattagaaaaaatgggaaatgggacctgaagattagctgcttagagctgaatcaatgttaatttcttgatattgttggttttgggggtgttatgccctttgtttgttggaaatataaactaatttatttgggtaataggggattggtttacaagagaaaaaaattctttgtccatttttgtaatactttttgtgaatttgagattgttttaaaataaaataattttaaatatgtatattgaattgatatttaatatagacttgcattcaaaacagggccacttttttttcatgtgatttattcttttcttttcccaggtgatggtcttttaagccgtcctatttttactcaggagccacatgatgtcatttttcctttggatttatcaaaatctgaggtcatcctgaattgtgctgctaatggttacccttcgcctcattataggtaaaatcctacctgtgggcaccacactattttgttcttcctcactgaaccaaaacatacacaaaataaagtgttttataaaatgtcctaatttgtagtgtacagctcaaggaatttctctacgggtatgcagccatgtgacaatcactcagataaagatataggcatttccagtaccccagggtattccctcatgccgctttccaggcaataattaaccccctacccaccagctccaggtaaccgtacttatgtctctgtcttattgattaggtctgcttagaacatttattcttgagattggtgccatgcattgccttattgtggtcagaaatgagagagagagagaagagagataggggagagagagaagagaaagacaggaagcaagtaacacaggaagccaggaagaaaagaaagataaaaggaaagaaaaaaatgaagagaaaggaaaaaaaaagatttgtttcctcaatttgaaagactaaaatgtaagctcattttgcatttcccacccctgcctcaatgcggaactgcagcctcagttgctgcatatgcaatgattatgaaaatgttctataaggaatgaatccagatggatatctagatttatttcatcagataaaattatgtgacttcactggtgggtcacatcacccaaaaatactgattttagaaaaatatgttgaagacagctatgtaccctctaaggcagaaagggaatttttattctgggcaaataagaaaaaaaaacctatatttgtttctcacatattatttgtggaattctagggagaaagggtcagtaagtttttgttcttatttatcaagttgtagcaaaggcagaatttgcttcatattgtgggtggaatttacaaatttaaaaatatatgcatacgtaaatattcataggtaaatactacagatatttagttagtagaaacttcatatgtagtgttaatacaggaaaagaaaatacatattaaacttttgtagctttgggttttaaaacctttttttaagtcttgttttacagatgtgaagttgatatgacacacacaaagagtaacaacttcagtgtattttggcaaaataagctggtttagcctgattttattttgcagtaaaaatacactcttgatgtgcatagttatttagatcctaaaattgtctagattaatgagttaaatgacttaaatgcacttaattagctaaatgacttcaaagctaaaggcaattctaccttatcttgaatttttttgagctaacttcagtgtcttctttttacaacaaaggagctgaaaaaccatgtcttctcattccacagactaaagcttccttgtctttatcatacccaaaccagtgaaactcatctgtcaggggaagatccttcactttgcaaatttgggacactcaattcagagtttgttgatttgttagtttttcttaaatgatgagctgtcctattagtttaatatatggttaaatatatgaaaatttgattaatacatttagtgagatcacctaatacttaaagtagtaattttatgtttgagagctaactaggttgatcctaggggttagtagagaaagaatataagaattcctataacattttttgaaagtttgctgaatataagacagacacataaatacataaattacatatttatataaaaaatctattggcttttaacagttagaaggatataaaataggttctcaagataatttgctaattagttttatctgtgaaaaaatagaatgaaggcaacagttttcaatgttgttaaatggcttttatttctaagatccttgtaagctaaaaggctaaagacaagtaatttatgtgcttatttccagcccccataacctggtttggctcatttcttttttttttaacttttaagttcaggggtacatatgcaggtttgttatatagataaacttgtgacatgggggtttgttgtacaaattatttcatcatccaggcactaaccctggtgcttattagttatttttcctgatcctctctctcctcccatcctccatcctccagcaggccccagtcgttgttccccttactcatagacaagaaactatggaaagagagtgagaaaagaattaagtttttaatgcttaaatgtcagactcaggcccaactttattgataataaagcaaaggacagaggtatttcagataacgtgcattaccaacaaaatgtaaaagttcagttttaatatgaccctttctaacttaaattttattttttaaaaagcctcacaactatattcaccttagatggtgtgtgtgtgcatgtgtgtcttagaaggaaagccttcacaattcacagattctaacgttatttgaggttacctgggtatagtgtaaagcaacataaaagaatccttgacttaaagttatcatttctagtcacagctctatcaatccattggtgactttggaataatcatttttctctcctggcgtcatcttccttattcataaaatgaggctgggtttgattttaagatgtgttttctttcttttagtaaattccatacagcaaatgaaatctcagggaaaataagcaatattaaaagcaaactttttgaaagagcttaagcttgcccatgaaaaaggattaccctttattctttcaaagatcacataacacatgagaatatgaagtccagccctgaagccctgcaaagggaagagaaatgggctacccaaagatggtgctttggaaggattgcttatacctggaaagtctaggaaaatcatgtagcaatgaacttagttctacctcagaatatatatttgatttggaaaaatgaaataacatacacataaattatttctaaatagaatatactctctatcagaaaaaaggatttctgacaatcttctctctacctggtcaccagaggagactcctttctgtaatttagtctactctaccctagtcatgaacacaaccttaagtctagagaagctctaggcctctaagaaaaaactataatagtagtgactctgcccttctgttctttttattcatttcccgcaactttatccttttaacaatcctgtgagataagcagaatatacattattgcacacatcgtataatttgtgaaatgacttctggagaaatcagaaggcttgttcaagtatatgcagcaaaggaacgtcaaagctaggactaggattctttccacaggggtcacagactcaaattcagtgtacatcacaatcacccagagagacttaaaatttagattttggtgttctctgtcagaggtctggggatgggctcagaaataagccaggcagagagagacaaatatcatctgatctcactcatatatggaatctaaaaaaagttgatttcatagaatcaactcatagaagtagagtgtagaatggaggttaccagaggctgagtcagggaggggcaggaagggaaaggggacaggtgggtcaaagggtgagaagtgacctttagacaggaggaataagttctgggattcatttggacagtagagggattatactcaatgataatgtattgtatatttcaaaggagctggaagagaagattttgaatgctctcaccacagacaaatgatagatttttgaggtaatgaatatgctcattactctgatttgatcattacaaaatgcatacatgtatgaaaacatcacattactccctataaatatgtgcaatcattatttgtcaattaaaaataaataaaactcaaaaaaaaagaaacacattctttcagcaaatataccatgtaattctaaagcacagcctaattttgaaaaacaccaacaggcacaagcgcgcacacatgcacacacacacacaaacacacacatattacggaaggacagccaacaaacacagcccacaaccattattctttttttgtttttgtttttgagacagtcttgctctgtcagccaggttggagttcagtgatgcaattttgactcactgcaacctctgtctcccagactcaagcaattctcctgcctcagcctcccgagtagctgggattacaggcgtgtgccactatgcccggctaatttttgtatttttttaatagagactgggtttcaccatgctggccaggctggtcttgaactcccgacctcaggtaatcagcctgcctcggccttccaaagtgctgggattacaggcgtgaaccaccgcacctagcccagccattattcttgacacaggactgaactacttaaaagtgaaggatgtttcccaacaaagggtcgagattttagttcacatccattatgttttctggaactaatatgatattaattcagatgctaaaagcaatcatttaaaacacatttcctaggttgcatcataggaagacacttgtcagtatgcaattctatcagaaatgtgtgcatgacaatcatttgaattcattaatactgtttctccattgatttagacatattaattaggacaaagcccacaccaggagttgaacccctgatctatatgtacagtttaataatcattgtaccgtagtgatcagaatgattatggggatactgtgaaaaattcatttgctgccgctaagccaacaactttgaatttgtgttgaaaaacaattactgagcttaattaggagcatgtaatgatgacagcggttatttcagtgattgattccaaaattaaaaggagctggcaaactaaatatggtatatcctatgctttgaaaacgatagggaacatggaagtctaaagagcaaattatcaaaaactatattagagtgctggcaaggagaatattggtgtcttgagacaggcctaaagaaagaaaagttttgaagggttttattattgttttttttttttttcacttttttcttaccctaatattgaaaacgagcagtctctacaaattcctctagaaaaaaatgatcgcagaaaatctaggcaaatgaaatgtactctttaactgctgtctttcaacttccaggtgtgcaggaaatggctaaataatttcaaagttaacagagttggttcaaaacctttgattgatttgacatctgatccatcacatctcatctttaacatggtagaggattacctaaattcatatttcttttctactttggtaggcatttgtcagattctccccatgggatgtttgaagacgcgcccgaagaagtcaatgacatttgaattaattctgtatttttagtagaggcggggttttgccatgttgcccaggctcgtctcaaactcctggcctcaagctatctgcccaccacggcctcccaaagtgctgggattacaggcatgagtttctgcacccaacctctttgaattaattatgtaaaatgtcattttttaaaaaattaaccactcccaccaaaatatttttaatatgattttggtataaaggggagaatcatagcaaagctggcataaaccctaaaaaacacagtttggaaactggctatattccataggaaaagatcattcacttgttttcctagatgactgtgatggggttcaggacataccacctcaaaatatggcaccttggcatttgagaaaatagcagaagcaggaagatcattctcaccttcccctcactcttcttctctgaagcaggtcataaaacctttattccagaggtatcatttctatatccagaggaaagaaacacccttttcctcctcaaagacacagagaaatcaagaagaattggaacaaaaggccttgctaacttcccgccagtttcttaccattagatcataccctctttttacaatcatacttctgcaggactgtctactcttcatcaaaactagcattaaaaacacacaggttttcctgttttttaggattttttttctgaaggctttcatgtcatggaatatttatattaaataaaattatatgtttttctgttattaatcttcctttccttttagagacctcagccatgaacttagcaatgagtgagaaaagatatttttctacatgcacaactgtttgtcattattcaatagttttaagtgtttattttaaaaaatggtctatgtgactatacacagcctgtgccctaggaatgtatctcattagatatatacgattcatgcttcaaaatatttggggattttgatggagttgggagtttcaaggtaggaaaagtgagtctggttagagataataatcaggtattcatttgtcttaaaaatgaccaaataaaatttctaaaactagttatgaatctttgaaagtaaatataactctaagactcttcagctagttaattcatgtactaaagaattgttgactaatagctaagccaagagaatttttgcttctcaaaataaaaacctctcaaacagcatttgctttgctaaagtataattttagtttggcatttctaagtaccattgaaatattttcaacatgattaattttccaagtaacatactaacagaggtaatcatgttctaaagtagtcaggttattattgttttgttatcagccctgaattggcgttgtaaaattatgcttgccgctttcaatatacgcttcttgaattcctatctttaaatcattttgacattcaattttgtgctaccagttgtggatgttcaggtaaggtatatgttatttgaaaagtcactaaaggaataggttggccagtattattgactgactgtctaatttttatttctcatgttgagagttctgtttcctctttgtatacatttgggtgaatgtaacttataaagagtacatctttcaaataatctagttactgatctcaccaaacccaccaagacagctacctttggtaaaactggtaggattacctccacatgtaatcatgttttttggtgttttttatagttgcaggaattagaactacatgttttttaagacaaagattgattgactctgtatattataagcactttattttttttttccttgaaggtggaagcaaaatggcacagacattgattttactatgagttatcactacaggttggatggaggcagtcttgcaatcaatagcccccacacagatcaagatattggcatgtaccagtgcctggccaccaatcttctggggacaattctgagtcggaaggcaaagctccaatttgcatgtgagtttggggtaaattttgtaatctttgtctctgaaaatataatattcttctgatacacacattttaaaaatctagctttgccaatgatatatttgagaatgaatatgactttatgggcttttgacaatgttcattttgtgaatctagattcttgggtataatagaaacctgcttctaaaaaaagaataaaaaaaacagggaaaagatcaatgttattatattttgtgaattatttttagaaacatttctaaaagtttcagacataaatattaagataaagatgtatgatatagcattctttttctttttcttttgcattggatattaatgcaatgtggagagcacaggaagaaaaagctgagggcagagaggtcatctgggggaggtgggcgttctcccaagaaaagcgatcatgcacccgtagtttgatgtaggtggaaataaagtggttgccaaaggcaggctttatattaactgtaacaatgtccagctgcatcacataaatgtcatccaagtaattaccctggtgacatttggggacattagcagatgaacaatagacatactgcgtctaatatcctttatatatagtgtttccagggactgaaatgtttcatactggattcagcaaaagccttgcttgagagtaattatatctgttgatgtggataaagtagaaggcttgcatttctccctttgcaccaaccattatgtcccagaggatctagccaaggaaccaaaaagtgagctgctatacctgcagggctcatagaaatgtctatactgtctgttactttgaaaaagtaattgttctgaaattttattaacaaatacatgaccaaaactcaccttgtgaaactacttcagtcatcagtagatacatgaattaataactgggtctgtttctcattgcaagtcttgtgttccaaagattattctacaccagagatcccttgatctacacagagttctctttatgttgaccattttggggatggccttgcttctgattttacatacaccacatacacatacacacatgcacacacatatacatatatacagatatacacacataaatatgttgctaactgtatccaaatgtatttgtatctatggaagtaagaagtgaacgtggaagtttattaacctaaatagaaggtgggaaagggccagtggctactttcgaacataggataaaaatatttataacacttgatttcttcatttcagctaagactatcacctggaaaaataatagggaacaaaataacataaaaacttatgttatagaaataaagaattgttccagactttgaacgattctgccacagtaattgtttatttctcctgcttggataggagatgaccctacaacatacacatgatatgaatcagattccataatcataaatttgactctttggtaaaggaaactccatacagcatatttatttgctataccctcgagtttctctacagttatgattctatctactctcgaaaacagttgaatgtctacatctcaaatcaatgcactctttgatataaccatagatttcttctcctttgttctgtactttttaacaaaaatatgttttaaaatgtcctacattattatatcataccttctttctgctttaaaaatttcttgcaacgagaagtttctctagttaaaacttattttgtttatgccatatcagaataaaagtctcaattaagaagaaattatatgctttcatctggctaaatgggacaaatcaatttttctgtccttattgactttcccatcttatcataaaattttccattttggggcagaaggtgtatgactgttgatcttgaaaagcatttctattacctttaatgcagaaagtaagatggcctatatccattaactaatctttcttctgcaaagttaaaggatcttaggctctaagagcttgcaaaagcaaggaccacaacatggtggtggtgtcatgtctgaaatatttctcattgtatccggggagacatgtgcgagagtgtggaaacagagagtaaagggtataaatgccagtccccaaccaaatggaaagttcctaaagtgcatgaactgtaccttcatcttaattataattcctcacaacctccttcataaatttttaacaatatcaattgtgatagaaaaggcctttggtaggataaccacagcagataaatgctgagattttgggaaacagagaggtgtgagttcaaattctttttgtcaaatatctagtggtatgaaattaggtcttttcttaacaacgttaagcttctgttaagaaatctatacgatgaggatacagcagtagccaccacataggacagtgacatggagtcactgagaaaatgaaggtcaagtccctgatccattatggaccctagggaaatgacagctctaattctttctttcactattattacctatctcaacttagacagacatctatatatttcaaaccacttgagtttcttatggaaactctcctagtttagtttacatttgaaaacttcctaaaggctagtttcttgttcttttcttttcatgtcaaatataatacatgtgctttgacatatattatttcacttgaattggacaacagctgtaggaggcagttgctatcattgcccccattttacagattagaagcctgaggctcactgatattggggctttcttaaagtatgttgttagagaaaagttggaacttgtgtatagacaaagaagacttcagactctaaaactcatgcacttcatgtcacagtattgagtccttctcaaacactgaccacacagttcatgtgggccttctttctttgtttcacttgctggcacagtaattgtctaaataataaactgtatcttcaggacagaatgggtcaaataagcctggtagtagaggctggtgattccttgtccacatccgcttttgcaagtgatgtgccaacccccagctatgaatacccacagatatccctttttgcatttcatgccccaaacctctccatgggatcaggctgaaaccagacaacagctgcaacaccttaattagcttcttcacttgctgtttccttcttccctccctgcctttctcctaagaggatatcctcaataaatcatatgcacttgaatccttgcctcaggctctgcttctaaggaatccaaagcgagacagagattaaacatttaatatgagattgccgatctacttactgacagaaaaaagcgggtgcagaagccccactcccatgaactcccatagataagaacaagctatgcatcagaataaaaatggatcaactcccttgcttcctgtccgttggcagtccattgtaaaatgtcactttgaccttcagaatgaatggccttatgaacaacctttcagaatctaccctgtccatggcagaaacgctgcagggacatacctctagataattgatggcttttgtttgtcacttttatcctggtattcagtaatccaaaagcacactttgagtttattttagacacagactgtaacactctgcttcattatgaatcgtctcatcatgaaaccatcctgaaatgtggcctgtatataaaaactacctgttgtgaaacatactcctaaatcaaatctgtctttaaccaactatgtaacttagacaagtcattcagttctctggatttagctaaagtatattttgaattatttgattacaaaagtctctttcagctattgtcatataatctgtccttccaaatactcaggtagatcctattttaagtatctctttcttccccaacccaaactctaccctaaaacaaattcagcaggagtctagtcaccaaaggcttctgttatcatcctggcattcttgaatgataaaactagtttgacttccaaaatcacttgtagctgctttcaatttcttttatttatcaaagcttttggtggtaaaggttgaacttagacctcttccttttgtatgtatgtatgttaatgaattactctgtacttgtgtgagagaacattgcatctgtcattgctgtttaaaatgtcatccttgagaaaatgagataggtgttttgaaagaaacccatgatatcactcagatgtaatttttaaatgcccttataatatataactctaccaatgaaaagataaacatttatgataaaaggtagtcatgaatggggctttttgatcctacattatttaatgtgtaatcacagctagcatttcaaataagtttgctccattattgcaaaaggaaaggcagctgggctggagcctcctaattgacccttcatttattcatcctccaagcaaccggagaacacctaatttatacccatcaagtactacactaggtcctaaagattaaatggtagataagaaacagctacttcctgtctcaacagaacagacaggggaaacctttaataaaattaaaaataagaaaaggaaaataaaggaaagtgctaacgcctacaaagtattatgtggcaggcattgttccaaactctttatgtaaattagctccattgatcctcacaataaccctctgagagtatcatgatcttcactttcagataagcagattgaggcacagaagaatgaactagcctgcctaaaatcacacaccgtatgtgggagagtctgttttcaaatccagacagagtgaagagtcctaccacctactgcactgtcccaaaacatcaagtgaagtgagaaaggtgaaattgacctataacagagtggagctcaaagtgagaagtagtgaagtttgtctgaattggagaaaaggcaagggaagcctttcaaaggaaatggggcttgcattgaaccttgacatgttagtttgtattctggacagagaaagtggtagagaaagtacaggtcggaagaacagtaagaggaaatgcagatgtgtgaacaatcttcaagtatcgaagaaagtgtggggaggtgggcaaaagacctgagaactgaaatgcagaaagctagggatcagaaatgactggttttctaggttgagactgaaaactaatttggagccacttataagtagtcctttatatccgggcctaatctgcaaacaataggataatttagagatattatgagatgccaaagaaacatgcaaaaatccatcatagtacaatattccacactcagtatgacactgtgtacggtgttaatttatggttaaatgccagtattgcccatttcatatagggttactatgaggaccaaatatattatgtggaaagcagagggcaagggcaactgatagactggtatgagttgaagatggtgagctaggcaggggtctggccatacaaatactaagaggccaagttttgtattttactgcttatcctaagagcaatggaaccgttctgaataatgttaaggatgttgaagttgtttataaaatgtagtttgaagccaggcgcggtggctcacgcctgtaatcccagcactttgggaggccgaggcgggcggatcacaaggtcaggagtttgagaccagcctggccaacatagtgaaaccacgtctctataaaaaatacaaaaaattagccgggtgtggtggtgtgcacctgtaatcccagctactcgggaggctgaggcaggagaatcgcgtgaacccgggaggcagaggttgcagtgagctgagatcgtgccagtacactccagtctgggcaacagaacgagactctgtctcaaaaaaaaaaaaaaaaaaaaaaaagtagtttgaaataccacatactatttccttaaatatgttagtctgacatattaatgatattattaatattatcaaaaccatagcacacatacttagggggcatcccaaacctcagtttttatcatatacaatggagtgaacgaattcttgcaccacatcacaggattgattttaaatggttcaaggttaaaatgcagtaagaatgcattttaaagggctataaacatgtaggcatttacaatcatcatagttttttccagaggaatgcaaagggttttacacctgccatgccattcatctttattctatacctgtaagctattcttaaccatgttttacaggtgaagacattaaaaggcaggacaactatgttacttgcccaaggtcaactaacctacagcagacccagaatttctaacatttccttcttgaaacaactttttaaatttatatttattttgtagacagaggaagtaaatcagaattctcatgaatttaatgccatattcaaagaaaaacaaaaaaggtaaagtcgtaacataaaggtctttgactccttgcagaaggattctaagatatttgtgtatttaaaggtgataaatatttttatttctatcttttgaccagggtcttataagcaagaacaaaaaccctcacatttagaaataaattttaagagtttccaaatttctttaaaattctttcatatataagaaatataaaagcagttatatgtgctcccgatgatatggtgataaagtgcatttatatcagaaaaagaaattaagacccagcagaagaagctttaaaaataacacttaaaaatgcttttggaaattgtaaagtctccgataattgcgaagtgcgtattaagtgggtaatgcatacctaattataaatgaaaatgctaaatggcttttaaccttttttctacatcagaaaagaactaactgaacaaaagccatgaagaaatattttttctttaatttcttaaattaaaaaagttggtaaattagtattgattttttcagtatcatttgcaaatagcataagcaatgttacaatggatttaatattctcaatttgtcttaatgaaataacagcataaccaccaattgttatcatatcaaggagaaaactttgtctttgcttttaaaaataattcagatcttaaacaaatagactgtaagcagttgcgtggttaaattatagcaagccactgttatatttatatttaaaatcaacagggaagtagattattcaatgctttagcctcattttttcccacactatcgctgctggaaatctatttatgtgtcttatcagaaatggtactttttcaaaattcaggccttctcccactgcctacttctacttatattcagcaggagctagtctttttagttcatttgaataaaattgtgcaggctaagagttgggatgggagaggaaaatataagaaagtaggggatccattctatcaaaactgggagtttctgatttacaaaactgagacagatgcacaagctgaaatgcttgtttattactcatgttatttgacaaactgtttcaaggaatttatgaacatagcacatagagattttgcttctaagatttataaaattggttcaaattacagtgacattttttgcattaaaggatcaaatatttctattgtttatttatatataaataaatatataatacatataaagagcatttataagtaataatgtgtatataattatctgaatttatatccaatattgtctaaaaagtaaatcagattcaggtgtttaaatagcaaatacaggagagaagatggcggataagcagcaagactagcttgcagctcctgctgggagggatagagcagcatgtggagactcacatcatactttgccccagaaactaccccaggaacataccaggaaagccgagagaatccacaaaccctttgaaagaactggatcaccgctgcaggctccctgagatgcagaaaaactgtgagtcggcttgctttctcaatagggaggctggtggtctggggcaggttctcagccctggtcactagctgtctggaaatagactcagtgctgctgggggcgggtggggcatggtgggagtgagactggcctttaggactcacgctgtgtgggggtggggtgaggcctgtgactgcgttttccctcacttccctggtgaactgtatgactcagcagaggcagccataatccccctgggaatataactccatcggactgggaactgtacccccatccctcacagcagctgcagcaagccccacccaaggagaggctgagctcagacacaccttatccctatcccagtctggtggtctttctctatgtgtcctggtagccaaagacaaaagtcataatgtcttgaaagctctatcgccctgcccaccacctgagaaacctgaatacttttgcatcctccgtataggaccacagctgatgcactcccgaagcgccatctcctgactggaggccaaccaacacaaaaccagcgctaaacaaaaacgcaaccaaggaccctcacagagttcacttcactcccctactacctccaccagagcaggtggtggtatccacagctgcaagacctaaagatggatcacattacaggactctgcagacactcctcagtatcaatcagagcctggtagctccactgggtgccagatccagaaaagcaaagcaatcactacagttcagttctcaggaagccccattcctaggggaagcgggagaacaccgaaacaagggagcaccccatgggacaaaagactctgaagagcagcccttgaatcccagatattccctctgacataatgtacccgaatgagaagaaaccagagagacaataatgataatatgacaaaataaggttcttcaactcccccaaaagattatgccagctcacctgcaatggatccaagccaagatgaaacttctgaattgccaggaaaataattcagaaggttaattattaagctaatcaagaaggcaccagagaccaggcgcggtggctcacgcctgtaatcccagcactttgggaggctgaggcgggtggatcacaaggtcaggagatcaagaccatcctggctaacatggtgaaaccctgtctctactaaaaaatacataaaattagccaagcgtggtggtgggcgcctgtagtgccagctacttggaaggctgaggtaggagaatggcgtgaacctgggaggcagagcttgcagtgagctgtgatcacgccactgcactccagcctgggcaacagtgcgagactctgtttcaaaaagaaaaaaaaagaagccaccaaaaaaaggtgaagtccagcttaaagaaattaaaaacattatacagaaaattaaaggaaaattcttcagtgaaatagatagtataaataaaaaacaatcacaagttctggaaatctaggacacagagtaatgtaaaatgcattggaaagtctaagcaatagaatcaaacaagcagaagaaagaacttcagagctctaagacaaggctttcaaattaacccagtccatcaaagacaaacaataataataataataattcttaaaaaatgagcaaagcttccaagaagtttgagactacattaaatacccaaacctaagaataattggtgttcccgaggaagaagagaaatctaacaatttggaaaatatgtctgagagaataatccaggaaaacttcctcagctttgctagagatctagacatccaaatacaagaagctcaaagaacatatgggaaattcatcacaaaaagataatcacctaggcatatagtcattaggttatctaaagttgagacaaaggaaagactcttaatagctatgagacaaaagcatcaggtaacctataaaggaaaacctatcagattaacagaagatttcttagcaggaaccctacaagctaaaagggattgggattctatttttagcctccttaaacaaaacaactattagtcaagaattttgtatccagttaaagtaagcttcataaatgaaggaaagacacagtcttttccagacaaataaatgctgggagaatttgccactaccaagccaacacaagaacagctaaaaagagctctaaatctgaaacaaatcttcaaaatacacaaaaatagaacctccttgaagcacacatctcacagaacctatataacaataacacaatgtttaaaaaaaaagaaaagaaaacagaaaacaaaacaaaaaaaaaccacaaggtattcaggcaacaaaatagcacggtgaatagaatagtacctcacatctcaatactaacatagaaagtgaatggcctaaatgcttcacttaaaaaatacggaatggcagaataaacgagaattctccaataaagtctctgctgtcttcacgagactcaactaacacagaagaactcaaatttacttatagtaaaggggtggaaaaagatattccgtgcaaatggacaccaaaagcaagcaggagtagctattcttctatcagacaaaacatacttcaaagcaacagcagtttaaacaaacaaagagggacattatataatgataaaaggattagtccaacaggaaaatatcacagttctaaatatatatgcacctaacactggtgctcccaaatttataaaacaattactactatacctaagaaatgagatagatggcaacacaataatagtggaggactttaacactccactgacagcactagacaagtcatcaagacagaaagtcaacaaagaaacaatggacttaaactatattctagaacaaatgaacttaacagatatttacagaaaattctatccaacaactgcagaatacacattctattcatcagcacatggaacattctccaacatagaccatacgataggccacaaaataagtctcaggaaatttaagaaaatcgaaattatatcaagtactctctcagaccacagtgaaataaaattggaaatcaactccaaaaggatccttcaaaaccaggcaaatacatggaaattaaataatctgctcctgaatgatcaaacaaaaagctgcctctttgaaaagataaataaaattgatagactgttagtgagattaaccaagaaaagaagagagaagatccaaataaactctattagaaatgaagcgggagatattacaactgatatcacagaaatacaaaagattattgaaggctactatgaacaccttcacatgcataaactagaaaacctagaggagatggataaattcctggaaatatacaactctcctagattaaaccagtaagatatagaactggaacaagatagggatgcccactttcactccttctattcaacatagtactggaagtcctagccagagcattcagaaaagagaaagaaataaagcgtgtccaaattgataaaaaagaagtcaaactgtctctgtttgctgacgttacgattgtatacctaaaaagccctaaagattcatccaaaaatcttctggaactggtaaatgaattcaccaaagtttccagatacaaaattaaagtacacaaatcggtagctctgctgcctaccaacagtgaccaagctgaaaatcaaatcaagaactccacccctttcacaatatctgcaaaaacaaacaaacaaacacttaggaatatatctaatcaaggatgtgaaagacctctacaaggaaaactatgaaacactgctgaaagaaatcatagatgacacaaacaaatagaaacacatcccatgctcatggttggggagaatcaatattgtgaaaatgaccacactgccaaaagcaatctacaaagtcagtgcaattcccatcaagatagcaccatcattcttctcagaactagcaaaaacaatcctaaaatttacatggaaccaaaaaagagcccacacagccaaagcaagactaagcaaaaagaacacactgggaggcatcacgttacctgacttcacctttttctctgaggccatagtcaccaaagcaacatggtactgttacaaaaataggcacatagaccaatggaacagaatagagaacccagaaataaagccaaaaacttgcagtcaactgatcctcaacaaagcaaacaaaaatatgcagtgtggaaaggacatcctattcaacaaatggtgctgggatcattgaaaagcccagtgtagaagaatgaaactggatcctcatctctcaccttaaaaaaaatcaactcaagatatatcaaagactaaatataagacctgaaaccataaagataatggaaaataacattggaacaacacttccagacattggcttaggcaaagatttcatgaccaagaacacaaagcaaacacaacaaaaacaaagataaatacatgggacttaattaaactaaaaagcttctgcacagccaaagaaataatcatgagagtttacagacaacccacagagtgggaaaagatcttcacaatctatttatccaacgaatgactgatatcgagaatctacaaggaactcaaacaaatcagcaagaaaaaaacaaacaatcccattaaaaagtgggctaaggacatgaatagacaattctcaaagaagatatacaaatggcaagcaagcacaaatgggaaaatgcttaacattgccaattatcagaaaaatgtaaatcaaaaccacaatgcaatacgacctccctcctgcaagaattgccataatcaaaaactcaaaaaataatagacattggcatggatgtggtgaaaagggaacagttttacactgttggtgggaatgtaaactagtacaatcactatggaaaacagtgttggagattccttaaaggactaaaagtagatctaccgtttgatccagcaatcccactacttggtgtctacccagaggaaaagaagttattatactaaaaaaaaaaaaagaaaaaaaagaaaaaaatttcatgtgtgtccgtgtgaagagaccaccaaacagactttgtgtgagcaacatggctgtttatttcacatgggtgaaataaacccatgcaccttcacgtgggtgcaggcgggctgagtctgaaaagagagtcagtgaagggagataggggtggggctgttttataggatttgggaaggtgatggaaaattacagtcaaagggggttgttctctggtgggcatgggtggatctcacaaagtacattctcaagggtggggagaattacaaagaaccttcttaagggtgggggagactacaaagtaccttcttaagggtgggggagattacaaagtacattgatcagttaggatggggcaggaacaaatcacaatggtggaatgtcatcagttaaggctgtttttacttcttttgtggatcttcagttacttcaggccatctggatgtatacgtgcaagttacaggggatgcgatggcctggcctgggctcagaggcctgacattcctgccttcttatattaataagacaaataaaacaaaatagtgttgaagtgttggggtggtgaaaatttttgggggtggtatggagagagaacgggcgatgtttctcagggctgcttcaagcgggattaggggcagtgtgggaacctagagtgggagagactaagctgaagggaggtcttgtggtgaggggtgatattgtgcggatgttagaagaaacatttgtcgtatagaatgattggtgatggcctggatatggttttggatgaattgagaagctaaacggaagatacaaggtccgaattaaaaggaggagaaaaatgggtattaaaggactaagaattgggaggacccaggacatccaattagagagtgcccaagggggttcagcataattacttgcttggttggcaagtttttgggctctatccttgagtttttttatgttgtcatacaccaggccagattgatttaggtaaaaacaacactcctcatttaagaatatgcagagtcctcctttttcagcagtaagtcagtcaaggcctcggcggttttggaggacaactgcagctaaagagtcaacttgggcctggaggactgataaagtttgtgattttgaaggcctctaaaagtattaaagcagcagcagccgctgcacgcagacatgagggctaggctaaaacagtaaggtcaagttgtttggacagaaaggctacagggtgtggtcctggctcttgtgtaagaattccgaccatgctaaccatgcctaggaaggaaaggagttgttgttttgtagaaggtgctggggtttgagagatcagtcggacacgattggcagggaaagcacgtgtgtttttatgagaattatgctgagataggtaacagatgaggaagaaatttgggcttgattgaagtaatgggggctgtctgtgaagctttgcagcagtacagccttggtaatttgctgagcctaatgggtgtcagggtcagtctaagtgaaagcaaagagaggctgggacgaggggtgcaggggaatagtgaaaaaagcatctttaagatggagaacagaatagtgagttgtggaggaatggattgaggacaaaagagtgtaggggttgggcaccacagggtggatggcaaaacaatttggttgataaggcgcagatcctgaactaatctgtaagacttgtccggtttttggacaggtaaaatgggggaattgtaaggagagtttataggttttagaagcccatgctgtagcaggcaagtgataacaggctttaatcctttgaaagcgtgctgtgggatgggatatgggcgttgagcggggtaagggtgattagattttaacgggatggtaatgggcatgtgatcagttgccagggaaggagtagagatgtcccatacttgtgggttaaggtggggggatatgagaggaagacgcgaaggaggctttgggttggggagaagggcggcaatgagacacagctgtaatccaggaatagtcagggaagcagataatttggttaaaatatctcggcctaataagggaactgggcaggtggggataactaaaaaagagtccataaaagagtgctgtccaagttggtaccagagtgggggagttttcaggggttttgaagcctggccgtcaatacccacaacagttatggaggcaagggaaacaggcccttgaaaagaaggtaatgtggagtgggtagcctccgtattgattaagaaggggacggacttaccttccactgtgagagttacccaaagctcggcgtccgtgatggtctacggggcttccaaggcaatcaggcagcgtcagtcttcagctgctaagccgagaagatctgggaaggagtcagtcagagagccttgggccagagttccaggggctctgggagtggctgccaggtgagttgaacagtccgattttcagtgggttcctgcacagatgggacgcggcttacgaggaatcctgagctgcgggcattccttggcctggtggccagatttctggcacttgtagcaagctcctggggaaggaggttctgggggaacgcctggctgctgcggttcaggtgtttggaagttcttgtgtgctggagatgtggctggggtttgtgtcacagtggaggcaaggaattgcaacttttttctattattgtacaccttgaagacgaggttaattaaatcctgttgtggggtttgagggccggaatttaatttttggagttttatttaatgtcgggagcagattgcgtaataaaatgtattttgagaataagacggccttttgaccttttagggtctagggctgtaaagtggctcagggttgctgccgagcgagccatgaactgggctggatttttatatttgatgaaaaagagcctaaacgctatctgatttgggataaagaaaaagaagcattaaccttgactatgcctttggctccagccaccttttaaagagtaaattgctcggcaggtggggaagagctagtcacagaacgaaactgtaagccagaccgggtgtgaggaggggaggctgaggaagtattgggacttagctgggtctggcaatgagcagcttggggaggacgggaaaggtcagatgggtctgtagaaaaggaagactgggaagactcagcgatgcttggggttgggaccaaggggacaggcgggagggaaagaaggaggatctgggaggaatcgcattgggaacagaggctagggagggaacgaagtgtgaaaaatgcctggacgtaaggcacctcagaccatttgcccatttttcgacaaaaattatttaggtcttgtaggatggagaaatcgaacgtgccgttttctggccatttagagccattgtcaagtttgtactggggccaagcggtgttgcagaagaaaataaggtgtttaggttttaggtcaggtgtgtgttgaagaggttttaagttcttgagcacacaggctaagggagaagaaggaggaatggagggtggaaggtggcccatagtgaaggaagcaaacccagagaaaagagagcgtagagacacggagggaaggggtttgggggttcttgcctcctagaaaagtgggacttgccgctgagggtgaaggagaaggggttgaggggtacttggccctgccccaggaaagcgggacttgccgctgagggtgaaggagaaggggttgaggggtacttggccctgccccaggaaagcgggacttgccgctgagggtgaaggagaaggggttgaggggtacttggccctgccccaggaaagtggagaagaggtagagaggtaggaacaaagagcaggaggacgggggattgatctcccaagggatgtcccccgatccgagtcacagcaccaaatttcatgcgtgtctgtgtgaagagaccgccaaacaggctttgtgtgagcaataaagctgtttatttcacctgggtgcaggtgggctgagtccgaaaagagagtcagcgaagggagataggggtggggctgttttataggatttgggaaggtgatggaaaattacagtcaaagggggttgttctctggtgggcaggggtggatctcacaaagtacattctcaagggtggggagaattacaaagaaccttcttaagggtgggggagactacaaagtaccttcttaagggtgggggagattacaaagtacattgatcagttaggatggggcaggaacaaatcacaatggtggaatgtcatcagttaaggctgtttttacttcttttgtggatcttcagttacttcaggccatctggatgtatacgtgcaagttacaggggatgcgatggcctggtctgggctcagaggcctgacaaaaaatctttgcacacacgtgtttatattagcacaatttgcaatagcaaaatatggaaaccaacccaaatgcccatcaatcaacaagtagggtaaagaaaatgtgatatatatatatatatatatatatatatatatatatatacacacacacatatatatataacatatatatatatatatacacacacatatatatataacatatatatatatatatatatatatatatatatatatatatagcatggaatactactcagccataaaaaggaatgaaataatggcattcacagcaacctagatggaattggagactattattgtaagtgaagtaactcaggaatggaaaatcaaacatcatacgttcttattcatatgtgggagctaagctatgtgtacacaaagcataagaatgatacaatggattttggggattgggggaaagggtgggggttggtgagggataaaagattacatattgggtacagtgtacgtggctcaggtgacgggtacgccaaaatctcagaaatcaccactaaaaagcttattcatgtaaccaaacaccacctgtttcccaaaaacctattgaaataaaaaaaggaatataaataaataaataacattattggaacaataagaaagccaaaaacaaacaaataaacagcaaatacaaataataaagagttttgatggaaatccattgaaatgttaattatgttttaaagcaggagtgtccaatcttttggcttccctgggctacagtggaagaagaattgtcttgggccacatataaaatacacaaatttttagctgatgagctaaaaaaaaaattgcaaaaaaatctcataacgttttaagaaaatgtatgaatttttgttgggccacattcaaagccatcctgggttgcatgcagcctgagggctgtaggttggacaagcttgttttaaggtattaatttatgctcttcttttccctagaagtataatatatacagaaaagtacaaaaaacatgagcagatagatcaatgaagtattgttaagccagatccaggaatagatatttccaacacccccagaaggtccgcccattatatccccttctagttatgacatcctccttctgcctcaaagatgagccatatcttgacttgtgaatttgtaattattattgctttttaattttatatgaataaaatcatgcaatatataatatattgcttcaagtctggcttattagccaactatgtttctgagatccttttatattgttgtaggtagctgtagttcatttttctgatcacatataatattttattgtatgaatataatgcagtttatgtggaacttttactgttattggaaaattgtattatttctaagtgcattcttctatgattattcttgcacatatcttttgggagatctgtgtaaatatttctctgttgtatataccagaaatcagaattatcgggaaattgggcatgcatatgacaattttaaaagataacaccaaattgttgtctatagtgattttattaatttgtactctttccagtaatgtttttttctatattcttgacaatatttgatatgatcagtctttttaaaaattttagccttttgcagggggatagtaaaaagtatctcattttggtttagcttctgtttcctgatcactaatgaaattgggcactttttaaaattattattggctatttggaaacctccctccctccccttggtttctaggaataacttaattcatttttccatattttaattgtgttgtctttgttttcattagtgattgattctagagaagagcacaatgttgcttttttgtgtaggaaaccgcttctactgtgtcgcttgccttttcactctcttaatcatgtcttttgataaacagaaaaatttaaatttaacatagttcaatctattggtctttttctttttgagatgttttttgtaaaaagtttaagaactgttttccttccttgcgatcatattttcctgttatcttctatagtgtattttgtccttcgtatttaaattataatgcacctgcattttatttatttattcatttattttcatggtgtaaaattggttcaatatacaatttttttctatagggatccaattgagccagaacatatatgaaagatgcagtcctttctttgctgttctacagtgccattcctaaagggaattaaatctgcatgcctgcttgagcctgctattgacctcttttttctctcttcctttgttgtatttgtaaatgccatattctagtaattactgcagtcttacaataagtcttaatatctgatagctattaaaatagactatatggtttaaaaaaaaaagaggcttgaattgtaagtgaaaccaaaggagaataaaatccaaagagaaccagaggagaataaaaattcatgccatgagatccaatccattatgaaaattgagctttaaaaagctttagaattagtgaccaaggcaaagagcggtacatatctttcattggataaaaatataacaactgtttctgtgagtataatcaccctgagtataaaaagcccgagggaagcttctcctgtgaacctgcatcaagagcagtgggtgattccgtggattatagtcccctcacagacatgcaatgctggcttttttatggtagcttcctatagcatatctcaaaaataatagctaccatgtattaggtatctattaagccttttacataacatttgttaaaaaaaaaattcccaaactatgtgcctggtttgctaccactatagccaatgtcactgggcatctcactattctctgactgtagctgttacaagagcatcaatagattctctaaaatgcagacaatagaaaggagttgctaaatttgtcaaattttaagtgaatctactgcttattttgttggtatgttgggtggctcttcttggtggaaggctcacaacctgtaactgactccagagcttctgcttaccaatttcagaaaactaggtttcgagtatttcctttgagcattccttcatgtgcttttatgaggctaactctccttccctatttccaagatggatactttgggaaggtaacatattctagttctcaaattgatgtaagtacatttatgttactttcttctctatttttgtagcagtgagggaataatgggaatttatacaaataaaccacatgagtatttcaagttctgtgatgttgatcacattctctgtgatgtatgctttagttgtatcttcctcaaagtaagtaccaaccttcctacagttatttctaattaaacaggataatctagtttaatcctcaaaactaccatgtaaaatagaagctactattataatttcaattttatatataaggaaaattaagttcagagaagtgaagtaatgtgcccaaggacatcaagaaatagtgaagttgggcctgtaatctcagcactttaggaggccaaggtgggtggattgcgtgagttcaggagtttgagactaggttggccaacatggtgaaactctgtctccactaaaaatacaaaaattagccaggtgtggtggtgggcgcctgtaatcccagctacttgggaggctgatgcaggaggatcgcttgaacccgagaggcggaggttgcagtgagctgagatcgtgccattgcactccagcctgggcgacatgagtgaaactccattgcactccagcctggacaacaagagagaaactccatctcaaaaaaaaaagaataaataaatagtgaagctaggatttgatgccagacattctgacatcttaaccgcttccttaatcattcaactaatgcttgtcaaatttaatgtgcacaggaatcacttggagatcttattaaatgcaaattctgattcagtaggtctaaagtgaggcccaagattctacatgtttaacaagatcacaggtaacactgatggtgctgccctggacagatatcagacggtgggtagcaaacagtctcaaaatgaaccttaggttaatgtctaaagacaatcaaatagcattaccataggggtcaacacaaggtgatagaaggaatagctctattatgatgtaaagaaatcttagggaaaaacaaatggtaattggtatttcccaccactaagatggtcattcaactatccatttatgcatccaaacaatgcatatttattaagcacctaccatatgtgtcaaacataagtgcaagcagtaagtaaaataaggtctattttctgtatttatacatctgccaaagtataaatgcagactcactttttaaaaaaggaattatatgaatgccattggaataaagcaccaggaaaaaaatgtgcttgagcattaaccaaagtaataggttttcaaactgtatttccttgccagaaatactatcctcctaggcagtgtttctactcatgacagaaaatgcaaataaggaagagtctccatctatagacgtgatttaacaagtcaattgcaggtgtttttcctcctttttgagaattgtgcggttgagagatctactttcacatacatattaatgagttgttttgcataaatcaattctatttttatgaatggagattatataaccctcctgtaattcttccagaaatcccatccaaacaagctactagagttcttagtagggtatgtcccttgagcacaaaggattttattttaattatttcatccatttttaagcaaaagtaatcaaatataaacaactgtgctggaggctgcaccctctgccagctgcctctcagccttctgaaaggctctgtttttgtgttgtttctgttttgtttttttgttgttttttgttttttgtttttgtacttttctcagtactcatttagaaagcaatcctattgtttttatttaaaaaggtgtaaaatgtagctgattcaaactttaaaatttatgatattcctctttggcaagtctagctgactatgggccctgaatattattattgctataaatattaaaattaataaaagcttatatgtgtccagtaagccaaaatatgggaaaacatttcctgagcttgcttaaattttcacagcaagtgaatggcagagccaggactttaaacctcggtctaatggacaacagaaatcaggcttcaaacacaacactggcatttcaaagcatgtcccaggtggcagatgtcctaaagaagcatctcacttctacctgtggttccagttagctcactctatcctccaccttctttccatagttaacaggggaaaatgtcagagtctgtgatgcactggataaaattgtcctcccctgagctccacgttttcacagctggagtgaagaaggtgtcttggcaagattcccacaaacacacactcaaaacacacatcctcactcccatatttgccttgacatcaccatctctgcttttacgaggtcttgactcctgtgtacataaggcagcaagcctggaattcttaggtcacccctcattgcccaaaccttcatctacatagagctctgaatgttcccgtatctgaacccacttcccaatcctccgcagcttgtgaaattcttccttgggcctcctaaaaccaaaatcaataattagcaaaatctttgcacacttaaagttttccctgaaagtccccctgactgtgttgcttcaactgacatttggcttccatctgaagatgcttctcctctctggctgaactgctgattcttttctccaatacccctcttaccacaggtctgtcagtagggatagagtcgtcccatctcctccgtgccatttccagatgatccctcctccctcatatctaattcctttgccattaaaatcatgccattagcccgcactactcataacttctctttgttgcaatcatattctcatcccctaaactccaacatttcttgaagattttacctattagctcactgtcattctctgcataatactcctgtcgaatatcttggccatttcagcctttggtgaatttggtattcagtactcaatatcctgatttgccagtttcttgacttctttcgttctgttgcccttgtttatcgacccatcttagccaatagccacgctgctaagatgactcttttaagactttgtcaatgtctaaagttgccagttccacccataatctgattttcaaccttcccaaatttgactgtctgactcactctctccagtccatggactccagcaatactttgactctgctagatcctataattcacgaatcctaacaactactcctgtccttctcctgcttcgtcttgtcattccctctatactgagacaaaggcaaaaaacacttcttctcattaacttttaactcacttgctcatcacttgcacatcaatgattcactttcactttcccccttatttcattcatctggtgaaatctaagccatgatgaaatccaaaccaaaattttaatctagtgaaaaatccaactatgacacctgctttcactttccaattaatgaccaccgacatcagtggtccattcagtgggccattaatgttgcctgacattaagtcaccatgaagctcaaagatgttactgtattgccggcatcttcagtctagaaaggccctctgtaggtggaaaaaagtatgagctagtatttttctcctataaaagtcaactaaatcatcctcacatacctcaaacaacattttcctgaccctttaatataatttatgttataaactgcttgatacttagttctgattcaggtctgactcattgcctagtccctgagccaggatggactttggctgtacttgagatgtcaaggtaatctggcactctgactaactagatgtgtttcagttgcttacctctagagttatttccccaaaataattccaatgaaacgttaaaacacacaacaaaggcagcctctttctttttccaatcccatctatcacataccattggatttctgttttgctacaaagtcctgaaggttttggccttttatttttatctcacaacctaggcccacttcttaaacattgcctagcttgcctttcccttttaaaatctgccaacaatcactttctctgttgaaattatctcttcctacatccaactgtgggaagaacagccttttcattgtgctgttctctgaggacaagaatagaagcacattttttaattcttatttttgtgtgacttttttctgcttagtagttaccagtttttactacaattgtgattcctgacaatatataacatttagaaaataaggaaaagctattaataatatcacctgagccagagacaaccactgttaacattagtagattcttctaaaattttttcttatacaaatcataaacacagatggatgaatatttgttaattgtggataactatttcactttacggaaataatacaacaaacactttaaaacattttccctactagtcattttagaggatattttaacaaaaataataaaatacggagaacaattaagatttcagaattttcaaagtttgcatattcatgatctgttttttaaaattcaggtctcctgactaagatgcttattttactgcagagaaataagcttttgtggataccacactcaaggggaaagacaggcttattctcgaagcaaatagagggtccttcctgccaatatgacctagagaaacagacaaatagtgagaagatgcatctccgagaaccttcaggctgggccactgtaaatccggttggatttgactcaacccagggcataagtaatgttctcagggcatttccttaacgaagactccctattgaaagaaggtatagcatgaacaatgtcgggaagtcagaatgcttaatttctgcattttcttcctctgaactgctaagattgtatttagagacaggtagagtcctatgtgcgtgttctaatctagttaatttacttcaatcatcctcttttattttgccagcaggcaaagccccttcagaatacctaattattattccagactcctgtcttagttttcatcagaggacttgtatatttcattagcttcagtccttgtaccacctctccttaccaagcccagcattgtgacaccatgtcctttacccttgtgtttttgaaagcaaaagaagaaacgcatacatttttattattcattcttttatctcactagtcttgttctgcgaaaatttgagatctcaatagatagtgaaacagtctttcacccttttccatggaataaatagttattggtgtttatatactctataattattatatgttgataaatggttatgtaatagctgcatacagggaggaaaagtccttgcaggtaattttgtctgctaattacatataaattggttaagcagtcatgcgtattgatgacatcgttttcaactgatttgacttctcaaaattactaaacttctacctggtcatctaaggcaggacaatttttccccaggatgaggggttggagggcagtggtttcagcaggtattagattctcataaggagtgcacaacctagatccctcgtatgcgcagttcacaatagggttcacactcctataaggatctaacaccgctgttgatctgacaggaggcagaattcaggcggtaacactctctcacctgccactcacctcacctcctgctgtgcagtcagatttctaactgtctatggcccagcactgcagcccagtggttggggactgctgatctaaggaataatctcagtctttgtctctctttatccaaaacaaccataagtctattatataaaaataatgtatgtatgtatacattttgcatgtgcttacatgtctctgcgcacacacataaatttatataaatgggattgttctagtaaccgacatttttctttaaaatttttaagttataaaaaatttcaaacatacagaaatgtctataaaaatattataaacagatttttatttaaatgtgtgttaatgtttttgcatttttgcttcagatcttttttaaagacataaaatataccaatactgccaattttcatctcgtgctttctttccctcccttcccagaagtaaccgctttcctgaagttggtgataattttttgaagtatggcttgaaatttttattgtctttgtttataatatttatataaatgtcatcagagtacaatttctttggcacctttttcactctacattcagtttttgaaattcagccatatttctacgtgtttacttattttaaatgttgtgtagtatttcattggattaatgaaagaagtttacttcgtttcaacgaaggaatgagaataaaatttaatcctgttttttcaggaacaatacactataaaggtatttttatttatatccatcaatttcacttatttttattgagctattatcatgtgtcagactctatcatgtgtggaagttacagtgctgataaaacaaacacatccttgcctgccatgagtctacgaaagcagtaggagagggatcacataaatatgtacagcataaaaaatgtaataaatagtctgaggagactctgagagactaaaatgaaaaagttatttattggaggctcaagaaagcaggattcaagatggatgaaatttccaatgaaggaaaattaaggttcatcaaaattagttatctgttagagttttttgtatctaatgccacagtaatgtgctgaaacaaagcatgaaaaaaacccatgatgtccagcagtaaacatttatttttggtcacgaatttttggtttactcggtggttcctctggtcttcttggggttcagttttacattggtggtcacatatgcagttacgttaatcttgctgggctaattcattacgtattgttggcccaggctggggcaactgcagtgatttatttcttctgcacatggcctctcatgctccagcctgctactccaggcttttaccatggtagctgggtggggatccaagagcaaggggatagaaggctacacagctacttgaggcatatgctcagaaccaatatattgtcacttctgctgcattttgtttgcaaagtcagaccagattgaggaatggtgaaagagactatgcctctgatggaagatgctgcaaagtcattgcaatagggtacaggaaggtgaaaaattaggactaagttgtaatcactctcccatggtgatatgaggaatggggtaagaatattccatagacggaaacaccacgtttaaagcctatgaaattggaaggggctacgtaagacatttgaaaatggaaaaaaaaaaagaaagaaagaaagaaagaaaggaattgtggagcctattgaggaaaaaagggaatggtgtcagtaaaagctggagaaattggcagggaccatattatgctggcattattgctaacactcaggattttgaattgtatcctaggaacagtagagctccatacaattttaagaaatgtattatttaattgatgacgttacctaatttattacatgatttaatcgattatatataatctaagtttaaaattatttttattatttcttagagtcaaggtctcactctattgcccagcttgagtgcagtggcaccatcacaacctactgcagcttcaaactcctgggctcaagcaatcgttttgcttcagcctcctgagtagtagctgggtccacaagcttgcaccaccatgactggctaattttttattttattttattttagttttagttttattgttttttgagacagagtctcgctctgtcatccaggcttgagtacagtggagagatcaagactaaccacaatggggatccacctaagctcaagaaatccactcagctcagtctcccaagcagctgggaatacaggcgtgtgccaccatatccggctaatttttaagatttttttgtagagacaaggtctccctatgttgcccacgctagttttgaactcctgggttcaaatgatccttctgtcgtggtctcctaaagtgctgcgattacaggcatgagccaccaagcctattatagaatgtaatttttaattaaagttatttgctttatctgtattaaaatatcttaagaattataattttctaagttatgaaataatctgggagcctattgagtcattaagatgttagacgtgaaagtgtgggtgagaggtagcaatggagactaagaaaactgagatatgattgagaaattttggatgttaaaccaataatatttgctatgaggtgggatgtgggttttgagaaagaggatagtatcaaatatcgccaaatggataattgatatttattatttactttgatgaggaagacttgaagaactactttgaataaagaattaagagttcaatttcagagatgtcctgaggttggatataagggtctggattgccaacagaaagtctgtgctaaccatatgaatttgagaattatctacatataaatgttacttgaagccttgggagtagttgaagtcaccaggagtaaatttttcaatcaagaagaaaagaagacaaaaaataaatcccaaataattccaattattagacatcagggaatataaatagatatgttcatggttttaaatggctacatatcatctgattatatgtctttaccataattattctaaataaatgtctcttattggactttgttaggcttcattagacagtaataaaataactatctattatatacttctttactcatttgccaattatatccgaacagtagatactgggaagttgaattgctgggaaaagtaggttatacattttaaatgtgaatgcatcttgattaacaacctttgaaaaatggttatgccaaatgatactttcaacagcaccacccgaatatgctattacatcaatccctcttgatattatgtattgcttaatatgtacccttagcaatctgatgggtgacaaattcttgttgttttcatttggatgtctaggtttatttgtaaaatcaaacttttcttatctgtttattggcaatttaaaattattttgtaaatttcctaaattgggtctttgcctagttttctgttgaaggattcaaattcatttccaggaattattttaaatatgttaatatttttcttttacaaattatgtgaaatgttcctatttttattttaacttggctagttgtgtttttatgatacagaaattttagcaaagaaattgttttgtaattcaatttctctctcattttctttataatgctttttgtggcacatgcagaaacattatttaagccctatgattgtaaaaactatttttggtcagcactcttataatttcattaattccttcgaggccttcgattcaccttgaattttttgtaatgagcctgaggtaaacacccaaccttgcttccccacccctgccctatgaaatttccccaattccatttaataagtagttcagtgttgacagagcccattttctacttcaaatccaagaggttttctgctgtggaggcagtacaatatagtagttaagagtaaagttcccaattactctaaataattttcccttcacacccctcccggcagggtagaacactagctggtgagagcgagctattctacaaagctcaaagctacaccgaagggtcatatttctcctctagagaaagcccatttaacaacaaaagacaaacttttaaaatggcagcactgcctagatactaatggtttctgatgccttattcttcctgtaaataggtcagatataaaggtttagaagtcagcattaagaccaaatgcagcatctaaactagagaaagtgagtgaggaactgccttgaagtccattctatcaatttcattttaacctgatttatttggctatatgtttgccccctctgcatttcctatatcagctccatcacaaatcagtcccctccaagttgtattggaaaagcaatatatgtgattgagatattgttaacaacaaagccaattctggtcccagagctgttagattgtgattgataaaacttaatattttgaagggaggaagaaaaaaaacctattattccagttcttttatttgtagtgtgggtgaagttccttttatctcctctactttcattgtagcagtatgactgaaattccaataaattattgaatgcaatatccagatgtccagatgattttttggtgctgctgctacttcttagtgagcaagacaaaagatagttgaggttctgcaaaaagtgtcaaagcttagcaataaaataagatttcattgaacagaaactaatggaatcactcaatttatttccctttcactgttgtaatgcagggaaatcttgcttcatacgagtcacaaagcttgagtgtgcagtggcctggctctggcattgcatggtttgtgtgtgagggattggaatacctttaataaaaaagcgtggggtgaagcagcttagtctttcaaataaaagaagtttcagtgtctgggcatcatggctgtttaaaagtcaactttttcaactttttctcctcgtgtcacctttttaatattcttggggtccctgaagacctatatctccagttcatcttggcatacttaggttcaggttttatctgctccatggggacagctacctttttcttagagtgcttccattttcttttctcagatgcactttgtagctgtgtcatagattagccaagcatgcctgattgagatattaatctgaaggagtgttggttaagagacagaccagtggtcagcaaaccttttctgtaaagagccagatagtaaatatgtttgattttccggccaatgtctctgctgttattgggtgaaagcagccacccataaacccattaatgtggctgtgttccaataaaactttattcacaaaacagacagtgagtaggatttagctcatgggttgcagtctgcagagcactggagttcactcagaatactttatagatgtgtcctaccaatgatgactgttaacatttattaagcatttgctaaaaattctccttagataatctcatttctcatattatttactaaaactaaagtgtgggtactatttataaccatgtttatagataaataactgaagaagacagaacaagtaatttactagtacatggtagaagggcatttgaactcaggctcactctagggcccaagcttctaaccactctgccataatgcttttctcattaattaatagaaatgcaaatgctgtgaaaatccattttgttaagatatttttgtctaagtaagttttttttgtttttaattaatgacgtgtcacatatgtttcagcttactattcacaggacactagattactattattatttaaatgtaattatttaatttctattttgggaagattaaccatgaatttactggcagtggaaaaacacaaaggactaaatacaagatgcataaagtcagcatgaagagatgaaaacagacagggatgtgaacttacatgagttgagtctttaaattctggctctgtcctttacaatgtatgactttgcatgttacattctgagccttaattttctcattcatgaaactagaaaaacactagctctatatctacatcaaaattattttgagaatctattaaattacctaatgtagacatgcttgtatagatgtatccatgtataataatatttgcagtatactatatgtaattatatacatacacacacatacatacaaacacacaatagtatatattagtcatttttatttagaggaataaagaaattctgtgtttaaatgatatgttaaaactgctttgaatttggatcaaaatttagagtagattttcacaggttctgaggcataaagagttcttaagggtcatgtaggccatgcctctgtcttcaggaagagatatccttaagccaatgcagatgagatcctgtctatttcttttagagaaacaatttagtgaaagtgcctataaaccatttgctgatagaaagacaacctcttgaatacaaattgactccctgattgcaagtgactttgtgatgacaagcaagagaacttttcacaaacacagaatatcaaaaacattttttgtttgtttgttttcgggagtcaattgcctgtgtgcctgtggcttccggatgggggttccgattcaaaacatccagaggctccatcagtacttactatgcaacataacacctcttagtgtctagaggtgagtcttaatattttataccattaactgtgtagtcccaaagatagattcagggcagatgtttgatgtttggtttgctgagtaccatagcgagtttctctgcctatctttgacatttttgtagcagtaaccacatcacccttcttaatcactggtgctttagataataattccctcaaataaaacaaaaactgaggtgattttataacacattatgatatggtttggctgtgtccctgcccaaatctcatcttgaattgcagttctcataatctccacctgttgggggagggatcctgtgggaggtaattgaatcatgggggcggttaccctcatgctgttctcttgataatgagttctcacgagatctgataatttaaaggggcttttctccttttgcttggtacctctacctgatgccgccgtgtaaagaaggacgtgtatgcttccccttctgccatgactgtaagtttcctgaggcctccccagacatgctgaactgtgagccaattaaacctctttcctttataaattacccagtgtcaggtatgtctgtattagcagtgtgtgaacaaagtaatacacattatattctctcctttttgaagaaaaaattaagaaactggctgttcaaacttaatgtgaagtatcagagaactctatgtgcgatggggaaaaaaaaattagagaaacattggtttgccaccagtggaaactaaccagtcttgtctgtttagttcattgttgcattttcagctgctagagcagtacggggcacattttagttacttaataaatttggcagatgagacttcctttaaatgtctacagcacaatctctttggctttctgtgaaagcagatctcatggcgaagacatggactatgtagtgtatttaggtggtattctcagaagtatggtgaaggagtaggtaaatagatagcaaaaggagaaaacccaaaaactgatgaagaataaggtaattaattggttgtcattgtgggcaattgtggctcagtacagctgagtgccccctacagctatcaagcacatctcattattagcccagcataggccaaggaaactgggacatttactcattaccttctgtacctcattggttaaggatcagtcctcaggacttcaatttctggtaacctggcctgctttctatgtagacaagtatgtgtctgtggaataaaaaataatttctcagagcattctcaggcagagcaacccaaatggaggcagcaaaccctctaacgtaactgtcccccaatgtgacaggtaacttcctaaatgggttgaacagatatatgggatatggggcacctacagtggctgctacaatcatactttaaaagaactataacacttttggtttcccatgtgacagtcataatgtgagaaaattcaagaaattagcttgatatttacattttatcacataattttaatttaaaaggtcacatgtaataagacaagaggaggtgtaaaagttcagagatagcagttccggaatttcacattttttcccgtatacttggccctagtatttctatgagtaaataggttagtttttagttgttcttggtaaattactggatatgcgactggactgcacttatgctatccttcaaataaatgaaaaacccaattgagacaactggacagtgatctcctggattaattattatactgaagatgataattacagtttctgcctgtcttataaataagcagtcctcagttgccaaatgggcaacctcttttctgcagttacagatgtgcggcattaaacatctcaaaaatccgaagtaagagtcacaagaggacttcatggtaggctcaggggcagagaagcttatgcagtgttgtggctaggataagccaaagcaatatgcagtctgagatgttatgggggcatgaactataagtaaaaacaaggagactgatcagctgggaagacagtggagcagatattcatgcaaagcagagttaacagagactgggacacctgtagataaaggaacctagagagggaggaagagaataattggcaggtgtggcaagtgtccttcctgttcccagatatgcctcctgcactttgttggtctaagatttctcttgatcctttttaactccacccccgctttagtttatactactttaagtgaatttcatttcctggcatgtaaagagacctggcgcaaacaatgaacacacaataatcattgtagcagaaattgaaatgaactagaaaatcaaccagttggtcgtttaggccttatggcattgtgctaaagactataggtcatactttttgggatttgaatctttgttctattaattagtaaccagttcagtgaccttttggcaagttttttgaacatttctgggatttagcatttcatgtgtaaaatatatgtaataataataaatatttactgtacaatatgcttgtatagtacccacatatatagtataaattttatgaagattaaatgtaaatataaataaatccaagaagataattggtataataaaaagaaaaataactaaaaaataaataaatgtaataattaaatctacatatcgtttaaatcaactccaagtctttgtaagagttataagttatttagggccatttgacatgtagtttttaaacaagttacttatttcatttaagtctcacaacagtcaaataatatacctattttcagaacattttatagatccattcacccattcctcttttcagcaaatgttcttgagtgccctttgtgtattagacactgagcatattcagagaaattgaaaaaaaatgaaaagtaccattttaaatgtctcacagcttataaatccaagcacttcattcaagcacagatttatctgactccaaagcccaaacattttccttcaactatgtgaacactctttttatgtgaaataagcaagctttccatctgtttgagggtttttctgtctcccctgggccccagtctcttataacctaattttggaagtgacaagccataatttgaccagactcagttggttgtgcagactaatgctgacacaatgcggcaatacacaaagtggtggatattggaagcgagttcattcggggccgttttgcagcctagctaccacatgtttccaggtcgatcctagcctcttctctaagaaacctttaatcagacaaatttggtcttttgctctcttcaattcctaaaggaaatattgtagactatgtttgtagtattttgtatgcattcactcgctttagaggtataattatttcttaatttattaaacatgttcttgttgaatacctgctttttgcaaacactgaactcgcgggaaaacaaggtccctgttttcgtgaagcttatggtctatttagagcacactgaaataaagtaaatcaataatcattgctgacagtgactgggcctttggggaaaaatacagagtgatagggaactgctacgttagattggttagccaagggagggttcactatgtggtagtagcaagtaggctgagatctaaatgtcaaaaagaatctagaatgcaaagatctgggggtaagttttcaagcagaagaaacaagaagaccaagggccatcgggggaagaaactcattatgttccgaaaaacaggaaaataaaatggcagctgtatttggaatgttctgaacacaggtgaaaggatggggtaaacagggccatatcatatggggctttaagtaatttagtaaactatttaaagtcatctttatttctctgggttgactgatcattaatcaaatattttttgagtacctactgtgggccagcacttactggtactgcaaaggtaaacctgtacacattttgtggaaaggcgctgatacaaacaaacggtggcagccaagtagggttattttttgaaaagattttataaatacatgagttagtgaacaaactctacatttaaattactgttatagcaaattataatgcaatgcaagcagttcacctctttgtaaacttattgaatcagccaacatgtcctgaaccacctgtctttgaggagcagccacatagagagaggttgagtggttgatgtcatttgggactaaaagttccagtttcagctttgactgtaacctataacttaaaccagcttcatctgtatttttaaaattatttttaaattttatttttaattaactaataataattgtatagatttatagggtaaaatgtggtattttgatgtatctttagattatggaatggttaaatcaagctaattaaatttgtcaccccacatacttgtcattttttgtggtaaaaacatttaaaatctactcttctagaaattttggagtatacaatacattattatttattatttttaccactctgtgcaatagatcactaaagctttttcttcctgtttcactgaaacttcgcactgtttgactaacatttccccatttcctatgcacccctctcccccagcctctggtaaccaccattctactctctacttacatgaatttaacttttttgattccttgtatgagtgagatcatttggtatttgtcattctgttgctggcttattttacttagcataatgtcctccaggttcatccatgttgccacaaatgaccgaatttcctttttttttttttttttttggctggatagggatagtattttattgtgtatatatgccacatttttgttatctattcacctgatgatggacacttaacttgcttccatgtcattgcattcaccagaatgcagatatctctttggcatactgatttcaatttctttggatatatacaagaagtgggattgctagatcatgtggtaattctatcattagttgtctcagctagcactctctgcctcttcacctctaaatgaaacctagtcactgttctctggaaaaatcagtgtccaggtaattccagtgtaacccaatgaacagacatttccatgactacttctggctccaacttttgctgaagtcccattctctgctctgggtcttacagttttccctccttctccatcctggttcttactcaagagtagaaatgttttcttaattctgtccctcacacaacacacttgataaacacatgtctatagatttttgtttgtaacaaaatgtttgtagacatttaggggaggagtattggcaaaagaaaacacaaattactataagcagaaaagactatttctaagagtccttcagcattctatatcttgattttctttttgtttctgttctctcccctccaccaaatccttcatcatggcaaatgcagtcagaccactttggttgtctcaaagatgtcttgtctcctgatatgccatgtcctctggagctcagatggcccgttttcctcaacaaggtttttcagctttagcctgaaacacaaaaaacctttgtgttttttgaaatatcaatgtactgtctgtactatgttttatttttcccaaattgctttgattttttaatgagtaaatttgtttgaaaaaacatatttattaccactgtatctagaaagccagtgtcattcatcacaaatagaacaaaactttaaaaggcaatacatagttatataaagttaaaggtgtttttttttttgcataacacctaagtgcgtcacccatacaaccagtgatatctctcccacacattggtaatgtctcttctgcttatctctcagggttactatcaacattaaaaatgatgacagaaatgaaaatgctttggaaaaaagtgagattttatttaatagtctctctttccctccctccctttatctaaaccataatgcatgcaagggtccttatcactgaacctaattctccttagtgctgagctggagaaagctacaaagaaaatgccgattgcagctgtgattccaaagaccttgcttggactaagaaaattcaacggaaaaatgtcagtatttaccatcaaccctgcagtcactctcccgaattccagttgtggaagttcttgcaaaccgaaaccagtaggataaaaatctctggtaaactcagagcttatgtccatgggaagtctttaaaaaaatgttcttgcttcacgcttcttgtataaacaggagcattaagacctttacccaggagctctgtcccattacctccaaaactcggccttttgtattttacataggttgcaaattttgcaatctaactttctgattaaaccatcacaatgaataaaagggcttattaagggctctgtctatgaaggaccatagcaggtataatggttcgcataaaccactctttccaagtgacctcgggcctcactccattgaaatcactctcctttactctaatgagagtcacacatgtgaatcaagagggagctataaatgcagttgttcttggaagggcacaggtgcacctaatttgccaccaaaaccaacaccttcagccccctttgctgatgacctggcccaggagtgaattacaagtgagcttctggccagactccctcagacctctgggaagccagtggtcagcctggcccttttttttttttttttttttttttggagacagagtctctctctgtaacctgcgacccccaggttcaagcaattcttctgcctcagcctcccaggtagctgggactacaggcacacactgccacgccccactaattttttggatagcctgaactttcttgttacctaccacctgctaagacttaagtacaaggtcaggatgtacttcccccagtgacagggcagactctgtttgcttgctcttggataaaaagaaactgtttgcagccctctttttcctctccttcctcactttttttccctctcccaccattgagcagggaaagtggtatcctgaatagctgaaaatgaatcagagctgggtagtagtccctattcaataaaaggcctccttttatttttttagttatgtggtcttgagcacattgcttaacctttctgagcactggtgtgtatatttatgaaatgggagtcatatggggtacctacaactcattttgtttataaagttcaggaattgggaaggtctcagtaattaagaggtccccggctcctgtaccaggaagcccctctcacggtacacctctatagctcttagctgttgccatcaaatatttaaccaaaatctaataaacacttgatattggagaaaaattggaatgctgatatccaagtaggaagtaagaaggtcttttaagagtttatagtgtcgaatccatttacggtccaagttaaaatttctctttgggaaagataaaataatatttataaaaattaacaagtggagagaaagtgagttgttttttggcgtcctgggaataatgaattcaacaagctgatctttggatgagtcactttagtgtctgcaatggcaatggaatatacacgtttcttttgccattcagggcttcctcagcagaaacctcacatttctttctgaaaaaaaaaacacgtcccttgatgacaccactgatgacaccttgatgactttcccacatgaggatgatttacctgaagatttggccttttctggatactcccctttttgcctttgaacaatatttatatcacatattaatcccaagaagcacaaattgccccaaagaaatctctttagagattattgactacaaaggttttggcactgtcctccctgcagaacaaaaggtgagaaaatgaacatttgccaaaaggcaaagcccaagactatgagaagcagggcagcctaggatttttctggctattgtatgtccacccaagaggtcactgctgcctccagctgggctgtgtagcttcctaggcagtgagggtcactaaccatcagtctaacaacttgtgtcaagttggagaaacattctctggcataaaatagagagtgggctgggcgcggtggctcacgcttgtaatcccagcactttgggaggccgaggcgggcggatcacgaggtcaggagatcgagaccatcctggttaatgtggtgaaaccccgtctctactaaaaatataaaaaattagccaggcgcggtggcaggtgcctgtagtcccagctacttgggaggctgaggcaggagaatggcgtgaacccgggaggaggagcttgcagtgagccgagattgagccactgcactccagcctgggcgacagagcgagactccgtctcaaaaaaaaaaaaaaaaaatacagtgtgatgtggcagttcttggaataaaattcacatatttttgactttaggtctcctttttgtttttttccattcattcatgagcatttaagctgccaccgaataggcacagaagtaagtcctgactcagtcttcaagaaaatatgtctcgttacatcatccgacactgagatgaaagctgaaaaaaaagccagtttaaaagttcaagctgggattggtggcacacacctgtaatcctagctactcagaaggctaaggcaggaggattgcatgagcccagagatttgaggttacagtgagctatgatcaagccactgcactccagccgaggcaagagagtgagaccctgtctcaaaagttataaaataaataaaataaaaataaaaattcaaaacatcctaattttgttgatgtgccctcgtatcatcagtaatgtgattaaagtccctcacatcatatattttgtacttaacatcttctacacactttaattgtattatgtcattttttttcctctgaggcaggtactattgttagctagcttattttaaaagtgaagaaaactgaggtagaaagatactaaataatctgccctaaatcaatagctagtgcatgcacggccaagctagcatttgaatatagatagtctgaccctaaacttgcatttttgatcattttgttccatcactaagccttttaaggaattcgttagtgggttatttaatctattttgcatgctacctacatcaccttcctttcaggaacaccaaaggccagttgccttttactagttaagtaatctggcatctcaatgtatcctatgcagttccataattgtgttctgtttctctcatctacttttaaatgtagggaatatgccagcttagtaagaagcgagtttgagtctagcccacatctagcacttgtatatttatttttgtcataagtgtcactgttcttaccaccatttgtcaggcaaatgtgtctattatagaaaatcaaatccagtctgacatgtatattatcatagaccaattacctaattgatatttcatattggtttacttgtttaatttatgaaatgtttacctccctgaaaacttaagtgctgggctgttagggaaaaacatgcattatgtgctccttactattatcctatctattttttcataaaaaaaaatgcttctcagtgaattcattatattcccagaaaaacaagaaacaacgcatttttttctctacttatatataaatttttacgaaaattcttttacacccccaaaagtgaggaattttaacttggactgtaaatggatttgacaccaggagctcttaaaataacttcttacttcctacttggatattagcattccaaatgtatgaccagttctaagatttagctattgcctcttttacagcgtttgacaataacattgtgcttgattaggttatgtcgtgttgtgttactgagttatgctaggaaacataataatatcatgaacaccatgactgagtatatagcatccagaaaacgatggtggaaaatgaaactggtttcagtagagatatttctctgtgccaattaataaaggcatgggaaaattagttactatagaactaaaacaaaatcactcaagaaataggaaatagcaacatgaacaattttggtattattcataactggtcctcttcaaagaagagaagcatggagagatacaaatttagaataacctcactataatgttttgagattcttaagagtattttaatactgaaagttgcatatatcatatctgggagttctgtgagacttatgcagatttggggatttgttttcttggtgtctttcaccatttctcttttgctgggcagagtactggcatttctttgccccgcaaaatgtttttgccgtaggccaaaacaaaatacataccttcaacatgggaaccgcatcgtgaaggtgaacaagtgctccaacatcttgtttactccagaaccagctttcagtgctaaaacttcttcagaaggattctcaaaggggggaaatagtatttggttgacggaaaccagaaagcagggtaaaataaatcatagagtttaaaattagacctaacgtctttgaagtgaccaataattgaaattgcttctgaggtgtgaaaagagagaaaaggtctgtctgggtgactttctagatagagaggcagtatggtctggtggttaagcgaatgcactctcgagccacaatatttgtttctttactttgtctttgtttgtttgtttgttcttgctttttgagacaaagtctgactctgtcacccaggctagagtgtggagtgcagttgtgcgatcttggctcactgcaacctctgcttcctgaatagctgggaccacaggtacatgccaccacattagactattttttatatttttagtagagacagggtttcaccatgttgcccgggctggtgtccaactcctggtctcatgtgatccgcccaccttggtgtcccaaattgctgggattacaggctggagccatggcgccttgtctagaaacacagcatctggaattaaattttatttcctttacttattacctgtttgaacccatacagatcaatcaatttctggtgtgacagcaggagcagagagagctgaacatcttggcagatgaaagcagcgggacattttcctcctgctcctgaaagagaggattgtagtagggaagttatagaagagagaaggcagacgcaagtaagaggagtaactaaagggcctttaggagccatatacccaatatttcattctaaggtgttcgagctgcatatgaatatatcagtaaggctgacacaggctcaaaatctggtagtggtgatgcaccacacctctgttgtatgtgctggtgggcggtgcatagctctctatgttggtcaaaataaggggctacattctatgttcacatgcagatacagggagagatgtaagggtggagataaatcgagaaatataaagagaggtacaaataaggattcagaggattcaggacatcagaaacagagccacttctagaaactacaaattcttgggggagagaaagcacctttacccctccgctagcaatttgtacaactttttggaaaagcattaggcttttgatggtttgaccatggagtattagtttatgttaattttgtaaattataagtggcaaggagaccccaggtaacatctggagagcagtgttttagtgtgaaccgtggaaccagagggatatggttttaatgtatccccacccaaatcccacattaaattgtagttgccataatccccacatgtcatgggagggacccagtgggaggtaattgaatcatgggggcaggttttacccatgctgttctcctgttagtgaataagtctcacaagatctaatggttttataaagggcagttcccctgcatacactgtcttgcctgccgccatgtaagacatgcctttgctcctccttcaccttccaccatgattatagggcctcctgagccatgtggagctgtgagtccattaaaactctttttctttatgaattatccagtctcaggtatttcttcatagcagtatgaaaattgactaatactcaaactctctttttcaaccttatctggacacatagaaattgggtcaactttggtcagtggccagtcatctgtgaacctcaatttcctccttcgctaaatgaaagtgacaatggtacaggtgattgtgaggattacaggtggttctgaggattcaatgagtgtacttatcagagcatctgacatataatggctattctccatatattaaaaaatgaaagaacaaagaaaaaatttaaaacattgcaatgaaataattcatacatagtaaatgggaaaaaatatatatcattattcagatttttaacaactcagctgagtgtactatgtcctactgtaagcatgcccatttttctggtgaatattttccctatctccagcttttcaggtgctgtcttcttggtcctgatcaatggaccctgggtacccatagccttccttcaagcttatgagacttggcaaaccactggcctccttctgtgtcaggggctggcactgtcaagtgcatcgtctgattgtgatcctcaggccttggcagcaaatgtacagttttcttgctttaattaggctgagattcattcctacacgtggcagctgcaaagatatattctcttacaattagatgttacaatacttgtattgcctgaaccttaattttaagtacattttggtggcccttgtccctcccttgcaccttggttgctccaagagagagcatatggcccagtaattctttaaagctcattttatgggccattctcaggcacttcctgctggcctttggaacagagccttattcgtgactgcatttttgcttatactcctgccaaatgcttcctccaaaaccagcaatcaaaccacaggacatgataagccatggccatcagaatggcttaatgagagcaacctcaacaatcaaggtcattaacagcaaccagcactgcaggatttgtatcccgtgcacaagggcagcctgggcaggtcacctttgtggtctatgagaatatctccaaatattatagaatttgagaccatctcagagaacgatctcattctaagcaattttcttttaagcaaaaatggataggacaaaaatagaaactggtggttctctctggcctctccttgtagaagaataaatctagagtttttaaaggtcttacagagcaaagaaaatattcgctggatgcttgtatggctacctaattcagtcacccttgcctcagaaaatgatctgaattaaatcttgtttccagctagcagaagggtatttgaaatacagattggatctgtacaatagaccttgttcaaagcatatccacatgagatggtacatagtttaaataaggcagacttatatcttgtctatgatctgtgtgctattaaacagttttaaaacgtgaattattaattaaaacctgtgaactactaacattttggaatgactgttttgatagctaacaggacttgtgtgacttttgagaggcgttgatttcctttcatgtcagctaatagaaatcccattgtaatcataaaaggcacagagaaattatgtcacaagcggatgctatttaagtggaagtgaacacagaatatattaaagtatcagtgttcttatcagcagtgtcttataatgacttctgattaacactgaaaagatgattgatgttcctaggattgtggagcactgacaatgtgacactgagagaattcaatccaaagcttgttaatttcatagaatcattcaatttctcattactcctttttgacagtgtttgtttttgtgaccattacaatatagtcacaatttaatggggcctttcaaaaacaatagtaagaaaaaaaccttaaaattgtcacctatgatgattattactagaaacagaaacaatgatttcaatatattaattttttttgttttaaaataaagcttattaggctgatttttattcaggagtcatatttaaactgatacaagccaaagtcatagaggactcccaagtcaaggcaatagttcacatcaacagcgccaacatatgtaggctgatttagttttttcatggccaaagaagaaaggaagcatatttgatgtaaattcctgtatgagaaacatggtaggcatgccaggtcctaaattagtataaagctaatgactgctgattgagagcaggtggagaacgggaagggggtgtagttgaggatcagtagagtttatcttaatacttttgttattaaatacttttgttattaaaagtatagaaaatataagactttctcaatttacatatcagatctggtgaatctatcttattgaactcatactttacatggattgaaaagcaatgtttacaaaaagaacactgatatgggaagtaatgtagttagcagagataaactgcggatgtttcaaataaaatcatctacctccaaaaattttactggaactagcatgtgatatttaacttgtatttttagattagtgtatctgaactttgtatcagtcagaggaaaatgtatggttggccctaaccactcagaatgtcataatcatagtaattaccactacccagtagtagtaattaccaatattctaggcttcagtcaagacactttaaattcatcattttatttaatccccataacaaccctgctaaacataggtgtgtttattggatcttttatcttcccaaatgaccacccaacgcccccacccaaatcagtttgattgaaaaatttgaaaccagcaccaaaaactttctcatctaacccagcaaaaactctgcagtccatcttttacaagcacatataagttttgttttaatttctctttccttacaaaggccgatccttccatgtgggttctcattatcacccttcaggctttacaaggaccttattttatctgtgtcctgaatcgtcagtctctttccttacttgatcattgatttcagcatagtggcctcaccctccaaaccttttggtattcttcctaaatctcatctcttactcatagccaactctaaagagttctcatgactgtgatctccatgtccttatctgctatctactatccacttctcgattcatattggctttttccccaaactctactgaaacttttcttggcaagatcacatatgaccaacattgttttgtcttttatgttcacgtattattcacctctagctttttacacacaccctctctctcatatctgtggttctctacctctaaatatggagattttcaaggttaactcctagacaactgtccaccaatttgctcgtgccaaaagtttaagagtcaccccatcaggtttacattcatacctatgacttcaaatatggtgtatatgcttataaatcccattcttagccctaagcttgttttcctgccactagatggtgccatttgggggtgatgggagacagtgacagatcatcaggcattaggttatcacaaggagtgtgcaacttggatccctcacatgcgcggttcacaatagggtttgtgttcctatgagaatctaatgccactgctgatctaacagggggcagagctcaggaggtaatgtgattgacagggagtggctgtaaataaaatgaagctttgttcgcttgcctgccactcatctcctgctgcgtggttttgggattggagatccctgttttatagtatttgtaatattgtcgcttagatagctcatggataatacaaatttaatagatccaaaatgaaattcttgaattcctctaaacaataccaataatttgttccaattagaccatagtaaggttgttaaaaaataagcaaaactaaaaaaactacaatgtgtaatctttagaagactttaaaagataaagacagatgtaagtaaagatgggtaatctctactttcacatctcccatccattcctctaagataaccaatgtgtatttttttaaaaattcattctgtaactttatgccaatctaacaggatgcttatattagttttttactgttgttttcttccacagtaggataatggtgtatcaatatttagtgactttttaaagaacatgacactaagaatgttccgagtcaaaccatttagatttgacgtattctttctaattttcaatgacatgactttctatgcatgttccaggtatgattcaacgatgtgcgctgctgtattattagattatttccaatccattttatttgtattttaaatttaaaccaaatgtattgtacgtacatagctcacgatatgctgcttgctactgtgcttgctctgaaaccttgcccattatgcactaacaacactggcttctattcagtacaacaaaacgtccctacattttttatatccagaaatttagtacggttttttcattctggaagcagttctttccctctgccttaccatcattgcatggctgtctctttctcatctgtcagatcagtgctctcttcttatcttttacagggtatcttagggtaaaaagttaaactgatgcgacagagaccccaaaacaaatgcctcaaacaagatagaaatttacttatatgtaatataatgatctaaagttgacgttccagattagctatgtttctgctccagctagtcactcaaatacccgggtgaatggtggctcttttgcattcagcaagtggctttcaagacctcccatatcattggcaatttggcaatttaggtgggtgtggtggtaggtggatcaggaacatcaaaatttgtggagatttcctctcaaacatagtaagtgaaagtttcattcatcatttttgcttgccatatttagctgcaaagaaatctgggaaatgtgatctctggttagacaagcatgtttgataacaagtctattattatgggagaaggaagaatagatcttggtagacaatttcagtctacactcaaggacacttaccacaatttgtaaatgatgtattcattttaaaaacaatcttctggtcttcccattagatagtaagcacaataaaggtaaaatacctgcctgttttattgttttattcacaaataaaccttctcccctgaatactacttctgtcttttagtaggttttctttttttttttttttttttttttttttttttgagaccgattctggctctgtctctcaggctggagtacagtggcgcaatctcggctcattgcaacctctgcctcctgggttcaagcaattctcatgcctcagcctcctgacatagctggaattacaggcgtgtgccaccatgcctggctaatttttgtaattttagtagagatggggttttgccatattggccaagctggtctcaaactcctggccacaagcaacttgcctgactcagcctcccaaagtgctgggattacaggagtgagccaccacacccagattagtaggttaattcattaaataactaattgaatgaatgaaaggattttacaggtaaagaaactgaggctcaaagaagttaaacaatttaggagaatgggtgaccattcttcaggaaggtggaaagatttatacctcagatggcttaacaagatagctagtaagcactctttcaactctgaatttctgtgattctgttatgcaggaaatcaccacattccaaataagatcatgagcctgctttgtaaaggaataaatcaagagaaaattgaaaatacactttttgtctcattggttctgtcacacagaactctttccctcacaccattacatcctaaattctcatagatgccagtcacactttaaaatggcaaccattaatctaagatgttggaagactgcagcaaacttgtgacatacctttctaaaatcacaccttccttggacagacaaagtaaatatgtgttgggcttcacagatttcctgctaggctacactgtctggaagaataaaagcaaacagatagtgagtattgtctttatcacatactgtgtttaattaaaaagaaagaaagaaacacaagattttgcaagataataataagtgcagttaaattgattgtcaactaagtcttctggtcagcaaagtatgagattaattccccttaataataaaaacattcttgagattcttctttaaaatatttattctgcaaagtaactaattataaatctgcttttctttgttttccaagatattgaagactttgaaactaaaacaagaagcacagtatctgtccgagaaggtcaaggtgtggtgcttctctgtggcccaccgccacattttggaggtatgatggggtgatttgggtcatatcatcaatgcggtcacttggagagtgatgtgagcacatcaggtcttaggctcagtgatcaccttttatcaaatcaaagaaattgtgactctcgtcaagtgcatctactgcatacaaatagttctatatctaaacattttcttttaaaaatattcgttcaagcagccacacagcaaatatgtttttaaggagatacatcatggcattgtacgtagtgtgagtgccagggctttttagagaaactgaccgcagctgtaattcggtgctgtgacaggcaaacttcatgacaaggggacaatttatttaccccactttgaggcttggttttctcatctataaaatagagacattaactgtttgtttgtttgtttgttcagttttgttgtaaatgttaaatgagctaataaatgtaaattgagtagtgtaataactaatactttagtaagtaaagaaagttaagattgttactacgtttttatttttgggctctatggagaagcaaattccaactaacactcctcttggcaatgtcacattaattaccggaagggatagatcaccattaactggaagcaaattctgtatagcaccaaatcagaatgtctcctggcaatggtaaaaatcaagcaataaatgccagcctctactttggaagactctggcttggtcagtggactggcccgttgtcagggatccaaactacttactgattctcatcctcttgggaatggattttctcaaatttcacatgatgtggtaaatttagtcgtgattctcaactcacagtgaacctgaaggaggcagtgtgaaaacatccatggagtcatttggtacaaaccaatatcacactatattatagaaagcttaataacagcaaggacttacacagcacagacccaaggactttaacatgtattagattcttaaattttcacaaaaacttataagagatatatgagtataattattgttttacaggctcagtacactatagagaaatagaaagatgttaattaactggtccaaggtcacgcagctggcaggcaatgaagccaatattcaaatccaggaagtctggttcccagaccctcagctcttaactatcactgcagttgttataattgatttccactctggaatgggagaacttttaaaatacaaaggacagatgtttaaaaataaaatttaagcaatttacttttaatgttaaaccaaatcttatttatgagccttgagaaacttgaaagcgtttttccattattatttttacacaacctcatgaattgccatgaccaaaagaaaagaaagctaattcaaagttaacaatatcttattcggtattattagagagtattatggcattatattcacctgatatgatagggaagagttgcaatgcttttaatgctatattgagataaaataatattgtttcagaacacacaataattgctgaggctcttttggtgcttattttttaacggtatagaagattattttccggcaccataatctaagatgacaaaatatgcaaaatggtatcagtttgtcctgtcagtctatgtcattttatgctcttacgatgttattcaaatattcttgacactactgaaaattgttttcaactttgtttaatcgggaataaaagaaatgtaaaatatttgtaaatgaatcagttccatatgtaaaaaaatttaaaaaattaaaaggcagccagacaggagacgcttgtccttgttaccttgtcacctatcaccattaaaggatatgtggatcttttagtgtgtgaggccctcattgtaacagcgcccgtggggtcgatgccataaaattaagtcacacatttacaaaaactgccttaaattaagacctttgtaactgaataatcttgctgcatgggagtaatggcaaacttgtgtaataccaatttttttttttttttttttttttgtgatagcatctcgctctgtctcccaggctggagtgcagtggctcgatcttggctcactgcaacctctgcctcctgggttcaagcgattctcctacctcagcctactgagtagctgggattacatttgcacacaaccacacccagctaatttctgtatttttagtagagacgggttttcgccatgttggccaggctggtctcaaactcctaacctcaggtgatctgcccacctcggcctcccaaagtgctgggattacaggcatgagtcaccgcacctggtccgagatttaatttatgttacaagtagcatctcatcatgattccaagcatatttgtcggctgaatcatgtttcttgctgttaaggtccctgtttccttgataactggctgttaagggacactctcaacttgtagaggctgctgaatttcttgccatgagcatttgtccaatgtcaaagccaggaacagagaatctgtctcacatttagtccctcgaacatttcaaatttctttagtcaggaagagccccatctcttgtgagggctcacctgatacagatcatgcccacaaaagctgaagtcagtttctttaaatcaacctgtgccatctaatcttatctaatcatggatatgatctctcatcctgctacaagtcgcactcacactcagatgaagagaattatacaagggcacgggtcgttgaaggtcatcttgggattttgccctacaatatgtttctcaaatattatttcttctatttccaatctccctaaaggctccatatttcctaccacacatggctctcacagagaaacgtcctagaaatatattcatgggggcagacggagttaacagagcactgtaaagtaaatgtcggcgtggccaaattattttttaaatctcgtgtgtaagtattaaacaaagcttctcataaagaaaagtagcacagactccacagagatagaaggccataaaagttgacttttttttttttttttttgagacggagtctccttctgttgcctaagctggagtgcagtggccccatctctgctcaccactacctccgcctcccagattcaagggattctcctgcctcagcttcccgagtagctggaaccacaggcacgtgccaccatgaacacctaatttttgtatttttagtagaggcggggtttcacttctgacctcgtgatctgcccgcctcggcctcccaaagtgctgggattacaggcgtgagccatcgggcgcagcaaaggctgaaattttacatcaaatttttgataacttagttctgttgtctttttcaacataaacagtcagcaagaatgagtctcacagggagttcggcagcaagggagaaatcatgttaaacttgatattatcagaatatcctgaattctttatgctttctttttagtgtattcacataaattatacaaaacttttttttaataaggcaggcctatcaaatatattttagtgtgatatatataggtatacacacacacacacacacacacacacataactttataggagagtaagaaaaagtatcgacatggctaaattttataaatttacccagcaaagaatggctccatgttttaaaaacaaaacagaaaagtgtctagatggtttttccatgtaaatgattggtcacaaccccatgaaacagagtaatcaacagaaaccaaataaacaggtacttttatagagctgtcctttcttctgcgtaaacgaaaggagggctgactccagcataggccttctgtggatgctttccacccagttttgaagcacagatgcaaatgtcctgctcctctagaaaggaagggttttacacggaaaggttattctagcagagaaggcatcacagtgcaaaagaaaaataacctaagcaataatgccaggacacagttcaagacgctctattttatcatttcaaaatgtggaagcagaataggcaccattctctgtaatctgagtggaggagtatatttctcttttaatcctattccccaatcagagatgggttttgtgattgtaactgaatctctgtccttaggactagactcagtccttgttcccatatttccaaaaaatcttatctgtaaaatatttccgagaaatgtaggtttcacgaagttttgtaaggacagcacagagaggactgcaatgcacatctgattacaaaacttcactaagattcctgttaaacgtctccttcattcctcctaaacgctctctcactggtaggctgtgacttcccacatctttccaacaatctccaacaattccctcgagtatctattataattcttccctatttggacacctatctcagaagaattcagtactcctttagcttctcagtgcttggcagaacgaaatttactagttggccaaacaaaaatattttatttctttcactatgtccctgcagggttctaaggtcatccctcagttcatgcaacagaaagagacaacacaaaactctttttttttgagagggagtctcgccctgttgcccaggctggagtgcagaggtgccatattggctcactgcaatctccacctccctggttcaagcgattctcctgcctcagcctcctgtgtagctgggactacaggtgcatgccaccacacccagctaattttttatatttttagtagagacagggtgggtctccaactcctggcctcatgtgatccgcctgcctcggcttcccaaagtcctgggatcaccggtgtgagccactgctcccagcccacaaaacttatttagtatttattttatttatttttggggagcaggatgttaccgtgcctttggctgaactttgagctgtatgcagagaggtctttccaccatggattctcactcacctccaaagtgagcttttgttaaatttcagtcactcgtcacaaaaaatgtcggcacaaactatctgcaacagagctgaaggcagaatttcctttaaattttggaacagatataacgcccttgaaaccaaaactgaagaaggaatatgaaaacaagcaatcaataaacttccatggacccagtgagttagtccagcctcataggaaatcttatttaaaaatgacagaatgaagcaacgatacatgttatctacaataattaaacccccccttcactatgtagtaatagtttcactttatccaaagtaaagaacactctttcccttcattggttggatatgaaactctcggcggggctcagtggctcacacctgtaatcccagcactttgggaggccaaggtgggcagatcacctgaggtcaggagttcgagaccagcctggccaacatggtgaaaccccgtctgtcctaaaaatacaaaaattagccgggtgtggtggcaggcgcctgtaatcccagctactctggggctgaggcaggagaatcacttgactctgggaggcggaggttgcagtgagccaagatcatgcctttgcactccagcctgggggacaagagtgagatttcatctcaaaaagcaaacaaacaaacaaacaaaaaagaaactaagtcccgagctcataaaaattataggtttaaaatttgatttagaggaaatgttccattctctcctcagatgcaactttcaggttggtagaacagttgaattgatgccaaaagtttggatcatctgtgtctgtagcaggaagatagcacgactgtctgagcccactgtttgtatttgcatcagtaaagatgttgacaattccacttaaattaaaagtcattccaagcaaaggctcacaattgtgttatcaaataaagaggaaaattatgtagagaaaaaagtgctaaaacttaacatccccttcctccagttggtgtgcttgctgtttctggcgtaaatgaaagtgcttttgtcttagtgggtaggtcaaattggcagtggatatgttactctgaggctctctgaaagtgtaaaaggcagacaggcccaatagttgcctcttggtataataataatagtaacgataataaccgtattattgaacttgtacactgggtattcactcaacaaatatttattatgtagttactaagtgccactcgtttttctgcattttagtgataaagtggaaaagagagacaaagtttttagctccatgaatcttataataaagaaatataaagcatgacaggtggtaataaaagccagaagaaaaataaaaggagataggaaatagtagatgttgctattgtatattctaaggtaaaagaaggtttcactgctatttgagcagagaactaaagaagtgagggagtgagacacattaagtaaaggcagttcaggtggaggaaatagcatgtcaaagaacctgtggggaaaccacgtctagcatgttgggagaacggcactgaggtcagcataggtgaattaaaatgaacagacaggagagtaaatgaggacacacagccttactttcagacattttagggactttgccttctcctgggagtaagatgaaaattcactggtttatattcagaagagtgacatgctttctctgactttcatttgtaaaaatttactctggatagtagaccacagaggggcaagaacataagcagttaaaaagtgattgtgttaattcaggtgagagagaatggtgacttggaccaggtggattgctgtagacagatagataattaccagtcttcagtatgtatttataaggtataagtaaaataatttcctgaaagattgaatgtgggttataagagaaggagaaaagtaaaagataactccaaggatttgggaccgagcaactggaaaatggagtatcatttattggggtggagttgatgaagggatagcaggtttaaggatggagtaaatcaggaatttgttttaggagatgttaatgttcagatgccagttagatacaagggtgaaagtttctagcaggcagctggattatatgtttagggcaaaagctctggtttgaagagctaaatttggaactcaccttatataagtaatatttaatactacataattggataagataatgaatacttactatgtactaggcactaaacttagcatttgcaatacttcaacgcatttaacattttccgggaagatatctcaattttacaaattgagtattgtgttaaaattgttagtgttagctaacaactatagttaactaaactcaactaactataacatagcttggccaagatcttgtctctggaattcgaaagatcctgtctaaacatcagtgcatttattccactccctaattttctctggcataatctggtccagaagagacacttaaaagtttttaaataatacaaggagataacaagagttctttactctactggagactatgtaaacaacacacagagaggtctactgatttgcctaaaattagtgtacagtgttagaaccaggaagctcatggctcttcccactcttcatagctggccaaagtcagctctctagaaagtttatttctttaagtcccatgctgcacattccttccctccactttcagactccattcactcttagaaagactattttccttgctttccagcacatcaaacagaactctcctgttgcagcctgttaccatgtgtagaagtcaggattttccaacactggtacactttgtggcagtagggccagatgttggggagataggaagtaattctttttttctctttttattatcatactttaagttctgggccacatgtgaagaaagtgcaggtttgttacataggtgtacacgtgccatggtggtttgctgcacccatcaaccggccatctacattaggtttttctcctaatgctatccctcccttagccccccaacccccagtaggccccagtgtgtgatgggcccctccctgtgtccatgtgttctcattgttcaactctcacttatgagtgaaaacctgcggtgtttggttttctgttcttgtgttagtttgctgaaaatgatggtttcgagcttcatccatgtccctgcaaaggacatgaactcatccttttttatggctgcatagtattccatggtgtatatgtgccacattttaaagaaaatgtgacagtctatcattgatagatagatagacataatatccagtctatcattgatgggcatttgtggtggttccaagtctttgctatttcaatattaaccttaaatgtaaacaggctaaatgtcccaattaaaagacacagactggcaaattggataaagagtcaaggctcctccgtgtgctgtattcagtatctcacatggagacccatctcacatgcaaagacacataggagacccacctcatgtgcaaagacacacataggctcaaaataaagggaaggaggaatatttaccaagcaaaaggaaagcagaaaaaagcaggggttgcaatcctagtcactgataaaacagactttaaaccaacaaagatcaaaagagacaaagaaggtcattacataatggtaaagggatcaatgcaacaggaagagctaactatcctaaatatatatgcacccaatacaggagcacccagattcataaagcacgttcttagagtcttacaaagaaacttagactcccacacaataatagtgggagactttaacaccccactgtcaatattagatcaacaagacagaaaattaacaacgatattcaggacttgaactcagctctgcaccaagcagatctaatagacatctacgggagtaattctttattggaagaactgctctgcacgttgttaagatgtttagtaatatccctggcttttacttactagatgccaatcgcactgcctcctccaattgtgggaaaatttgtctccagatattgccagataacttctagagggcaaaactatccttagttgaaaaccactggtacagcccatctcttacattcactgtattaagttcacccataaaagatggaaattgggaagaaaaagagaagtctagtcctcatatatttgtatcctatgacttgcttggtctccctaagaattggaggtttcctagcaattcactcagaagctggctatgagataagagtcggtaggactggctttgcaaagtacaagtcaaaaagagcccactgacaaaataagatgtggtaaagaagccagccaaaacccaccaaaaccaagatggtgaaaaaagctatctctaatcatccacactgctcattatatgctaattataatgcattaaggtgctaaaagacactcccaccagcgccatgacagtttacaaatgccatggcaacttctagaagctacccaatatggtctaaaagtgtgaggaaccttcagtcctgggaattctcctcctctttcccagaaaactaatgaatgttcctccccatgtttagcatatgagcaaggaataaccacgaaaatagccagctctgaagtagccactgttacttattcctctactttcctcataaacttgctttcactttacagtgttggctcggtcttgaatcccttcctgtgagaagccagtaactcatgtggcctcccaggctgaaccccagttttggggtttgccttgagacagctgtgttttcgttccttctccaagtaggtttggccaatgtacaaccagttctatagttatttggaacttagcaatattaggaacccatgagacctttatttaactgtcattcataggccgtaaagaaccaccatctccttgattccaaacagtagatgtgtaaatcagaagggatccaataaaatccaggtgatcaagcagtaattgtggaacgaatgggaattcaaataggagtggattttaaagtgttaggcacgtttctggattacatcgtaaacttcctcagcctaatatcaatgacttcagtccagaaaaggaattattcttcttggattaggtttttgccactgagctagcataaccatgattgaccacccaagagtcagtcacatttaaccctggagcactacacaaggtttgcagtaaagtacacacattctggaatattccaaaggggggatttacccagtaaatctgaacactatacttcaagttctttattctactcatttattttctgcctcaggaaacatgctatcaattttgagatctgttctaaagtgccaatagaagttgtcagtatcaatgtttatcatgatgcttctctttcacatgagatatttttcctctaataaaaattacatgctatataatgggtataattgcatatatctttcttgtttgtattttaaatattacagtacaagatatagggctgtaaaagatgtcaaaacataatcacactctggggaaaagaggatttgttgtatgcttgagagagcagcagatagagtcttcaattgcttactgcagatctgccatttctaataataataaaattgtagaggacgaagtcattgtgaaactacaaaaaaatgcttcaggaaggaccaattatcattcagctctaatgctactgctgactcatcacagggaaaatgcatcacaaccgttaataaccgataaatgtcatagatggtggagaaaatatttaaaaattcaatggtttcaacctaaatggctcatgaattatacatttaattaagaaaagccaaatgggaaggtttttaaacttccagtttggaaggttttttttttctttccccattgaaagatacacagattaagcacagcagtggctgatgctggaacaaaatagataaaagcccccagtgcaggctggctcttcagatgactgggaggagccagcccatggggagaagggagcagggcagggtgagaaatactatgacagcaaagacttgcagctttacatcttcaccaattcagagggcacaaaagggcacctggattgtactcccagagctgctgctagctctattcccctctgcttcttcacttgtaaaaatgaagtggttgggctggcaagtctcgcaaatccttgccatcccagacgttttatgaatgtataaactaagagacagccttttctccagactccaacacaccactcaaacgcaaatatacaaggtggtccaccattcaaaatccaggcgtttcccttcccagtgtgatgatgcagaggagactgagttttatcttttgttttgttttgtttttttgggttttttttttttttttgagacagagtctcgctctgtggcccaggctggagggcaggggcgcgatctcagctcactgcaaactccaactcccgggttcccgccattctcctgcctcagtctccccagcagctgggactacaggtgcccaacaccacgcccagctaatgttttgtgtttttggtagagacggggtttcaccgtgttagccaggatggtctcgatctcctgacctcgtgatccgcccgcctcggcctcccaaagtgctgggattgcaggcgtgagccaatgcgcccggcgagttttatcatttttatcaatgatttccaaagggtagctccagaccccccagtgtcattgtcacctaggagcttgttagcaatgcagatttcctggctcctccccagacttactgaatcacagagtctgagggtggagcccagcggcttgtggtttagcaagtctaccaaggggttctgatgcatggtgaagttttagaacctctgcttcagagaggcccatttaagagggaaaattcaagtttttatatctgttctactccctgctaatattagcaataagtactttacagtaatttcacatggcagtttaacttatttatctatgaagttcttaagaaattggacgcaggacaggaaatgttaatgggggagggaatggacagtgaggaacatttgtcttagaatgtgagtaaggttggttacttgtggagcttgggagttttgaaggaaggctaaaggtgaggaggacgagctaaggagaggacatgaacatagaaaaagaggatcaattgtaaagacattgaaaagtagaaagctattgttatgggaaaggggttcagatccggactccatgagagggttcttggatcttgtacaagaaagaattcagggcgtgcccatagattaaaatgaaagcaagtttattaggaaagtaaaggaataacagaatggctactccatagacatagcagccctgagggctgctggttttccatttttatggttatttcttaattatgtgcaaaataatcattatatacctcctggttttagaccatatagggtaactttctgatgctaccatggcatttataaattgtcgtggcgctaatgggagtgtagcagtgaggacagccagaggtcactctcattgttatcttggtgttggtgggttttagctggcttctttactgaatctgttttatcagtaaggtctttacgatctgtatcttgtgctgacctcctatctcatcctgtgacttaaaatgccttaactttctgcaaatacagcccagtaggtttcagcctcattttacacagcccgtattcaagatggagttgctctggttcaaaggcctctgacagtattattagggaaagagcaaagatctggcatctgaaggatctaggttcaagccctgctcctcccacatgttatgaatacaattttgggaaattacctttatactgttagttcttgcacccttagcctcataaagcagttgctggcatgatgaaataagtttttttctgaatttattattaatctttatgtaatcttccctatttctggattagattcttccagcagcttctaaatatctcactattaaagaaggacacaccacatgtaggaatagattggcaagttctagcagctaaggtaaaaatgaattcaccaggggagagaggaaaattacagtctcaggtcccaagattacaggttgaagaatacaaagatttcttgggcactagtggcaaactgtaatttttgttaagtgaaaggggtgacattggatttcagagagctaaagcgtatttctctccacaaataggcattgaataaggatccgtaagctgagacatggccctgggaatttgctcaagattgtctttgtttcacaaaaaggttcaaaagatgaggagtcaatgacaacaggggaatctgaactacattctttccttcctctttatattgaagaaaaatttactctctagatgactctgatttcaaacaaaaacctttgagcatctctttggtggagacagcaacaggcttagaagtgaggcagcaaaggacgtcagtaaagaaactgaagcaagagaccacatggtatgatgaaagactccaatagagacttgcaaaagaaaataaagactcaatacatgagaacagcacgagcatctcaaagcatttttcaaaaattaaaagcaaattgcatttatgcatacttgatccaaaagtatagactcttagggagatcaaaggaatgttgaggctgaaggaaaccattcgtagaagcttaggtttaacccccatccatcgtcaaaacaatttttttttgctacatcccgagtagtgttcatccatactctgcttgatcatgtctaatgataaagaactcactacctagtagatcatccactgctatccttctcaaatttagactgttcttcattatattaaatctaacagcattctgtcacctccagcagccacgagtcctacttttgccttctggacattgatagagagggttttatttaactttttatgcgtgtggcagctcttcaatgtaaacagacagctgtaatatgcttccagaatctttttttccagaggcaaaatcaaagttttatcactatgttttgtgactggcttttgctacattttattttttatctcttgataaacttgatatttttaattcctctttcaataatgggtgctccgaacaaaatatttcagtcaattgcatgcgtcatttggagggtgtcgaaaacacagatcccatgatacctggctcagatagaataaataaaactaaattgctaagaattgagttagctatttgtattttaacaagcttctttagtgattctaatgtacatcaggtgtgggaatcagtgcctgcataaaacataaaacatccatttgaacggttcagagtaagaataagaaatgttatccaccctgtttttacaagttgcagctcattctagtgtttagcctttctgacactcttcttatcctgttgattctttcttccatttacacaaaaaatgcatagcaatttaaaattataatacgacagaaacacattacaaagagagtaaaagccttttgtatttccctccactcactctgagaaaaccactgtatacatctccaggtttttaaatgtaagaatttgcataaacatatcacacacacacacacacaaagttcccacactcataacatgctttttacctaacaatgctgcttaggttttttttcccacatgacactacttttatggtttaatgacactttttgcattttctcacttcatgcgcaagtagcatttactgtgctcctgctgttcctggtctcatctttactttatttcttctccattcctgggaacgatatcagggttctgtctgcagagacaaatttctttttactgacatcatttataaattgttgtgagaaattaattattttgctcctccccactattaatagattaactttttccttctttctctttccttccttccacattttctttctccttttttcctttatttcttccttcctaaaatctcattcctttaagtatggttcatgcttcatgcattttttttttctcgatggaagggatgacaaaatgacaatattccctcattcccattttcaagagtttgtctctatagatcagatttaagtccaaaatagctgtcagtttgttttgccaccttttacttttgggaatttaaatttagtaaggttagtgaagaatgtttcaggtggtctcttcccagctgaggaagcctaccggaacatatcagaaataattagcttcttttgtctctgccatgtcttgcttccgtgccagtttttaatgtaagtacagttggcaaatagcaactcagctctctgtttggacaagaggctccaagatgcataaactactcccctgtgaactataattcaaaagtgtatgagggtccatccaactgaagactttttttgagttagttgcagtatattccccttctccaccctgagtacctatatactccacctattttggggatctcctttggaccagctatattcttctacttccctagacatagttctactctacctagtttccgcagtacacctaatgtcttagcttcaggaagaattatattcaccaagctttaatacatatgaatatttgcttttgctcaaagatttctggctaaaacgaaagaaattgacagcacatgatttttgtgaggttatgggacaactggaactctcaaatattgctggtggaagtataaactgatacaaccactttaaaaaattcttttgtcatttcttataaagttacacttacatctacattatggcttactcctaggaatctaaccaagaaaaataaaaatgtatacagacagtcttagacaaggatgcttatttccacctaatacataatgacctcaatctggaaataatccaaatgctcatcaacaggaaggtgtccaatcaaattatggtatattcataaaatgaaatactatccacaatataatggaagaaagggcttatagtcatgaaaacaataggtgaaccttaaaattatgttaaatgaaagaattcagacataaaatagtacattctgtttgttttatgatgacatacaaatgacagcagaaataatctatgatgatagaaatccagtagtggttgcagcagtagaaaaaaacaggggaggatttctgaagacctggaaatcttcctcattttacttggggaaggatggttacagggggtatataatggtcacaagtgattaaacggaacacaagttctgtgcattttaacatatgctcattatgtcatttatacagttacccacaagatttccagagatggactgattgatgttcagtaaaaacaatgtgtgccctgtttcatgtttatgctcttgatagttactcggagaaatgcttgtcgactcctccgtcacttggatagctctagtttatcgtgccggtttcaaaatggaattccttcttagaagtcttttctgatgacacatcattctaggctccttctctgggctccctataatgcctttgtcaaagcatatgttatccttcattgagattactcacattattggcaattagcagtaactggtgtgacctttatagggcacaggttttgtttggttttacactaagacctaaaactgtcacagaatagctgcttaaaattatgtaataatcaggccagtgcagtggctcatgcctgtaatcctagcactttgggaggctaaggcaggagaatgacttgagctcaggagttggagaccagctggggcaacatagtgagaccccatctctttaaaaataaaaaagaaattatgtaatgatcaaatgagtgaacttcaaggtctgtggtagacttcttgaactgaaatttttaagttaaatttttaacaagtacctgtaagtatgtttaattcttctgataatgcactgagaaacactgctttgaagcagcataagtttttcctaaggaattcagtgtacatttggaacagttattattttatacgtcttatggtatttcttaataaactcatccacttatttccataacatcctattgttatatccttaatcccaaaaagtcaatgatggggaaagtgcccacataatttatcgtccaatctgagctatatttcaatataagggaatattacaattacaccagatgacagctatcaactgagcaaatagaggcacaattttctcctaattatggggaagtaagacaaagaattttcagatatgaatgaatgcagtaaggacagtatggttttgttttgttttgttttgtttcttgtttttcagatttatcttatgcatggaccttcaatgataaccccttatacgtccaagaggacaataggcgatttgtatctcaagagacgggaaacttgtacattgccaaagtggaaccatcagatgtgggcaactacacttgctttataactaacaaagaggcccagagaagtgttcaaggtccacccactccattagtgcagcgcactgatggtaagataatgagttatcttgggaatgtactttatctttggcccttaaagcctgggaagattcgtaaagctttctgcttccttcttgtttggtggagccaaattacgagtttaggttcaattcacaaatatgtaaaccagaaatataacagaaaattatctaattcacccacatggtgcagtagacatggttctgggtataccaagccatctcctttctggcattgaaacagcttgtcttttttttgcttaaagactgttttgtaaaaacaaaaacgatgttccggggagttggcgtgtgtgtatgtgtgcacgtgtgggtgctgccaaacatataactgaatcaatatatttttaatgaacatatgttgcagctactttttaatggccccttttttccatatttgccctttttttgttgttcaccctttatttacgtggctggcaaaatggagggaaaagttcatatccaaggaaagcaaagcaaaccaacattaattatgagcattccagagaagaatgaaacacaagatttatactaattatattcctccaaggaacataattcacactagtctctgacgagctttgtagcttagtcaagtcatggctggtacaagatttagagagccagaaagtttaaggaagtcattgaagtggagaaattctctagttgtttttttaattaaatgttcacagtgggattcatacaggtagaaaatttgttggtgcattttatgattgtattcaggacttgaaatgcaatacctcgtggagtttttctcccctctgaagagttgaagaaaagcaagaatataatgctaatgaagcataacagaattgtggaacaagtcccatagaaggagttcttataatagagcttttataatcactaaccacccaaatgtatttgcaaggtcttcactaagatttcagcaaccattagacttattcctaagtccaatttatctccttcaatgaatactactatttatgaccagaagaattcatgagccaacaatatacttggagattctaccatgtttttcctttttttgtttcctgtctactctgagtttctgcttcttgccttcttaattccttccttcttctatcccctctattcccttgaatacatttacaggaaaaatagagcagaagtattatatataatataaaaatcaaacctattttaaaagtgagcaggtaggaaatatcagatgtcaagaaagtgaaaaagaataaaacctaccaacttagttgaatgaagtagtactcactaccttctcaccataacctctttgaatgtttataatgatcaagtcttaaaaattaagtatttttatttcatatatattttgtaatttttactttttctgcaattatattgaccaccaacaatgtatttattttagaaatgtattactctgtcgtttggtacatagattaaaaatgatcaaagtatttaaataatcttgagatgtcactgattaaattaattaagttaatgagaatagcctacagatatatttctgttacaactcctctggtaggcagtgtatttacaataggttataccatcatcttatcttggcacatatccccaattccttggattgaaagttttaaaacttaaaacaaattcgtataggtatacagcaaacttagcggcaaaaccttattgtactaatatgtgaatatttacatttttatctcaattaatgtgatgcctttatatgttctgctgcagaactactgttattttggactaagacctactgcagtggacttctaccagtgttagctgaaaacatcccgttgttgttgtttttttctttttttttttttttattaatcagatctggctctctgagttccctgaaaggtagataaatgtggatgtcactagaaaagtgtcttttttgaaaacacagaagcattttagaatctatatgtatccaattcttaactgaaaaccctaactcttattaagaagaaataatcaggttttggttaatgaagcatttacttcatagaaaacttctattctccagaaatgctgctagctcttttgatatttaacaggtgtgatgggggaatatgaaccaaagattgaagtgcgttttcctgaaactatacaagctgcaaaggattcatctgtaaaactggaatgttttgcccttggaaagtaaggtttttgtttttgtttttgttttcctggttgcattaatttttttttattaaaaacctttttgttattcatatattgctctaaggtaaattaccaagtagatttcaaatgctgggcaacagtggaactttctgatttgaatttaaacaaacatgtctaatactgagacaatgaccaggcctgtaactgaaaatgatcagggctgcaattcttccctacaggtgctgatatttccttagtttaagcataatgagacccatttaggcagcacattgcaagggaataagtgcactcgtataagatgatgggcaagtcactaaaccttccacatatccttcactccatcttgtcctacatccagaaatacattgcctggagtatttccttgcttaattaaccaacaattctgataaataaaaaaccactgcttgtttccaaaataagactaattaaagtccattgttcatagtgggtaattagaattgagcccaaccttccctgatagtggaggcattttgttttactcagataagtatttattaggaacaggtttggaatacttttaagccaggaaaatacctacatttttgcatgggatatctagaacccctctttgctttttggaggtatacaaatttcatttttgtgcctataaacaccagaaaaaaagaaggagacagatagactagactgtcattttcaaatgttaatatgcatgtgagttacctggggacatggttaaattcatattctgactctagaggtctagggtgatgtttgattcctccatttctaaaaagctcccatatattagtcatgcttcttgtaaacagaacatactttgaatagtaaaagacttgactgactcagaggtaagctcggagggcttacctctaaatccaaagtctattcctaatgtggccctcacatttagaaatagtgacttagtctccaaattctagaaaacatccttaaatgtctcagtcatattattaagttaaacatactcagcaatccaaataatggtggttactaaatcttagtttgttttctatagatggagttttgcatatctttgaatgaaatttctcagaatagtcatttctcatggatttaagagaccgtattttattttcatagagtatgggtctcatagcatttatcaaataaataattattgattgattaaatgattcttaagaaagtgacaaataggggctttacatcagtttttaattgtctgccttttaagacataatgaactttcaccattttcaggctttttcagaagttaaggtttataaaaatattaaatgtcatcaaattctttgataattagataattaattttaaaagaaaaccaatgaaagagagtatctgaaaagaatattaatagcttatttaatcatatttggcatcaggaaatatagattcctgaaattaaaaaatggtcttccacaataaaataattgaaaatgttgaggctatttctcaagaatctaatgaaaataatttcatttgctaagcacctataactaagcatttatgatacaatatatataattgtcataatcttgcagggcaagttacgttttcattacatatgagaaactgaagctcagattggagaagtaacctgttcaatcttatgtttctattcagaggaagcaagcaattcaaacccaggcccacctgattttaaattctgaatttaggaacttctaagtaaatagtaagagaactgcttttgaaatcctgggagacagattcaattcccaattttctgaagagttatttgattgttagcaaacgtgcttataatctctatgaattaccatattttcatctgaaaggagttatgatgattccaccttgtatgtttgttgtgaagattagaatggataatacatgttaaaacattaagacttggcatttatgtaataaatgctcactgaattattctaaaaccaaaatccaaatttcattctacttttttttttgagacggagtcttgctctgttgctcaggctggagtgcagtggcttgatctcagctcactgcaagctctgccacccgggttcccgccattctcctgcctcagcctcccaagtagctgggactacaggtgcccgccaccacgctaagctaattgtaatttttttttggtatttttagtagagatggggtttcagcacgttagccaggatggtctcgatctgctgacctcgtgatccgcccgactcagccttcctaagtgctgggatgacaggcgtgagccactgcgccgaccgcattctgcttttatataagcaatgtttgaattagtgaggatgcccaagggagagtaggtgtctcagagggggtatgaattctcatctttcccagcccagtcctgttctctctgtctcaggattgatgacagtataagagagaaaggagcaattagggtcagttcaggaaggaaggaaggaaggaaggaaggaaggaaggaaggaaggaaaaagaaaagaaagagaaagaaagaaagaaagataaagaaagagagagaaagaaagagaaagaaaaagaaagaaagaaagaaagaaagaaagaaagaaagaaagaaagaaagagagaaagaaaggaagaaaaggagagataacatgatcaatatagtctttgaactgctcacataccagtttcttaaatttatttatttttatattattcaaacctatagaaaagttgaaagagtaacacacggacatcatatactctatctgaattgaccaagtgtaaacctgtgctacattccctttctctctctctctccccctctctctctttctttctccacacacaaatatatttaaccagatacatggtaagatctaatcaggaaaaatgaagcttgggatatatgaggtatgtggaataatttaaaaataaataaagcagtgtcttattttctattaactccatggtgatggaaataatcaacgtattattaaattgcaaaaggtaaaatttataatacaggagtccctaaacttttttttttttttttttttttttttttttgagacggagtctaactctgtcgcccaggctggagtgcaatggcacgatctcggctcactgcaacctccgcgtccccggttcaagtgattctcctgcctcagcctccagagtagctggaattacaggcacctgccaccacacccagctaatttttgtatttatagtagaggcggagtttcactgtgttggccaggcttgtctctaactcctgacctcctgctccacccatcttggcctcccaaagtgctggtattacaagcgtgagccactgtgcccggctcctaaacttttgacaaaaattaaactagcaatatttgacccagaaaaatttgagttggaaaattaatagtttaaaaaactctcaaaatgtaaaatctgatgtgtatgtacaaaagaaaccccctgataaataaatcatgttggttaagtttatgcaggaaataaccgttgaacatgaaataatgttaaatgggaataggaaaataatataaattaccaaaccatacctcatagaaaattgtcaaggaaattcttgatttaatagagtacactccctaaattgttatctaacaaaattaatcaatgttgagattatgtttattaaatgaaggcattaatatagaattgaaataccttgtggtaaaaatggaaagtctgaagcatctgctcggtcaaagcggtagcgttaagatgccctgtataacaatcttacattttgtgtagttggagtgcagatacatttctcatttcttcaaaacaacgaaatgtatgtgaaaatactttgactactttggaaaacttacaaatgtgagttactaccaaaaagaattttatatatgcttgccaatagttttcagaaaacaaattaaattatctttgacacattgcaaacatactgaaaatgcctttgagtccattataaattaaggtatttagcaaatgccatattgtcttctaaatatataaaattaacaagcataaaaggcgacacactcactagaagattaattatgttataggtatataattaacaatctgaaaataaaaagtcaaacgtcttatcttcaaaattataaatctgtatttgtaagtttgttgccaagtgtttttataaagtctattgtttattataaatcatattctctaacatctcttcataaaaatattgctgtgcagcatttggttttagtcatttttttccccaaatgtggggactcccttttactaatccttctaaatcttcctgtctactttgtgatgtactttactcttttgtaagatgttgcataacctcaaaactgagaaaagctagttgacttgaggaataaaatcaaatatttttttcttattacattactattcattgactgctatttaagctatagactacacatttattagactaagatgtatatattttaatagatgggggaaagagagagagaagagggaggaaggaaatcaataggtgggtagaaggaaaaagaaatgaaaatatagaaagaccagctccagtgccagatcttattacattttttatttttaggtcataagagagcttctgatataaaaattggcttttgttaaatgtttgtttaatgtaccccatacatgtgctcacataactaggaaatatcaccccctatcactgggaatattttttctcttgaggttgtagattatttttgttatttatttatcttgctttgttttctctgaaattcctgagtctatggtttggtgtttgtcattatttttgaaaactattcaggcatgattacttcaaacatttatttgtttgtttttttctccttttagtatttgttttacattatcttttatgccatttgtaatctcccttctgtccaagttcttaatctttttaaaatttttatttttatctttgcatctcagtttgggaggttctattgatactgcttgtcattcatttacttccccccttagctatgttcagtctactggtgagcccatcaaagccatccctcatttgtgttataacttattttatttccagcatttccttttgatcctttcttagagttttcttctctgtgcttacattatccatttgttcttgtatgctgttcacttttttattatagcacttaatatattaattatagtaattcaaaattacagtctgataactgttcaattttaaatcctcagcctgatagtcctaaaagtttcattgtatttgagtctagttatcatggttgttttgtctcttcagactgttttttagcaggctttgcacttttttttgaatcctggtcattattatatcagattaaaggaacttcaataactaaacttttagcgtgaggttttatgtttttctagctagggttagactgtaattactgttggctctagctgtggtatcagaggttaaattttagctagtacctttgcttttatctccactcttgcccttgggtttccctagagactctttcctaaatagcatctaaagcttgccgttatttcagctgtaattctctgcactgtaattatataggagccctaaataagtcctcgcttgctaattctatcatctcagttatttgtgggtctgtttctattggctgctttttctcctagtcacagttctcatttttttgcttgtttggatatctagtaatttaagattgaatagtagacaccataaatgtcttgttgttgaatgctaaattgtggtgtatttattaaaaagctttttgaactttattttgataggcagttgttatactactgtgaatcctcgagttttctgtggttattaaggctggtttactactaaaatgaaatccccaactgaatgcttcaaatgttcaccaagtttttcttctctggcatagtggagctctcatgtcttccaggcctatttgagctctgaaaattattctttgcccagcctcatgtgacactcctatgcagatcttcagagcacattatttgagtaatgccattctttctaacactgtgctctgcaattccagccacttcagcctctccaaatcttatctttgtcttctcagcttagtgacacagtactttactacttatgtctcccctacctactccctgatctggatggaaagcatctctacacagaaaataagggctaccaaaaccttacttcatttatttcccctctttcaggatcatacttttgtgttgccaattgttcaagttccagaaagaggttttttttttccatatatttgtctagtttttcactgtttttgaaatactaattacggaggtaaatacagtgaggcttagataaattaagtgacttaaccaatgtaagttgcataagttgcatatctgggattcaaatctacatctcatagattctgacttcaaaactcatgcttataacactttcatatttatattgaattaacttctaagtatctgacttacttaatcctccatgtgcagatgtagtatgaccctcaattatgtaaatattttacaagaaaaaggcttgaaagaattcagcaaaatgttaaaaaatgctttatctagggaatggaattatagatatatttcccatttatattatctataataactaatattccagcaacaagtaagttttaattttatatattaaaaataacccttggccgggcgcagtggctcacgcctgtaatcccagcactttgggaggccgaggtgggtggatcacgaggtcaggagttcaagaccagcctggccaagaaggtgaaacccccttatctacaaaaaatacaaaaaattagccgggtgcagtggcagacacctgtaatcccagctcgggaggctgaggcaggagaattgcttgaactcagagggtggaagttgcagtgagctgagatcgtgctgctgcactccagcctaaagacagaatgagactctgtcaaaaaaaaaaaaaaaaacaaaattcaaaagataaacttgtaaaaattcaagctgtgttttaatgagaagaaaaaagtgttttcaaaaacatcaaaaatcaggtttatacaccttattattttatagatgatgatggcaatgtacaccatttctaaaagtctggtatacctgattaggtagcactcagaaaacatagcttctgtcacggataccatcatgcagacagaatgtataaaaagtgaggtctagagaagaacaggtgaagtgtttactcatataatctaacaatcttaaaccactataagctagtgtgagtatagaataattaagacaaagcttcaagtaattgtcttaactttaattgctatgactttggggatatgtaactgacttcctttgttggagtttcagagctgacatgatcacagctttcaactctcagctttgtctcatttgtttaacatggtggactcttaattatgaaagctgcaaattaattgtattgtgaaataccctgagaagctccttgtataggtgctatgcaaatgtagtatgattgactgatagatatgtacgtctcctttgaaaaaaatatgggctcttgctgagtgaagaaattaaactgatatcccccataactctattctactgcttttataaacaaccaaacatattttcctttttttaaaaaaatcttaatttagtaccttttctgtcagtgttctggaatgtaaataacattagtagcagcactgaacgttcctgtgtgttctgaagccttcacacagaggactatatttatgtgtacatgtataacttatttttttttctaatttatgaagctaaagatacccagcttggctattaatgtcaagcaacaaatctgaagtctcaccatgatgttgttaggtgttccagaattttcaggtgacagaggagctatttcttatagtgtttgcttttcgtcttactaatgtggacatcattgcagattatactgcagaaagatttttcaagtcacttaagatgaaaataacatttttaaatcaagctaggcacactgaaatttttcagttccttagcgattatttttggtttattgaattaatcactcaggtatcttaatgattttgaaactggatgtctaaaaaattgtttaccttttgtttcccctcattgagttgagcagatagagaacagaatctcttcctaggcatagtttaccccattcactccagaaatgtatactgaaacctaatctttagattcttgctaatggctttttctataacacgatattatcaataacttttttttaacatgacgtggtattgcttggcataaaataatcaagtaaactctatagaacactcacctctgttgaccatgctcacaaatctgagaactaaaaaatcttcaagccaattattcagaaattgaaagataacattaaacccactacactctcacataaacaagcgctcaacctagcaataaataatttatcagtgaatttactagcatttgaaggcaaatggtatgctgaaaagtgtggactttaagttcaaatagagcaggattggagtcttaacttcacttgtcaatagctggatgactttggtcagttttcttatctgtataaggaaggcaaaaatgatagagagagaataaatagatacagcagaatgtttgtaaggactggaaatactattaagctcacttactaaatttcctgacccataataggcattaaatagtaactactttattaatcctgggaattgtcaaagctgctttgactgaggaggtaaaaaggaacatgtaagaaggagcgaagtggtttctgtattatatttttgtgttaagggacttccccagaagaatagatttatcattttaaattctgttcaatctttctaagagttactgacgtttcctcactcactcatttgacaaattgagcacaaattattcattcacttagcaaatatgtattgaatacctcattccatcattaattccttcatttcttcatttaggtagtcagtcaggagggattctccaaaggacagacacttggccctgggagataaagaagattacataaaggccccggggaggttgcaggctaatgaaaataagattgatgtaacaatgtgcaatcacacattctcttgggatcagctctttccttccagactttcagtgaaggaagagtcaaggatcctcactttgggagctttactgattatctttttcccacgctgccctttatcaaatagagactggagagggtcactgtcatttctttagcagagctaattttaggctattatttaagggtttcttgtatttctgagaaatggaaaattatttcttccttttttcccctctgttcataaatacattttttaactaatggattttaaagaatagttttagaacagaaatattgaacggatagtacagagaggtccaatataacccccccacacacaatttcccttgttactaacatcttacgttattatgatgcatttgttacaattaaccagccaatactgatgtctgattattataaagtccatattttattcaaatttatttggtatttatgcccttctattccaagattccatccagaataccatattacatcgagttttcttgtctcattagtcttctcttgtctgtagcagaatctcagacatttcttgtgtttgatgtccctgacagttttgaggggtggtggtcagtttattgtaggctgcccctctgttagaatgtgtctgtatttgtcataattagactggggttacaagttttggagaggaagaacataaaggtaaggaacaattttcattacatatcaaggttaactttatcataatgatttatgacagatgatgctggccttgattacctggctgaaatactttttatcagggttctccactgtaaaattactcttttctcccactccatactgactctttggaaatgggtgactatgtgtagtccacatttgatgaatagagtgttgtgcttcaccttctgcagaataatgagactatagaattcttctacctgtgaaatgtgtcacttcttcctcatttattaatatttaataatttacttctgtcagtactgactcacatataattattttagactttgggttgtaattctgtgctactttgtttattttgctgctcaaattgttttagcttttgccattgggagacttttaagttggatcttgtgccctttgttatgcactcatcaatgtatggggtgttttgtgtgtgtgtgtgtgtgtgtgtgtgtgtgtgtgtgcacctgttagcactttcttatttactggcattaaagatgttccaggttcatcttgtatgtttcatgccctagtcatagaagcagtcatgtctccaaggatagggtcttgttattgaagaatgacatcagaaaccaatatctgggtactaggtgtgcttgttgctgctggagtgtcatttatttaggcgctctcagatgacagagaaaagaagtatgtgtgtctatactaattattatgtacatatatctataagtatttctacatacagctatttgtattatgttaaattaaacatatgatcttgttgttgtctccgactctaatccattaccacatggatcactctgctctcctccacttactgatcagtacctttccactccacacagtgctgtcccattttgcaataccaccagtaataaattagaattttgatttctcttaatctacaccagcatttgatattgtgtgtgtttttgttttgttttgttttttagccattcttacaggtgtatagtggtatttccttgttgttttaattggtaattctctaacggcaaaggatgtgaacatcttttaatgtgattatttgctatctatttatcttctttagtaagacgtctgcttatatcttttctacatttttaattggtatgtttattttcttattgatgagctttaagaattctttgcatattttgaacataagccttttatcagatatgcgttttgccaatattttctcccagtctgtgacttgtctttgcatttccttaacaatgtccttaacaaagcacaaggtttttattttaatgatgtgcaggttatcaattttttttccaataaacggtgtttttggcattaaatacaaaaactcatcactatatccaaggttacctagatattctcctctgtcatcttctagagctattatagctttatgttttgcattttcattgatggtccattttgcattaatttttgtgaaagatatgacttctgggtctattcattttataacatatggacttccaatcgttccagtatctgttaaaaagacaaatttttctccactgtattgcgtttgctcctttgtcaaagatatgctgactgtatttgtataggtctattaccgggatctcttttgttccattgctctgtctattcttttgccattaccacattgcctcaattactgtagctttacggtaaatcctgaagtcaggtaatgtcagtactccaactttattcttcttcttcagcattgtgttggctattttgttttgttttgctttccttgtctttccatacaaacttagaatcattttgtctatatccatgaaatagcaattggggttttgattgggattgacttaaatctattgatcaagttgggaagacttgacacactgacagtgttgagtcttttcatccatgaacacagactatttctccgcttatttcgatctcttttaattgattttatgagattgtatagttttctgcatgtaaattctgaaatactattttatataaaccctagaatttcatgttttagtgctaatataaatggcattgtatgttaattgtggaattcaaattccatttgttaactactggtataaacaaaagttaactgactttgatatattaacattgtatcttgttgccttgctataagcacttattagtgctggagttattttttgttaattcttggggatttttcattgctgcctgggaacaagtattatttccttcttttcaatctatatacattttttttgccttttcttgtattattgcaccagctaggatttccaatacaatgatgacagtgagtgataagagtaaacatgcttgcctttttccgctatccaaaatgaaagcatccaatttctcaccattaagtaggatgctagtgctacattttttggcagacatttttatcaagttggggagcttcctctccattcctagttcattgagaatttttattttggataggtgttgcatttttccaaatgctttttttggcaccagttgatatgatcatgtgatttttcttctattcattagtggatttcatgaattaattttctaatattgaaccatcagtcctgcatacccaagacaagtcctattttgttgtggtgcataagtctttttaattgttgctggacacaatttgctaatatttgttgaggatttttccatttgtattaatgaaagatactggtctgcagttttactttcttgaaatgtctttatcttattttggcattatggtaatttggcctcatagagtgaatttaaaaatattctctctgcttccattttctagaagagattatgtacataaagaagaaatgtatgtacatcaagaaaaaatagaggccaggcgcagtggctcatgcctgtaatcccaggactttgggaggctgaggcgggcagatcgcctgaggtcaggagtttgagactagcctgcccaatatggagaaaccccatctctactaaaaatacaaaatcagctgggtgtggtggtgcacacctgtaatcccagctactcaggtggctgaagcaggagaatcgcttgaacccgggaggcagaagttgctgtgagctgagattgtgccattgcagttcccaaaggacaaaaacgagcaggagaaccagagttctagaagtgaatttgaaatgagagctgagggcaggcaaggaaacaagcaaggagattaggaagagttacttcctttgcttaaagcaaaacaaatacatacttaggtttttatatatacataggtgtatgtatatataaaatgtctttatatatacataggtgtatatataaaatgtctttatatatataggtgttgtatatataaaatgtctttatatgtacatatatgtgtatatatacacatatatatttgtatatgtgtatatatacatacatatttatatatacatatacgtatatgtacatataaaatgtatatatacatatatgtacatataaaatgtctttatatgtacatatatgtacatataaaatgtctttatatgtacatatatgtacatataaaatgtctttatatgtacatatatgtacatataaaatgtctttatatgtacatatatgtacatataaaatgtctttatatgtacatatatgtacatataaaatgtctttatatgtacatatatgtacatataaatgtctatgtgtatataaaatatctttatatacacatatatgtatatataaagtttgaaaaagtcagatatactcatttaagaaaattctgaaaatataggcaagaaaaaaggagacaataaaatcctttttatacttaatttctcccccaaaggataactactcttatttcagtatacatatatccttcctgtctttattctacttttaacataattagtataatacactgcatatttgtttgtaaatttttttaattcttaaaaatataccatgaacatatatgcaagtcattaaacagtcctctgcaccctcatttgtaatgacaatgagatatttcaatatatatttatagccaatctcctattggtggacatttagtttccatcaattttgtttccaattttttgtaatcatgaataataatgtaatgaatattcttgtggctgtattttgcttacgttcatgtaaacttcctaagtatatttttagaaaattaggattattggtaaatggaacactatgtaaaatactacgatttctaaatatcttgccagtttctcaagaaagattatagaggggccactgtcaaagaccagggacctgccctaaaagttggcctcttttaatcttaaagacacactccgaatctaatgtcaaacattcctttccatatagtttttgaaaatttttttttcaaggagcatagagtggattgttacagtgctgtttctaaaattaaactaatttaaaggttcttaaaaatcatccaagaagaatatatatatatgtatatgtatatttctggaagcaactcatcatcctttccatcccagtctatcaccacctctctcaggagacccacagttcttacttttaagtaattggcagtttacagtagagaaggatttcaaatctaagttggaactgggctcaggaaaaataataagttgtttgtttcctattttccagctgaccttggagcccatctctaagcttctactcaaatttggaggcatctcaatatgttttaaaaagatagtctccgtgatttcaccttttgcctcttatacaaaaaaaaaaaaaaaagcatctattgactggttgcaagacacattagttccttaggtgaagaatgtattgctaagcacatgttatacaccctaataaggtttgctctcattttgtacctggttaattcatgcagggggagcaaagcatggtgatttagagctccatgtctgtggaaagacagactttggttcaaatccttttttttttttttttaatttactgtatgatgttgggcatattacccaaactatcctaatcccaatttgttcatctacaaaatgtgaacaactgtaatcgtatgtttgatagtgctatagcatgatttaaagaaaatacttagcatggagctaacatataatatgtgctcaattcatgttaaataatgataaaatgataaactgttaatatgccatttcagtctctttacttctttatatgaaaatttatgattccaaactgagacaagatcaaacggaataaatttgaggtaacacaaggcccacctacctataccaaattatcattttctctcctaagagcagcagaggtatttatcgaggcttagtattatttattaataaaaaattatagacaagctgttagtgaactgctaagtgcagtatcatattcagctctaccacatcttgaaatagtgggcttcaattcatgtttcatgtgcagattagtattcatattatttacattaaaaggagtagaaattggtagtaaaattcttagagaatctttggacaatggtcctttcatgtctctgttcataatcttggtattaaggcaatttactaagccttatttatgcttcaaacattgtattttagaatgtactctcatggatatttcctcatttgctcttcctgtgtactcattcttatttctagttaatgtaaagagaacactgagtctcagagaggttaggtaacttgtattcagctctataaaatttgcctgcgtccttttttttcccccaactgcaggtgccattctgttaccactgctattataaacaaaccatttgtggcttttcaaagatgtcctccccaagggaaagctgatataggcatcatcttattcccattgggctgccatcacaaaatactgtagacttgtaaacaacaggaattggcttgtgaacaacagaaatttgttgttcacaagttctggaggctgggaagtccatgatcaaggcaacagcagacttagtgtttggtgagatgtctggtgagggctgatctctggttcatctagctgtgtcctcgcatggtggaagagaaaaacaagctccctccgatctattttataagaacactaatcccactatgaaggctctatcttcatgtcatagtcccacctcctaatactatcaccttaggggttaggtttccaacctataaatttggggaggacacaaacattcatttcctagtagggactgactgcaaggacagaatcatgactccatttacaccactcagagtaaaataaaaatgttttctctttttccgtaacagtgagattgcttttctacagaactcatgaatttatccatattgtattgccataggacaatcttacattccaagctctttgtatgaatatttcaaattggggaaatgaaagcagctagctgaacagtctgaaaatgtagcaaaggcattctttgctggttttgttattctgcttcactctctttgattaaaactggcccactgacaggatttcctgaaatgaggttcaagttaataatcccaaatacaagcatcttaagaaactcattctctgtaccagtctttagttaaaaacttagtatggcttggatttaagctgtagataatgaggtttaagaaatccaggggagaaatacaagctttctcaaatagcactagtaataaaaattctatttatgggctaaaggtatagaattgaggcacagtgtgcttctactagtgtatgtagagctttaatttaactcgaaatcaggatgaactaggtcagatggttaagaagtgtattctctgtcttcagataaaattaataggatgctccctttgtaaaagcataaagacatgacaggatgaagtaaaagtccatatttatggcaatgcgtattccagaagcacgaaaccacagcagaggaaaagaaaaaagaaaaactttgcttttatcatctagtagtatttcacaattgtgaagaatcacatttcaggcaaccttcatttagaaaataggaacaaaataagaaaaggcttttgcaatgctccttttgaaatacaaggttcaagaatccctcatctatggtctgaggaatctttgaataagagaattgcttcatattggttttctttattgagatttgcatccaagctcaatttttgtaaaaagagagaggggagaagtgtaaaattggagtttaaagggaaatgttgccagaaacgactgatatctgtagttaaaatgataatggcaccatttgttttgactctgtaacatcagtttcaagagatttaacgataatctccattctgaagaccccttcaaagatccaccttcctccatggtgttctttatctgattaatatattaacttttcattttaaagagatcatttatcttgaagcaaaacgaactcctagtaaatactgcattgctagtatcaacatggacaaactacacagagtctaaaaagaatgctgaagccacagtaggagaaacagtctattagtgcttttaatttagtgggtggcaactcaaaggaattagaaggtagatcacaataaattagcgtgctctggaactctaagtggaggagaactggcaggtaataatttagttgaaattacccatctaaaggtgagtatcattccaaaaagttaattagcattgttagcagctgcaagctgggtatttagctcagatggcatatggaagccatctgtcacaatgcctggtacatagtaagcactcagttaatgattattaatattattttaaaatatctaattttcctataccatttccttcagtttggagagcactgtctgattgctttcttccctactgaaatggtactagatgattaaccacgttaaagaaaaaggtcctccacacccacacatccatgtctcacctgaaagattcctgcccttgtcatgatgaagtgaacatgactactatgatcaaggttgtatctccatagcagctaggacattaaatggtgagatgcaggaaatttacacacactcatgcttgtgtagccgtttcattcatagtgtggagatctgatttcagtgtataaatgattcgtaaatcagtttgtatcaaatgcgtagtcatatggatcccttaacagagagtaaaagacaaatacatgtgaattaggattcctggttttgaaatgatagtaatcacattataataatcttaaaatatttttattaattgaacactcaaacatattgtttaataggtgctaggcagtatggtaagcatgtgacatgaattatcttaatcctcaaaataagcctatgaattgtgtactattactaattaccatgctataaatgagaggcgtattaatctattcttgcactgctataaagaaataacagggactgggcaatttataaagaaaagaggtttaattggctcacagttctgcaggctgtacaggaagcataacagcttctgcttctggggaggcctcaggaaacttacaatcatggtagaaagtgaaggggaagcaggcatgtcctacatggctggagcagaaggaagagagagagagggaaggtgctacacacctttaaacaaccatatctcacaataactcactcactatcatgagaacagcaccacggagatagtgctaaaccattaatgaatgatccacccccataatccagtcacctcccaccagatccccaccttcaatactggggattacatttttacatgagatttgggcagggacacagatccaaactatgtaaagaagattcttgcttataaatgtgcaacaaaatttagctaaggatgagagccacatttctctctttactacatacatagtattatactagtaaaccttattgtaattgttattattattattaacacagaatggtatctcttggaaaaatacgcttacattaaaacattaaagctcgctactaaaataattttgtttttcattgattccagtttttcccacccactgtccatttaggatggcttcagaaaagagaaatggtgtcaaatctgaagcagtttatttagtgtcttcataaaaaattctgggatgaagtgggaattgctcattaaaatgcatacatatttttaaataacctgtgttttgcatttattctttctgcctctgtaccttacattaccaatgataagcaagaggaacatggcattcagatttagcagttatataactgagctgaaaaaaatctcaacatttaattaggaactgtgaaattgtataaacctgcttcacttttctcccattaaaaactttgttaacacagactattgccgcaaaatgcatttgattagacttttcttatttaaaaggtttttatcattattttttgataatttgttgttttttcttgctgtgaggattctaaaatatctagagcacacactataatagccaggaggaatccaccatatcatgtaattcaatcacacagatagaaactaacctagctagcatttgaactgaggcattcagaatctatttgtcaggtctgttctggatgaatacagcaggaaaatgactcaaaatgggcttaagaaaaaaataatatattggctaactgaaacgttcaaaaaggttgatgcttgtttgtttttcggggggtgggcatcaagcatgccttgagttaggtgtgtgaacaattccaagtttctttcctctgtgttagtttcggatttcagagatgctttctctatttggtggaaaattattgactagaatcttggcgtttatacctcactgtctcaaaaaacctcagtggaaagagatctcctcttcaagagccattctgcaagcagtcctggaactgaatctaattgtctctggttggtttgtcttcatccccgtgtttgtctagtcaaggtggctatgccctacaagcctcttatggcaagacctgaattatgtgctctcacctaatgccagaggtgtggtcagcccaactgaaatgagatggggaggattgggctttgtaaggaaaataaaaatgcaggttaaaaaaaaaaaaaaaagcaaacacatgtcctctgcagatttagaatccaggacattaattcttgtaaccatcttcaaaatggaacaatataacttttaaagcccagtactgtaccctgaatcttataaccttctccttaattgaatgttttatcagacttacaactccaaacacaattgagaaagaagaaaaaaaggaaagaaagagagaaggaaagaaagaaagaaagaagagagagaaagaaagaaaaagaaagaaaattctagaggagtttctttcttagtgagattttcttgtctcttttaagtctcatgtctcttgcgtttcttgccttttgctatcattctggtgtgattgtagctctgcagagcaataagttctcaacatatgttcacaattcatggtttttcacaatggttctactactaatttttttttttgtcttatatgccattcatgttcaattctctagacttccatttggatgtgtgtctaaagcctatataaaaatactataataagaaatacttaaggtttcctacagttggtattttaactaaagtagcacatgattagagcccgctgggaattctaattaattgaatttttaagaggcagaacctgaaagtataattttttgcaagtgatttattagatgagtttttagaaagaacccaaaggaaaagagggaagtggggcagggaagagatagtagccaagctcggtatactgtcaagcaaagttccacagaaggtaaatttgattcaatcctatagctctggagagaatacaggtcatacctagagttgtctcacaactaggagcacgggagctggagaagttataccctagaagccagtcatttattggttaatggctgctcctgggggtatgtaaattcctaggtactttcagttctctctttgtgaagataaattagctataacagcttgaggacagtgtccaaaaagagataacatgtactggctcttaagggtacaaagtacataggaatctggggcggaagagggattagaagggacgtgagtccagcactgacattttctgctacattactcgtctaagaaaggtgtatctaaataggagactccatttcttgtatcaaagggaaaaaatgcttgtccagtaagactttaatgttgtcactgagttatttttctttggacaaggtggaattctctttacacccacacaattgggccacttaaaatggagatccacttttgtaaagtaacaaatacctaggcttcaagggaatgatctaattaggtttgtgcaaaagtaatcctacttttgccatgacttttaatggcaaaagccgcgattacttttgcaccaacctaacacaacagctgtgaagtcagtattcctttgaattatactcatagcttctacttcaagaaaacctgaaaatgaatcccagctccgcctctttagctttagaaaagtaagtgaaattatatgtacgtattgtacagatacatagtacttggtactctgtattgtacaggtactgtgagtctgcataatatatgcatataaggtagctatttgttgtaatattattacaattatcataattgtcaaaatgttcagttacttaggtatttagttatgttaaaaaatgacttctgtcttcacaatcaatataaataactaagagcagagggaaaaatacacaatttttacttatattttgtctgaatgttttagattaaaagccttttcaattggatactttgcatgtatttgttataaatctcagagatttgctgtcataaaaagataaaggatcatgaattcagacaaatattagagctctatttttcctttgtaaaacaattttctcagaaaatttttattacactggtaatgcatgctcattgcaggaaaataatgaaaaccagaaataaacagagagcagaaaataaaataaaataaaataaaataaaataaaataaaataaaagacatttatatcacaactacccatagataaaaacttcacatgcaatacatacaacatatgcatttttaattgaataatacctcatatcctataaaattcactagacattgtgaatatctatgtgaataaagttccttctagaatttcgttcttattggttagtatgccataaaatgaatgaaaaagaacatcagttatctgaggttaattgttgccatgaatataccaatttactgaaatgtcaacttaaatttgtggcaagtggcaaggctttttaaaaggacaaaaacttagtatatgataataattattttttacttaaggcaattcaaaattcaagttttcactgtaattgtatgttaattctgagaataattgaatcaaacattgatttagggcacattttctgacaaatatgtttgagtgcatatgatttttatccttgtgctttatccttgatgtacataggaggataataattttttccaataaaaatgtctaaggcttcataagtgttcttgcttgaagcttctactgagacatcccaactttctgcagttgtttactgctcaaactctccaaatctttatttgccaagcactttgcatgtagttggatgagcctcccacattccttctgctgacttgaagaaattctgcctcttcttcaaggtttaccaattgactttgcaaaatgacttactaccattattattaatttgaaatataattagaatagaattattcaaatcatctaaaaatctataagggaatgaagaatgacttgacaagaggaaaggagagatattaatgtgaacagactggggattcattttacaattcattagtttagtagtgaatattttccttctggaactttgcttgcagcctgcccgttcttattttatgccttctaaaccattaatttctaaattcatcccttattgttaaacacttagtttcatttattataacatgtatttttgctcctttgaaagatacccatattagactaaaaataatagatatgagaaagtagacgaaattaatattaataaagtaactttatttacaagttctttataacaggggacaggctgcggtgtaaatccatctttgttttacttttttttaaatcgtatataaatgagtactttttttgaggatcatagagcctatttaccagttcatatgggtctgttttatagtgctgttttccctggataatttacctcacccatcccatgtcttcagttacctattagtaccagtttagatctggaatactttatatttttgccttagaaactataaatatatatataaagcctgcctagtcttaaatgtcatgttctcacaaagaatttccttgaccactataataaattgacataatcttgttactatctctgcactctatttcttttgtttcggttattgcagtttgcaagtgtacttgtttttattatttgtttatggtatgttttcccactagtctgtaagcaacataagggcagaggacatgtctattttattcaccactattttccctgaacatagcacagtgacttgcatacggcaggcacttaataaagtgttaaataaatgactgattgagtgaatggcgaatgattgcatgatctgaaaactagtcataatacaacagattgatagaatatttttcttgagagttatttgtatggatgctcttcttttattttgctgtcataaagattaaaccgtcttctattctaatgaggtgtaactgtttagtccagtccccgatattagttggagaaggttggacgggagcccgttgccagggaaagtcaagtacagcaaatcccaagctatccttgaaatcccgaacttccaacaagaagatgaaggcttttatgagtgcattgcaagcaaccttcgaggaagaaaccttgcaaagggtcaactcattttttatggtgagctaattggatttcaaatatatataaaatatttggtaatgcccttcataataaattgtggaagtcattagcatgttgtgaaaaagtgtcacgggagaaataaggaaggcatatttccgggtttagatgcttaacacaatgattagcagatgggaatgaccacctttaaaatatggttttaattttagcatggtctatgaatgctattgtttattatatttgccttcaaaatatcagcagtgtcatgttaaagccataaaagtttataataaaaggaagcatgaactccatatatttcccattaaacgttctgcagcagattatagcaatcttgattctaattctaagtagaattaataaatgaaaaaaattgataggaaaaatataatactgcatggtggtttataatatttgttcctagttttcatattttgtctactcataagtaggtaatataaaaagaaggcaattacattatttaaaattatgtttgtctcagttacaaaaatctctcgtaaacttaagagagacgatgaatgcatatattatctaaaagctgtctttgtgtcttctttaatccaggattgaaattttctcttacttaacattaagtaaacaatacaatatatctcagaatttgcaaaatgctgtatactattaaaagatccttaacttctttgataaacttaatgtatctgtattagataatttttaaaaagtattgatatatggccaaaatactttcctatgtgacatgtttataatcaatgataaagtaattagagaaaatatgtgtgtatgtgtgtgtgtatgtgtgtgtgtgtgtaataactagaaaaatccaggatactgtaattatcccataggaatgttgattgagtgcccgtggggagaacatattgtgtgtctgtaatattattttccattttctttagaatttccaactttaacctgcaatgaatactactattttatatatagaatataattttctactcattattctcctacagttttagcaaacctagccaagaaaaacaatattttttttcagtagtacctacactttaaaggaaagtctttggaatttagtatcctttgtaaataaaataggatacaaatgggagttttagtagaatgaagatattgaatgctttggctagttttaaagaaatattttccattttatatataatagacaaagatataatcaagggatgaaccagaacacaaaggtatctgtaaactggaaatcaataataaagtacctttctgtatactgataaagcaaatgttagcttacatagcaattttacaaacattcacttatagaattcttaatcttaagaagtagaaatcttaagattaatattaagaggtagaaacaatgttcagtgatactataggcaaaaatatcttaagttaattgtgcaggatctcacagatagtgattgtcagattcaagatcagaaccttgaaatgtcttctgaaactgccatagcatttcaacatggtggtctaagctcattgtactatatctcaccacaaccaaattagccatttaattagcctgaaatggtccttgtaggggaataatggatacttagtcaataacataatcattatgtttcttagtcacatattaattcactttctgaagtgctttcaaaagaaaagaggattactgactcagttacctcagagttgaataataactgagaaattcaagaaaagaatctctcagtctgttatattgctgtgtttaagttataattcagaaccaagtaatattgtatatccatctatatcgtaattttataatctctaaaagaaatctctaaagtattattcatcatagaaaatagaacatgttcagaggagttaagtggcttttcataaccagtcaatatggcagaaaaaaatctaaaactcaaacctgtatggtagacccaaaatcctaagcctcttctcccatgaatttcctacctagttttaaatttaaaactttgctctccagaattttaatcatccaaagaatgttcacgttgaataaataaatgtgttctgtagccgcaattattgcattaagcataaaatcagatatatctgaaacctttgtaagttatgtgaaattacatatgagcatgcatttattttcccaggtcagacatatattaggacaatttctaaacaaatacttatgaattatataattttgttaataatacccagaaacatgattcaatttcaccaatagatctagttcttctaagttttgccttgatttgtccctcaaggctgcaggaagcacattctgtaactggaagttgtcctgattcctgcaagaggtaatcctaggcttagttcccaccacccagagacatcatgatttcttttactcgtttgtagtctcattgaagggtcttctgtcttggtgaaggcaggttgtgcagtagaaaaactctagaagtcagacagacttgcgttttatattgtgcacaatttcgaatcctctcggccctgcttcttacttcagccactgctacggtggccagttcagcactgtgcgttgtagatgtaacctgaaggagtgttgtctcaggtgcaaaactaccaagcacatcttgttttctgttctgggttttctttggctccttcgtgagcctactcagcatttaagcatgcccagtttggatgtgccagtagtttacacctgcactacccttagatgaccatggatgggaactaaatgatcccccttcatttccctgggtagacagctctaaagactgcttagaagttgacataagatggagaacaatggatcgtgttggtggtcaactcaataactcagccttgcattgacttttttttccttcccggtgactacctttttttcctgatgcttttcccttgggctaacattctcaaatgaacatgtggaactcaagccctttacttaggttctgcttttagggttcaaattttggcttccctgttttctaccatgtcatcttgaacaggttacctaacatcgctgcgagaatccactgaaagattgtagagggaattaagtgcaattacaaatataaagcatctggcttgccacagcctgagagtccaagggaagcgtcatatacttctgtatatccaaggacagaactaaataaaggagagggattaattggcacctccaggcagtttccagtcagtttatgaaagagatattcatgtgaaaacatttaatttccaacccgcctgtttccatgaatgatggtaaaaataatacaatcttactttcacgtcaattatgccagtttcttgttgtctcactactatgaagaactttctcaaattaaagaaaatttggaaaactcacacccagaattaaagtaagatactgaacctgtataaaactccaaatgttcaccattccttgtcaagaattttatctaggaaaaaagaatactggattatctttctaccaaaatgccaggaagctcatgtttgatttatgcttcaaggtattgagttgtaattgtgtctgaaacagatacagatttattacttttagtttagagcaaatataatcagtgaactttcagatttattccacaggttcagatttgatatacattttctaacttgacctatgttctaatatttagcatggatttattccctggccctgttctacattttgcccttttcccacagctcccaagttgttatacaggtggagcaaaatgacagatgacaaacatttaacttgagccaaatgcccaatgatatttgcaacaggatttctgtcaacccgcattgaagctcctgcatgtcccctccctcaaatcgtgtgtgtgcaatccaactggacccagttagccttgtccttctgatctctacagcccttgtaatgtagcataatgtcttggataactgccttttaccaaacagtggcacttgcctttttgaaacagctcctccagaatgggaacagaaaatccaaaatacacacctctctatctatgacaacttgctctgggaatgtaaagctagtggaaagccaaacccttggtatacatggttaaaaaatggtgaacgactcaacccagaggtaagcaactatgttgatattaaaagtttacctactctactaggtaaattttgttactaacagtactagtaactaacagaaacagctaatgttaatggagtctttggtatgttccaggaaaggatgcatacactgatttatttaatccttaaataaacttacaaagtaacccatctttcaaaagagaaaaataagtgtagacaagacaaataactttcacaaaatcactgttagccagtaatagattcacatttaaatatcatcatcatcatcaccgtcatcatcgacacggataacacttactgaactctcatatgagccaagccctgtgttaaatatttttccgtgcattatcttattgcaccctcatgaaaacattataagagagatacaagtattattcctttatgtaaatgaagaaaatgagtttcaaagaggttaggctacttgtttaaggtcacacagcagctagtaaatgttagaattagcattttaaacttttattttggtctgatatcaggacccaatctcttagtcactacccagtattttgcttttatgaacactgacgactgtctttaaacccctaggaaagtaaataactaaggcagttatccacatttctccatttaaagcatactttcttctacaatacctagaaaatgaaagatttgttttttacctattaaattatccagataattgtgtcaattctccattttactttgcacatgtaggcatagccagagacacaaagaacatctgttgtttggaagctgaatataatgctgttctttgtttcagcatcagtgaaattttcttcctgcatgccttttgcatatagcattctgtttcctccagcctattttccttttccctagaggatggtaatacatgccttgaaatatttagtcttaagttatatttgtactattaattatgtcactatgtgcactcaaaattgtatttctataccccacatggggttctgtaacagattttggctgtttaggcacactttatagtagtttgtagaaaggaaggatttagctactccaactcaagactcaattagaaaattatcacatcatcacatttcaaatgtttttgaaacttttggaaaatggaaagccaaggcagtgttctagtcatgatatacatgtctaacattattgttaaccgtgttttcctggaataattaggacggtggagtattccaaattactatgtataccaaataacagaaagttaacatacattttgtgcaaagtatgtcaattgtcaaagaaatgagataacataaaacacactagtaaccactaaaattatcctaaacatattttcgttttttaaacttaaaaatgctgctcagaatctagtagtgtattaatacaccaaattatcagatctcatagatatacacaaatgttgtttaataacatatcctggttaagagaatgctatattaacgtacaagcatctttatatgccttttcctttattaggagagaattcaaatagaaaatgggacactcatcataacgatgctgaatgtgtcagattctggtgtgtaccaatgtgctgcagaaaacaaatatcagataatttatgcaaatgctgaattgagagttttaggtaagtcgtttatttacaaccaacaaattcaaaatgacgttttaacaagctataattatgcataatcccaacccaattttttttgtaaattagaaattgctgtcccatcaaataatgggaaatgtctaaattaactttttacaaaattcaaggtggtaattattattctgcttgggcaatgcactggggcttcagaaaaaaacccaccattgggtgcatccaaaccggaggaagctcttccaaagctgattctagcatgaatttttgagtataactcaaagaatatctttaggaatattttcagctgcaaattaaaaagtaataaaaaaatcacaattcacagtaactaaaagaaacagtaatttattttatctcttagcaagaggggcattggctgccgggcatggcacctcaacttgacaaaatcctttacaccttcccttcagcatcaaagcctcatggttacaagatggctgctctagttatagaaatcaagtctatgctcaaggcagaagagcgaggttacagaaataatcacatttatctcttttattagaaaagcagaatttcccttagcttccatagtaaactttttatgtcattaactagagttctgtcacatgaccatccagacatcaagaggaggtagaaaaataagtccctatagtgaaaagtgctgagattaaagcaatttgagaatgatattttgggaagtccaaccagtggtgtctgccacaataaatgacgcgttgatagttttcaacccaagggtttcttagtggtaggaagaacagaggagataaaagagaggaaggatcaaacaacaagacacaaagttttatgagcttatgggtgatgagcactcattcatttgctcattctttctatcgctactgtttgattgaacatttattatgtactgagctgtatcaagatgaagtgatctttatcttcactcaacctataatttcaaggagaaaaaagtgtcagatttaaaatatggcaattcttatggctaagaattgaggagttgctatcgttgcacatgacaagttgaacataacctacattgaggacattccctttaatctaagatcagaagtaaaaacatgcatcagtaaggtgaagggtagagaagcaacatctgaaaagcccagaagcaagagagcatggcatacccgaaagaacttcagttcacttgagctttagattagaaatggagactggacacatggattccaacattcatgaagttggaaagattcagaggcaccctgatagcctaataatttcttgtccttctgaactggcatttgttcaacatatatttagtggggaaaaaaccgacatagtgatacagcatttctgatttatttcaatagtattttattgctaatagcaataaaatatttctgatttatttcagttgctaaccacaatacaataccactgaaataaatcagattggtatatatacatatataaatcacatatatatgtatatatgtgtatatacgtatatatgtatatgtgtgtgtgtttcttcaacatcatatgttccattgcttatatacatatataataaatcagaaacacacatacatatatacatgtatgcatatacatgtatatatatggatacacatgtatgtgcatacatgtatatgtgtgtgtgtgtttctgatttatcatatgtatgtatatgacatgtatgatcattgttttggctggaatagactttcctggtcagaattaaaattccttcttcggcctcttttgaaaccatcttcatcctctttgttgtaaatgctattagaaaagtgactttgtctaacttgcctcctctctaccacttgcttttattattgcaatgaccaccaacaaaacaaaaataagttgcatttattgagcctatactttgcgccaggcactatactataattccctgcaactgttacatcatttaatctccacactaactctctaaggtaatatcttttgtcatcttcattttacaaacaaaacataaactctaaaatgttaagtcagtatttggtccaagaacaccttgagcaaagtaacctgaaaagaggatacagctataaatattagattctgtctagcatagcaagtcacccctggagtcactacatgttaactgagtaattaaacaattttgtctttgattttgtttttagcctcagctccagatttctccaaaagtccagttaaaaaaaagtcttttgttcaagttggtggggatattgttatcggatgcaaaccaaatgcttttcccagggcagctatctcttggaaaagaggaacggagacccttagacaaagcaaaaggtaaacaaatctttatttttaaaaatatttttgtttgtaatataacatcttccaaatttttaggttttagtaggcctttcaaaatttcctcttttatgataaagtctcattggcatacctagagacgccagcattcttctcatcatagtaaaattgtaaaaaacaaaaggatcttataaaataaagacctgtttgtataagttagctgcaatattttcagtgcatgcacttgtaatagatttttaaaaatcttttaagacctttttctacattcagtttgaaggcttcctcctgaaccagcctgctgagaaatcagtgcgaataacatttcacaaaggagagagacactcattggcacacacctggtgttgtggtttttaaatagtcacacaggtgttcaccccatgacaaaatgaattcaccacatgaagaaatgtagagaggttcctgtagagaaagaagagaggtttcctaccataatggatacagttgagaaaccctaggtcagcactggcatgttttctaggagactttgacaaaagaaaacaaacaaacaaaaaaaaagacgggtgtttttctctacttgtaatatcttttattctattgtaccgtagagccttgtatacatgaggtgactagaccacagatgctgctctcttttaatgactcacatgtgttactctataatcagatatgcaattaaatcctaatgtgaacgagccattgtgctgaagatatgaaaatagtccctttcgttcaatgagctcttcttcagcatcatatgttccatgacttatatgcataccaggatgggcaggtaaaaggccaggtgaaagaaaggacaactaaagtgtgttaaaaaatgacagttgttactcttggaagaaatgactgtgacggactagaaagtgagttccctacctaaaaaggatagtcacaactccaaattctgtcaactggttgccttgcgggaaatgagaactaggtttgtagaacttccaatgtttcagagaaagctagaagtctgcattctggtattgaatctcccatgccagaaaaaagtagccataggatgaatgaagggacatcattttatcacttctaatcccaagatttcatttgtggccgaggaaaaaagaggtgaaaacaaacaaaagcaggggtctctgtggtttgtgtagagtccctttgtggttataactgctgccttgaagatccattccatttacacaatgaagtgtacatcagagagcccctttctagggcattctttctttccttattctctgcatttctttacatccctggactaaagcttttcccaggacaggaattatgtcacatttatctttgtatgtcctgtgccttggcacagaaccaaaacttaataaatatctgtggaataaatgaatgaatcaaaaagggtgaacatgtaaagcgttaccagctttacagaaaggctgttcttggggaaatccctcaagacataggaacaggtgcttcagaactaaggtgaaagaaaaggtgaaaggaaacctgttgtcctgactcaggttgggtctcttcttctgtgtgcattgcctaggagatttgctcccaacagatttagatgtgaattctttttaaatgtttcctcatgcattcctaaaatctaatcaaggtttgaatacactgctgtggaacagaaaaacataagagatcctgcagtatcaaacacagcaccttgtactgagggtctggacaaattgattaactgtgcctcatttaataaagtaactcacccaaggagcagaatgatggcatttaccttccacaagctttaaaggtccaaacacgaagtatgtgggaacaagaaagaaaattaggaggagaatttgagtaaagctaagataatgagagagagaaaaaaaaaagctaagataataagaaaaaaaagcaggagggaaactgctttttaaaacagctcttcaggtttttgttttattttgttttgtcccatacagaataaatttggggtcattttcacctcaccacagttactaataatcatatcagctcagcattgtctctctgtgattaagggaatgaaccctgtgagttctatttatacattattctttcattctatcttttcattgcttcagggtttcactgcaggtcttaacaaaagaaaacatacatacaaacaagcaaattatctccttactgtgcattcttaaaagttgaaaataattgagctctagcagaatgtagtaattacagtcactacatctccacccggtagagattacactgagcagtaattttcaaaaggtcacacagttaactccatgagtctatgtccctgcacactttctagcttgtcctttcttctgttgccatctgatcgactggctttattaagtgcatggcttcaagctgtttgttgagaaatacagcatctatgcttctgtttgtgtcagactattgccttttttatagtcttatcgtgggacttccaaacagattgaggtaaaaaattagagtagtgataagaaagagagaaagaaaggaaggaaaaaaggaaggaaggaaggaaggaaggaaggaaggaaggagggagggaaggaaggaagagaaagagggggaaagaaagaaagagagagaggaagcaggaagggcaagaagggtcactgctgtttactatagacgtggtgtgatatagtaaaaagatttcagcccccaccctgttgagagcctgactttggcaaagtcatttgtcttctatagaacttcatatgtaaaatgaattagaggtacttcattttcctaaaaaaggagagaaagtcaaatggtttcttcaagcctgttcaggcccaaggttgattatttcttctacatctttggtctgaaccattacgtggtagccaaattcttttttccctgatcagaaccccctcttctttttcaaaagagtattgacagaacagatcctaaatcctagcaaagtagctacatttagctttcaaattgtcatggctttaagaagacaatattaacgaaagctttggagaagacaacatcaaaatagcagttaatttcacaaaatatgttttcttacatttgaatacataaaaaagtttatttgattgagtatgtatgtgtgtatttgtgtgggtggggtgtgggtagatgggtacctaggaattggcatcagatttccaaagcaaacaaaattaaatatattaggagccagggacagagtattgcacataaaggttgactgggcaatttatttttagatttgattacaaatgcaagggttattgcatgtgtacatacactgttcaatgctatatttgaaaggagcactagagataatgtatcccattttccgaatttacagtgccagatcctaaactcaaacacagaacgctgagcccagtacacattttttaatgccacaccagactgattatttcactcaaatagcaatatatacataacttctaccatctcatacctctgttaaaacatgacacagttgtatatatatgaagaataaaaaagtcagatataggaaaaaagttcaaaattttacaatgattccaagtagaaatggtttctagttcttgaccttggaaatacctatgtgaggaaatgtacatttttagtttctgttgtaaaacttctatatggtactgtctactttgaaatttcattgtcactaactcttgcagccaataaagtataactacctagagatggttgagagggctctaaagaaacctattcaaagtaatcagactgaagtgctgacttataaaaaaatggtggcagtatatatattttgacaatttcttctagtcttacatgaattgaaacagcttccatcacacagctaataagtgaagaagcttagacttggtgccaagtcttccatctctgtattcacgtcttttcctctctatggataatggagtacacgctcagctcttcagtttttgaaaggctgttgtcacatgattcaacgtaatttgatgtgttgataattcagattaagttacatttctcaatacagtgaacatgtttcttattagcctatgtgccataattgaagtcttggctgttttaagagttctgttcctaaagcaaggatctgtatttatagcagcctgtcagaggagaaaagtgtttctcgaaccaaaaataggtagatggcattacagagtccgaagactgcctggtttcctgctgggaatgaatggtcatgcaacatctgtctcattctttttagacccaccagtggtttagaaatagcacttatattgaagagaagcaaaaggcatattcctgcaggagaaccaggaagcactgggaattagaaaacacgggttgtggtctcagatctatcactgataagtggcgtgacttgagtagaaatgctagactcctctttttattttttttttttttttgaggccactatttcctggatttatcttaagatgaaataatatgaaaacaactttaggaaatattaaacactatattcatgcagtgtctgcttgcacagagattacattttagaaatcaatagagaaccttagcccaaggggttgaaattgaaagttctatcttagttataactttatatatgttttaatgatttgcttgggtgaccaggtgactgagccaaacacggcaattgctgtgaactgtcaaaacagctaaaatgatttggttggatggattcagagtttacagagagccctatcagctaggctgtaagctccatgaaggcaccgagcaccattctttaattcaccattataggcctagcatccaccacaaacctggaatatagcacacattcagtaaatattttctgtgttgctaaattaataaaagttaaaatttaatttgtttaactaattttagagattttgcagctaagccaaaaattttaataattaatagaccgatggtatgattattcatttattaatttcttcattcattctgcaaatatttgctgaacacctattataacctaactgggtgctggggataaagtgttaagccagatagccacataacatataacattcttcttgccctttcttatgataatgtttttctttaaagtgatttgaagtcaaagatctgggttaaagtcccaactctatttcttagctgataacttctagcaagtcctttaacttcacaggttctcagctggttcatttcagagaaaatggtacttgtctctctgatgaggttataagagactcagattttatgtccggaatgacaggtgagctgtacacacactgctacattggatgtatttgttgctgtcatcgtaacttgtatgcatatcccagttgtgcatgcttttacctctggcagccaaggaacaaccacggaaaatcaggatgaattacagattaagtttatctctgcaaggcattctcaggcaactgagggaatcaattccacatctgctaagtttgattaatcacttctttttttccttgtggatctacttagcaagtgaactgacagaaatcaaagtcctagatttgtccccttatgcccagtgactgctgtctacctattcaggaatcacctcctgaatttaataggaagtgttaacccactggagagacagttcaatgttgttctctgacaggcagcattaaatacaattcctgaattacctggggtttggtcatagcggacatacaagctatcaacaataaaaacaaagagatggagaaaagaaatgttgtcctattattggaagaataccattatacaattgaatctggttgggtgcagtggctcatgcctgtaatcccagcactttgggaggccaaggtagaaggactgcttgagttcaggagttcgagaccagcctgggcaacatagtgagaccctgtctctgcaaaaaaattttaaaaaggaatggggtggaacatggtggcacacccctgtggtgccagctaatggatgggggtgggaacgggtgttgaggtgggagaataacttgagcccaggatgttgaggctgcagtgagccatgattgtgccactgcactccagcctgggtaacagagggagaccctgtttcaaacaaacaaacaaacaacaacaacaaaaaaatccctgaatctttggtaattgacagcattttctctcattttccttaaaaaaaaagcctactgcactttgcccagatttcttaaaatcaaataaataaaataaaataaaatacagctaaatgtcagaaaaagtctcattaataatgatgataaccactttaagcaccttctacatgctagatggtgtaccaggcactttacatatctcaaaacattaaagcacatttttttttcatattcagatatatttctgaggatcacaattgtcaccgattatatgattaaatttgtatcatttttaccctagtaatctcaaaaagttaaacacaaaggcatttttaaatttacagagaatcaaactgactcaattacagagattctaccccttagcaattggtttcagaaagtgattatattccccagaattgaaatgagcggacagctggactctctggaaaccaattccgttacctttatctacttactccaagtatatatatttgcagacaggtgttatcaaatcatggattctgtgtgatttatcctacaataatgctactgttaaaacctgtgtggccctggacacttggcaaatgcatgtaccttgtgggaaagagtgaacccattaggtgaattggagtcttattcaattattgaacaagcggtgcttcttcaatatttttgccttcaaacctcaaatttagagcagacccactgcacttccacctgcctggctccgcaatgcccagacaccttcctcttggacactatattccattgtgggaaaactacacaaggaaggtataaagatcgtagggaaagtggaaagtggaagaaggaagccaaagtaagagagaaggaaatggtagagaaagaaagatgagagaaaggaccagggaattccctgtgacaagatagaagtgctacttattgagcaagtcactggatctttcttttcttcatgggtaaaatggtccccttgggaagacctgtttgaaagccgttagcataatgcctgacacagacaaggaacagaaaaaaattagtttgtctttattcttctcattgctaagttatgtggacaaagcagttcttctagttacacagccattgcccaatacttagctatcattacattttcttcttggaggtttttccaatcatctgatcttgtggaggcaccagctaatgggagtctggctgcctgaatgcaagacagccaattatatgattcttcctccctgtctgacacttctctacatattttacaatatctaccttctaaattattactgttccttttgcttttgcctttacccccaagtgctcagtcttaataaaatatctccgtcgcacatgccttttcaagacaacattaaccattatatagcaactgcaaagcaggcttctctaccccttcctcctctttgcagagcttcctaatggaacaagcaaataaacttaattttattttgtatctccaactacttaatataatagtgcttagtacgtcaggtagcatgagtatcaaacaggcaaatgaaccatatgttcccctgtttaaggaagaatgacagtctgcataatgccaggcttattacaatctcccttctgtgctgcctctttgtaataaaattttaaattgttcatactcaactcctgagagccttgttaaggtgagcctttccaagggaatacatgttggagatgtcaagagccatctgatagtcttgcctgtttcacatgaagatgtaacaagctaaaatcctgtgtgtgcccctgtcagtcttgttttcattttcccctcttgccatccaattcccctttctttatccccactgacctccactgatctggggcactcacctttcacacagtgcctgcagaaccacccagatgccatggtctgaaaaagctccggttcattaaagttataaagcctgcctttaaatccagcctgcctaactcaatgtacgctgttttaccctgctgccttgtgttggcctattactgctgtagtccctctcccatgttttcgtgacaggtaaagccacccttggtggctttcaaccaagggtaaataggagaaaacaaagaagtttcacaaaataaatagcatcttataaattattaaactgtgtcttacaacagaaaatgggtaggcttccttgtagagtggctgtgaattcatgggctgcgatatcagtcagtttcaaatttgatcatgcaccataagaatcttgtgaaaaatgcagatcccagagccatgcccatgattttgatttagtaggtgtggaataggttaaggaacctgaatttgtgtaagttcactccctctgccttcaagagaggctgaagttgttgaataccacctagaggagcactggtttggtgcacacatatctacttagatagaaatgtgcttcattttatctctgttccaccccagaactttgattcctatcctagcagttcagccattcattctatctcactgttgaagagatataaatccttagttctcccctttttgaaaatgtgaatataattggctctagaatggtgtccacttattttacctcttgcttctaatttctgagtgacacttgtatcttcaaaattttacataaatattcaacagcaataattttatagacagaaaaggtcaattattcatgtaatttatacaaatgaccttttgttcttggtttgatttttgagaaaagaagtggttacttgataaattttaaagtataatgtccttttttgtttacttaaaaagaaaatggttgatgacagatctttgtcacacccacaccttctaatgccagtgagtgtatttaaaaaaataaataaaaataaataattagaaaaagcattgctgtctatgacaatccagtagaagaaataaaagctggagtaatagtatagaaatcagtctcattaaaaccttccaaacaagcagtgaagctgtcagagcactcttttttttttaagccactgactagaatttttcaattttttctttttttcatagtagaactttttaaattttttttcaaatgaaatgtatgcaagaaaacctttcattccacagataaaattgaactaatctggctaatgtcccggagggagaaccagaaccccactcaatgccctcctcaatccctctcaccctaaatctccatggtgtgccctagaaatcccctagctctccaaggagcatagtttgaggactactaatttgtagtgacaaatctgattctcaagtgtgacttgccaaacgattcatttatttataagtatagtggcaaaccaatttgacgggcgttgtgaaagattctgggtttataacttgaatgagctcagagtctcctggggaaggcagacaagcccacagctccggtgcagtggggcatgtgtcaccactaacatgtgaagagagtgagggcaattcactaacttggcttacaggagtctagaaaggtttcaacaggttgcaggtaactgaactggcagttgaagagtgagtgggaatttttcctggaagagaaaagtgggaggtacaggcttattacgagactgtcttactgtatatttggtatccagacttggtgtcatttcagaattttgggtacagatttcccttcctcaatacaagacacacttctcccgtgagtcctctaaatgcaagtaaagggtactcaaatcattttgcaaggcatccaagaattgactctttgactactcaaggaatgcttggatatacctaataacatatattttaattctatctccaattaaattaaccaaatacacccataaatctatcctccccatatttaaccatgagtttcattatataagaataataatgatgatgatatatccatttatatgctatccatcaagggcagatagtgtgttaagatgtttgatacatcatttcgttaaatttttacaacatacctatgagaggcatttattcatatttttagatgagtaaaactaaggcttagagaagttcagcatcataccgcgatcagtaagtgatagaaaaacattcagttctgagaagctctgactcaaagccttgtataatcttaaacacaacactgcaggattttaatgagatttctggtgtctatatgtggaattcaaggcagtccttcataatatacacatttttttgtttcttcagagttatactaaaaaaatcttctgaaaatagtgatatgcaaggtaaaactctatctttatgtcactaaaaggtatagaataagtcaacatgttgtccaaatactgatagatggagtcttatttattcacatcaatacaaaaatatcagttctttcagtggcacagcatcgtgaatacacaatgttcggaagactgattggatttttaacgtaacatacaatgtaatttttgatggcatggagaggtagatatgtaaattcagtaagcaggttaaagtcgctaagccccacaaaggaattaaaataggtataagactgtgtattataactaagaagaaagagttaaagttagcagacaaagagtcacacccaggttggtcccctattctcagccacttttgtaaacctaattttgtagactctgaggaatgctataattcagtagccaaagggaatccaggattggaaattccactagcatccatcactttcaaaaccatgttctatcttgatactcaagttttcagatactcatgtcctgaaatcatcagattacagggagctggagtgaaagggttaataatcattagcgttccagccctgttctctcacctttttatatgtgagggaagccgagaaccttaagtttcaagttggtggtttaaggtcatctgacttgaatctcatctgtctatcccaaagctttcagcagaaacaactttacatttataaaacttcaaagccctgaggaaatcacacaataggttcatagtcataaatgtaataatagcataggcagaatgtcctcacaatgttcagacttctccattctgttctgcataactctctcctctattgtattttcaatgtgttctcctctagtaactttgggagcatagtttgttggttttttttttttaatttatttctttaaagtcctgcattcacacatttttgtgtcctttgccaacttcatactttctagtcttttcttttgatttacttgggctataaggcatgttagcatatgaatctatgttaattctcttttgtgttttctcaggcatcccaaaatgctgcagcgaatggagacactttatctttcccttcttctactgaagagctaaatatttctctttggcctatttcactggattaatttagttaggctttccatctgatgctgttttgttaatgttaaattgtatttccttaacattttatgggagtcagcatagcagcacactctggcatgccatcagaataaagacacatcatggcaccaaataattacgctatttagcaactgctcttacctaccatctcctaatttgtgccataattcagtcaccgtgaatctgtgtttgtgttgcgtcagccactacaaagatcacacttaaattttttgtgtatattaaacaaggtgacacattatgataaatttagaggtctgaatatttgatgcttcctttctgctttggagtttaagacagttgaaccaaagacttaagatggaatcatttgttcactccagtaattacgcactagttgtaaatacaattacagacactaagaattctgaaaaagtagaaacgggcaccagtaacgttctcatttaaattaaaatgtatttgagtctatttctaatatctaggtaacccctctgaacaactatttgctaataaaaccctttcagttaactacctaaagaccctgaatcatccttgaaaaatcagttaatgggaagtatatccttagctatttaatagttaaaaatatgtatttctcgattttgttgaagagttgccaaaaaaaagtaacataaaagtactcaggtctatttcttttgtttgtttgtttgtttgtttgtggtggagtctccctctttcacccaggcttgagtgtagtggcacgatctcggctcactgcaacctccgccttccgggttcaagcaattcttattcatcagcctctggaatagctgggattacaggcgagcgccaccacacccggctaatttttgtatttttagtagggaaggggtttcaccatgttgttcaggctggtctcgaactcctgacctagttatctgcccacctcagcctcccaaagcgttgggattaaaggtgtgagccaccctgcctggcctgtctgtttcttttataagcacttgctttccagcaaaacatagcaaattggatttatttgttacctgtttatgatgtcacttcatgtaggttttcatttttgtttcctttcctttccctcttcctacggcccataaatatttaattacactctgcctaatataactcaatacagctgcccaaaggaacactattatttgcctggagctaggacagaggctaaaaaaaatactagagatcttattgcgacaattctgtgaatcagatgaatatttaggaaccaccaaacggggtctatattgttataataattaaaaacattttactctggcttgtattataccctttagtttcatgatcagaactgaaaaaaaataatgattaagatttgttttatacaccaagtcttatcctagtgatttgaatgtagagttgaccgttggacaacggggattgaactgtgcaggtctatttatacttgagtttttttcattaaaagttatactgactgtgcctgcctctcctgcctctcctttcacctcctccacctctttcacctttgccactcctaagagagtgagaccggacacctcctcttcctccttctcctcagcctactcagtgtcaagatgatgaagaactttattatgatcctcttccacataataaatagtaaatatgttttctcttccttatgattttcttagtaacatgatatcttctctagctgactttattgtaaaaatacattgtataatgcatataacatacaaaacttgttcatggactgtttatgttatcagtaaggctgctggtcagttggagactattagtagttaattttaggaagtcaaaagttacaggtggaatttcaactctgtgagaatgttggcaccccaacccctgcattgttcaaaggccaactccatttctttgcatcaacttttgtactgctttaaggggcatcagcaaactaacagaaagtcacttcaatgatcaaataaccacattgtttataagtataaagtttatactccttatttatacttataaataatgtggttgtttgactaaatcgctttctgttaggggactgaattgattgataatattgacaaatatacatctggctctagaaacaaaaggctgaatatttaacagcaaatgcaatcagaaaaatgcatatttattaagtacctgctaactgttgggcttcttggagaatataaacaaataaagaatattagctactaccttgggacacccattatgctctaggctctctctctctatatatatatagcataatgtatttaattctcaaaacaagatgatgatgttattactactcatatccccattctatataaagttggcatagaaatcaagcaactgctcctaaattaacatggccaaaaacagaaactcaggcacatattcaaagtgatctgactttagagtccatggtcttataatccctgtatcacctgcctcaaacaaaccttagcttttacagcatatttggagagcaaaaacttatctaaaaagaaaattaaaagtacaagacagtaaaatgatttagataatgactcagtagaaaaaacactgactccgtatcagaagacctgtatcggggctgcggttaagttagttattgaatctccctgcatctcagttttttgatgtggggagaaagcatatcgtgaactctagtgactggagaaggatgtgatagagaaagctgtatatcttggtggggttccgcaggaaacagtgctcagttctgcttctcagggaggtccacctgcagggcagcaatggatgattgtatcttactgcacacctgctgcctcacttcaagccatagtcacatcattggtagcttgacatcgtaggttgtcagctacataggttgcttccagacaggctgtatagagaaaccacttgggaacagtctgtggaaggaaagaaaaagggattaatttacctgactgcccctttgctggtggagctgctttacctgaacctttgacagtcagtggaactgagagaacctaaaagatttcataaggtgtgtctgaaacactgggaatcaaagaaggttttggagggtgaatgggattcagataagcagattggagagtgaaacctctgctagatacgaggagaagagagtttaggcttttgtctggcaggttctgtgaaggagggtactcaaagaaagatttgcaaattataaacatttgtttcctctttgggactcacacaactcttccctgaaaataaatatttgtgttctttccccaaagtcagacaaaataaaagagatgaatataatatttaacagtcctttctataaattttcctgaattttttgatatgtgtttcctcttgttcagaactgattaacaattgtctgtgcctgtgctttgctgaaagtgtgatctacgttacttggtacagtggccagatttaggtttgtttcctctggtccctcgatcatgtctctcttgagacagtacttcattttcacttcatctctgtctcttttgctttttttcatttttactacattgatgatcttataaggactgataaattaggttttcatcaatccactgattaaatctttgaattttgcctggacaggggtatcagatgttctctgtgtttaactacttatgtacaattactttttttttttttttgagacagggtctcacttagtccaccaggctgtagtgcggtggcacgatcttggcctactgcaacctccacctcccgggctcaagtgattctcccgcctcagcctcctgagtagctgaaattacaggcacgaaccaccatacccgctaatttttgtattttcagtacagacggggtttcaccatattggccagtctggtctcgaactcctgacctcaagtgattcacccaccctggcctcccagtgtgctgggattacaggcatgaaccaccatgcccagccatacaattacttataattaaagttactgacataaaatgatggaaaggacaacctttattttgatttaaatgagcaaactttgtaatttacttgtttgtagattgactttttatgtggtttgttaaaataagaaatttttaaaagatagcttattaaatgacagtgacattagcatagatattacacattaactataataattgggtgcaaaaatcattaaaatgcaatattaatatttaatctaaaacagattccggtgggacattttaccacaatatcagtatttgatctaaaatagattccagtgggagattttacctaaaacttaaattgtgaacaggaagaatttatacccacatttctatttcttatctaactcattttaataaaatcaattttacattttccaaatatcagtaaaattagagaatcaattaaaatttcatggtctacagcattatctttagacagaactggaagcaatactccagttaataatctaactataaaaatagcagtattgctctagtttcagcaataagaaattataattgcccgatgacctgattttttttttttttagtttaagaaatttagctatttctaatcctctttgtcctcaaactttgtacaaagttatggttgataccaaacaaaaaatctggagcatttcttattttccattcacaccttggaatctacatgtacagatctgttttctgtatgtaaataaattaaggattgggtagatattagatttgttatagtgacaaaaaaggatgtgaatgttaatctctattgtattgaaatagtttagttaattatgaacaggtattagttcatacaatgcaggtgctatcgtttggatatggattgtccccactaaaactcatattgaaattttatcttccatgtggcagttttgggaggtggagcctgtttgggccttggggacagatccctccttaatgcattaatgccctccctctgggttgagtgagttcttgctctcttgagaatagatttgttcctgctctcttgggaatagatttgttcctgctagacagcgttttaaaagagtctggcttcctcagtctctctctcttacttcccctcttgccatgtgacctctttgtacacaccagtttctttctgctttttgccatgagttgaagcagcctgagaacctcaccagctgcagctgcccaaccgtgagccttccagccaccagaatcatgagccaaataaaccatttttctttataaattactgagtctcagggagtctgatagagcaacactaaatggactaagacaccggaaaaacgagggtaaaatattccgcattagtctcgatgtagttccttaaagtaacacaaaatctgatgcacatgctgcgggtaaagaagccctccaagtggatgtgatgtgatccttctccttcctggtgttctgttcataatgacccatcaaatagaaggtaataggtacaaagtcaggcaaatgggtaggacatctgttacttttgttttctgtgtaggactacctaccttccctgacagtgggaagattaaaatgtcgcatgttcagctgctctttaaaaatctgccttcaacttatcagttaaacttgaaatatttatacgttattggcttagttttgtacatgctctatattctaaagccactataaaatctacccagtgtcacttaactgtcagacacagcttgttcttctgaattttgactcataatgcattagaggaattgcatggtacaatacaaacgctattaatttttctattagttgaatagtcatactatatctacacatataaatgcctttaaattctaattttacagaacattttaaatgcaaatgctataatcagtgatttaattatctaaacagaatattgaggtttggtaatttggggaaaatttttctatttaattgtgtgaacagttaaaatattctaattaagtggatattagagaataaagacatgagagaaatggcgttatcactaaacttattgaggaaataaggaggaaacataccaacaccgtaagtcaaatgtcagaatttggtgatgccaaaaccaaggagagtctggggactgataaccagagcttagttaaagccacataacatgcttctgagtccagccataggcaagaattttaagaagacattaggcatgagcaacaaacagagtgagaatcagaaatagtaactggagtcttggaagagagaaaatgtcaaatattagtatcagctaagaataagaattagattaatatctagcatttaattaacttttacagcaatcacattattattcctaaaataaaaattagagcattgtagatcaaaaagattaagtagctaagaacacagacaagaggttgcatgaattcacggaagggttttaagcagtgaaacttaatgctgaggacagttttgctggcattagactcctttcgaaaagcccagatatagttctcaggcctctttgttcaaaatgcagtgtgataaaacaatttcttctttccttgtttattcctcatggagttatagatatgcctacattcttaggcaggatgagaaatcagttcattgaaagcctacctattgactgctaatggagtccggtacagtgctaagcattttgaacgatttatatcaattaatcctcatgactctgtgacacaggtaatattagtatttctatgctatagacaaaaaaaaaaaaaaaaaaaggacttgggccattagttaacttggcccagtaacacaaaaatcaaatgttgggattcagattcgatcataagtagtttgtcctcaaagcccaagtttttatccactctgctaattacaccataattgcacaggatggcacaagaaaagaggaaaaacaatccttagtattagcatgaccattattagtacctcacgtgttaagatatctatggttaaaactctcttccagagcaggggaacggatattaagcctgtctttaagatgccacataaactaagaatcttgagaaaatgcacatacatgtacataaatgttgcatcacattttagagagttattagactctgaaggtcagattttaaatcttcaatattaaaggtcattctatgcaaataaaattatacatacatatatacacacatatgtacatgcacatatagcttaaatttatgctgcttttagtaactctgctattagtaaactatattttggaagtgaactaaaacggaacttgctaaaataagtgttttctggtctgaagaaagatatggttagaatctgagccctccgccatctagtgggtaccttgagtcacttattgcttctctttatgcctgtttcctgatttataaaataggggtgcaaacaatacctagcccagaagtttgtcttaagcattcgatgagttgacatttattacacacttactagagggcctgtgcagaaccagctccctataatatgtcatagcctccataaatttataacaatgagttttaatatggaaaagagcacctttaacatctaacactttttattttcgcatccccattgtaacacctaacataccgtttcaaacacagtagacatttagaaagtatttgctgattaagaaggaaaaaatatcttaacattgctccagtttcaatcatgtatttaaactgctgttgaatttttggaagtctcccatcatttcatggtgctcacaaatttccacacatatttttatgactcattatatattagtagtataacttcaaccttaaatcctcatataataatatacatataatatgtaatcatggtattaccttctgcttttttccctgtaactatatgctttgtactaatcattcatgcaaatctctacttttattatcagaatatttttcctgctttttacagatagccaagcttatctattcttctggctgtgtgtgtttttttttaaatgccagagaagcatatatgcaaatgaaggtagaatattttaatgtcgttcattgatatgttattaccaatccttgagataaagtatcttttttgcatattgtaaaagaagaatagaaaaaaatcagtctctctctatgaatgttaccaaaaccatcaattaaaatgttccagttaattcttacatgtgcattttgccttatctgaaaatgccaattgctcagtgccatttgatcttcactgagtgttccttcttttggcttttttaaaatcatttctgctaagacgtgtttagatatgttaaaaaactggaaattcttttatagtttttgtttaattttttcttaataaaattaagacaatgatcaggttgtttaattctgtttatattgtcatgagattaatttttttaccatattttaatatctcattaattaaaggagaaatctaagtgatacattcaaatatctgtactgtttgttatgccataaaatctttagttatgattaaatctttgaatgtctatatcctagatcaacagagagaacttttaaagtttattttaataaatcataaatcaatttggttactagtttggctatttttataaaacatttaaaatgtatgttattattcttttataaattattttcataagatcataagtaagatgtagtcttactttgaagtaaagaaaaaattttcagattaaagtttaatagtaaatagatcagtacttctcaaacttaattgtacatgctagtcactgtatgtactacagtgcatagggtgtcttgtgaaaatgcagtttgattcattaggtctgggataagaccacattttgaggagtaaacacatggaatatctttagggcatctagtgatgactctgctgaaacttcttggaccatataattaacatgcagaattattttactaaacgtaaggcaaagtaatggttctggaaaaagcctgagtactaggataattagatataacttcattctctcctacttagctagttagtctagggcagattttaacttttcttagtttgctctctcagtaccttaaacagtagtaagtacttaagaaatattgatgtgttgattaggatttcatagaaataatcagcctcaatgatggcaatttcaactcgatttagcaaacattgaagacctactgagcctgaaaggggtagtatactcagggtaccactgcacacttgaattattcctttctggaagttatgtgaaaaattatatgaaatatagacattggcattgacttagtggctggaaaactttcttggtggcctttagatatcagcagacctatcatttctgtcatgtgttttttattggccaatagttcaggtttctgtgttgctcaatattcctagttattcctaaatgttaggggtagatgcacccaaaagcttctcacatttacctcttataattcaaatcagataaagaattatatttggcctgagtttggtgcataatagaatagttttgttactctgtcaataatggcataattcaattgttaatgtaaattgggatctagtacactagacatctcagaaattaaataagacattaaatgtctgctatgggagaatactctaagataatgactttaaaaaatctgattatatgccatggaacattctaaattcagatgtggctccttccactcactgataacagaatttggaatctgttattaataataaatccaacgtcagaagctggcttcctgcaaattgtcgttggctggtattctctgtgtttcaaattgagtaattaattatattagctacattttgtgttatacatatattagaaacaacgatatgtttgcaatgcagcaaatactattttgttattgttaatggatatggcatgcatgccaattgtctagcctttcttgcctttaaaactgttgttaaaaattagtatgttgtcacacattttgatacaatcttgactacctactaatgtttttaaaaggttggtaactacatttgtaagatataaaatatggtagcctaaaattggacgaatatttttgtttttacattttttcagtctcctcttattacatttgatggtgaatttttcagggaacaaatctcagggttttttttttttttctgatttcagtggcattgtgctttagactatgctagagtttcagagaaaatttaatatggattattttatgaaagatgggaacttctttggcagatgaacctcctttttgtactctctcttttaggaatattaatattaattcataattaacccatgaagccttattctttctacttcttccttcctctttttgatgggatagccacataataagcatggccctctggccatggaaccatatagatagtttcttcaactcatcagcactggcaaatactgtcgtggttcaacaccccattctgtggccacagaaaatgctgacagaccacgtttaaaaagacacagactaattgtgaaaattagcttgcatttctcctaagccaagttcaatttttgccagtgagttgactttggaaaatacagagtaaatagttgcatttcttattcatcaagcaacttgacattatactaccaagcactgcttttatttttaatatgctttgaaatcgacaatgataattcaagttatagaatgataattatcaatatcgtgtcagaataaaagcaaatgccatttactgtaatatgtagactcagagatagctcacaatgaagaacagaataataggaaaggaaaaaattcatattatcacatacacccatgattttagtaaagttttaaaataaaaataagcacttatgatttaccagtgttgaagagccttacttctattaatgatgtattttctttttagaatatttctcttggaggatggcagcctcaagatatataatattaccaggtcagatgctggatcatatacatgcatagccacaaatcagtttggcactgcaaagaacactggcagcctcattgtaaaaggtatcatattatcttcatttgtgcttgatgaacattgtaaatatgcaggcatattatgacttgtgttatggtgtcaaacctgtaccatattgtgtatgtaaaattgttgatttcacaagttatctaagagatccattcccgtactcattaataacatgcacactttgccagtgggataccatggtagatgtgaatactttggcaattgaaaatgctgtcagagtgtcattcgagttaaaacctacacctaaattatttggctttttacataagccttaatgttaggggccatggacgttttgataaagtcactggataacatttttttggtcaaatatctttcagaatctttatttttatttgaaatatttacatgtatataaggctaccaaatacataactggctaatttgtttatataactccaggtacaaaactaatgaaatgcagggtcacaacctttagtaagcagttcttttcaaagagaaaaaattaaaatctgtgtgaatcattattatattttcatcacagtaagcagataaactcatacaatttatagagataaattctatactttacttttaagatttctaaatcagtatcaatccaaatgttcctacatttatcaccaaggacataattaatattagaagtatctattccctttccttgctgctttattttgttgaatctcagctcataaaactagtgtgtttactggaagctgtatcacttctatcatttcattgcctcctggatgataaaaatggctctcttgataaagcagtttaagcagctaattaagcccaaatgattaaaatcagcatttggtgctttctcatcttttccattaaaataaatatattcaataaaaagtagttagctgctacacttcaaccatcctttaaaatatctcaaggaaaataaacacccacctttgagcctggaagatatttctgccaacttgtctcaagcgtattacattatgacgacaattgtctgaagtattctggggaaatgtgactgataaaacttggtgtgtcaaaatccaaccagtatggcatattttgaaaaacttctcttccttaagattgtattgtcatcaatttttaagacagagatggacttaagtgtttcaagatagatgttatggctatatttaggaacagactatttctccagcaaatttttggcaatactcagacactgaaaaatgtgaatgctttatatttggaaaagtaacaagttcattaacgggaaaaaaagatatttattatatcatttcaaattaagaaggtgtaggtagtatgcaaattttattacagcagaagattaaaatgtggtgaaggataaaaaggcattttgcagttaaatcttctaggtatggaaaaatccagagggcattaaaacgtgaaatagaagggatagaaaacatcagcagtagcaatgtagtttttaaaagaaagtttctttagaatactggtgatctgggaggagggccaatggttttgctgttaaaatacaatgatggggattccttcactctggaggataagaaaaacacaagttaatggtagattgaactgaatgaataggcactcttcctccagtgtttcttaaactttgacatcataatattcacagtccactaataactgatgaaagaaaaataaaaggtgacggctaacaaaaatactaactgagaaactcggaagccactggactgcattctggatgtaacatttgcatatttcagatgtgtaatatagccatgttttctgcaagttaggttcctagtacttatgatagaaataagtttatctacactttcaagtattccataaatctaaccataatccccagctactctgctctttccataggtaaaacaataattaatcaagatagctcagttaacaaaaaaaaaaaaaaaagcctgacttacatttttgtttgttcatttctagtgctctttgctgaggttgttgaaacaaaattatcccactaggcattccttgttaccttaatcagttccactctttcttcttctgtaccactttttatcttcttacgaactgtataactgacttacttattatggttttttttcttgtcttttcttcccttctagaacagaagcataaagagggcagggatttttgttttaatcaatgatgaatcataaatcctagaacattgctgggaactgtatgtgcccagtaaatatttattgatttaataaaatgttattatcttatgcagcttagttcatagggatatttttcatactggcttccttgctctaaaatcggacagttttcaatttttcagggtctgagcttcttaggacactttgcaaaaaaagaacatcaaagaaaaaaaccaacctttttacatgcattcactttctaattgtagggtttgtaatcttttatttctgacagacatcgatcacctcactctcctaagggggtacaagcctgaacctacatcgaaatccaaaaattcgtgaagagaattcattgttttggtatttctagcacagtacaggagaataactcacatatacaaaaagggtacatgataacataactgatgtcactatgcctgattatcaagttactttcatgcatttacacctaataatgggaaggaaattttgctatattttaaccttcatgacacatccacatcccattttaagtggactttggggtcttttgcttctttgtcattaacaagaactatcctatgcaatataaacatgtacatacttaaccacacaaatacatataaataaaataaacacaaaatgtgtgtacagtatgaagaaaaacagccttagaaagttgctttattatttatctgtaatgtttaatctttatgaaattgtgtgactgtcatacaagcacagttctaagtctattattaccatgtcctcttaactagactgttatctctaattccctttcatataaaaatgttgaagacatcactgccaaggaattattattttacaacctacaaatttgaagcctagcataggaaaaaattataatagtgtacatcaattcaaccattttcttgactattgggtgtatagtcatctggttgtttcttaagatggcttaatagttgtgtatatatgtatgtgtattttctcatcagtaatattcatatgattgctgttacagaatcaaatataattttgtttctcaagccaaaatcagtgtatagtgaccttaagagtaatagagtgttaaggagcaaatgagaaatctcagtaaagctgataaaacaatcatctccctttgaatttacttatcagcctctgtcatgcaagaaatgttgttgttagataacatggaaaagataatagttacaagagtgagatattttccagcttagtttttagctgatatggcttatctctgttaagaggattctgaagttatctgcactgtatgttggaaatttctatttcactaatacagcaggataaggcgattttccattcaaacattgtgagtgcaattagcagcagcttttccagcgcctcagaagatgcccagtataatttaaggacatgtttcagaggcacaaacaaggaatcaagaggaaagagagtttacgtgttttcattttggaggactgagattaaaattacaatgtgtacatacactaagaggtatatgaaaatcacataaaaggagaaattatttgatctggcatttggaaaattattaaaaagcagagtaacagcaggctataaaaatgatcttgtttgcaggcaacatttgtttttgtttccccactggagaagttttggatgttcaattataggcctcattgcttcagtgttattttcaactgaaatgtcggaacttggaaaagcatatctaatgtgcaaattaagtttattgctgctcatttagttgtttattcttcgtgatagaagtctttattataccagcattacagagtggcctatccattttctccagcagaatgatacgggtctaagtttactaagagaaatgcccaagatatgtagataattggaggcttcgtggctctagaaggcagtttgaaggatttgaggtatcaagctcagctttattgacaagcccagtttgattgagcagaccaaaagtacactttcagagaaatgacaagatgtattggaatacatttgtcatatcgtagtacttgaaaacaccagagaagtctccagcagcactaaaatctccccaaaaatgttcagttccacacgccactttcctacacagaatgactgaaagcatttcaacagaatgaacatttgatttaaaaattagtgatggtaaaaattactttcaaggtgagaaaatatataaggagttattatactggtcagatgaaaaaatttcctgttccaatattgaaagtgatgctgcgtgaattattgaaacgtgaatactacaatctcttcaagtaaaaatgtaaaaacaagcaaaaacacgcatcaatttaagcaagcccactaagatcaatgttgtcttggtcttcatgaaaatttagttcacaatcttttttaaaatgcagcatatgtcactcagattaaattaccacatatgacatatagctgtgttttttcttaatgtatattttacaaaatataatgtaaaggatagatgttaatacagcataggttttaccacttttttcaagatatttttactgcatagtttaaacctattattggtcaaagttttgtttaattttgataaaaatagggggtgtatagctagtggtttatgccagttgaaggagaccagacacagaagagtatagaactcttactaaagtggtcaatacacagcctctggaattatattaacctgccattactaactaacgtggaacttgacgacttagtttttatggttattcatcttgttttctttattattattattcattactatttgttaaatacattctctgtcctaggcaccatgataggttctttgtgtatatcatctcatttcaactttcagagtaatgctttgaagcagatattattatctcaattttatacaagggagattgaggaataggttgctaaaaccacttgcccaaggtccctgcattagtaagtggcagaactttagctttccttcttttccatcttccaacaaatgtacatattaaaaaatgcatgagacaattttacatcgcattgttcaaagtctagcaggaataaaagtatagtaacatgcagatattagtacttcctcctaaataccgcagccttcattcattagagtgcaattttatatgtacatttttatatgtaaaaattcatttgagtgcaatatttatgtgcatttacattttattatatgtaaattttacataaatgcacatttatgtaaatgcacatttatgtaaaatttacatataataaaatacataaattttaatgtatattcactaaattttgaaaatggcatttgtaacccaaaacacacaagatatagaacatcattatcatccaacatctagaactttttttatgtcacttaatccttgttcctactacactcctagaagcagctactgtaataattttctcaccatagatttcattcaaatgctaccttatattgtgtattcttttgtgtttggtgtcattcatacagtataaaccactagctatccatctcctatttttattaaaataaaaaaacacttcaaccgatacgtttattctgcaggtaactaaatgcatatatacatgtatgtatatataaatctcaaactattaagtctttttgatctttagtttcctgcccaaacctgcaaacacttgtgctcacttgtttcttgagtttttagttaagaattggaaatttagtaaatttaccttgactctattctgaccgtaaaagaagcaattaggctactcttcttcttaggcattctctctctaaattagctcagtggtcacttatgctctagggccattttttttttttttaggaataaactatgtcattaagatggaaaagacttccccagaagcaagctatgttttcagtctctggatcctgaatactcaagcaagtagttaccaaatgctttcaagtccaaaagaggaatggggttgaagggcgtggaaggggaaaaaataatcacatgaatcaaacttagccttatcctctttttttgggttttattttctcattttgactccctcatcccaacatgaaacgttcagaagaaaatatcatttgtattaacacctattgacaggcacaataaaaatttctactttcatcttctacaaaactacaggctgggtgtggtggctcatgcctgtaatcccagcactttgaaaggctgaggtgggaggattgcttgagaccaggagttcaagaccatggcaagaccttatctctactaaaaataagaaaaattagtaaggcatggtggcatatgcctgttgtcccagctacttgggaagctgagatggaaggatcacttgagctcagaaattcaagattgcagtgagctatgatcatgccactgtactccagcctaggcaatacagcaagatcctgtcccccaaaacaaaaaaggtacagaagtcttctattgtataattcgctacagccagcatgaagttactattggagaatagtctgaatgaacactatctatttataagaaatataaatatgatgccataaatatgtagtcactgcctattatgtactaatagctttgaaacagagtagttgtcatatctaatttattacacagaatctacagagcatgttctgtttaaatagatgtcaggccctgctttgactatttgttaatataaaagatctgtgtttacattttacaatattatttgctagggaaatagggtaacattgcatgttttctcatttagacatctcaacttttagacaatgctttctctagactggtttttcacttgtttcttttaatctggggttctcagtagtcttttaatatttattccaaaccatttaaatgttgaagtagtaaataaatgagtaatggtacctgaaggtaaattggaatatattgaccatgattactttatgcattgaaattaaattttactctgtggtgaaatatgataaatgctgcatgtagattttaatctgtagatacacgtgtgagcagataatcatgcacttgtctaagaggatataaaacattttagacttacggattgtatttgcaaaaaggaaaagcttattaactaaagactaaaaacaactcctttatttctggcttgctacacctggagaaatgaagaccccatcacaccgatttccttgttcgtttgcctgcttttctctgtccaaggtttatttcagagtattagctttgattttcctgtgtttgctttcccttcttttgttcgtttgcttagttttctacggacttgccaacaattcatttcccaaatctatctcaatagtctcccttcaatatcagcctgccctgtgtgttgacgctccattgcctaactccatgcctttctgtttcttaacatactccttcactttggttgattaaaccttccagtggatttttgagaaataatccaagagatatacaatttttttaatctttcatgtttgaaagtgtctttattctgtgtttacattttattagtggtttagtttgaagtagaattctagactggaagccattatttctcagaaattttgagccgttactgtgctctgaaagcctaaactttgttgatttctaatctgttgtttgtgacaccttttccctcttgttctctagaattctgttttctccaatgtttgacaatttcaagataatgtgtcatgttttaaatctgttatcaactattacactgggcatttggcaggctttgtcgctgtagaaactcatacttcttggtcctaaaatatctttctgaataatttaatattttattccattccttctcctaaaagccctgttatttaaatgttatattttctaaactggtagtctagtttatggttatattcatctatatgtatgtatataaacatacatgtatattctatacacattctatatattctatatacatgtatgtatacacgtattttttttctttttttctctcttagtcttcattttatagctgtacctaccctttgtatctcatccagttttatgtttctaaatattatctataagttaattcccaaactcaaatcaagctaattccagctcagatatttctcttcaatccccaaattcaacagcctattttatcatcttcacttacaaatttactatatcctaaccttgaactcctgattcttactccccaaacttgtttctactgtcttctttctccactatattaatgacagtctgcactgacagttgtttagaccaaatccttgagattatttttaatttttttctttcatttaaaccccatattcaattgccccaaaatggtttcagcttcaaggtacatacagaatctaaccacttctctccgcttcaatgaccaaactttaagccatgccatctctttcccagagtattgctatagcacagaatggctcaaccaggatgattttgtctcccaggggacattggcaaaatatgcaaatatttttggttttcacaactgaagggtctcacccgaccccatccgctgccttgcaccacacacacgctaaacccacaccttgacacacacaagaaaaaattatttggaccaactgttgataaatgttaagcttggaaacccagtaatagcttcaaaagcatttgtcctaattctttgtttcccttctagaagctacaatgttgctattaaaatataggcaagattttgtcactcttaggactgaaatcttctaatggttcttcagtttggttttgttccttttgttcagcattcctactgatgtataatttggaataaggtaagggtgcaatactaattaaatggttttcaatagatgattgaataaacaattagtacatttctatgttaggaatctctacttctgtccaaaattatacttatttctttctctaactgacagcaattatcatactcttcaagctattatctaaaaacctactgataaatggcctaaatatttttaccaatacacttaatctattatgaaacattaataataaaggagaataatctgtcttaactagttgaagtaagcttatcacaccaacctcccactgatgttcaccacaaatattgttaaaatatttaaaaatgaacaaaaacagttttttcaaggaattgtgacaacagccaaggtgtttgcaacatgaggtgcagaagcctggagaaaacaaaagcacagagaggttagccccacattccctgctgtttttcttctcagaaatttgtcaattcctaagcagtataaatcaggaatgaagaaaccaatcagaaagtagaaaacatctcagcagaaattttggtagacttacagtgaaagggagacacaaatagaggttcagaataaaccaaatagaatgaagtctgctaagcagctcaaccttgagtcaggacatctgaaggactatgtcctagtaagaaacaaaacaaaataaaataaaattgaccaggacttaaaatgactaagatccagactcaattcatatcagtttcggaccagcttctggctctttttataattgcatgcttgaaaaagtaaatcttcccggtacaaatataacactataaaatcacttacatttttgatccacaacgtctagcattcaataaaacgttactaggaataactggagctatgaccaaatgaccaaaactcagagaaaaaaacagataatagtaacaggtcacagcgatagaaatattgaagttctcagacaagggctttaaaataattttgattaatatattaaaagatagatgacaagatggagaatttcagaaaggaaatggcatctgttaaaactccaatggaagttctagaactgacaattgcaagtgctaacattaagaacagaatacattgatttaacacaaggatagctataacagaaagaggattagtaaaggggaggatgcgtgaatagaaaatgtctaaactgcagcatggagagagaataaaatgggaaagacagaaagtatcataaggaaaatatggaatatagtgaataacttttaacatatataaaattgttccaaaaggagcagagaggacagaaagaaaattaggcatgagcaatatttgaagaaatatttgccagatactttttaaaaactgaaaatgataagtatccaattcaagaaattatgtgagtcccaattcagacaaatgcaaaggaaagcctagctaagcacacagtagcaaaactaaagggaaaaaaatcagataaaaaagatacattaagtcaaaaaaacaagactagcagttgatataacaaagaaaaaaggaacccagaagaaaatgaaatgacatttttaatgcgctaaagacaataccaataagaattctatccctatttaaaaatccccccaaataaagacaaaataaagatgctttcaaacaaacaaaacctgagagaatccccatcacttaaaaaaataaaaatttcatatatttaaggggtacaacaccttaaatgtttgacctacttatgtgcaataaagtggttactatactaagcaacttaacttatgcatttcctcacatagctgcctcttttgtgtgtgtctctgcgatgagaacacctgaaatctaaactcttggaaagttctcagtatacaatacagtatttatgatacagtatacagatatatatatacacagataactgtatcattgtgctgtgcattctatctctagacttatttgttctacataacaataactttgtacctttgaccagaatcttcccattttcctcacttttgtgctctcagtgaccaccattctagtatctatttgtatgtatttgactttttttgatgccacctataatttagatcatacaggatttttctttctgtgcctggcttacttcacctagcatagttcttccagattcttctatattgttgcaaatggtagtatctccttcttttatagagctgaataatatcccattgtgtacacatgtcacaatttatttatccattcatccactgatggacactaggtgatctccatatcttaactatcatgaatactgctgcaatgaacatgtgagtgcagatattcctttgactattgattttattttctttggatatatatccacaagagggattgctgggttgtatggtatctctatttttaattttagggaaccctccatactgttttccataatagctgtaccaataaatattcccaccaacagtatgtaagagctccctttttccacaccctagataacagtcatctcttgtctttttgacagtagccatcctaacaggtgtgatgtgacatctcatcatggtttagatttgcatttgcctgatgatttatgatgttgagcacattttcacatacctattggctatttgtatgtcttctttggaaaactgtctatttaattcagtttctacagttggaaggaaaaccatgtatatagaggaagtaataaagagcaacggaaaggactaatatcttaatatgtagcgtaatttgagattctgaggaattcattagaaaaaagaccaatttttaaaggtatttatttctagacattgcaagttaactagcaagagaaaatatgagagaattttgtcacctatttgaagtgctatttatatactagtttacttaatattgatttcttagcaacattttctataatgtcatagataaataaaggaagagccccatgtttgtacaggaggaagagtttgataatttttcttacacttttgtctatcctttgagaggagtttataacttcagcaacaccttagcagttattattctgaaaagtgacattgataagggtttcaactgagttgaaggaaaaaaaaaacaaaacaaacaaacaatattttctgtatggtcaggaaagatgaattatacatttaactgccatccccttgcttctaaaaatgtagttagagatcatgaaaggtaagagtgtatttatttggccattgatatagagaagcagtcccatttttaagtgtttaaagaaatcacaataaatggtcctgacataagttttgatgtaattagtcttcatgtctgctggggtccccgtaactaaaatgcattctggaaacatcattggctattatgaaatgtgaatttcagtaaggctattcatcaaaagcgtcacatcatatattctattactcttcttaagaataggactgctagatgaagctgtttttatataataacttttagctcactgacagagattgaaaatggtaaatattaaaattctgtggttttacaaactcttcatgaatgattgtcatttatatttagggcaatcttcaaaaagtggctagttcttatgatttcagaaagtgaatgagaaatgttcctccctattctgtatgtaaatattcactctcccccaacatgttcttccttttattattgaaaattgcaagcacacacagaagtagaggtgatagtataagaaactctcatgtatacatcactcagagtcaatagaaggcaactcttatcaatcttgtttaatctatacactaacctacttccacaactccaattatctggaggcaaatcccaaacctcaataatttcacccacaaatatatcagaatgtatctttaaaagattaaggaatcttctttttaatataacataaaaccagttttcttatggtaacaaattattatttctaaattatttagaattcaaatttccataatagtctcataaatatgtaagcttatatgtgtatgcatgttaaataaaaacacatatattttatatgtgaatatatgacatatttatgttgtgtttaatcctcttcaatcatgaaagcaacatttccggacattgtttctcagaagtccttatataccaagatatacttccatttctatgtacgaacactgtatgtatcaagaaatgttacatggattaaaaatattccatactctaccaaatgtaggaaaccttgaattaaataaaattttaaaaataaataaacttacttttaatgacaaaaaccgcaattacttttgcaccaatccaataaataagaattcctttcatttaggaattctcagagcttttaatatgttaaaatgtttaagaaatgataaaagtggagataatatacagaattaattacagttaaccttgggactccatctttctttcttgaagtattactaaccaggaacacttactggatataaatttttcctaaatccacagtattagagaatttcagacaatatattttatatttgaatgtttcttaaatagaaatttcaggttcaagttttaaaaactaagggaacatttgtcaaagcatggtctctggaataactatatcaaaatcaagtggagaagcctgatgaaaggacgtattcaaggtctagacacactgaatcagtatttctggtgcaatatgaggagctcacgttttgaatgcatgctcaggaaactcttacacatgttaaaattttaaaaccactagatcagacttcctacaaatggctaaggaatatgcaagaagaatagcatgacatgaaatgaaagcgaataagtaaccctttgttttgtttgaaaagacttaaagaatctcaaatttttacaaacgatagagtctagcgtagtcaacaactttcctcctttttaatttgttataattcaggccctaaagatctcaccgatccataaataccgagaagtgtttcagtgtcgatgagcctcgagtaactgcagctactctactggcacatatgcactcttaggaagtgagtagaatataggatctgagtggtttgaagaaatctctcagatgcttgagtttcttaagaatttaaggtgtatttgatgaggaattaatggactgaagcccctcttctttccacaaagtagcatgaacagttttgcatatttcaactgtgcaagcaccaatcttccagtccctgcaagtgtgatttttgtctctgtggggtactcatgttagtgctggggctgaggctgcacatggctgtagaatgaactctttgagagagcaatcaatggcctcatggctattagacagccatctgcacaggatgaggacaggtctgcctgtggtgggtggagaggatacagcagttaaaatgttcttgtccaagcacctcttcacccacacaggaggctactcccaggaggaactatgcatcccctttttctggataataagcatgcttatgtagagctacttcttttcaaatacagtctatttttcacactgcagataatggtatgtcatcatatcactcctctgcttcatacttccaaagtttttaactttttcagcaaaaaatgcatttctaaaatttttaattgatgaatagtaattttgttttatgtatttgtgggatataatgtgatattttgatacatgtttacattgtgtaatgattaaatcaagctagttaacacagccatcacttcacatcctatcatttttttgtgatgagaattaaaatcctcattgggtaattttgaaatatgtattacattaactgtagtcaccatgctgtgccgtaggtctctaaaacttattcctcccatctgaaacttagtacgctgtgaacaacatctcctcattccccatccctccctcccaccagcctctgataaccaccatgctactctttactatgctactctctactatgtaagaatatatttcttagcgtgacatccagagctggtttcatggacatacaatccagtcacacagagccctgtgctgaggaagtccccatgtttgaaatattctgctgtgactgtcttgaaattcttaatcattttacctctcaatttgtgttttgtacatactaaacacaaattgagaggtaaaatgattaagaatttatttgtaacctgtgtgtgcatgagctgctgctgctgctgcttcaccatacccacatgcatatgtggcagctcctgcacacacaagttcaggcttaaagacccagcagtcggcatgcgtgcacagcagttggtgtggtgtgcaggtgtgcacatgcttgcctgggtagtcatagtcctggagtcctgagggcatgggcacatcagaacctgggcctcttaaagggatggagataatggtggtagcagccatagaaacggcagtggatggcagcaaaggctgcaggaagcgacttcaaaagtagtcaacaggaggatccaaggtgggaggccagcttgcccatacctcgccggaggctgtctctgtgggatttgcaaaaatattaactctccatcctgagcaccagaacagaaattgttagtgctcaggcaataaactttgtcaataaattattgcaaaaggaaggcatacacatggacattgcaataaaatccacaggcttagaaatagaaattaaacttaaagattattccagtcaatgataagaacattatttttatatgatgctttggggaaaccaataattgatgagttttgctttgtaattgaagatacaaaaatggaatggtaaaacaggcattttgaactatacgaaaatcatgaagtccctttcaatttcttgtacaacctccacaagttacagtgtatgtcagaggaaacattaagattccattgcatacatttatatttaaaattaaattcaggctttcataaaacagatttgtataaagagttaaatctttttagaaaaatattggtgaagagaatcatcagctctagatatttcaacatttatatttcagtgtataattcatcagaaacttctgaatgttactacagtctataaaacagtcttaatggtttcataaaagttgcatcagagaaagatactttgcaaaataaaaacttatcaaaaagtatttgtgatcttgcatttgccaggagtgactgatgtcactgaagttatatcaattgaaaatgaagttgctaaaaatataaattctgttgatctagtaaacaattgaccagaaaagtaatggagaaaattatataatcaatcaagatataacctcaataaagtattatttattatatcgtataaaattatgacaccaaaatcatgtattttgtaatttgtaagtgtatgtcatcactcatctatgaatcataccctaattttattttataagttataaattattttaaagcgaaaagctttgtatttaatacctttaatgacactttttcctctttttcaaaaaagacaccccacgctttcattttgcacttggacccacaaattatgtagctgaccttaatgacgtttgtggcttatatcctgaccaaggctatcctccagcttcatcttcttcgctttcactcctctattactctgtgtttaatcctttcattttcagcacatggttgcacggagtctgccgatcacagttctttttcacacagtttctctgtgaacgctcttgcctgcgcaggaaatctagtttcctctctctacctgctacctttacccagctcactactacttgccttttacttctcagcgaaaacagttctttctccataaactgatcccctcaggatttgccaaacatttcaaacaagtcacttctagtatatggtgcttatcacacattactgtatagtaactaatatgattggattcatgctagcttccttttgtagacgttcatctctgtgaagcaacactccttatctttttgacttgctgcgggtttttttttttttttttcctcattttcttccctatcttgactccagtacttagcataggattggacatacattacatgctcaataaatattagttacaaatgagttaactagtgaaaaatgtaaccattataagtgatgaaataaacatttcttattcataaagctttcatcattattactgtacaacaatgagctatgtagatagggaataatttgtccaactttgccactatgtggtgtcataaatggaaggacttgctgtcatttttaatgtctgaaaattactttaattgcatgatctaaaactttaaatctgggcagttttgctctgtcaacacatccagttagccaacttatcctcctataaatgtaaataagacatttgtgattttttttttcagagtaactacaaaaggaaaatattttctctagttctaaaaaattttcttggatccctggatatcttttttttttttaaggttcaatcacactttattcatttatgtttttaagttttttaggtcatacatttcctcaattcttcatacattttatttcagtcaattaaattacaaaacaatacaagctttttaaattcaaagtctaaagtatataaagtaataatgattccctctctttctcttacccttcaacttcaccttgctaatgtaacaaacttaataatttaatgtgtatctttttttattttctactagtttattctttgattagaatccaataagatccaaaaaaaagaaagaacccaataagatccatacatggcagttggccaagtttttttttaatctattggtttctcctccatctctcttctttttctttctttttttttaattttattattagtatactttaagttttagggtacatgtgcacaacgtgggaattgaacaatgagaacacatggacacaggaaggggaacatcacacaccggggactattgtggagtgtggggagcggggagggatagcattaagagatatacctaatgctaaatgacgagttaatgggtgcagcacaccaacatggatccctggatatcttttacccttattttggttgcaaatctgtgaagaagccttggaattaagaatgggcatagtccacaaaatcattctttaaatttctccttagacaaaattagaatataaagtgcatgcatctggttaggtgcagtgattaacgcctgtaatctcagcacttgggaggccaagtcaggtggatcacttgatgtcaggagtttgagaccacctggccaacatggtgaaactctgtctctgcaaaaatacaaaaatttacctggcatggtggtgcgtgcctgtaatgccagctactcaggaggctgaggcaggagaatctcttgaatctgggaggcggaggttgcaatgagctaagatggcatcactgcactctagcctgggtgacggagcgagactccatctcaaaaataataataacaaaagtaaaaaaaagtacatgcatctaatataaatatggaaagtattttaaataataaaaaatgaagacatatttgatacagaatgagtttgattttctctattatattcatattcagaactatagcgtgtgtttttattttttcatggctcttttgtcagtatgtaccttaaaaccccaaattattacttcctactttctacttctaaatatttatgaatgaagaaaacaattaaaaatgtttaaatggtcaaataataactaaacattctattggtaaaatgcagttacacattaatcattgtgaacatataaatgcaatctcaatgttagtttggtttcttgagcagaatgaagaaggtagaagaaagtgaagattttagtccatttcttagagagctaaactttatcttataaattacccatggagaaatagattctccatgggtcatttcactatttttaaacttcttcatgtataattttttttttacaataacttgcctaaaacctttattcttaaatgtaaatctttcaaaacaatttattcttggtaagatggtacatatctaaatccaaatatttgtccagggccccttcatagatattgagttgctctttgatgaattctcaactctctggaatcagaactttattataaacgaagtagtcataacgatctacattgtgagtctcttttaatctgaacaaatataggactctcaagtacaactggcacaccctgggattgtcctttgaaattttggtcaatgaaatgctaggtcttgtaaaagaaagattgacatagagaacatttctagagggaaggtttttatgatggatgcataattttaacactggaaaatctgaattattaaagggaaaacttccatcttccctattcatgttgcatctttaacaaaaagaaaattagagctacgtcaaagacagaataattatgttgcattcaccctcttaaatataaacgtatgtctaaatctctatagaaactatggtggtcataatcttagaaacatggtttgtctcatggtatatgaagttaacagagagcatttagagctgttaccagtgtgtcaattgtaatgttatgactaaaatgttagaataaaatataacaaaaacaatgcagtgcatcctgtatatatggaatgccattttttgaggtctacagttttctgtaaactattttcatataaggtgtgaatatatttttaattttagtataagtaataagctacaataataaatacaagacatttaaaaacaggcaaaggaatatttcatactggacattgtagaactccaggttgcatttatataatttcaaatgaatgataaagtattcagaaatatgtattttataaccataggctagcatttcataagctttaaaaaataattttttttctcaacagagagaactgtcattaccgtcccaccttccaaaatggatgttacagttggcgagagtatagtgctaccatgccaggtgtcccatgacccctccattgaagtggtatttgtatggtttttcaatggagatgtcatagacttaaaaaaaggagtggctcattttgaaaggattggaggagtaagttactgaaattgttaagtgcttaataaaatgaatcaagtcttttacatgaatcaccatttttcatagttactctctccatctttatttgcatggataatcactgactgtttttgaagctacatttgtttttgttttggtttattttgtttcgtgtcttccgtagaaatacttgttttctagatgtaattataataagggggataataaaagggtttagatacaagaaatgacaatgatactagtatatcttttaatttcagagttgttttatgtttcgtatttatccagctgtaacaataaagtaggacttgttatatgggcttacgtttttatccatttctccctttctgtctgcaggaatctgttggggatttgatgataaggaatattcagttacatcattcaggaaaatatctctgcacagtacaaacaaccctagaaagtttatctgcagtagccgatatcattgttagaggtaagcataaatggtgaaaaagtgatcacattgtttcttcacagttacagtgttcatatctaaattgtagacctctgagaaaccacaccatgttatggaagtgagatgtaatcagatagagttttattttttaaaccccaggactccatggtatgggtagtgtgaatacagacatggaactgtgtgaatacagacatggaactgtgtaggatttgactatcatgaacggtcacgcttggcaagcggtgtcagtaactaaaacttagacataccttctgtttataataaatcattcttgtcaatccagagtcaaatccacatgctcctgtagttcttcatattagctgcaattacttgagttagattttaagaggaattaaagatgatggttctcaatctttgagtataggttgatatgcaatcatcctatgcctgatattttctaatctccagaggaagcactactacattaatgtcatttaccatgtaaagggaattaatagaactttatcgctaataatgtgctataaatacattatggtcaatattttacttcctaagcacaacaggtaaaaataaaccatcctagtaccaaattaatgaatgtaagtatctccaatggagtcatgataaaacatttttttcaaggtccaccaggtcctcctgaggatgtgcaagtggaagacatttccagtactacttctcaactaagttggagagcaggcccagataataacagtcccattcaaatatttactattcagactcggacaccattttctgtgggttggcaggctgttgctacaggtgagtgacaaaagtgttttgggtcactttaaaaataatattttagtccaataattttaataaatgcaattacattttaaattaataattatataattttgtacaattatttgtttttgagtagtcccaacctaggtgccttagtgtctcattctttttagttccagaaattctcaatggtaagacatacaatgcaacagtggttggtttgagtccttgggtggaatatgaatttcgtgttgttgccggcaacagcattgggattggagaaccaagtgaaccatcagaattgttaagaactaaagcatcaggtaaagaatcaatgtgttctaaaagtgtggaagatttcgtatgatacagttcttaaaacaaaacaagtatttttatgtgtcttctaatacttttggctcaaaattgtttggcagtaaacgagtggctctcattttcttttatttttacatacacaaggcaaggtgtattttctccaaatagtaggttcaataagaaatgattacctttaagccaacatgtcaaaatcagagttcttaggaaactgtgtttgcatcgcatctattttctagtcaaaattcattagagaatctgtagatttgtatatgcaaatgagttactgcttgtttcattaaaatgttgtagccaggaattaactgagactctgttggtgcagtcagccatatattttcatctatttctcaactctgaactagttgtagcttcactgagcagtagtataaatttttttccatgcaaatgaggtaaatcctaagctcatttaacaggggcactaattgagcattaattggttcactgaacagcagaacgcaagaacctggatcagataccatgccttcttaagctcttttcaatggatcctctttgttccactcaaacttttacatccagggtgacatttaatctgctagctgtatatagcccacaaagttcacattcttattcgatcacataaacaaaggatcacttgtcatggctagcttaatttaacaaacacaaattaccttattaaagtgtgcacaattgtcagaagtcaataaatcaatccttaaactaaagataatgttatatgtttatcatagaattggggctagaaaaaggacatacttgacagtgatatcatccaattaaatcacgctagaagcttacagctgagaggaaatccctttgttttacagaagaggaaaatgaacaccaggatattagctggttgtttgtgacagagctaggttttgaatccaaacctcctgatttttacacccagcattctccataaaagaggatcttaatgtagatgagcaatagattagccaaagaaagtgtgtaaatatagaaattccccggccctcctatataccccctggatcagaatcttcaggtgttgtccatgactctggatatgagctttagtttcaggttgtttgtttacagttgatttatattttggtagctttggacagggttgacagaaactcttacattttcatagcaaagtttgtgtgccaccttctaaccattaatactctcttgtttcagtagcagaatgagactggtgatattcatacccactgagtcaaactctactaactgaaaacctactgagtctctcgtctctccctctctgtctctgacatcatcaaagactaacaacttgttctcaatatggttttaggcttaagtacaattaatttaaaattgaatagggaaaggaattttctatttctcagaacattggaaactttgtagaaagtaaatcaaaatataattcaaaatacttttccttacacagctaaactatgcaaagatcctgagatagtgtgcagttagtcactctaagctgtcaagcactataaattcagcaactctgtaaaatccactctgattcacatcgcttttgatcaaaggcattggaagtcttagaaaataaggtttaggttcacataacttctttctaaaaaattatgaagcttaaagctgacaaagttaagggtaaatttaaatacgaaaaggtatatctgaaaggtgcaattttgaaaaagaacaatcagattatcatatgactattttctggtcatgtttatagagctaaacatcagtatgaaatggaaataaataaaataagcaatctagatttatttaggtggtctatatggtggggaaaaatttgaaatgaggaattaaaacttacatattttaatccctgcctaccaatccccagacatatccaagtgcctcctcaaccaaccacctctcctattgttcagacatggtccagtatagacaatttcatgtaattccacatttaaaaagtataccctgctgatttagcgattatcacagatttaggatacttttgtcattacgtcaagaaaaataatgcttttaaacacttacgcatgtgtaaagtaaaacctcattctcgtgaggcactacaataccatatacacactcagcatttcctcagttttacagtttctatgatctattattcattgtgttagtccttacaaggatacagagttgaagggcatagttttttaaaactcatcaaaattactggtttctgaatcctctaccacagagccttagatcccaagaaataaatagaaagaacctctcccagtcgcattcttgacaggagaaaaacctgactttgcaagtgaaaagttagaagaaaatccctcttcttctctcccgagagatttgagattgtaacgaggagttttaaaacaagaatatttatttacatatttttcagtatttaattttaactggtaaaatatcctgatgactaataaaaggaaaaattagtttagtttgtttattgaaaaaaaataattaatatactgcctcagtaacttgtttacagctcaactgtataattaggcactaaatcagcagtgtcactgtcaccatctgaatggaacatcattttgccaattagtagatgatgcataatgatgtcaaatacccgatgttactcaatttttaattaattttggagccagggtgctcatgtatcaaacacaactgtgtcctctctcttagaaatttggatatgtgtaaacataatttacgttcattaaaaatgcaagactctctcacagtatgcctgtgtgagattttgaaaagtgaaattcaaaaacaaaattcttcctgatgaagacgtactttaataattgccatcccacatttctcttggttatttttagtccctgttgtggcaccagtaaacatccatggaggtggaggaagtcggtctgaactcgtcattacgtgggaggtaattttctgtccaactgagttattttgaagaaaagagatttaactggccagaaagaaactgaaaaacaaaaagatttatttgatcactattgagagcgtaaaaaaatatggtataaaaatacatcatcctgatgatgaattatttagaggaggtattaggaacttttctcatggtgagacagtatgacgaactcagcacaattttctcccaaatacacgaaaaacaacttcagtatctattgagcgtgtgtcagtagcattttcgttatcgcttgatgaattaggcattgtttgatttgttacctgtggcactgttgtattgtgaataagttgagcccagtagactgtaggcaaaaaatagttcttgtcctaaccctgctgttcacctctgatcaactcattcttccctgcatctagatgaaagcttaggcacatggagtagattttgtggtcattcttattacccattaacatacaggctcatttttttaccttattaaaaatttcagtctggtgtgtacacttcaaactggagtataaacgttagaatttagactttcaaccaatttaaagtttctcattttcagtatctcagtgcctcagcctaagaattctatagcgtgaaagggaatacgtggtcagttcaacttctctccattctgctctttaatttatctttccccattcacagtgttacctctggattctccagagctgtagaaggttggtgttggtaggggaggagaaaggaaaaggtctggattgctggtacatttctcgtttgactttggtgtgctctagttatggcaaattatcagacgctgccatttcatagggtagggtttctgcgttttttaatttattttttatctgggagatggccactggatgatcccccaccaaggactcccaactgcaattccttggtgcagacccaactggctgctgaagggtatcagttcctggattttggtggtccatttccagactcttccagtgaatattctctctcttgtaggtggtctttgtggatagagtccccttgaaggctgtccatggatgacccacttgcatgggtttcacatttgtcctcagcagacacataccctgctccatgtttagcggaagtgcaatgcatacccacttagcatctctcttcactctgccaccgtgggctgtctggatctcttccccactttaaatttctcagacatttgtcagttaaatgaacctgcgtcccttatgttccaggaaatgcaaaccaggtgtttcttgctgtagcctacttcacatagctaggctatgagagataactgggaaccagagacgttattctttatggttataaatgacagtgtcagaaactagatgcaattgccctgaaagtcaccctttcctctggatatcttgtttcatgtggacattataggcctagcacagtgcttggaaagtggtccaccctccatgaacacttgttgaatggaaggtagtgttttcagagagttggaactctcagaggccagacagagggggaaaccctattttttcaagcatttacaggatttcaggtgccacacagagcatttcatatcattcagtccccacaataatgctataaggtggttataccactttcaagtaagaaaactgagacttagaaaagtgacatcattgggcagagaagcatttgaacacagggttctctctttctgttcttttactgtatcctgtattacaatcccaattgtcttcatgcactgtgatggctgagggtgggcctgagtccttgagtatatctaccttaagtagtaagttaaccatattatacctactactccaaacatatttcccataaaacactgactttcaaatgagtctacaagagaattgtttgtgagtagtttatttaggtttctatattcatcaaaggccaaataagcattatcatcatagtgtacaggaagttttgcctgacttaataacttattttgttctcctccttggtaagaaattcctacaggctgttgttgcaattgcttgtacacagtctataatgagggcccaaatgctatgcattcattcttaaatagagatgagcatgaattaccaaagaatactgtctttccacgatttataatgttcttttttctttaaggcaaaggtacacaaaccatgacctatgagacaaatttgtctagtttcctgttttgataaataaatccacccatagctacatccattaatgtattgatgctttcttgctgttgcatgagaccatatatcccacaatgcttaaaatatttactatctggtagcaacaatagacgctagcgtctgctagagtgacgagaggaagggcgagggttgaaaaactagctatattaatgggtactgtgctcactacctgggtgacgggatccatcataccccaaacctcagcatcacacagtatatccatgcaacaaacttgcacatgtacccccgaatctaaaataaaagttgaattttttttttaagtttactctctggccctctacagaaaaagcatactaacccctatttttaaaaattaaactaaattaaagccacttcctctgtgtttattttttcttcctgaggaggaggtggggggtggatatctgatatgcagatacttgcagaaagtaaattagtgaaatcggtttcccatttatcactcatatttgacattatgtacaagcagatactgagccaacttcttctggtgcccagcttctttatggaataagttatgtatatttaggagaagattcatacattaggatgaatctgagccaccagaatgcaggtagtaattccttcaatttaatgaactctattaggtagcttctctgttcctatcagtggaatacaaaaatggatgagaaaaggtctgaatgctcagaagcgtagaggacagaatggtcttaacccagcctggaaggaggtcaggaaagacaccatcagaactgagtatatctgaactacgttttgaaaagtgacttggaagtagagaggccaccccaggtcaatgtcactcctgttgtagttgaaatagtacctgttggactttgaaaggcactgcgcgacacaagactgttctaagttcagtcacaatctgccattacgtttcataagtgacaactttaatgattatccttcatttaggctccctgtggtataatctgcctgaactgaactaaatatctttcccgtgttttccccagagccacacaataaatgtagattttttgtttatttgttttgatttggtttgtttccaaaaacctagacataatatcaaatttttagaatatagcaatgggtaattcctttttaagggcatgtttatacattattttatcataatgtgtatactcccaaatacttccaggtttgaggtgcttgtggtgaatgtctcataaatattactataaaattaggtacacaggataaagcactatagagtaagagatacatacctacactgagggttggcacgctttttatttaaagggccagacagtaaaaatattcagtctcgtgggccacatgacctcttttctaatgtctcagtctgcttttgtagctcaaaagagccacataccacttacaaacatataggtgtgggtgtgtctcaaaacctttattttcaaaaccaggctgcatgccagatgtggctagaagtacatagttttgctgattcttagtctgtactaaagatttggttcttacagacactgtggttgagaattacattattagtttatcaattttcatagattttactcccaggagaatttcacaatttctttattttactgaacactgtctccacttaaagaaaactctttttctggccttgttaaataactatatatattttttaatcatttgactctctgttgatgtaagaataaagggaagtatctaaataagtctcttttttcccctctaatctgcatatgttggactcaggtctttcttgagagagcaccatgagaaacactaattgtacttgactaacaaaaacaaaactcccctatttatgtagatgaactgactaagcatcgtgattaaatccgagatgaaagaaacttcagaaatgaatcaaatgctctagcaagtagcatcgattcttataaatctcttccatgccattcaaaattaactggtttacttctagtctccctatgaaaaagaagagaagtgttaatatgaggaaatactttgttgtttccccagatgtccggagcagcacttttcttcctcttttcactttctgtatttgttagactgttccacatggcaagaaatagagaccagctcaggtcatctcgggtaatgggggtttattttaaagctacatgggaagtaatgaggacaggaaaaaagtctcagcaagcaggcaggaaggtcagatgaagaaccggaacatggttcatcactgctctgggcactcgggcacaggagctctaggcaaccatcaacaacccctctgctgatccagccccggcttgaatagtctctcatgcttatgcctcagttcctcccatttcctttacttccagttttctacctggctgccagctaatttggatgccctctctctaatttacagcatctgttttctcttagcttctattgcctcactgttcctgctactccatgttctctactttttgcctgctctgtgtatatctatcattgttttgccacccaccatgtttcatatgcaaactctgtgagaggaattgaccaggtctgttagtcaccgtagagtacagagattctgccctcatagatactcaccaagacggtgcctgtggttctggcgctcgtgaattggtgctcgcatgggttccaagtggcaagtagatagtgtgattgatagaataaatggactcccatgaataaagagaacctctgaaatggagttgtggacatgagggactagaagcactgtgtcctgtcaggtgttgcctttattagtctgtcagaatatttattaaaaaaaaaaaagcaaagcattttccttgggaaaaaccaaataaattccattgatttttcaatacaagtttcttgccatcaggagatatgttggtctaaattcaagtacagattcattttaatttgctaagtttatgtgattgtttacaatttttagtatctgcagagtacagggggaatattaccaatttctattttgctattttagtaattttagatttgaaatgtattttatagaatctgatctttgtgagagttaacagtttattctttcatgtgaggaaaaatgcacacatgtcactaccaatgaagatgtatgcctaaaaaaatgatgggaggtcttttatacttttttaaagaaatattctgtgtcttaaagcatatgttatttcacagtaattccattacacatgtcttacaaaaacttgtttaaaatgttgtgaaaggaaaacatatctagtcttgaaataaatagttaagaagttaatttgtgctgagtttaaaaattcatatcaaaccacatttgagtgtgtatcataaaatcttttaaactgttttattattataatttatgaatgatcaaagaaaaatatataaatatgtaaagcttgttttatatttctatctgaaaacttaaactatttatctgagtatctttaactgggatcatttttctaattggcattccaaataaaagtgttttttaatacatcattaaacagaataaatatccatatttgtctctatggaagaaatgtgaaataatcaataaacattatagtagcttaataaaatatttttgcaaatactcagtgattgatcacattctgcccaagtcaattccagaagaactgcagaatggggagggatttggatatatcatcatgttccggccagtgggctcgacaacctggtccaaggagaaagtgtcatctgtggaatcatcaaggtttgtctacagaaatgaaagcatcatcccactgtctccctttgaagtcaaagtgggtgtgtataataatgaaggagaaggatccctgagtactgtgaccattgtctactctggggaagatggtaagttgtcctcaactctggttttctttgagactctatgcatagtttgtgttcccttgttccattttcaatgaaccactctgctaaagatggttatgtctttctctggatggtagaacctcaactggccccaaggggaacttctctccagagtttttctgcttctgaaatggaggtttcatggaatgctattgcctggaatagaaacactggaagagtgctgggctatgaggtaatccacattaatttcacttttgcttatgaatgtgccaatggacttcgcaatagctcctattcaacagtcctatcctactagcctgttgttagcatatgataatgtgtgtctaaagctaaagcagagaatgaagttgagacagggtaggtgagcccccacattgagaggcttagcctgggatgtttcttgtcctcgctcaagacagaattcgagagtgagccagtggtaaaaaaacaaaaacaaaaacaaaaacaaaaaaaaacagctttattgaggcagcagtgttacagttttgaaattgcttctgcagagcagggctaccccataggcagtgtgctaagagcagcagcttggaagcagttctacactcatatttatacccacttctaattacatgcaaattaatgggtgagttagttattcagaaatttctagaaaaagggtggtaacctccaggccattgccatagaaagggatggtaacttccaggtgttgccatggcagtggtaaactgatacggaactggtggttgtgtcttatggagaggtgctttagcctcttccctgtttcagtcagtcttcaatctggtccacagtaaagtcctgcctcctccctcaaagtaagggaaatctttctaggtaattcaaagcaaacaaattaacacatagtagccatttttaaaggcatacagattcagtaagtaagatgagtaagctctaaagatctgctgtacaactgtgcacacagagtcaacaattatgcattgtacccttaaaatttttcaagaggacagatctcatattaagtgttcttaccacaacatcatttttcaaaagtgatcaggtgattatatgattaattattcaaattgcagtcatttttttttcccttggtaagaggtgaagtctgctcctcaatcatcttacaccatggaagaatttcattgagaaacctgctttgtgaattgcagtataacttggaaagatgtaatcatctcagaaaaggcagttaagtaatgaaaaaaaatacctagattgtcttgaatctgctatttttagtctatgaagaataaggcaaattacatttgtaggccttcatctcacaaagtaaagagacaagaacattttaagggaaagttgttcatcactcaatctttttcaacttgcaaattcagtgattcacaaaatgggtaacataatttatttaactttggatttagaataaatgtataatcctaaacattcttaattttgcctatatatatatatatatatatacacacacacacacgtatacatatacatactatatatacacacatatatatacatatatacacatatatatacatatatatacacatatatatatatatatatatatatacacacacacacacacatatatatatatatatataaccataatcctctgattccaacagaaagttctactctcaggacaggtgtcttttccactccatgccaagaatgccttacctcttatctgaaccctagttacttctcaaatttcatccctagtcgcctcttctctctgagctctactcccatcaattcctgatgtattttgtcaaattcttgtagcatattttttctataccacttctttgcaatgcattctgtgacttattttcacatacactgtggattctaacctcttagctagatgataaggggcttgaaaataggtacttaatttattctctttttttttcaatgtacctaaaacaatgctaatgcaaaggtagggttcagtataaattgaattattaattaacctgtgattcaaataactctgaaaagaaatgccaatagcaagacattataatgaaagtctttgactgattatatacaaatgtgtttttgtctgacttgttatacatcatttgctaaagctggtaacctttagatagctcataaaatactttattttggtaatctaaaaaatcacgttctctaatttccattgtgaatttgcattcatgacttttttcctcataaatattagagaataacaattttgttgttgtataaccattttaattagaaaacgtttttgtcatctatacttctgtcttcttcccatattccttgtggttgtggttgatagttgttggtaaaaaatgattgatagttattggggaacaataaattgcttgttttggtttttaattatcaggtcttatactggacagatgactccaaagaatccatgataggtaaaattagagtcagtggaaatgtcacaaccaaaaacatcacggggctgaaagctaataccatctactttgcttccgtaagagcttacaacactgctgggacagggccctcaagccccccagtcaatgttaccaccaaaaagtctcgtaagtatgcatacactccaggaaacaagattcatctgtgaagagcaacctattcctttgcttgatgttcatttcattcccacacctcatttctttactaattggttactttggttagttggtttgtcccttaaatatggatacttgttgaaaccttttggtaacaatcaaggtaattgttttcatatttctggaattccaaaagaggaatattccaagtatatcgatgaaagacagaagagcataatgtttaagactggccctgacgccctccttctaaatgcattcaaaaactgacctcctatccttggaacgttaggtggtatttatctttgagtctcagttgcctacctataaaatgaggaaaaagtcatatttatgttttcataggttttgttcaagattgaaagagattattaataataagtgtccagtacacaccttaatatatgctcagtaaatggtttttttgttttgtcatttgagtccgagtatattcacatgtgatcctacaactgtcagacacctagatctttccttttaggataccttattactacagcttacttggaagtccctgaaatctaagaatgaactcttctgttttgtcttatatcccctgataatcagccaggtgatttcacagaatcagaatctgctacataaaagatgaatgtttttcatcttttggtgattgttgctgcctttattttctgactgagtctggtaatgcacaaatattccataatacgaggcacagcaataaattgggaaaggtctgatcatccgacttagttgttcctgtaagatgatttttttgtggttgaataatatttacatattccttatatattattaatgaacacaaattattcataaaatcagactttttaaaacacatttttttgctctctgaatcctgatgaatgaaagataacaaatatagttgctgaattttgagaaagactaagacaaattcagtgccacttacaaaaatctagtttacctatacatgccgtagtctaattacaccaccatatttggaaagaagagatggttaagaagagtttgaaaataaagttatattaaagttattccccttatgcgtatatatgcgtatatttgtcatgtccaaaagaagttagttaggaaccatctcagagaataggcccttgattaaatagattatccagttatttccacacaaccagatcaactgtcagatattcatgttccaattctgggtacatcattgactcacaacttgaaataggacaaggcattccatttttttgctttcatgttcttatctatttattaaatagaaattatctctgtcctcactccttcccaaattacccatgaagcacaaacaaggtactgattctggaagcatcttagaaaatacaaagtgctgtggaactgcaaaagcctgtggagcaaaaatttttgaaccaaatttcctccagtccacccagttttagacaggctgggctgtgagttattttcaagaatggattagttaacaatgaagttctattccttttcctgttttactcaatgttgactaaatcaatgaagttgttgccagataacttggatgtatgatttgcttctttggtcttcctggagtggtttagcttctttcagctaatctgcaaatccgaatgaaaatctccaatcaatcagcagttttcagattacctagacatttagttctagttgactgagagatgccaaactcacagaaactcttgtgtgtagggggaggagccaagatggccgaataggaacagctccggtctacagctcccagtgaagacgcgtgatttctgcatttccatctgaggtacccggttcatctcactagggggtgccagacagtgggcgcaggtcagtgggtgagcgcaccgtgcgcaagccgaagcagggcgaggcattgcctcacttgggaagcgcaaggggtcagggagttccctttccaagtcaaagaaaggggtgacggacgcacctggaaaattgggtcactcccacccgaatattgcgcttttcggaccagcttaaaaaacggcgcaccacgagattatatcctgcacccggctcggagggtcctacgcccacggaatctcgctgattgctagcacagcagtctgagatcaaactgcaaggcggcagcgaggctgggggaggggcgcccgccattggccaggcttgattaggtaaacaaagcagccaggaagctccaactgggtggagcccaccacagctcaaggaggcctgcctgcaactgtaggctccacctctcggggcagggcacagacaaacaaaaagacagcagtaacgtctgcagagttaaatgtccctgtctgacagctttgaagagagcactggttctcccagcatgcagctggagatctgagaactggcacactgcctcctcaagtgggtccctgacccctgacccccgagcagcctaactgggaggcaccccccagcaggggcacactgacacctcacacggcagggtatgccaacagacctgaagctgagggtcctgtctgttagaaggaaaactaacaaacagaaaggacatccacaccaaaaacccatctgtacatcaccatcatcaaagaccaaaagtagataaaaaccacaaagatggggaaaaaacagaacagaaaaactggaaactctaaaacgcagagcgcctctcctcctccaagggaacgcagttcctcaccagcaacggaacaaagctggacggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatatagagaagtgcttaaaggagctgatggagctgaaaaccaaggctcgagaactacgtgaagaatgcagaagcctcaggagccgatgtgatcaactggaagaaagggtatcagcaatggaagatgaaatgaatgaaatgaagcaagaagggaagtttagagaaaaaagaataaaaagaaacgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaacggcagccagagagaaaggtcgggttaccctcaaagggaagcccatcagactaacagcagatctctcggcagaatctctacaagccagaagagagtgggggccaatattcaacattcttaaagaaaacaatttcaacccagaatttcatatccagccaaactaagcttcataagtgaaggagaaataaaatactttacagacaagcaaatgctgagagattttgtcaccaccaggcctgccctaaaagtgctcctgaaggaagcactaaacatggaaaggaacaaccggtaccagccgctgcaaaatcatgccaaaatgtaaagaccatcaagactaggaagaaactgcatcaactaacgagcaaaatcaccagctaacatcataatatgacaggatcaaattcacacataacaatattaactttaaatgtaaatggactaaatgctctaattaaaagacacagactggcaaattggataaacagtcaagacccatcagtgtgctgtattcaggaaacccatctcacgtgcagagacacacataggctcaaaaggatggaggaagatctactgagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatctatgcacccaatacaggagcacccagattcataaagcaagtcctgagtgacctacaaagagacttagactcccacacattaataatgggagactttaacaacccactgtcaacattagacagatcaatgagacagaaagtcaacaaggatacccaggaattgaactcagctctgcaccaagtggacctaatagacatctacagaactctccaccacaaatcaacagaatatagatttttttcagcaccacaccacacctattccaaaattgaccacatacttggaagtaaagctctcctcagcaaatgtaaaaggacagagattataacaaactatctctcaggccacagtgcaatcaaactagaactcaagattaagaatctcactcaaaaccgctcaactacatggaaactgaacaacctgctcctgaatgactactggatacataacgaaatgaaggcagaaataaagatgttctttgaaaccaatgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctggcagaaagaaagaaataactaaaatcagagcacaactgaaggaaatagagacacaaaaaacccttaaaaaattaatgaatccaggagctggttttttgaaaggatcaacaaaattgatagaccgctagcaagactaataaagaaaaagagaagaatcaaatagacacaataaaaaatgataaaggggatatcaccaccaatcccacagaaatacaaactaccatcagagaatactacaaacacctctatgcaaagaaactagaaaatctagaagaaatggataaattcctcgacacatacactctcccaagactaaaccaggaagaagttgaatctctgaatagaccaataacaggagctgaaattgtggcaataatcaatagtttaccaaccaaaaagtccaggaccagatggattcacagccgaattctaccagaggtacaaggaggaactggtaccattccttctgaaactattccaatcaatagaaaaagagggaatcctccctaactcattttaggaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacataattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtccaattgtccctgtttgcagatgagatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactgcaaaccactgctcaatgagataaaagaggatacaaacaaatggaagaacattccatgctcatgggtaggaagaatcaatatcatgaaaatggccatactgcccaaggtaatttatagatttaatgccatccccaccaagccaccaatgactttcttcacagaattggaaaaaactactttaaagttcatatggaaccaaaaaagagcccgcatcgccaagtcaattctaagccaaaagaacaaagctggaggcatcacactacctgacttcaaactatactacaaggctacagtaaccaaaacagcatggtactggtaccaaaacagagatctagatcaatggaacagaacagagccctcagaaataacgccgcatatctacagctatctgatctttgacaaacctgagaaaaacaagcaatggggaaaggattccctatttaataaatggtgctgggaaaactggctacccatatgtagaaagctgaaactggatcccttccttacaccttatacaaaaatcaattcaagatggattaaagacttaaatgttagacctaaaaccataaaaaccctaaaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatcaagaatctacaatgaactcaaacaaatttacaagaaaaaaacaaacaaccccatcaacaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccacttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatatggcacatatacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagatcacatggacacaggaaggggaatatcacactctggggactgtggtgaggtggggggaggggggagggatagcattgggagatatacctaatgctagatgacgagttagtgggtgcagcgcaccagcatggcacatgtatacatatgtaactaacctgcacgttgtgcacatgtaccctaaaacttaaagaagtaaaaaaaaaaaaaaaaaaagaaactcttgtgtgtaattcagtttctatctcaagcaaaatcaagagtgattagaaatgtgtaagaaacaaacattaaaaaaaaaaacacattgtatcatggtagactgacagacattttagtgcagttattgagccaagactcaggtcaacttttattatacataatcccatcaaccagtttaaggtggattgaaacttgaacactgaactaatcatttacctcaggaagagagagatatatccatatgacatatataatacctatacatgttttaaaattcttattgagattttctgtatgatatatacatatatatattcacatctcactactaattttatataaatatataaaagtgagtagccccacactcccttgacctcaagggcagtctttgaagcaccttcttccctgctattcttaagcactgggtggatctgattgcccagatagggcactgcctttccccaaggtcacacagcaatgaagggggacagatggaggagagggggcctagatgtgcaggcagccccacacggtctcattggagtactgagaggcccaggcctcagctacataggagaactgctccttgctgctgggccagtaggtgccctccgtctgcctcatctccggaagcttccgcaccaatagtgccagccccactgccaggaacaagacagccaggaatcagaggaccaagatgatagcagtgacggccccccgaaacagggctccactggagctggagctggtgggtgtaggccaaacaatgctactctcatttgcagaaggggttgatatttgcgcccagggtcgttcccagggacgacagcagcggcaggcccagcgccaggagtagccccaggccgagctgggtgacgggttgacagtgccgaggaaggggcttctggcgcgcgcccctcctacagcatacagggcgggccatgggcacctgcaacggggcacctgacccaggtgtctttgaagtcgctctgtatatattctatatatatatatcagaacatctcagtaataattttttctgtcatctgaatttgctagtttcattgtccatgaaacctaaattaaaagtgttagtttgtgctaaattattctatgtttttaagcagaaacaaatccttgtttttgacactaaattttttcagttgacccaattgatcctacaaatgggttggacagaaattcacatcaaatgctaaagattattggtttgtctgatggttaacgtatgatcaatttgtcaaagagtaggagataaaaattttcgaaaacagttaaattaaccatgagtaatttcacccaagacacaacgttagaatacctctgctaaggaaaaagtgaaataataatcagaaattctaaactgaagattagcgttcctttaagtattcagctttcttaactaaatcaaacaagaaaaacctctgtaattcctagatatctagtttcaatagctcttaaatttgactcttaccagcctgtatgcttcagtgaccctataaaaatagccaacaagcacctgagaataagaagaatatacaagtctccatccctttgcatttaaatacctatccaacctctcattttattactttgacattctacatcacagacattgtgaaagcagaagagtaacttttctattattctattaatggccttaaactcagtgttttaaaacaatataagttgcttatcacacatttttggaggtcaggagttagacaggggtttcactgggtagaaatccagatgtgctcaagggctgcactagctttggaagctccaaaggataatttgtttcctgttttctggcttttggagaccacccatatccctggcttgtgaccctccttaggtttgtgaccccttcctccatgttcaatgccagcaacagtagggtaccttcacatctctgcctctgaccctctgcttctgtcatcacaactcctctaactctcactttcttgcttccctctttcccttgtacggaccctcctgatgacattggagccacctgaatcatccaagattatttcctcatctccagactcttaatcacatttgcaaactccttttccatataaagtaatgtgtccacaggtactggagattaggatgtgatcatgttttgggggatccttattttgcttaccacagtttcaaattattgagcacttctatgtccccagccctgtattaactttatcatactaaatctcacttaattattacaataagtcaaggagtttggtattttaatttctagataggaggacacaaatgcttagaaaggttttgtcatggcctctgttagactgatgagcatgaaatctcttcatcccactaccactgtgctcctttatcaccttcctccctaaccatcccaataatttctctccctgactgtcaaatcctccatctaaacctcaaactgctttgaaatttttcctcctaaaatgccgtcatacttctcttctcttcatcaaatgtcattgtctcctctattccagagaatgtagactaagaaaaaggcaagcaagatctttcacaatgtgtctcaaagctcctttctataacattcctcttctagccctgacatctcaaacttactgatcttctaaagtttaacattcacttacctggcttcatgaaatctctcagcttgtagtacccctgccaggcctatatatggtcaaatggtcttttttctgctctatagcttcccccaaaatttcccctttaatgtatttgcgtttttctaagaattccaataactttggcccattgtgaaacagtgttggaaaaagttggaatgggacttcagagagaattgtggatatggatccctgctcagccatgtactatctgtgtgccagatctaattatttgataactctgaatgcattttctcatctgaaaaatagagatgaagatacttacctctagcgatttctctgagaaccaaaggatataatgtacaccaaggtgacccagaggctgtcatacatcaaggctcagtgcctggtaacatgtgttattatactcctcctttagaggcaatttactttctttgcattttttaaagtaagaaaccacagctactttctttcactttataagtttgttgcagaattttcttttctttaagggtcgtagaaggacatccaaagcatgcatgaaaaacagctttactgaaacattgatgataaccatgattccaggtgctattcctgtatgtaactttgactctccatgtccttgagatgacatcaagattacctctcaatagtggtgactgaaaaaattctgcattcagcactgtcactgtctagatttgtaatctgatatttgatcttccattggaaagtctgaaaaagcagagctcacatttaccaaaatctctgcctgttctaattggctaagctaaagagaagacagaggtattttctttgtttgtttgttttctcacatgatcatccagtcatctactcaagagatagtgcctcccatgagccatgcctagagttagatgctgagggcctaagagcaattaaaccaagcaagatctttgccaaccggcaatttctcttttagagaagaggcaacctaaaacaagaaaaaaagacaaatgaataaaataatcataaattatgaaaagaacagtgaagaaaataaatgagaaactaagatgtacataaggagcatctatatgggataggctatgtattttgatacaaaattaaagataaagaggagttaaaggacaaaagaacttccagacagaaggaacagcatatgccaaacttcttaagtattattgttgctgttgatgatgatgatactagtattattaaacaaatatcagtgattcatctgcaagtaccaaagcctagtggaaatgatggatttccaaaagaaacagaggtactgcaaatatactgtgatccacacagacattacttaaatggaatttagatttacaaggaaagaaagaaaaatatttatgtcaattccaagcagaaaagaaaagtgaaacaaacaaaacactacttatgtggaaagaagtattcagacgcaataactaaaagtgtttgcaaatgttggctcaatttggcccttgacgttgactgactagcactttgtactcgattctttcttgctgcaaatatgcaatcaatccatatttaaacataaaggaagcattaagcttttattttatcttgcacttatgttctttctcttctgcccaaatgtcaaccccatgctgttacttagaggtgtaacataagaagttgtttttgaattgagttcacagtgtgaactacagttgaaaagaaatgccatctacagaaaaattgattacagggaaaccattagaattctgaggggctagtttaatgttgctctgtcatttgattaatagaaaatgatttagtctttggaaattgcctggaaagattttaaaagttagaaaagtgcttgtttgctgagtttaccattgacagacttggtacaaatatcatgacatgtgttttgtgctatccatgtggcagtgttttggtttctcaagatgatagaaattttaattttatcatagatatttgcaatccagtttaatcaactatatcaaaccagaactgttaacagtactcacattaaggtgatggccttctaaagcagctttcagaagttttatttgtcaatatcagacataaaggattgacactggagaaacatccattgataaaaataagaaaggatgtagactaagagatattctaagataattagctgagactctcccattttatctccctttctaaaaacatatcaagcatccaagtaagagcaatattattaaggggaaaacttgaatgtacactaattgtatctaagaagtgaatcatttgcaaacttcagagttggattattagcaacaaaccacttcgaacacaactgaaaaattgattatgtcataacaccacagtggagaactgctactcttggaagagaattaacagttacagggctttttaatatataccactaaccaaatgaggaatatttcatattttatttcatatctcataaattaggagttattcgtttcattttataatgggaaaatccggctcttggaagagattggatacaaattcaagtctctctgacatcaaagcccaactcttctcatctcccagagagcaagagaagtaaaacattctaaataatctgtataattggctattcataccaaggtactcactccgaatgcaactcttctcgttttatgcccacagaaagttgtgcttctgctttggtagatgaggacacaaatgcaaacatgtcaatgacaaagtcattgccaacattgcaaactgctcctttacatagctggaagaaatcaattctgtctcctagccagttgattttttcaatggatttatagtgttgaaaacaatactttttcctaaaacaaacaaaacatccggaaatacataaaacattcagaatccacactgccaatgacactgaagtggtgaatttgtattttctctgtattgattatataatggtaatgttagtgctgaattttaaagaacagagataaaaagaaaggtatcaagagtagactagatattaaaattgcaatatcctgtgagaattttgatattatatcttttatagctgagaaaaagattttaaaaggcactggaggataagttgaggaaggatagttacaaaataattcttgctgccattcagacctttagaaataaatatgttgataagcattataaatgacaagtacgttgtacattgacaagcaaagtaatggatgcttagtaagctaaaagctttcaggcctttaattatgggtttatattgtcaagaaatgtaccaggacatggtcaatccaattggcctgtccatcttataaataggtatggattgctatgagtctgaccacggcaattggtcttgatcataggacaacataatgaatggattggctgtattgtgtcacctatggatctgcccagagcccagtgcataatcaatacagcctgagaagatcaccacagggccctgaacagttttccttagccaccttattgtacagtcatttattcaacgtgtatgaattggatgtctcctatgtgccaggcactgtgctaggggttagtaatacagagttgagtaaggcacttgccctcaagaaatttaaacaaacacataaccaagaataaatgtaaaccaatgtgataaacctataataaaatatgaactaagcctcatgtaagcatacagggaaacatttctctatcacatcccaactggactgtaagtgattgagtgaacaatagtgatatcccagtggaagtggggtggaaagagaatgtatggtaatatatttgagacacctggattcagcaatatgtgaatcttccagtgacacacaggagattaaacagcagttgactcaaaactatgaaagaaatagtttccacttctaccagtgttataatgaattaaatattatgctcactcagcctcacaaattcaaaagagatgccaaaaacatcttgttgggcagttttatctttacttccactttccagatgaattattttatatctctccagtttcaatctcaaaaatagtcatgtggactcagataagcagcaagttgttctgcagaaacactagactgaaagcgctagaccaagattcgtcagctgcatgcttttggataagtgacttcccaacctggattctcgttttcttgtatgtaaaattctctagttggactatatccattactttagaagccagattctaaatctttcatctcttatctcccaccatctctcacgcagacaacattaatttcagaaaactaaaagtcgcagtttggatttaaagttgatgtcctttgggatgatcaatcagtttgtgatgattttccccttttctggcttcccaaaagctccatttattttaaacggcatgcatctttcacattgtccagacacagttgattaagctaagatagacatacgaccaaatgaagtcaatcatcagctttctcaggggaactcaaacttggactatctctgaacagaggaggttttaagtttcaggtgtggtgaacagtcatgatttctgccgtgtgcagtgagaatgacaaagaggtactctctggcaagatgagtatacagcagaccctgcttcaataagcagagtgaagactgtggctttgtgacatttttttctctcctcagactctgctgcaatctgccatgacttataagaaatatccttgataatttactacaaatattttgcttaaaatatcttgagttagttgtgttacagttagaaagctaactaatacaatgttaaaaagtaaagaattttaggaatgaacatctatgtgttgatatatataaaatgtttgcaacttgaatttgccaaacatgctcattgattgatggccaaatggaatcctagataaagagaccctctgtctgtttatatatgataaagtaaacaaactcaacagcaatgattaataaattaatactggacatgcagcaagccattattaattcataagtctgtcacaaaggcattcccaaatgaccagatttgaataaatttgcttactgtgattagaattaatatatttcaaatgacactgaagacattttagctccttctatgcaaatcatcgaagacttattttttcttttcatgttgatgcatcatactttgaccatgagctaattaacattcatttggatctttgattatctctttaaagctccaagccaaccaccagcaaacattgcctggaagctgacaaactctaaattatgcttgaactgggagcatgtaaaaaccatggaaaatgagtctgaagttttggggtacaaggtgagtttttagtttttcctttaatcatatcaattaagttactaaggaatgaaacatgtgacacccaaatggaaaacaaattggatgcatatggaaacactggaatctttttcaaaattattttgaaaataccattgctgctttctaattttccattgaaaatgttttacattccaaggtccagtaatgtattagggaacatcaataaatcaaattccataggatgtaacattttttcttcaagtggcatcccttgctatcataagatgatggcttatgtgcatagtagatgtgatgacaatgagatcaaaaaatatatctaaatagagattttagaacttaggctgcagtatgatgtgatcttttaacaacataaaaggcatctaacaagagtacaatcaagtacccagagcaactcatttccatcagtgacaatggacatcatctcttggcagacatatattcaacatttgaaatgggtccaaactcaacagtgactttccacagcaagctccaatgataatagcctcaagctatttaactaatagggataaatctactctccttccagaggcattggccaaaaaaaaaaacacctctttttcttaacaggagcaatggaatataaggaaaagacatcacttggatatttccatctgaggagtacaacatttatgatgatgtatcttatgtcttacagtgttccagaacagttgtgtgaaccttagaaaagcaacatgtccatgttaacttgatacctcattttattcagattctgtaccggcaaaacagacagagtaaaactcatattttggaaacaaacaatacatcagctgagcttctggttccatttgaagaagactacttaattgaaataagaacagtcagtgatggtggagatggaagcagcagtgaggaaattaggattccaaaaatgtcaagtaagttgagtcaccattgctgtagtagattctgaacctagacagctgcagcatgaaattcagctccatgaaaccttccagttatggcttaaatgttgggtgataagataaattttcaattgtgagcaaaaggtgatgagccatttttttaagttattctccaaaattataacatacactataaatggttttatgcttcctcatttgaaaaccaaaaagagaacaggaaaaaaaatctttgtgtcattagagcataattgtatcactcattctattatcacaaaaatcagaaagatttttcatagattctttcgggtcttttacaacaggaatggcaaatatgaagcacaggtaaatatacaccctttcccatgttcatggcagacatcactaatcaagtgtggctttcataaggagctgagtcacaactttcaagtcctcctcaaaacaattttctaagccaaccaacaccagtcagtcagagttagcaggcaataataatgtatcatttttgcattagaaaaatcacttactcatctgcctgaagctgtgattgagtgcaagtcattagcatccaatgttggccaatcctttaggcagactttgccaatttagggattttccttttgcatttttatacttaaatcagatgtccttggacaaagacacggtaaggcactttctaaaattaaatataatgtgaatgagacaagtataataaaatatgttactagaagagaaatgatagtatgaaattggggttttgaaaaattaatctaacaggcaatactttatctcaaaatatttttgtcttatttttatattttgcaggtttgagttccagaggaattcaattcttagaacctagcacccattttctttccattgtcattgtgatttttcactgttttgctattcagccacttatctgatgaataaaaccataaatctttgagagttttttgaaagcaaatcattctgtatatatgctctccagcctctgacacaagatgcgttcttaatacagacttgtttgcaaagaaaaaaaaaagtatattattaaaatcctgtaaatatctatggtatattaataaaacaattttaaaca

SEQ ID NO: 2201 - DNA, 450474 bp, Homo sapiens
aggccagaaatacttctttttattaaaacacggatcattattaaaacaccttgaggtacattaaataaatacagcctttccagttgtacagacaggtctctggtggcttgaaaacaatttcctataaattctgccttagcagcctctgagagtcagcatgggtggggagaagcatgtgtgtgtagcgagctttctgtggcctggtgtgttacaagcatttaatgtggatcctcatctccagccaagggagacctgaagtccttgcggatgatgctcccccttctgcgatcttgcttgccatagagttggggtccatgttctccccactcagcaaccttgtggcccccaggctggggtcaacggtggtgtcacagcaggtgccaaccccctttgggtctcaggggagggcaggggatgcccggggcccagctgagttggagaaggagcgtgtcacccccaaagcagccacagttggcccatttcagatcccagatggaacatgattggagcgggggaaagacgcatagggaggggaagcagccagctttctcctgggctgtgagctgacgtgcagcccggggcctgggctcttgctgctggtacccggatgccgtggagccggggccaaggggaccacagcttctgggtcaagttgccagcacattccctagtctaccagcacctctctcttctggggaccttcccaggaagcccagaacctggaccctcctagagtccatgagtggccctgagcagcggggctgatgggggcaccccaccccgtccctgactgcctcatttcgaaggggcagaaggttccagcccagcggcatcaagttgggtacagtttccgtatccacaaaacagagctgccaccagcgcaaacccagagctgggtgaaggtggggtgcaggtgaggggcctacagggaggcactgctggggcagcagccccattggccattgggaccgggccctgctgcagagaagggaaggatgctgagcagcaggctgagggggtccagtaggcctctgccccggctgcatgaggagaacaccccagagaccgagtccactgggtggctggtggtcttggcctcgctggaattgcagccatgtctgaggactgcagctctagcccacccaagggctcagcccagggacaatgctgtgtgaacccccaagccctagtgtggacccccccaagcaggtgaaacccctgcggcgtggccccagcgcacctcagagacagtggagattcagaggccagggcgtcaggcgtggctgaagctcggctccagggcggccattctgaaaatccaccaattaatttcacctgcaaagggacttgccttgagggaattcaaaagcccccacttgaggaaaattagagatttcctgttttatagtctgaataaagtgctcaaaaattcatctctagtacgtctctcctgcaaaagtgcaggttgtcatcaaaaggcctggcttatgtgttttcagctctctaaagcaatcgaagccttttcagccgaccacagctgaaggagtcccacaccgcagcccccagggcagggataaaggactggaggaaggctctgggcacctggattggaacctcacccccttcccagcttccagccacacagaagctccccagcacactggccacagtggcattagggaattgggggagctcaaggacaagccccacaaagccgagggaacagcagcgtgagccccctgccctggcacccaggagtggaagacaccctctggtccccctgcgcccccatgccaggctcatgggctctctggggagaccttggcctctaggctgttttgttcaccgcagggcccacccaacgcagctcaggggctgtggctgctagtggccctgaacaggcatttccatcactgcacaaagttctcgtggatggcgctgttccacggccattgttgggagcagctgccactgatgccaccagaaaacaaggggatgggggctaagaaagtccaaggtccccaggctgtccccaagctgggcgtgtctgcttctccataagcagcacgttgggtgtctgcttcccttctcgtgtgggtttgtaagtggtttatgatcctcctgcgcaggtgtgtctgctgccgcatgcccggggaaaggtcagctctgggtcaaagggacctgctttatcaggaggggctacttctcagagaaaccggcctctctcctgcagaactgtgacccgctgagctcaatcaagtgagctcagacacaaaggagctgggaatcggcacttgttgttacggatcacacaactgctccagggacaggatgggagcctggagaaagggggcccaagaggagggggggaaggcaccccacggagggaggccgagctcaaggcccaggagatggtgggttcctccaacccccgcaacaccggcctgttccctggggggggccgggctatggcagaggcccgcactgcacatttgtttgcacaatagccctgtggacagaaagttgggcccaggctgccatctgtgctaacactacctatttcctttcacaggaaataggccagagcgtgatgaacgcctaatgatagagccatcgagccacatgagaaaatgtttcatgactcgatgtcaccctctgtccactgaacactaagttaaatgggggatgggagactcctgctttggaaggccctgattttggagatactttgagtctttaggtgacgtaagtgtcgcctgttgctgtattcacatttgtgcaacactgctcagttcaaggtgctgcacgccagataaaaccagagagttcactgtggacgtgaaagtcatctttccgaattactgggctaggcaggaaatgcaatccccaaagagacactgctcggctcccctcgagagagggggtaacagttccctgcccacaccgcccccagatcatcctgggtgtcccccccacatttatcctccgccaagctgggcctgaaggcctctttgtcaggcatgatggcttctgccaagaacatctgtggcgccaggcgttggtgtccacggtcagaaatgtggctccttcatacctggtccagaacgtcagcgccgaagacggcctcctcctcgaggcgctcctcgttggtgacagccaagcgcatggcacccaccatgtgctgtgcctcggtggggagggcacagtgtgagtgttccaaaaacttggccaccaaaaccctggcatccgcataggccttgctgtccactaaagagcgtggccgctctttggaggtcgctgggaagggctctggtgttggccgttggtcagttttccaggtatctgggtcccccgctggtgaaagctgggcccgacaggcagccgtggcagagcgagacatggaagctaaaaatcaagggcaaaagtgcagttcaaaactcactgaaataagaagttaactcaaaagcaaagaaaagcctgctcgggaggagcctcctgctggggtttctgtgttcctggggctggcgctctgggcatgccctgctgtccccatccctcctccccttctcaaccccaaactgaactagtgtcaacctccaggggctgcagcctccaggagcgaaggcctggggggaagggccaccacagcaggcagcgacccacttctgccctctgctagaatcccaagggcacaggggctggtccttcccagtcttctcgcctccacgacctttgcccctttgggtctgatctcttgctggggcagaatcatggcatctagagacagggtctgccttaagaccagaactgggggtggcagagggaacatgagaccgccccccccatcatgccaggtgcaggcagccaccactcagtgccctgctccactgcctgccaggccagaggctggggacctggctccagctccccacagagctgacagcctctctgcatgacccacaggctggacactgggctgagggtccctgtaagacggccagctccgggctgtcagtggcgagggacgccaacaaggaccagcgaaggcccggcttgcccagcctgagcttcacgccacacaaagttggaacattctgggtcgtctgttctggtgtcttgtttggtggcaactggaaagcctagcaattaaacatgagaaattaagaaactcccaggtggggcccatctaccccagatgaaatctcataaagtgggctgagcagtcacaggtgtgttaaattagtgctagccctggatataagtgcaccgagagacaaaggaagagaaaggccctcaaagccagacagtgggcagcccccattcccgggggtggggtgaggagctgcatttggaaacaatgtagccaaggacccaccaacacccgccccacctcccagcaggcgcagtcaaagcgctttagaaaagaagcgtctcaccgctcccaggcacagcctcagacagtcccgcttccaggtcctggctacacgacggcctgtgtgaagaggcatcgccttaaccagaaggagaattcagtgaacacatgaaaggaaaaaggaattcctgagaaagctatcataacccgcctgtgactaagacattttagatggcgagcaagcaggagaagcctgctgagctgacacccaccgagcggcagatcagacaggaaccgccctgcagctggccaggcctgccgtgggtcaagtggtgtcccaggtcccaccctgacacagtgcaatgggccagtggctcaaagaaagcccagcacccttcatgggaattcccaccctcacctgaagggctccaggcaccctggaaggcatgtgcctgcggcgtgcacatcagcctagccaagaggggacagaggcgtcaggcgggtgtgtgggtgccgaggtgtgaatttcactgagagggacaggcccaacaaagccatcagggggccacagagtggacccatgagcccctccaagtacagggcatcctcctccaaacctcagtgagtgaatgtgagcatggtggagagaggttccggagctcaagaaaccagcagaggggggtgtttcagaaggtttgacgggactctctccctgtgagctggcaatgggatgcaggaaggaggaatacagagatgaccgcagccagggagtccacatgtgccaaacctggtatttccaccaggagggtacctccaggcaactggccactgcgggctctggttcctttcagggactcggttccgggctccagtagagatcagctgggcaagaccatcgaggggagactgagccaggacccactgcgccctcttcagggttcctgcacttccacttcatgaaaagtccccacagcaatggcatggaggtcaaaggcccaccaatctttattggcagaaactgtgcctcctctcaaaagacagtgatgaggactgggtgtgagttctccagcgccgggggtgcccaagactcccggggagctactgtgaaatgcaaattcctgcgctgctggccacagggacctggtgccaggtcctaggctccagggcactgcccgcagacacagtcgcatggggcgatttttgaaagctctgggctgtgtggagagccaagctgcctgggaaatgctgctgaaaacgcacctgtgtctgcgtggggcggctccagctgatgacacccccatgcccagagctatcgttgggggtcatctgtcctgtgccagactctaggccttttctgggccctggagcacgtgtgcagcacttatagctaatgtcctggactgggccccgggccccttgaatccttcctcccctgccagagtgacaagcctggtggggtgcagaggggcccacaggctgctccccacccacccctggctcaggggccatcaagaccacattcccagtgtggccccagacaggatctgcagggccgggcctccactctcaggggtcactgagacctgcagcatccaaggaaagctggccacactctggggacatgggtgagcctggccaacctacctgccatgctagatgtgcacaaggtggggtcgctggtggagcgggacacacgcccgggacctggctgcacctgtgagcccatgccaggatcctctggagacacatggccagggggaagggcaggttcggagggtgctggggcgcccacagggccatcgggggatgggctggaacctggcgtagcagtgccctcggacaccaggaggcttgtgctgtcagctggtactgcaagagaagggacatggcattagagtgggcggccgcaggggacgctggcgtgggacaggcctgcccctcaaactccagacctagatgaactctgaaaccctgggggtgcggaaacactggataagattgacaaatgctgctttatgctgttgaaagttgggggcaccagatgagctcccagaaatcattccaggaatggcatggttcgggggcttagacccttcacactacacaagagactaaaagtcagaaatcagacactttggtcacaagacgctttggtctgggtgaacagggccagtgcaggggtacacagcagccccaagggacatcaaggcatccccaccaggtcgcggcaggccagatctcaggcccgcccttgcaggggtgcagccccgggcctggagtgcagccagacagggtggtgcaggcaggtgggataaactccgcccaccagacactggccttggctctcagggtgtggacgccacgccagcagcagcagcagccttgccctgggaacaagcggggaatgcagactctcagctggaccccagacccatggaagcagagactctggcgctgggcccagccaccggggttgaagcgagccctccagggaattctgatgccctccaaactgtaagaactgctggtctggaccgggatgctggtcagggctgggctcttgccgggaaccactctacgggggctggatcggagtctgttttaataccatctccacggggtgtgcatgcatgtgacagtgtgataagctgctcctgcactctcccctcccatcaccaggtgccctcagagccccctcctggcgccacagtggagttgcctgcatgggggacacttcatagatcacagaagcctggactcctccaggcgtgggggctttgggtctgttcctgccatccctttctgtttttccctgcgtctgtgagcctgcccatgggcaacaggcttttcaggccacctcccacttcatccttcctgtccgtctgtgaggcagccccaggttacccccaccctacagctgcagaaatgggcttagacagggaagggttgagggtcacacagccaccaaggtggtcctctactcaggagagtcctgacccctgtaccccagcagaagcctcggtgctggaagctctgctggtccctgggtcagctgtagagttcaccgcccaggtcccaggagggaggaagatccagccctgctgaattctgggtgaggagcacccctgtctatttccacctgccctgagatgggaaacaggaaggggctcaggtagcaccagcccccttcagcccaaaccctggaatgctgcaggtgtggccgccctgtgacagtgactgagatacactgtaccctgggttggccgtgggaaagtcactgaataccttcttgaacagcctctgatggcttggagtgaccaaaggaaggaaaagattgcttccaaatcccacgactgcaaagatgctgcgctctacaacccccggtggcctcagaaagatggctccttcctgtttctcttagatgctgagtgagtgttcagcaggggacagagcgccctggggcgatcatcctggccctctgtgggatcacatgagttatctaactttgttctccaaataagccagcccatgtgacccctcgcaggggcctcaagacggtggctctctggctcacttggcctccgtgccctttctccctctgctgctaagggcccttctgctttcctggagccttagaccacctcccccgccccggctctgcacgcgacacccaccctctgtgtctggggatttgacccttgcacacgtgtccttcaatgccctcaaggacatgacttccagcctgcaccctcctgccagccgcccagcccagccaccttcttcagagggaggtgccgtgtggacatttgcccggtaggtacaactttggctctggaaaggggaccctagatggagtcgtgctcttcttcaaatccatatccctcaagtgagaaagtggggcagaggaagacaaggtctccccggagagcgcaggagatctcctgcatatgctgactgtagtggatgcagacacaggaagaaatgtggggatatacagggtatttaatgggaaagactgctgcaaactccaccctcttaaagagtaagaaatggagggaggaggaggaaaaagagaagagaagagaagagaataggacgaggacgaaaaagagacacccttgaaaacaggaacaccccacttcaggagctgaaagaggtaagcttacctggagtgctgaagccagcactggtgtttgggtccccggagctggactcggccacctgctgacctatacttgtaacctacagtaagaaacagaaagcgtcaaggcggctggtccgtgggaacgcagcacagcagcctccagtagtgtaggcgcttaaacttgtctcctggtgggaagcgctgagagacgttcatccacacctccactcttctcccctacatttatgaggtggggtgtgagggttcaagttgcccttgccaaggccaaagtctagttttcttttttctttttttgagacggagtcttgctctgtcacccaggctggagtgcaatggcacgatctcagctcactgcaacatccgctgcccggattcaagcgattctcctgcttcagcctcctgagtagctgggattacaggtgtccaccaccgtgcccagctagttttttgtatttttagtagagatggggttttgccatcttggccaggctggtctcaaactcctgacctcaggcgatccgcctgctttggcctcccaaagtgctgggattacaaggtgtgagccaccgcccctggccgaaagcctatttttctgaacttttgcaatcagagagcctggcagggccacagagccacctgagcctacgagttgcacagtcatcgagcttttgtggctttcgatttctttttcttttctttatttatacattttagagacaaggtctcgctccatggcccaggctggagtccagtggtgcaatcatagctcactgcagactcgaactcctggggttaagcgatcctcaggcctcagccttctgagtagctgggattataggcatgagctaccacgccctgcttttttcagctttcttcttggatatactctgattccgcctggagaggcctcagaataaggggaaggctatacctcctctgctctctgccccatcttcattttgcccattctgcgtgggccatggtttccacctcagagggcatcagggcctcccggatgcgatgtttggatgtgatgccagctacacacatgttgcatgagcacccccatgcaccccatgctacctcagaaaacaattttttgaatccctgtgttatttcagaattgctttggggatacacttgcaaataatgagctccagaggagactgggaaggtgaggggggctcctgcgacttgctctgattccagctcaggtaattacatttctgcctcccttatctcccgccacttcaatcagatagctggtctccttcatctctcctcttcaaccaggctgacaccagggcgggggctggggctgcagccttcccacccacacaaagggtgtgagctgcccccacagcgtggggctcgagaggtggttccgagacaaagagaagacggagagctgcccaagtgcgtcctttgatctcactaagatgctttcgcataatacggtccatactatttttcttccttagccctctcattctgctgggagggaatcggtgagggagaattcaccccaccatcagcacccacctgctttttcactgaagtcattatgtgccaataaccagtcctggaaatctctgtccagaaccttccactgaatcacaaagagcgaacaatgtcctaacggtttgtttcatcctgtgtctcccctcccgtatctaaccctctctcggacttgcttttcttttggatcgtagacgggtggttaacttagaactccgctgtctaaaagaaaatcttctggtaataaagaaatataaataaaacaagagaaagaaaatatacagtgggacaaggtcaggaggaaactggattcacttcatgttgtgcagaagcatcattcacttccttctggctcccggtcagatttggtttccagaggaggcagctcctgggagcctatctatcacctctcgcaagcagagtgtcaagagtttaatttaaatgtggcccttccctgatgtcagaagccaccttgccacgctaagccatggggaaaatagcacttcctttcatacagcatttttgatgaactataacagcagtagaaaagggtggggaagaaatatatttgtggcatagaatttaagttgaaatttgagttcagtgaggaagctcataaacacagctccttacagaaggagagcggggagagggctgttgacaggagacgctgtgggaatcacttcacctgggtcttactggtttgcagatgtgctattctgaacagtcatcgtaactggaaaataagttggcttttcaacaaataattcaaattgtatgaagctaagacacttgcatggaaattctgccccattctgtagtttcccactcctgggtgaggccaaccattagaaacagatttatgaagagctcttcgtttggggcaattccagcgattatggaaaatgtgagttaaaattttaggctggtggctcaaggcaaactttgaagacactttgctaacagattttatgtggatcgtaagtgtcaggacctggtgctgctcctggactctgctggtccctctcccttctcacaactccttgtctcgcactcaggttcccttccacctggcatgctgccaccaaattaaactcctaaagcatcactgggtcgcacccaagacgccaaactcctcaagggcacttctacagtttgacatccaaagccataaaatatctgcccaaatgatttcagccctggggtgctgaagctcccacagccaggctccaggctgtcctgccatgcgccttagctggtgctgtgaccttcacctgcaccacctccccctccttcacacaccccagcccgacaagcccccccatatcacctccccctctacacgcaccccagcccacccagatcaccaggcccgattcctctgcagaagcctcaaaggagttcgtgtctgtccggtctccatgtgagagtgcgagagtgccacgacagggggattctgtcctacatcctctggagggccaccgtcgtcagtggcccctgaaccatacgcttgccacccagacaagaagatcaaactggtaatttctcaatcactttcctgctatcaaaagaaactcactccttgaacactggctgaagagtacagcctcaaaccacaggaaagagaatggcatctgacctaagccggaagggaagtgtgcacggcccgtcacccatgcgagtgctcacggagcccaccctcgtggaggccgccccctcttgggttaaacctcttccccagcacaccccctgccccgccccagagtcagctcctccccgacagagcccgccttctgcagcctcctctctttatccaaactgaggccgagggcactttctacgccatttgtcctaacaaggaggagcactactgaccctgcctcgcccgggctgcggggtcgtgctgtgaaggggtgctccttgctgtctagtcagaggggccttgctgcctggggaggggacagctggtggtgcagctggcggcacggccttccctctgtggacggtaatgggtttctttgacttccagactcccagacacggccgtgaattgaaaagtgctcccaggccatggggtcaaagacagtgggcccgagggctctagcggccccttcatcaccagatgctgccctgctgccaggcgggcgcccagggacaggccctgcaggcggtcgtgctgtgcccctgccagcactgggagctgggggtctccgagccaacacatgctaattcgagatcagcctctgacctttcagctgttctcaccgcagttctgagaaagagatctcaactgagagaattccccagagttctggagaagggtgtcgcattggtttcagaaccagccagatcccttccaatatattctattcttcagagaaaacagtaaaactgtgaacacaacaggaacccattccttccgggggccgctgtgaggtcagacattgaatggcacacccaggtccagaagctacttccagcaggcagggccctcgggaagccagggtctgggctccacggacaggggttcctgtcgtcaggaggcagaggggtccaaggggcagggagaaccgggaagcaggctcagagccagtcccagtgcagagccggaattgtgatggcagcaggcagggtcactgagcagaggcggtgaaggggacagagctgcccccgcgccacaaggcagccatggggaaccacacacccctgccgccttcaggggtttccgggtccatctgccgccctgcccggtgcccctgctggctacagcatggagcttcccattgcaccctcggtcagcctcccctctgccttcccaggggcttccctcacggagggccctgtcctgggcctgccatccccagtatctaggtccttccacatctgcctggtaacctcctcaaggtcctagatccacactcccctctacctaccatcccatcttctctcctctttaccaaacatcctgcgagagtgatctactcctgctctcaaagtgggagcagcagcagggctgaggcttttatacccccaacttcaataccccaattactgactcaggagccctgggggtgggcccagtcattaggatttgattatcaagttccccacagggacacccactggtgtctgaaaaccacagccacacctgcgctcccctgcgcacgtgccgtccactcctttacctggtgtggtccagccctgccctccatcgcatcaaagctgctctgccaaggccaccagcagcccctccatggtgcgccacgtggccctggatgttagcttctggacagcacctgacccattgctttcttccagaactgctggttttggcaaatccaggctcctgggagccctgcctagtgccctgtagcctgtcgtgtgtgggggtgcctttctcctgccacctgcaatggtgtcattctgtggggctccctctctcacatttcccaggccccagtgacagcggcagctaactctgatcactatgaactacagctcctgtcatctggtggacactcactcagaattcaacccaccacacccagacaggtcaacacccatgcacactcatccgagactctttacggacgaccttctgtttgggggatacgctgtgcctgtccttcttccctctgagcctttgcacaggctgttccctctctcaggagcccttccagccccactccctgcacctcgcatgcctgatgcccacccagcctgacctcccagaccttccatggacccccaaattgggcctgacatcatgacaggtgccccacagtgtactgggctccccttgcagtgctgatgacaactattatcacagccaactgtctccactgataacattgatttgaattatttttatcataaatggaaaactaaacaacattgggaaggcagaggtcccagctcagctttataaaaacacctaagaacatctccattactgccagttcaggaatgggatttcagggccatgcccacctcctgactaaaggattcctctccacaggcagctcccacacatctgcttctagcacccacagtaaaaagggggtcctggccggggctcagggggccactgtctgcagcctgcctggctgctccaggtgtttcagggtggctgcttggggactgtctgcttgtgtgaggatgtgctgggggctcacgggccagccggaagctgatctggcccaccacaagccaccctgaaggaggtccctgtggtatatatgactccccaggtgcggggcaccttacagcgtctgaatgcgctgtccatatatgactccacagggcacagagaagtcacatctcttcctgtcctaagaccaccctgcctgcaacggtgaccagtccttgtgggtgtgattgtcggaagggcttgtgagcttattcagccaacatggaaactgctcctccacccacagaagctcctcagggtcagcgctgccttggtcactggttgggacagggaccagcattgccacctggcttgcgtgcatgtgggctctcgggatctcaaagtgacagggagagcattgggggtgacatcaaaaggtctgaaccctgtgctagggtgtctttacaggagtcagcagacagcgagcagctggccaggcctgatctgatgcccggtaccagtgcctggccagtgatctgggtagagataaccatccggggctccacggctgctgagaagcccaaagcaggtgcagttctgggtgggcctggatgcttctggtcatgctgtcatctgctctcctctgcttgttgcttgggctcagaattggcttcagcccctacccccgcccctccctggtgaatctgcaagtctcccctgcccacgccctctgctccaactcactgctgtgttccccagccatgccccagtccccgaggcctccaggacctccttggccacctgtcacgggagttctctgcatttcctaaactggactgtcggcctctctagcaggattggggcaatgttcatggatgatatcctaaaatatgttttccagtcgtttgctttctctccctgtatttcagggacaccagtgagctgtcgatttggtctatttacataaccccatgttccttggagggtgggtccttggaagatcccttgcactatgggccacgtgacttttccagatgtccccatctctctgtcctggctagcagcattccacactgagtcatgacaacaacgatgatgaggaggaaacaataccccaaaagggtgactgacttgctgaattcagaacttcccatgttccaagtcctgttggctccattacggacaacatcccatttcgtcccataaccctggtactgttatgatcctcattttacagatgaggaaactgaggctccacgaacatactgcctgtcacgtgtcaggcaccatgaggctgcaggagtgcctggcatgcccagctcagagaaggctgaaaggacctggcaactgaggcacttccctggcctgaagcttcttggcctcagacaggaccagggatccagggctgctttctccccaccccagagggcggtgatggcagtgtgtgatcaagacaggccggggcgccctgggtactcggtccatggacccagctctgctcctgggggctctccccttgggtcaggagctgtcccaggtccttttacctggatcccagaccacctaccagcacaaagctcagacgcacctgggctgtgactcgtggctgcagaaatggaactggggatctaaggggaaaagcaccagcactgggttccccaggcccgggctggcgtctctgcaggtgccgctctctgagcctgtggcctcatctacagcacagggctgataagaccaacatcccacaggtttgctgaaaggcttcaagagagatgaatgcatccgggggcctcggcacagggcgctcatgagtgttcacctcacagccagctcggacctggcgcggtgtgaggtgccttccgagggcaggccgggacggtgtccctagcattcccacgggaactggctttgtctggggccccaggcctcacctggctggcagggggctggcccaccaccgcctcgtacggaggggggagctcagcaggatagagcaggccggggctattgatggccacgtcatacaaagtgccgaatggagacggagcaaagtccaggtggaggcccctgaaaagacagaatcatcacatcgtcattgcccgaaggaggaggcagaagtgctgacagctctcaaagccgccagagcaggggcggccagggcttcccctcttctaatacttcccatcattgtgaaatcaaagcttcagtcactgggcgatttgcacttttgttttttttttttttctggaacgacatcaacattttcaataaactctactgacctgtccattaaaattcaaataatcatacagctgattacatctttcattaaactgtacatgttacacaaatgactgcaacgtgaccgcagctttgcacgtcatgagaacttaaggcagcaacacctgtctgcctccggcttctttcgggttgcgttgcaaaggtgccacggggaacgctgtatgtctaagaccctctccttccactgcccctcctctgttctcaccgccatgcctgcaggaccactgcaactcccaccacccggacactgctgcccatcttagtggtttcgagatgggggcagccgcgggagaccaacctctgggcctcagtggacggtgtgcaggtgtactctggggggtaatagggtggaggcgggagtggggggatgaactcgtcgaaatccagggtctggtggagaacggtgccgtgaggagtcacgcaggtggggttggcaggatgtgacctctgcggaaggaactggaaaacagagacaaccacagagttatctgggacatcttgtgtggcttgtgtctcattaagctaattatacgagagctttaatgatcagtttggaatgcctgtaatttcaactgtcaagccatgactgctaagcacacactttaaaatgaaggcgccaggaggaacgcctcgtctcagaagtctcaaaacgctttgttgcccacgctgttatacagaatgcctctttttaaagaaaacatatggtctgggaagtctttcatgctgtccctaccactccaactggcccctctgatgacagtactcaaagactgcagacggaaggctgcctgacgtgcgtggtttaagacggcacttcggctgggtgtggtggctcatgcctgtaatcccagcactttgtgaggccgaggcgggtggatcacctgtgatcaggatttcgaaaccagcttggtcaacatggcgaaaccccgtctctactaaaaatacaaaaaattagctgggcgtagtggtgcatgcctgtaatcccagctacttgggaggctgaggcaggagaactgcttgaacccgggaggcggaggtggcagtgagccaagattgtgccattgcactccagcctaggcaacagactggagtgtttttgagactctgtctgaaaaaacaaacaaacaaagacggcatttctcaaagtgtgttcatgagaaaacactagaccctcccctcgaaatgtccccaccccaccccagaattcccgtggtcaatctgtgggaaatgccacatgctcccttcttggagtcctgcattgtgcattcgtgtgttaaaggctctgagaagggctgtgctgaagtacttatttagctgtttaacattttaacccagcatttctcaaatatttcataatgggcccctttggacacgtagtatctattaatattttgcagtctcaggatttcacacagtttgtaaaacactgctctgaggaaagagagacaacttcatgagttccagaacattctactggccaaccttgaacaccgagatgctgctttaatagtgaggtgaaatcactttaacaaaaatgaaacctgtttctgcctagttttccgtttctgaaggactaaccaacaaccaactgcttttctttccaccttcacatctctgctgcccagaggtcacctgtggcgtgagatgcctgggacattgctccagctccagtcaatgccgccctatgagtgtctacacggcaagaagatccatgctgcaaaagctctgggccaggggccctcctggcgcagggcaggtgaggtaaggagaggaagggtgagtgcgtgtgtgtctgtatgtgtgtgttgtgtgtgtgtgtgcatgtgcatgtgtatgtgcatgtgcatgtgtctgtgtatatatgtatgtgtgtgtttgtatgtatgtgtatgtgcatgtgtatatgtgtatgtgtatgtgcatgtagatgtgtgtgtctctgtgtgtatgtgtatgtgtgtgtatgcgtgtgtgtgtgtgtgtgtgtgtgttgaggggaagacagggacccagaatcaccctacacaagcaaggacagctccattagaaaacagtgaggtctccaagcactgtgtggggactgcgctccccaaagcattcatgaagaacgcatctgaacgggtcttgaaagattggtgggatttcatctagtgggcgctcagggagacactcaagccccagaacaggtgagccagggaaggatgtgtttaagaaaagcaaatagataaggctctggaagtcaattcttaattctggggcactggggagcctgtaagggtgttggagctggggagcagggggactggagctgcgtggtaggaggtgccttctggcagcaggggtagggtgggctggagctgacagaggccaggacgtgaagcacttttgcacgggtatgggtgaggtgacgattctgaatggggtcaagcgctgtgaaataagcatgctctaggttgacgaagaaaggctggtggccgtgtctaaaggtctaacacatcacaggaaaatggctcccgtgggcctcctaacacacggagcacactcctcgcctctctggctggaccgacccacggctgcgtgtgtttaattgtccgaaacagaggtgaatcatccgctgtgagcgggacgcatgtgcgtctgtggtcctccgccttggaggctgtcagtcctgatgcctgctgcacagagctgagaagcagggcgagggcaaatgccctcaggtctaatcaggaaatattttcaattagtctctatcagaaattagaaaaaatatcaatgacatacccaagcaaaactaatgacatgcagacaccaaaacactttccaattcaaggcaccattccaccaggaaggagaacaagcatttgaggaggggcagaggtgcaagggaccctctccgcaggtgcaagtgagcagaggctgccacacactggaggctatgtaaaggtcaaaggacgcggctgcatctgctccgggtcgcctttcggggacatgttggccccaccttcctggacccttttcccaggaatcctttgaccttgactcctcagcctccccagcgagaatcctgcaagtggcgcttgacgtctcccctctcttccccaccatcagtgtgtgtttaattaggtctgggtgtgtctcgcggcccagggtggccagctctgtcctctgctctgcaggctggggctggaggtctgcagactacgcttcccaggctgccgtgcctgggctgccggcaggctctgcctgtagggggtgccagagggcacctggccggcctgcggggcgaggagggagctgcgggtttcctgcgccttcccacctcctcccttctgttccccggctttgcgggctgagagctgccctccgcacttattccactctctgtaagctcagcaccctcttctgttccttcagccttccacacccaagtaacctgctccccgtaactgtgttgaaatcctaagggcaatttcttttcctgaccatctggggcacatctattttacccacctctgtacccgtctcacaatcgcacacagcgggtactcagtaaacttctgcagaggagacgggcagacgcctccttgcggggcaactccactcagcccctgtccacctcctcctcgcaggagcttctaacctgtgtgcctctctgccttgattttctgtctctgtaatttggtcgccatcctgctaccacagctgtttttaaatcaatctgatgaggtcactgcagttgaaaagactttaatgagaccctggctcactgaactccatctggtttccagcttcctaacccagcgcccccaaactccccgctctttgaacaaaccagctctaatccctactatcaaacacgtattgttccttcttcccagctccccacctccctttcacctggcgcctcccagtcaccttcaggaccagcggaaatgcctgtgaccctgaaaagccagtgggcagccacccctcccccatcccacccaagctccaggctctgcagcctcacctgcatgttgactgccaggtataaagctcaactctgcacctggaggtggagggcaaaaaaggggctgtgaacagtcccttctttcccaggtggctctgtttgccctgatctgtaactgtcttctctgatccatgtggtgacaaaggtacacctgtgtctggtgcccagctggggctcatgcacccgatgtgggcatcactagtgcccagggctgtccccgcacaacaggagtgaggatttgagaccccgctggagaagagcccctgctcagtctgctccggggagaggggatccgaactcaggtgtgtgctgtccaccttctcaggtgggtgcacgtggaagtgatggaggatgagaactaaggctacctggccttgggcagcttcccaaagcccacttaacacagagccccgaacatttcagtctatccacacagcccagagtctgggatctgagggagatcgtgaagaggtcaacctgcctgggaccgggagtcagaccgcaagtcagttgtctctgggccctgcctgggcactgagggcccacaggatgtgagcacatttctgatcctgtgagtctcagtccccttccctgagaagcaccattgctcacacagacccagacagcagtgctgtgtggctgaaaggaaggcttggatcattagtatgagctcatccagcccatgcctccatctcctgccatcgggaacaaggtggggcagggcaggcatcaggggtctgtggacaagggccggggatttgcagaaacaccgtggagctctgagctgcctgttcctccaggtcccagccgggtctgctcacctccctttatatttagtggtttcctgcccagcacccactctccctgctccctctaccaatgtccttgccacatcctggctcctgaagggagcacacacacctctgaatttttccagaaagactcagaattacagggaagggccttctccctctgccttccttagacttggtagaaacagcaggcttgttactaccgaagtttgctgaatcaacttcctcctggacaaccctgcagatgagctggagctcccgctctgcgctccagaccctggggagagcccgccctgcggccccctggtcctgccgccacccccaggtaggttccatgcccacccagggctccagggtgccttactgcacagggtgaggcctgtgttcattatgactgtaattgcataaggaaatagggatgcagacaggaagagctgctcgttctgtgaaaaccaagttgaatgctttggaaagactcaataaaggagggcagccaagcagaaaccgctgccaagtcaagtccaggcaaggcaggtctaagagcagagaagaatcataaaaatctagggaaggtctgtctcccctggctggcttcccctggctggctccactttagaggaactgaatctgaaaatcattgatggtgtgatttccacaaactttctgcaagaaatacacccagacaggacaacagacccataaccaaagggatgaccacagccccaaatgagatgactggttgacagatgctcattagcatatctgacgtcaaagaaaaacgattgtgtgtccacatcatttttatgattgtctgcattagctgtttggatgaagttcctggtctgatagataagtagcacctactgtccagagacaattctgtggagcccaggcctcaaggacctcaaggttactgtgggtccccagagtgccctctccagcaggtgcagccagtgctggggtgaggcggagagaagacactggtgaacttggtgatgctgtggctcccatggggtggtgtcgtgtccctgaccagccagcaccgcttaaccagctccatgggcaaacccacagttaccacgcgatggaaggcacagtgccccctctgcactgtctaaaggaggtcaactctgtagggcagacagctacctaaatgacaataatgaaagatgaagttaataagcgcatgcctaatggagatacatgtcatagtagatgatattcctgaggctgcagcagctggcgaggaagtaagtgaagaagaaaacaatgtatcagaaaagtggaagaatgagatgacatttaaaaacaaaaaaaaaatgacattacagacacttaaatgatcaaaaaccttttctgctaaatgatgtcaatcaaccacattgtatcatcagaatgtcttttgccacgatttccacacatattagagtagctcagcttcatcagttctgacaataggcagaacgctttgcttctcatggatacaagcatgcattatgctagttccatcggcagttaatgatcccaaattgctgatccacagaaataagatgggagtttcaggttctttggagacttgttcttgctattcctagattcccaccagcactggacacatagcaaagcccctgagataattgctgactaactgaatgaatgaatgagtgagcaaagaagtgaacagatcagtaaacacaaaactgggactcttcctgaaaaatggttacggctggaattttgatcaattgtgtaagttgtcagcacatcaatcacaatagaaatcacagcctgggtccttcctgctaacatggaggagcagggagaggggctgggaaagtggggctgagacccgcacagtggagcagagttgccaggctgcagggctgccttgggggcaaattgggaagaggtgctccttcctgtgggaggtcagggcatggctgtcatcccctcagcccagcacccctctgtagggcgcagcacaacagggcaccagagaagggccgtgggggctggagctgtggctcggggggcttcccacaggttctttctgagaaaagaaattagttgattgggaaagggtggccgaagggcttacacacacttgcccacagtgaccttcctccttaattatgctccctttataaattagtgcttctcacttggaaggtctcagatacaaataaacaccagaaatgaagagttagtacaaccaaagccacaactgaatgcaagaaatgaaaacccgctcagaacaaagaggccgacatacaggaaggtaaagaacacagaaacagcagtgagcagtaaagcttctataaaattaaatctaaaggggtcatgaagatgtgaagggatgctgtgatttaagggctaaggaggagtgacatagaaaagacatcccaaagagcttacactctaacacatttcgcctggaactaaatgactttaaaccaccgcaggaaaacccagaagctggccatggtgtgggaggaggagggaagtgacgcactccaaagaaatgacagggtaagaagaaagtcatgctgaggaaagcacaaaacaccaagacacacagatgccaagagacgccttcttctctgggactagtggttgcctggttaatgaataagaaagttatttaaagtggggagtttcacacacacatacacatgcaaacataatacatacatactgaacccattttactttaacttaaatcctgtatatgtggagaaattcatagaaagacacaaactaccaaaacagacttgagaagaatagaaaatgtgacaagagattgaattagtaataatacaactacccgcaaggaaaagtgcaggctcagatggcttcactggtgaactctatcaaatatttaaagaagggccgcgcatggtagctcatgcctatcatccaagcacttggggagcccaaggagagagggtcacttgagcctacgagttcgagaccagcctgggcatcatagagggaacctgtctctacaaaaaaattaaaaaattagctgggcatggtgacgtgtgcctgtagtctcagctacttgggaggctgaagtgggaggattgcttgagcccaggaggtagaggctgcagtgaaccatgatcgcacctctgcactccagctggggggacagagtgagaccttgtctcaggaaaaaacaaacaaaaaaaaacatttagccgggtgtggtggctcacacctgttatcccagcactctgggaggctgaggcggctggaccacctgaggtcaggagtccaagacaagcctgcccaacatggtgaaaccccatctctactaaaaataaaaaaaataaaaaaataaaaaattagccggatgtggtggcatacatctgtaatcccagctactaaggaggctgaggcaggagaatcacttgaacgtgggaggtggaggatgcagtcagctgagatcaagccactgcactccagtttgggtgacagagagactccatctcaaaaaaaatttaatgaataattaatacaaattcttcataacaatcttccaacaaacggaagaggaagaaacacttccaaactcttctattaatatgaaaaggattacttatcataaccaagtgggatttatctcgcaaatgcaaggttggcttaacatcagaaaaatcaatctgtgtaattcaacatattaatagaacagaggacaaaaaccctatggtcatctcaatagatgcagaaaaagcatttgacaaaatccaactttctttttgataaaaaagacccaacaggctggacacggtggctcatgcctgtaatcccagcactttgggaggccgaggtgggcagatcacgaggtcaggagattgagaccatcctggctaacacggtgaaaccccgtctctactaaaaatacaaaaaaattagccaggtgtggtggcgggcgcctgtagtcccaactattcaggaggctaaggcaggagaatggcgtgaacccgggaggcagagcttgcagtgagccgagattataccactgcactccagcctgggcgacagagcgagactccatctcaaaaaaaaaaaaaaaaaaaaaaacaaccaacaaactaggaatagaagggaacttcctgaatctgatcaacagcatctatgaaaaacccacagctaacatactacttaatggtgacagactggatgcttcccctagatacaagctaagaaagtccactctcactgcttctattcaacatcgtagtggaggttccagccagggcaatcaggaaagaagacaagatgaaagacatccagagtgaagtaaactgatttctatttgcaggtgacatgattttgcatatagaaagaatccagagaaaagcccaacaacaataaagctcaaaatgagttcagcatggtttcaggatatgagatcaatataaaaaatcatttgtatttctatatattagcaatgaatgatctgaaaatttaattaagatagtaattccatttatgatagcatcaagaagaataagatactcaggaataaatttaacaaaaaagcaaaacttgcacactgaaaaccgtgaatataactgaaagaaattaaagaacatctaaatgaatggaagggtacctcatgtccataggttggaggacttactattgttaagatgacaatattcctgaaactgatccacagattaaccacaatcctcatcaaaatcccgggtggattgtttgcagaagttgacaaactcaacctaaagttcatatgaaatcaaagggcacagaatatccaaaacaatgttcaaaaactacagaactggagggctcacacgtccacacgtcaaaacttactatgaggctacagcaatcgaaaccatgtggcactggcatcaggacagacataggtcaatggaatagaattgagagtccagaaataaacacgtatatctatggtcaattgagtctgactaatgttaccaagaccattcaacggggaaagattcattttttcaacaaatggtgttggaaacagaacaaagctggacccctacctcacacagtgtataacaatgaactcaaaatggtctaaacacctatgtgcaggccgggtgtggtggctcacgcctgtaatcccagcactttgggaggctaaggcaggctgatcacaaggtcaggagtttgagaccagcctggccaacgtggtgaaaccccgtctctactaaaaatacaaaaattacctggggtggtggcacacgcttgtaatctctgctactcgggaggctgaggcaggagaattgcttgaacctgggaggcagaggttgtggtgagccgagatcacaccactgcactccagcctgggtgacagagcaagactccatcttggggaaaaaaaaaaaccaaaaaaccctaagtgtaagagctaacagtaacactataaagctcttaggcattgctttcttagatgtgacaccagaagcacaaacaactaaagaaaaaagcagagaaactgaacttcatccaaattgaaacttttgtgcatcaagtgaaaagataacccacagggtgggagagaaatttacaaattatatatctgataagggggttgtgcctgaaatacagaaataacttttacaactcagtaataaaaagacaaataacccaattttaaaaataggcaaaaggtctgaaaaacatttctgtagggaaaatatacaaatagccacaagtgcatgaaagtatgttcaccatcattaattatcagggaaatgcaaatccaaaccacaatgaaataccacttcaccaccactacgatggttataattaaaagaaagatcataagtgttggcgtggatgtgaagaaactggaaccaaaatgaaataccacttcaccaccatgatggttataattaaaagaaagatcataagtgttggcgtggatgtgaagaaactggaaccaaaatgaaataccacttcaccaccatgatggttataattaaaagaaagatcataagtgttggcgtggatgtgaagaaactggaaccacaatgaaataccacttcaccaccactaagatggttacaattaaaagaaagatcataaatgttggagtggatgtgaagaaactggaaccctcatggtctcacggtgggaatgtaaaatggcacagctgctttggaaaacaatcttgcagttcctcaaaaacagaatcatccttatgacccagcaattcccctccaaggtatatactcaagataaattaaaacatatgttgacacaaaaacttgtacaaggatgttcataacagcattattaataacagccaagaaggcaaacagcccatatgaacatcaactgatgaataagcaaaatgtagtatactgatacaacaggatatactgttgagccgtaaaaaagaatgaaatgttggtacatgtagaaacatgaatgaaccttgaaaacatcatgctaaatgaaagaagccagacacaaacggccacatgttgtatcattcaatttatatggaacatgcagaacaggcaaatccatggatacagaaagtagattagtggtttcctagggctgagaggtgggaaggaaatagggtgactgctaaaggctatagggtctctcttggggataataaaaatgttctaaaatggattgtggtgaaggttgtacaactctgtgaagatattaaaaccgctgaattttaaatggaggaattgtatgataggtgaattgtatctcaagacagctgttacccgatcccccatctcacagatccctggtaaaagaaaaaaaccatttataaagtgtccctctgaatccacaaggaattgcttccagaacctcctctgccactggatactaaaatcggtggagggtgaagtcttttacataaaataatgttgtatgtggacataacctacacacatcctcctgtatactttgaatcatctctagaatacttctaacacctaatacaatataaatgctatggaaatagttgttatactgtattgttttttatttatatttttgttgttgttttgttatttttattgtgttttttccttgaatagtgtcgatccacggttggctcagtgggggctgactgtacatacatggactgacctttttctgcctgagtaaagccttttctgagagtcagtctgctgtgtggagtgcctcgtggtctttcctgcataagctgcatccataagacatgaatctaacaacccttttctgtgtttttaaagtggggctagagctgaaaggcacttgtcaagcaatgtgtatgtggactccctccagatttttttttaatttttttttttttttaagtctcaatctcgctctgtcgcccaggctgtagtgcaatggcacagtcttggctcactgcaacctccgcctcccaggttcaagccaatttcctgcctcagcctcccgagtagctgggattatcggcatgtgccaccatgcccggctaatttttgtatttttagtagagacggggtttcaccatgttgaccagggtggtcttgaactcctgacctcaggtgatctgccggcctcccaaagtgctgggattacaagcgtgagccaccaggcccggctcctctagatttttatcagcatttatcgcaaccgccatagttgtctcacttgcatctaatggacagcaatacattcagcagcaccccctttcaccgaacctttccaaagaactcgactgtgctgtaccagaaacaattatctttctgcactcatatttcatggctttacatagtactagaatatgtaattacaacaaatatcactggcataaactagttaggaatagctacaactgtcccttggaaagctcatggcccagcttcctggagcagaaatggcgcaggggtgaactgcggaagctactggtagggaatggttcgcacagccagcctggctcaagcctcggcccacatggcaagagccgacctccatgtggccaccacgttccttcaaatcccattcccacagatgagcggactcatcccatcagcagctctgtgaggacagcagggcacacgcttcatctttagagccgaggaaacggggtcccacaggcagtgatgtgcccaagattgtgccagtcccatagggcgccatggccaccctctgaatccacagggaagtgtggattcacccaccaccagctctcttttgcctcgcccatgactctcaagcccggcagcagagccgggggtctcatcacgagagcagagccttgggctcccgcggtacccgtcacagaccggaaaggatgtgctggcaggaagccggatatttctgcttccaagccagggtgtgaggcaaactcacccacaaagtactcagcgaggaaacaacagggcttctgacggcagccgctgtcgccgcagcctgcctttcccttgcacagtattttctgctggtaaagagcctcagcccaccgcgtctgcagacattgctgcgacgtcccagtgacagactgatattccctacacatttcaaatccaacacatcacacgtattagggatctccaggcatcccattcattccacttcacaggtgaggaaactgaggcacaggtaggttcagtgacacacccagagtcacctgcctcgaatgcagaagaggtgggactcagaccctggagcgcctggcttgagaagcacggctccacgcctgctcatgccccacccatcacaactacagagcgactctgcacactgctgttatactcgtatatgctcttataaagagaatttactttattcttatttagttggcaattttcattttaaagcataaaaccaggagaatgcaaacttttagcatttacatgcctttagttctgtaagtttggtcaaatggatgtgatatttacagatcaatagtaaaatctgctgaggtgaggagaagcccctggtacttaacctttcctttacagaacacgttggagaaaattgccaacatgaggccccgatgaacaagggcagaagttcaaggctaccttagaactgcttaattagatacctttcagaaagggcagcctggctgtgacagctgtgtggatatacaccgggagggagagactcccatggcatgcaattaggaccaaagaatttttaacgtcttggtaatgatgctctctggccctgtatcttgattaactggatgttgactgccacagggtgaatgacaaagaagagcacattaaaaaaacccactataagaaccagctgccttttcttgcataagatgcataaatcattgcgtgggaagcagcgtaggtctcaaaggggcaaattgagagacagagagacagaaagagaccgaggcagaaagacacacacagagacagagagagacagacacacactcatacacacacacacgcgtgcgcatagatattcctacccttaccatggaagaacaatattttttcatcaatttctctttgttgtactcagtagcattctgatcagtaggctgtgttccattcacattgaaacaggaagagcgttcattatttatgagatgtgtatttataaatgtgtattaataacccacatattataacatgtgttagtgaaccatgctccgggcctcctcgctgcccctgggagtgacaggtcttcttgtgtatgaccctgggcaaagggtcaaatgatggccagtgactggcctctggagtatgagctcagggttcattagcaaatcaaaaatgcacaggttagcaattttccaactggaaaagaactgatcttctaacacctctaaacttcccggattaaaagagaattctgaagcccgaggaaggcaccttgctttggaggtgctgggtccaggggatgtccagggctgcaggaatttcactacatgactcaagggcacatgccaggggccatcctagagaacacgacagtggcagaaccctgtcaatatggagctccaacaacacctaaaataaatacatcagcggcgccacgtgtgcagatgcttggtcttccagagggcaacacaaggtggcctccaggtgccatggactgtcaggggccgctgtcctcacagcatctggctgaagccagaagcgtccactcctacactggtttcaaaccgcgcagaggaggaggggatcaggccactcaccatctgcaggacatcggaggagaccatctgcatacagcacatggctgtggccagcgcacacacgatagtggacaggacgttgagggcacacacgctgaagaggagatcctgcgaggaaaggtgcaggagaatgtcagcctcatcccgaaatagatagcagaatccttagccctcctgccagggcccagaatgagccgaggtcgatgaccatccacttcatggaggttttgttttgtgtgtgtctgtgttttcctcataatcaaaattggcctttcatagaaacacattcgtttattccgttacaatgatgagcaaagtattcataatactcaacaatgtgttttacaattttgataattattaggtagtcagtaacatgtctaaggaaatcataaggtggccaacatttaaggaggtgggccatttttatcaaacacaacctataactcaagtgaaactttttatcttgagataattgtatattcacatgcaattgtaagaaatcctacagagagatcttgggtaccctttactcattctcccttaatggtaacatttggcaaatctatagtacaatatcacagccagatactgacattggtatagtcaggatgcagaatagtcccatcaccacacgggtccccccagtgttgaccttttatagacacactcacctccctttccctgctccccatttaacccccagttctgatcccctgtcaatcgctagtctgttctccattttttataattttgtcatttcaagaatgttgcataagtggattgcacagcatgtaacctttcagaattggctttttccactcagcataattccctttagactcatccaggttgttgcatgtatcagtagttgacttctttttattgctgagtggtattccaccatatggatgtaccacattggtttaatcctcaacaactgaagaatatctggttttttggtattccagttttccagttgtgggctattacaaataaagctgttgtgagcctttgtttataggtttttgtgtgaacataagtttttgtttctccgagataaatgtccaggagcacaattgctgatttgtacagtaattgcatgtttagttttattttaaaaactgaaaaaatgccttccagagtggctgaacaatttttaattcccaccagcagtgtatgagtgattgggtttctctgcatgattgccaacatttggtgtcactgtttgtgttttagctattctcataggtgcataatgatactcctttataaaatgttttattttgcatttccctgatgctaatgatgtcgaacatcttttcatgtgcttatttgccatctagagatcctctttggtaaaatgtctgttcatgttttttgcccattttctaattgattgtaatgtttacttttttttttttgtagtgttgagttatgagagttctttatgtattctaggtactagttctttgtcagataggtggtttgcaaatattttcccccagactgtagcttgtcttttcatgtttcacatagagtcttagtcagctcaggctgctattacaaaaataccatagaccaggtagctctaacaacagtcacttctcacagtcctgaagtctggaagtctgagatcagggtgccagcctgttggattctggtaagggcctgcttcctggttgaagatggctaatgtctcactgtgtccttgcttagtgaaaagagggcaggggagctctctggtgcctcttttaaaagtgtattaatcccatcatgtggaatctaccctcatgacctaacaacctcccaaaggccctgcctcctattaaataataacatattgggaattagaatttcaacatatgaattttggagggacacaagcattaagtccattatatctgagtttttaaagaacaaaaaattttaatgttcttgagatccaactgatcaacttttgttccatacttttggtgtcaagtctaaaactttgtcaagccccagattgtgaacagtttctcccatttttttctgaaagtttttatagtttcatagtttgcatttaagtctatgctccatttttgttctgagacagggtcttgctctgttgcccaggctggagtgcagtggcacagtcatggctcactgcagcctcgaccttctgggctcaagtgatcctcccacctcagcctcctcagtaactgagaccacacatgcataccactgtgcccagctaatatcatccattttaagttaaattttgaataagatgtgagttttaggtttaggttcctttttatgtttttaatttcattttccaaatgttgttagtacatagaaatgtgattgatttttgtatgtctatgtgatatcttgagactttgctgaaattgatatcttgggactttgctgaaattattagttctaacaattttttgaagatgccaggggattttctgtgtagacaatcaggccatctgcaagtgttttattgatttccttccattttattaccttttattattattattgttctttttttttgcctcgtggtgctagctagaaccttgagcattataaataaaaatataagatgactaagatcatgaaagcagacatctccatcttgtgctcttagagggtaaacttgatggagttttaacagtcgaagtgcaatatagccttcattgagaagcttactctcaaatccatgtcagaaatagaaaaaaaaaagatttagaatgatagtatgtccttcaattaaatcttttcatatacaagtgtacaaaatactggacacactcaaaaagctatcagaaaacatgaatctttcaccacaaaggctatggcattaatcagattagtttcagttatctaatcaaggggttggcaagtgctcaagaggagacggggaatgccaccctcactgacatgctctgtgcgtgtgctaggatgtgggcacacagagtctagcagcatcctcagggctcgttcatgtatacatgagcccatgtgttccaatctgtaacatcctctggacaattccctgttctcctacaaacatcactgcccaatccccttcctcagaagctgctcatcagttctcaagcccacactgtgaaacagtaaagaagtgtgattaggataatatcatggaaggtggttaacatacagtgtttaaacactttcccaagtttatagaaccccatgcacatgtgaaggcagaaaaatgagtcctgaacttaagaagcgttaggcagaaccggccgggcgtggtggctcatgcctgtaatcccagcactttgggaggccaaggtgggtggatcacaaggtcaggagatcgagaccatcctggctaacacggtgaaaccccgtctctactaaaaatacaaaaaattagtcgggcgtggtggccggcgcctgtagtcccagctacttgggaggctgaggcaggagaatggcgtgaacccaggaggtggagcttgcagtgagccaagatcgcgccactgcactccagcctgggcaacagaacgagactccatctcataaaaagaaaaaaaaaaaaaagaagaagcgttaggcagaaccaaggcaaggctcagtttagggctaactattccccactttggaggtaaggcctatccgagtccctgaatgatgtgggaacaggcactgttcctgtgtgagcaccaggcactgttatcactaatcctttcaggcagttcttttcccagactcaggtcgtttcttcatatgcacgtgctaaccagcatccaactgacaactccaggcagaccctctgaagacccccatgtttctctcctggtgcagctctgccctcgatggtgctctgtcctaagaactcttgtctccaggccttgatccccctcagactctcagccctctacgcccaccccagggagtctgcagggaccctgctgtgttccctttccagcactgaacctggaaactgtctcaaggcagtaagctggggcaatcgtagggctcacctcatttatcacccacccctcagggatcagggttcttcattgcctgatagtgtcttcctacactgtgttcattttggggggctgtttcaggcaggaggttaaatccaatgtcctgctactccatcttggccagaagctcttggtggcttttttgtttgcgttttctaatgtttgtagcaggactaggcggactgccttagggatcctactataggcatctccactgccctccctgctcctacagctgctagacatggagcaggatgggggcttagttgtggcaaacagcaggcacaggtggggctggagggaggctgaggagcctagattgtattttgcaggtaatggaatgccactgaagatgtgtgatgctgggaaagaggtcatacaacctgttttttgttgttgttgttgtttgtggtggtggtggcgtttttgttttgttttgttttgtttttgagatggagtcttgctccagtccatgctggagtgcagtagcgtgatcttggctcactgcaacttccatctcccaggttcaagcgattctcctgcctcagcctcctgagtagctgggtctacaggtgcccgccaccatggctggctaattttttttgtatttttagtagagatggggtttcaccatgttggccaggctggtctcgaactcctgacctcaggtgatccaccctcctcggcctcccaaagtgctgggattacaagtgcaagccacggtgcctagcccatgcaacctgttttgagaattgattgagaaagacacctttgcagggagggcctagcacagaactatagatggagtaaacatcggttgaagtgagactggacacagggcagtgacccgtgaggcggtaccggagaggagtcaagcagagcccaggaggaggcatgcagatgccggtctgagggtgactctgaagttcagaacaaaagggcgtggctgtttactggagtaggggagaccgggatgagggtgcagatatagtagaaagatgattctggtgagtggaaacatgagatgcctgcgcgtgggccagggactgtgggagagaagcagtcttaacgaacacctcagcaggccaggcgcagtggctcatgcgaggcgggaggatcacttgaggtcaggagttcgagaccagtctgaccaacatggtgaaaccccgtctccactaaaaatataaaaaaattagccgggagaggtggcacatgcctgtaatcccagctactcaggaggctgaggcaggagaatcggttgaacctgggaggtggaggtagccgtgagccgagatcatgccattgtattccagcctgggcgacaaagcgagactctgtctggaagaaaaaaaataaaaaataaaacacctgaagtggtctgggacatgtggaggctgagttaccagtgggcctgacccactgagatgttggcaaatggttggaaatttggggctggggctgacgatggagatcagaactggaggtgtggaccaggagtcatccctacagagttcaaatgtgccttcaccttgcggatgtccttgatgtatctgcgggcccctgtgtgtcctcattcccctctccagatccatcagacttcaggggcctgggggcctccgcaggctccctacagaagagggcatttctttgatgaaattaccattctcacctcaaagatacacctcagcatagttttcctctaagtgacatgaattttgtgctggattctagaaaactgacagatttatccatgtgcgcagtagctggctgagtgccttttctctcctgtgaggaagagcttctaaaatgtcttaaggctcagccagaagctttagcacatttttgagcaggaagttggactcactgtagtcttaaaacaatcctgctggtgaatgaagtcataattagaactcttaagtatgtattttatatatctcaggagaacaattcaaagttataactaaaatagcgacatcttttttttttttttttgagatggagtctcgctgtgtcgcccaggctggaatgcagtggcgcgatatcggctcactgcaacttccacctcccaacttcaagtgattctcctgcctcagcctcccgagtagctgggattacaggcatacgccaccacgcccagctgatttttgttatttttagtagagacggggtttcaccatgttggccaggatgacctgaggtgatccagccgccttggcctcccaaagtgctgggattatagacgtgagccactgctcccggccaatagcgacatctcttaatgtaccattgctaaaatataagcaatacctttactttgtcctcaatctagaaatttcaactttattgaccacataatccactgtcatttaaatgaatgcctttctacaaataatattaatttcgcatatgctaccaaatgaaactactcacagacagaaacaccaactctgacctctgtttgcatacgcatcatgaggcagcctgctttacgtctcatgaaaggtattcatttgaaatacatgccagaaagacttttcccctccagctgtttaaatacttgatgtttttctaagtaaccgcaaaccacctggtattgcgtttatgtgtttcttcagaattcttttttggcttaaatgacattatctctgccttttttttttttttttttgagatgtagtctcactctttcgcccaggctggagtgcagtggcgtgatctcggctcactgcaacctccacctcccgggttcaagggattctcctgcctcagcctcccaagtatctggactacaggagcacgccatcactcccgtctaattttgatgtatatttttttaagtagagatagggtttcaccatgttggctaggctatctctgctttttgaaagttttatcagagtcctttacaaatactgaaatccacattctataaaattcctttacaaggtgattcaaaacggcgaatatgagagagaggcgggtctttcattgctgatactgagttttgctactggatattctgatgttattagctttttgatgttattaatgttataaagttaaggaagttatgtatctaataaatgatgtatagaacaaaaacaagagaaaaaagttttagatacttgggcaaagctacagttgataaattattttgaaaatctctccagtctacgtaagttatggatattaataataagattaacagagaaaagcgacagcaatgacaatgtacatacatatagcctacacgttaaaaacattaaacagttcaggacattgagcgggtcgtggtagtgtatctggaattggtgggttattggtctcactgacttcaagaacgaagctgtggaccctcgcgctgagtgttacagctcttaaaggtggcgtgtctggagtctgttcgttctgatgtgtttggagttttttctggtgggtttgtggtctcgctggcctaggagtgaaaccacagacctccgcggtgagtgttacagctcttaaggcggcgtgtctgaagttgctcattcctcccgataggttcgtggtctcgctggctccaggagtgaagctgcagaccttcacggtgttacagctcataaaggcaaggtggaccgagagagtgagcagcagcaagatttattgcaaacagcataataacaaagcttccacagcatagaaaaggacagggccgggttgctactgctagcttgggcagcctgcttttattcttatctggccccacccacatcctgctgattggtccattttacagagagccgattggtccattttacagagagctgattggtccgttttgacagggtgctgattggtgcgtttataattcctgagctagacacaaaagttctccatgtcacaactagattagctagatacagtgtccacacaaaggctctccaagtccccaccagagtagctagatacagagtgtcgattggtgcattcacaaaccctgagttagacacagggtgctgattggtgtgtttacaaaccttgagctagacacagagtgccgactggtgtatttataatcccttagctagacataaaggttctccaagtccccaccagactcaggagcccagctggcttcacccggtggatcccgcaggtggagctgcctgccagtaccgcgctgtgcgcctgcactcctcagcccttgggtggtgtatgggattgggtgccatggagcaggaggcggcgctcgcccgggaggctcgggccgcacaggagcccacggagacgggggaggctcaggcatggtaggctgcaggtcctgagccttgcccagagggaaggcagctaaggcccggtgagaaattgagcacagcagctgctggcccaggtgctaagcccctcactgctccagcaggcagggccagctggccactcccagtgcggggccgcggagcccacgcccacttggaactcctgctggcctgcaagtaccacgcgcagccccggttcccgcccacgcgtctccctccacacctccctgcaaggtgagggaaccgactctggccttggcaaacccagaaaggggctcccacagtgcagcgtgggctgaagggctcctcaagtgccgccaaagtgggagcccaggcagaggaggcaccgagagccagggaaggctgcgaggactgccagcacgctgtcacctctcagtagctcacacctgtaatctcagcacttttggaggctaaggtcagatcatctgaggtcaggagtttgaaaccagcctggccaacatgatgaaaccctgcctctactaaaaatacaaaaattagccaggcgtggtggcaggcacctgtaatcccagctactcaggaggctgaggcaggagaatcactcaaacctgggaggcagaggttgcagtgagccaagatcacaccaccgcactccagcctgggtgacagagtgagactctgtctcaaaaaaaaaaaaaaaaaaaaaaaaaatcaggacgttgatacctttgcttgctggacaaaatgaggacaaactatcttacatttatttccgctagttcattcagtagtttttttcctatgtcttctctctttgaataggagagaggtctcatgggaacctattatcagtcaagatataatgatagaaggtatgatgataaggagagttccacagcataaaacacaagcggaagaaatatccagcaatagctgtatatgtggtaataattataagggatgggtgttgggctttatctgaattattatcttaaatgcccacaccatttattctttgttgccttgtgatggtagacattggtcatggacctgacgttccgtgcagatctatgttgggagaggcagtctgccatgggccctgagcatgccctgaagttcctgctgggtatgccaagaatgtaaggccttgactgctctttacctgacccatttcccagggctgtgtttgcaccaagaaaccttgaggaaggaggtaacgtctcccctagacaaagtgtaggttctctacaaagacagggattccccaagctcagtgtttctgccccataacgcagctcaccacacatgtgcaggcatccgtggtgggcccttagcatcaccctgagaccccagggcatggggaactgacacacactagcctagagctctggctactgcttttgccatgaataataaagtcccttgtctctgaaccaggaatctcatgtctttttgccaggaaagtaacagtaaacagtaacagactagtttgttagcttgaaagtaggttaaaagctcagaccctgcagttcctggcagtttatttccatctccatcttgtaagaacatcaagagcagagaccaagtcttttgctactctgtatggtagaatatcttattcaaaataggtggttgctaaatatttgaaattttacaggctcattgttctcttctgaattgtaagttcagactagaaggaaatgcataatttccaagcttctaaccacacacagaaaattcaccttcacctttaagtaaagtaatgcagcacacataggatcatggtggacgggaggcaggactagattgcagctctgaacagagcaatgtgcagaggcttgcattgtgaattttagctccagatcgactgcaagaacaaaccagcaaccccgagaggaccgacagacctctgaaggaagcagactgctcttgcaggacctggaagacaccccaaatactgtgagtgcccaaactgcggaagtgggaaagggagagcatcctctcccaaacacacacgcccactggagaaaaggaaggtctgtttgcaggagaagtttccgaccttacctggagctgagtcaatttagagagtcgagcgaaatacagaagtagaggaagcagcgggaaaggccctgggagctccctgggtccccaagcaggtcattcctgcctggcaccacagggatccaccaggagggcagccagaggagcgagggtaaaactcaacagggagaaggaaatctctagctgaaatttgtaacaatttgaacagggttagaagcctcctggccagaactcgggggagggcgcaaatctggtgtgcagattctccacaggtgggaagaacaagccctttcttttgcagctgggaggtgggtagcctgaggcaagttctcaagcctgtctcacccactgcccgaaaacagacttggggcggttggatgggggcatggtgggagtgagactggactttcagtttgcatgggagctgggtgaggcctgtgactgccagctttccaccacttctctgaaaacctgcatgactcagcagaggcagccataatcctcctaggtacataactccagtgacctgggaatctcacacccatcccccacaggagctgcagcaagaccggtccaaagagagtctgagctcagatacgcctggccccacccccacctgatcgtccttccctacccactctggtagcagaaaacaaaggacatataatcttgggagttctacagcccagcccacagccagtccctctcaaactactacagctgatgctttctggaaagcgccacctcacagcaggaggccaacccgcacaaaaatagagcattaaaccaccaaagctaagagccctcacgaagtccactgcacaccccccaccacctccactggaacaggtgctggtatccatggctgagagacccatagacggttcacatcacaggactctgtgcagacaaccctcagaaccagcccggagctgggcagacttactgcgtggccagacccagaagagagacaacaatcactgcagttgggctcacaggaagccacctccataggaaaagggggagattactccatgaagggagcactccatgggacaaaagaatctgaacaacagccttcagccctagaccttccctctgacagagcttaccctaatgagaaggaaccacaaaaccaatgctggtaatatgacaaaataaggctcttgaacagcaccccccaaaatcacactagtttaccagcaatggatccaacccaagaagaaatccctgatttacctgaaaaagaattcaggaggttagttattaagctaatcagggaggcaccagagaaaggtgaagctcaatgcaaggaaatccaaaaaacgatacaagaagtgacgggagaaatagccaagaaaatagatagcttaaagaaaaaaaaataaataaaaaatccaggaaaaattggacacacttatagtaatgcaaaatgctctggaaagtctcaggaatagaattgaaaaagtagaagaaattcagagctcaaagacaaggtctttgaattaacccaatcccacaaagacaaagaaaaaagaataagaaaatatgaacaaagcctccaagaagtctgggattatgttaaatgaccaaacctaagaataaccagttttcccgaggaagaagagaattataaaagcttggaaaacatatctttaggaataatagaggaaaacttccctggccttgctagagacctagctatccaagtgcaagaagaacaaagaacacctgggaaattcattgcaaaaagatcattgcctaggcatattgtcatcaggttatccaaagttaagacaaagtaaagaattttaagagctgtgagacagaagcaccaggtaacctataaaagaaaacctatcagattaacagcagatttctcagcagaaaccctacaagctagaagggattggggctctatcttcagcctcctcaaacaaaacgattatcagctaagaattttgtattcagcaaaactaagcatcatatatgaaagaagatacagtctttttcagacaaacaaatgctgagagaattcgtcactaacaagccaccattaaaagaactgctaaaaggagctctaaatcttgaaacaaatcctggaaacacatcaaaacagaacctctttaaagcataaatcacacaggacctataaaacaaaaatacaagttaaaaggcaaaaacaaaaaacaaaaaaccaaagtccacaggcaacaaatagcacaatgaatgcaatggtacctcacatctcaattccaacattgaatgtaaatggcctaaatgctctactttaaggatacagaactgcagaatggataagaactcgccaaccaactatctgctgccttcaggagactcacctaacacataaggactcacataaagtaaagaggtggaaaaaggcatttcacacaaatggacaagagagtaggggtagctattcttatatcagacaaaacaaactttaaagcaatatcagttaaaagagacaaagtgggacattatataatagtaaaaggccttgtccaacaggaaaatatcataatcctaaaaatatatgcatctaacactggagcgccaaaatttatacaacaattactaatagacctaagaaatgagatagacagcaacacaataatagtgggggacttcaatactccactgacagcactaggcaagtcatcaagacagaaagtcaacaaagaaacaatggatttaaactataccttggaacaaatggacttaaaagatatatacagaacatttcatccaacaacctcagaatacacattctattcaacagcacgtggaaatttctccaagatagactatatgataggccataaaacaagactcaataaatttaagaaaattgaaattatatcaagcactctctcagtggaatcaaactggaaatcaactccaaaaggaaccttcaaaaccatgctgatacatggaaattaaataacctactcctgaatgagcattgggtcaaaaacgaaatcaaggtggaaattaaaaaattcttcgaactgaacgacaataatgacacaacctaccaaaacctctgggatataagcagaggtggtgccaagaggaaagttcatagccctaaacgcctacatcaaaaagactgaaagggcacacactgacattctaaggtcacacctcaaggaactagagaaacaagaaaaaccaaacccaaacccagcagaagaaaggaaataaccaagatcagagcagaactaaatgaaattgaaacaaacaaacaaacaaaaatacaaaagataaatgaaacaaaaagatggttctttgaaaaggtaagtaaaactgatagaccattagtaagattaaccaagaaaagaagagagaaaatccaaataacctcattaagaaatgaaacaggagatattacagttgacaccactgaaatacaaaagatcattcaaggctactatgaacacctttacacacatcaactagaaaacctagaagagttggataaattctggaaagatataaccctcctagcttaaatcaggaagaattagataccttgaacagaccagtaacaagctgcaagactgaaatggtaattacaaaattaccaacaacaaaaaatgtccacgaccagacagattctaagaagactttctaagaagaattggtaccaatccttttgacactattccacaagataagagaaagaaggaactctctctaattcattctatgaagccagcatcaccctaataccaaaaccaggaaaggacctaaccaaaaaagaaaactacagaccgatatccttgatgaacatagatgccaaaatccttaacaaaatattagctaactgaatccaacaacatatcaaaaagacaatacatcatgatcaagtgagtttcataccagggatgcagggatggtttaacatatgcaagtcaataaatgtgacacatcacataaacagaattaaaaacaaaaatcacatgatcatctcaacagatgcagaaaaagcatttgataaaatccagcattgctttatggttacaattctcagcaaaattagcatacaagggacatacctcaatgtaataaaagccatctatgacaaaaccacaggcaacataatactgaatggggaaaaactgaaagcgttccctctgagaactgaaacaagacaaggatgcccactctgaccactcctcttcaacatactactgaagtcctagccagagtaatcagacaagagaaagaaatacagggcatccaagttggtaaaaaggaagtcaaactgtcactgtttgctgacgatatgatcatttaccttgaaaaccctgaagactcctccagaaagcttctataactgataaaagaattcagcaaaatttccagatacaagatgaatgtacagaagtcagtagctcttctatacaccaacagtgaccaagccaagaatcaaatcaagaactcaaccccttttacaatagctgcaaaaaaataaaatacttagaaatatacctaaccaaggagtcaaaagacatctacaagaaaaactacaaaacactgctgaaagtaatcataaacaacacaaataaattgaaacacatcccaggctcgtgaatgggtagaatcaatactgtgaaaatgaccataccagcaaaagcaatctacaaattcattgcaatccccatcaaaataccaccatcattcttcacagaattagaaaaaacaattctaaaattcatatggaaccaaaaaagagcccacatagccaaagcaagacgaagcaaaaagaaaaaatctggaggcatcgcactacctgatttcaaactatactataaggccaaagttgcaaaacagcatggtactagtataaaaataagcacatggaccaatggaacagaatacagaacccagaaataaaccaagtacttaaagccaaccgatctttgacaaagcaaacattaacataaagtggggaaaggacactcttttcaacaaatggtgttgggataatcggctagccacatgtaggagaatgaaactggatcctcatctgtcaccttatacaaaaatcaactcaagatggattaaagacttaaatctaagacctgaaactataaaaattctagaagataacatcggaaaaacccttctaggcattggcttaggcaaggatttcatgaccgagaacccaaaagcaaatacaataaaaacaaagatcaatagctgggatcaaattaaactaaagaggttttgcatggcaaaagaaacagtcagtagagtaaacagacaatccacagagtgggagaaaatcttcacaatctatacatctgacaaaggactaatatccagaatctacaacaaactgaaacaaatcaataagaaaaaaacaaagaatcccatcaaagagtgggctgacatgaacagacaattctcaaaagaagatatacaaatggccaacaaacatatgaaaaaatgctcaacatcactaatgatcagggaaatgcaaatcaaaaccacagtgtgataccacgttactcctgcaagaatggccataatcaaaaaatcaacaaacagtagatgttgacatggatgtggtgaacagggagcacttctacactgctggtgggaatgtaaactcgtgcagccactatggaaaacagtgtggagactccttaaagaactaaaagtagagctaccatttgatccagtaatcccactactgggtatctacccagaggaaaagaattcattatatgaggaagatacttgcacacgcatgtttatagcaacacaattcaattcacacttgcaaaattgtggaaccaacccaaatgcccatcaatcaatgagtggataaaggaacggtggtatatatatatgatggaatactacttagccataaaaaggaatgaagtaacagcatttgcagtgacctggataagattggagactcttattctaagtgaagtaactcaggaatggaaaaccaaacatcgtacgttctcattgatatgtgggagctaagctatgaggatgcaagggcataagaatgatacaaaagcataagaatgatacaatggggagaatagtgggaggcgggaaagggataaaagactacaaatagggtgcagtgtatactgctcgggtgttgagtgcaccaaaatctcacaaatcaccactaaagaacttactcatgtaaccaaataccacctgtaccccaataacttatggaaaaaaagaatttaaaaaaacctactacacatagttacaaacccaataaagaaagaaagtaatgcagagaaagactctgtacaaagactcttgttggtagcacaatcagcgtgtgtgtgtaaaatctgtaatttaaattttccacgaaatttctagagtgatgagacacatcctggggcagatctaggactgtttaatttgtctctgtagaaagcagttatagtctacagaggtctttgtggcgggcttaaatactgatcctacaaaaggagctaaaattaggctgtcatatggagaaggtaagtgattcatagagaaatctgtgaagctataatttcaagaggcaaacatccatttacaatccctaaaaatgtcgatggattttggccttgctttggccactcaggcaccaccagtaacacatgtgctgctctaagaaggcaggattgctccccacatggtgcctgctgtttgctcaatggcacttttaactctgggcaaggacccaggagggagttcacacactctccgcaagggttcagaactgcaccctatttgataattgaaaacctggcttttgtcatctgaaacaatagcttttactctttagtggatggctgtaaattgcctacatgatcatctgtgtaaataatcgtagactaattattttcttacagttctacgaagttttaagaagaaaactatttgccatttttctgatattcaaggcaaagtaatgaggcaaaaaaagtttctgtgtgtatacacacttttgtatctttgtgtgtgtatatatgagatagattatacacatacatgcatatatacatacagaaatctttcctataaattctggatttctgaagactcactgtgatcctaatgagcctctagctttaaaacaatgttgaacaaaacaccatttttaaatatttggctttaacctaaatttatgggaatgaagaaaataaacaagcattgtcaagaacattttgggaaaaaaaaggctttgcacacatcaaaatgtaccctaaatctacaataatagtatagggtggcatcaataagggacagaatagagatcctattataataaaagaagtacaccacattacttgtgttgggataattggctgtctttaaaaaacaagtaagacagatctagatgtgaaaagaagagaggaaaattcttcctcgtgaacctagatgcaaaagtcctaaataaaatattgaaaaattaaatacagtagcattttaaaaaacatattatgaccaaatgtggtttattcctatattacaaggatgttttaacataatgtaatttattaatggaattcactacattaaatgagaaaaactatatgacaatctcaatagatgcaaaatagcagttggtatttcaacactagtgtaaaagcctctaataaacttgaaatagacaggagctccctaaactcaagaaaccctacagcaaacatctggaaggagatggggattgctgccaatatcacttctgttctacacaggtcccagtcattggaagaagacaggcaaaagaagtaaagtgtgttcaaactgggaaggaagaaaaactgtccaagatgatacaattattcatacagaaaactcaataacatttccaaatatttagaactaaatataatagttgtgcaatgttgctgcatataaaatcaatatgcaggccgggtgcggtggctcatgcctgtaatcccagcactttggagggccgaggcagggggatcatgaggtcagaagattgagaccatcctggctaacatggtgaaacccccatctctactaaaaataaaaaaaattagccaggcgtggtggcgggtgcttgtagtcccagctactcaggaggctgaggcagaagaatggcgtgaacccgggaggtggagcttgcagtgagctgagatcgtgccactgcactccagcctgggtgacagagcgagactccatctcaaaaaaaaaaaaaaaaaaaaaaaaatcaatatgcaaaattcattcactagcaacaaacagcaagtataagttttttaaagatacgatttacaatagcaaaaaatgtaaagtagccaagaataaatatagaaaaaggtggaaaaatgtgttgagaacaaataaataatgagatcttgtagtcatgaataggaagattcaatactataaatacattaattctttccaaatcaacttataaatccaatggaattccaacaaagaccacaacaagactgtgtgtgtgtgtgtgtgagtgtgtgtgtgtgcatagtctgtgacaggatcattttaaattcctcatctcccttctctctcccacccctgctgccccacaccatgtgaggacacagtgacaaggcttgcctttgtaaaacaggaagagggcgcttgccagaactcgaccatgctggcactttgatctcagacttctagcctcctgactgtgagaaataaatgtctgctgtttataccaccccatctaaagcattctgttacagcaacctgtcttagtctattttctgctgctgtaacggaataacagactgggtaatttacaaagaatgtaagtctatttggcccacagttctggaggctgggaagtcctagagcatggggccagcatctggtgggggtcctcctgtggtggaaggtgaaaggcagaaagctgaagtgagtgtgtgagacagagagagaagccagatttcctttataacaacccactctcaccataactaacctctcccatgctaatgacaatccatacatgagtgctccactctcacgacccaatcacctattattaaattcgacctccaacactgactgtggcattgaggattatgtttccaacatatgaacttttgggggactattcaaaccacagcacagcctgaactgattaagacagtgggcttttctatcttctatcattaaaccatccgaaacaccattagtcctctgactgcaggtccagctgtcctgagcagttcaacatttcatatttcgaggaatgcaggttcactcataaacaacacctgtgacagagccaccctcactcacatcctggacactctactgtctgttcacccctgtgcattccaggatgtaacaggcaagatgatcccaactcaggcacagctgcagtgtctacagctgcaggaggtcctgtctccctcctgcccccagcaagaaaacccaagtaaggtatttttttttaaggtatagtttttttccttcaagtttctaattttgacacaatgaaaatattgtatttatattagcaatacccgattagcaatttcatgtaaaggcgattaggtactcataaaaggtctcaagtactccaactaaatcagtcactggttaataacaatgatccacgagctgttttcctggttttcatgtggaataattggcaaggaaaaccatacatgaaaaaagaaaaaagaaaaagatcagcaactttgcagctttagccactatgtgatgtgctatcaaaaagccacctagaatcttttttcatgagttaaaacactactgtcatctataatcctgaacggtaaggtctagaaaccaatactgacagaggtgtccaaacagctcctcttgcagtgctgtggggcacatttcttttaaccttaattgacttcaattactgtgcttcatctcccatggcaaaataattccccaaagaaacaaagagtattagagtgttttcactcatgaaacagcccgtaatgcacctcttttgcttaggaattggaagccaactagatttgagcctgcttgaaagaaaatctcatcactgaagaatccattagtgggccctccaaaatccacacagtcttaaggccagggaccaactggacttcaggaataggatcaaaaaagccaattccagttccatcgtgatgtactgatttaactttgattgtgaaggacagtaatttattgagtaatttatcttgctaaccaccatattaatccagtatccaatcagcacttctctcattcaattccaaggagcaggagtcctagatggttggaagtgtcagacaggaagggaagagtgtcttctagtgtcttgcccagtaattgtacggggctccaaactcctggggagggggaatgatgtctgacttggagcaggccagtggggatggacagagaaaaatttcagcaggtgcccattgctggagtgcaataagtagagcccggggtgatgagaggcctgggggagaagggagagggagggatgacagagaggacaataggaacacagggtcccttgcccttcataatgcccttgattcttgttaaagggaaatgccacggatgtggttggtggagccaacatctctgcctcatccttgatcatcccacacaccccacatccaaattctccctggcgtgttgacccggctaccaacctcacctgcaatcctccctgggctccagctccacctgccctggctgaacctccccctctcacctggactctgaggtggcctcccagtacctcaggtctactcttccctgtcaggacacctgttttagcctaagtcggctcctgtccctcccaggttacagtctgtggcgggaggcccaccagtgataaaatctccgcgccttcccccgtccctggctggcaccctctgcagcctatttctgcctcatttccacggaggctgtctcccattttctctgcagaccagcccccaagtacacatcgtgctaccatagttccacactggtctagctctctccgcttcccagtcccccgcccagggaaggggctcactgaaccagcctgggcacgtgtccactcccaggacagtccactgcaggaatgggcggggcagggtgcacaggagggtgctgtaagctgggcctgctttctaagccaacctgggtgattggggagccaactcaccatggggccgctgcctagcccctctgcttctacgtgactatgatagaagacggcactgaagccttccctctgagaaagttctcagatcttcttttggtcacttctggctcacaccccacaaaagatcccctggacggaagcctcagctctcttatttctggggatgtggctttgagggtttcctcatcgctctgagccttgatctcatctgtgaggggatgactggcttagactttaaactcaagtaggtgaaccccggggcacttggtaaagggaagccctcctgggaggattccgccagggtgtgcagagccacccgtgatagcaagtgatctcattactggaaggttctgaatcggggggagatggtcaccagcacctcggagggttggggcaccattcatcttctgattggttatcatatttggtttgatttcagtcaccccagaggaccaaaatgactaaaataagtaagttattcatctataaacattatgaagcattttcaggcatttaacagatgtaataattacctatatctaagtcatatttgaagggtaactaaattttaattgctttataatatgtcttataatctttttattagcaattatataagcaattgattgtaactatctgtaagtgaaaactaatatctggatagccaaaaaaaaaaaaaaagccaaaaaatcccactctttcatttagatgactggggaatattgaagagtcggggaaatagcaggctctattttaagcatcattttaaaggaaatataacacaatcttaatcgtaggtggaaaaaactccaaagagtacttgttatgattgcaaattcctaagtaaaagccatctacagatgtgacttgtttccaggtattactcttgattttggggacatgtctcttcccttgatgggagaccccctgggtcactgcatcccttgtacatcaaggtttctttcatggcagatgtcatgtcatttttttctccatgtatcagaacgacaactcattccttgcatgacaatggagtggaaatgcagggagacctcaatgacattttattcagctgacaaggaagagacaaactgccttgtcccaggagtctgtgaaaactagaaacacggccaggcacggtggctcacgcctgtaatcccagcactttgggaggccgaggcgggcagatcatgagatcaggagattgagaccatcctggctaacacggtgaaacctcgtctctactaaaaatacaaaaaaattagccgggcatggtggcgggcgcctgtattcccagctacttgggaggctgaggcaggagaatggcctgaacctgggaggcggggtcttgcagtgagctgagatcgcgccactgcgctctagcctgggcgacagagtgagactccaactaaacaaaacaaaacaaaacaacaaaaaaaaaaaagaaaactagaaacacctcatactgggaactataaagctttgccactgccactgctttgtaaaacaagaacttttccctgcctaaggtatctatttcataggtagaattcataacacactaaaacctttgacttggcctgcttggtatagaaaacttatgcatcacaaaatattctgctcagagtataagcacataggtaatgcatgaatttgtggtttatcaattttcaaagaaccttttacaaagacactgaatatatatgagagtaaacatgttgtgatttttggtagttcagacagtaatcagtttctcgctgggcctcagcttgttctgagcattcaggtccacagtcctgaagctaagctagtgtcccgggtagcagcctggtgtatgtatcactgcatatggcggtgagagccagggctccaaagccagactgccggcctgggattctggctccacctttacaatctgcatgaccttggggagttactaaatttcactgtgcctcagtatcctcacctgtaaaatgagaataaatgatacgtgtacctcaccgggttcttgtaagggtaagattagtttcacaaatgtgctgccggtaacgcttagcacacagcaaggctcaatcaacattagctatgactatcatacacgattaatcatctgagtgtctgatcggattgaaaacacaggctcctgcagacaaattcagcagaggactttcaggcctcatgcatgaatgcttaaggaaaagagccctaaagattatgagacgcccatccaagaacatccaagaatgcgttttgcagtctgaactgattctccagggtgctccttgtgttcaactgatgggacaggaacgctgatgtttgtccatctctctttttcttcctttttgagacggagtctcactctgtcacccaggctggagtgcagtggcacgatctcggctcacagcaacctccacctcccaggttcaagtgattctcctgcctcagcctgctgagtagctgagattacaggtgcccgccaccatgcccggctaatttcttttgtatttttagtagagacggggtttcaccatgttggtcaggctggtctcgaacccctgacctcgtgatccacccgccttggcctcccaaagtgctgggataacaggcgtgagccactgtacccagactgtccatctttcattgctctactttctgggtcttgatcgtcctctctcatgactacttcttttactcccatcaaggtaaagtgtgagtgaaagtagtttgattaaagcccaggcagattaaggacgaagctaaaaagaatgaagagacactggtaggaaatactggctgacatgcagaagtaatttcaacgatcttattagcctttcgcctcttgagtacttggttaatgttcataaccagaagtaatgtctctaatctgcatttaactgatattctaactcttccttaaagatacagacctcttttcctcaggcttcataggctagacaattctccttaaatgtcctgagagccgtggcacataggggatgagtggtgggggggcacattcatttgcctggagtgtgggaggagcccccacctttcctgattaatgcagctggtagttctcagtgtgtgcagctgggtgggcctccagaacagtcagtttgggggccatgaggggcaggctctcctggatggtgacaataattttaagagaggggaggtcagtagttggaagtgggaagaggccagaggagagaagagggtggaagagcagagaagcatccctcctcagctcaccagacaaaggataaaatggaggaagtcacaggaccctttgccagagaagcccccaggaagtgtggcacatgcagggcaggagccacgggccccacttcatgctgaggtccttgccaagcccatggcccgcagaccctgttggacggggcagcaccgtgcacctgaaggctgaggccgggccccaggaggggttagatctctttccctccttccctccaggtcgccaggctttgctaatttcatcttccaaatatttaccaagttaatgcccttctcctcctactctgatgtgcctctgcagttttggtcccattatctctgcccaggttggtgtctgtgccctctctgggcctggctctcagtcctgtcccctgctgctgctggatgatctatttctgtaatgcatctggccactgccctctcttccctgctaccccaaacaccccaattcagtgtctccacgttgcctgcagctctgatactgcagggcccaggactttcaagaggtagagccaagggtgggagaaggaagagttggagggacgcccagctctccacctgggagctgagcagctaggggtggtggtgataacatcgacaaggttggaaagagaagcagaagctgagccaatggattccctctgggagcggctgggggaggatggcagggagtgatccgaggggtcccgctctcgtgtatgggactctgtcatgtgagtacacatgtgatggctggcaaaaaagcaactgtatggcaggatcctcatccacgggaaggacagggcttctattttaaaatacactgaacagcaagactgcacatgctttctggaatagaacataaatgcatctatgaatcaaagtcagaaaatatattggtggttgttttcttgctttattttgcgctctcacaggtgtgactatcagttttcaggaatatattctttgctcaatatgtatcttcttcctgccctccttgcttcctttccttcctccagtgcacacagatcgagcccacaacgcagcaagcacagagatgaaaagaggaagatagacgcggggtctgcacccacgaaactcagtctagagggacacaggggtgccctggccagcatctggactcgtgaggctgatgcatcaagccacggcagagctgcctgggaaaggtgcatagggagcactctcaggggccagaggaagggacatccaggcggcaccgggcagtgaggcaagtcaagggtggcggaggttggtggggacagtgttactgggagagggaaggctgagtgcagaggtggagggtagggatgggcaggggcagaaagcactgtgaagggagcttagtggaagagggtgggcgaggggaggcagggcgggagggatacagggagaagggtggatgtgctgcagggacacccgggtggtgacaaaattaaagtgcctaaaaatactcaaggagaaatgaactttgttaacacagtttctttaagaatgtaacgtgcctgtaatcccaacacttagggaggttgaggcaggaggatcacttgagtccaggagttggggaccagcctgggcaacatagtcatgcctgtttctacaaatataaaaataaaattagctgcatatggtggtacgtgtctatggtcccagctactccagagactgaggcaggaggatggctggagcctgggaggtcaaggctgccgtgagctgtgattgtaccaccgcactccagcctgggcaacagagcaagaacctgtcttaaaaaaaaaaaaaaaaagaaagaaagaaagaaaaggaaaaagaaccggttaccatctcaatgaattagagaagacagaactaaagaatatttatatcctgcccaagtgttcacaatgcatctctccgttttcacaatgcacctttcttaccttctctctgttttttgttttttgtctggactaattgctagtcagactgttctcctctctgcagtcccctgaattctgcttgtccctggggcctgggcgagcgctagaaaggagaatgggccagtaatcagctcgtcccacagtgagacacatatcctggtcatcttcctttgctcacccaacttccccttaagtttctgctaagatttgctgacctccctgccctataaaagaaaagcccttttctgattgattttgagatgtttacagttcttgagttccaaggattctcccctgttagttgcaagagtctttttgaataaatcttctccttatctaagacaagattagttttgcttgacaatgcaaatgaccagagggacacagagaactaagaacattttttaaaagggaaaggtcttgttgaaattaaatctatacttaatcagtatcagatcatcttgtatttgagacttcctatcttgtgtcttgagaagggcaagaagcagtctggtgatactgagctataaactagaaaggttttgctatcatctttgcagaactgaactatttatgtggcctacaggcaggttttctgcaggatgttgtatttgttatatgtttatgggaaccattcttctctcgaaataacaggctaaatttgccattaggacattgaatttacccacaaactttgtaataaatactcttcaggctaggatggtaatggctttactttggtctaaccagtctctaagtaaatagtatgaatattcttgctggtttggaactgctctccgctcaatttcattttcctcctggacagtgcaagaacactaaatgtggtgagtataggagccatgtgcaaatgcacaatgcaaattcctttttttctgcaagagaagaggatgaatatgatagatatttaggaagacttagtgaataatggcacttgggagcaaaggagaggaaagagccattccatggtctgagcaatgggaagccattctctgagtgggatggctgaaggggcatggaattgccaggagctaaagggatactgaggatgagcttagtttgagtcatcggagtctgcgtggtgttccacagtaactgcgtggatcagggccggagtcgtcttttttttttttttttgagacggagtctcgctctgttgcccaggctggagtgcagtggtgcgatctcagctcactgcaagctccgcctcccgggttcacgccattctcctgcctcagcctcccgagtagctgggactacaggcgcccgccatcacgcccggctaatttttttttttgtatttttagtacagacggggtttcaccgtgttagccaggatggtctcgatctcctgatctcgtgagctgcccacctcggcctcccaaagcgctgcgattacaggcgtgagccaccgcgcccagccagggctggagtcttaaacttgggagtggccagtgcagagatgggactgatgctatggaagcagatgaatttgcccaaggatggtgtgctcaatacagagagaagggagtttggataaggacccagaatcaggagcaggaagaagagtctacagagacgatcatgatgagaatgaccagagagaaagacggaaaccaagaacaggaggacacatggacaaacccaccataggagtggaggaacacatttgtctcaatgtgtccagcagacaactagttagtaaggacatagaagagctgaacgtgccagatctaatggacatgtaccatatatacatttacctgtcctcaaaaagatatgtatgacttactacaaaaattcaccacaaagtcgtgcacaaagcaaaatctcaactaacaccaaagacttgttattagacacattgtaatcaggttacctgactacagtacaattaaatttgctataaataataaaaagtaggccaggcgcactggctcacgcctgtaatcccagcactttgggagtcgaggcaggcggatcacctgaggtcaggagttcaagaccagcctgaccaacatggtgaaaccctgtctctactaaaatacaaaaattagctgggtgtggtggcacacggctgtgatcccagctactcgggaggctgaggtaggagaatcgcttgaacccaggagacggaggttgcagtgagccgagatcacgccactgcattccagcctgggtgacagagcaagactccgtctcaaaaataaataaataaacaaaataaaataaaataaaaataaaaaagtaacggaaaaaccctccatatatctgcaaaatttaaaaaatactgctaaataacccagggactgaaaaataaatcataaggaaaattaaagaagtctcagaactgaataaaaaagttactagacatcaaaacttagcgtatgcagtttgcctgcttatatgaggaagaaagactgaatttagtaacagcatacatcgagagaagtgagaaaaagaaaaaggaatttggaaggaaggaaaaaatggagaagagagcagaaactaatgaaataagaaacaaagcaatgacaagatcaataaatattaagctggttctttgaaaaaaaactgacaaaaataggcaagtctctggcagaggctgattaacaaagaaagaaaaggaataaattaaaatattaaaaattaaaaaagacataactaggcatagcatatacatgaatttgaaaacctaaacaaaatggacaatttattccagaaaagcaaaacattctaacatagtctcaagaagaaggaggaaatccaagtaacctataatccactgaatcagtacttaactatctactgactgcaaaagaaattaccaagccctggtgattttgtaacttttaccaaacattcaattcaagaaataggtaagtttaatcttctgcaaactttgttttcagagggaaaaagaggggaacacctcccagctcatctttctaggctagtgtaaactaaaaaataaaataaaattaggcaattgcagtatgaacaagggaaagcttgattcatataatttatgaataatgatgaaaaatctttaataaaagaaaagcaaagtagattttcataattatatgaaaatattgtgcctaagttttatcccagaaatgcaagaacggttccacattagaaatccattctacatgaatatatattcatgtagtttcatgtatattcactatattaacagaatacagttatatgtgtatgaatgtgtatatacatatatacacacacatatacacatacaaatacacacatgcatatatacttatctcaatagatgcagcatttgctaaaatttaaaactcatggcaaactcttagcagactggtaacaaaatgggattcccttcatctggcaaataatatttagtattagaaattttcagcaaacattattcttaattattaaactctttcctttaaaatcgggaacaagacaaggatggctactggctcaacttccattccattgtgttgaaagtcctaaccagtgcaggaagatgggaaaaattaagaatcaatgtgaagactggaaaagaagaaacaaaactgtcgttattcccagatgatggaaccctctaaataaaaagtcctaaacaatctacaggcaaactgttagagaataaaaaatttaaagtaaaaaaaagaatttttttttttttttgagatggagtctcactttttcacccaggccagactgcagtggcgctatctcagctcactgcaagctccgcctcctgggttcatgccattctcctgcctcagcctcccaagtatctgggactacaggcgcccgccaccgcacccggctaattttttgtatttttagtagagacgggggtttcaccgtgttagccaggatggtctcgatctcctgacctcgtgatccgcctgcctcggcctccgaaagtgctgggattacaggcatggccactgcgcccggccaaactaaaaaaattttaaactccctacttttccaataaggacaaaatgatatgacacctaggaatatatatttaacgtaagttgatcgagactgtatattaaaaatggtaacatttttattgaaaaacagaaggctaaatgaaaagctgtaccaaaaatgataattctccccagattaacctaaaaatacaatacagttacaatgatggtgtgtgtgtatatatgagaaagaaagagagagagagagagaagggagagagaagagagctctctctccatctctcttggaggaatgagaatggccaagacagttctaaagaggggaagagtggggatttaccctattaactacaagacaaatacagaaccagtatttcccgtaatgtggtaacaagagagacaagccatagaccaataaaaaaaaagagccctcagaaatagacatcttcaaatatagaaacagattggtgctgtaataattgatgactatccatacacaaaaataaatacaactagatccgtatctcacaacacacaaaattaaaccccagggggattactgagctcagtgtgagaggcaaagttttaaaacttccatgaaaatacagaaaatttttatcacttggggatggaaaaatagttcttaaaatgcaacactaaaaggacacatcatccaggaaatgaatttgcctgcattaaaactgaaaacttctctatcacaaatgatgcccaaaacaactttgagtgatgagtcactgatcgtgagaagacttttatgacaaagggaaatcgtttagagtaaagagcaaataactcagcaggaaaagagaaaaaaccagggagttagcagatcaaaacaaatagccatcagtcacacagaaagcctgaggacatcgagaagcaaggctgccttttccactggccaggagagcggggatccctgccatcgctgtggagtgcggtgactaaagtcctgcagatgcacttcccctgtgagccagcaagtctgcaggctggagaaaatgcagcaggtgcacacacgctgccgagtgcacatcactccgcattctagcactgttagaataatgagaaactgggaacaacccagtgtccatgaacaggagatggagaagcaacctgtggaatactcgctcaatgcaagaccatgcagaagccccacgaagatgactaaggcaacccttatctacatggatcagtatcacaaacctgatgggggtgagaatagaaactggcttacggtaccaaatgcgtcaactttgatgtaaagtttcagtgaagcagacaactctgcaggggaatgaaaaattccctgatgcctcaggatagtggctgcttctggacaatctctaatttcagacagagggagggacagagagccgtggcagtggaggggactcagatgggtctgcaacaatgtatgataatatatttcttatttaaagaaaaagaatagaagcaaatattgtaaacatagtaagattgaataaatctggaaggtattatattattctcatacttttctgcacgttgaactagctagtaacttttttttttgagacagagtcttgttctgttgcccaggctggagtgcagtggcatcatcttggcttactgcatgcagcctcaacctctcaggctcaagtgattctcctgcctcagcctcctgagtagctggaactacagccacgcaccaccacatccagctaatttttgtatttttagtagacacggggttttgccatattggccaggctcgtctgaaactcctgagctcaagcgatccgccggcctcggcctcccaaagtgctgggattacaggtgtgggccactgcacccagccactgacaacttttttaagggtgcagtgctcaactttcagatgtgccaggagatgcacagaacaaggacctgctgagggcaccgctggtcatttgcacggaaatgacccattggctgtcccctgctctgctgcgattcttcaggcaccacctagtctccgtctcctactaagcggatcaggttggaagtggaggaagcaatggatctggcattaaagatggaaatctggatctaccaccagttgagtctgcagctcagcccctgcacatcctggggcctccattttcccatctcctcatggaaatcatgaagtccgcctcatggacttcactgcggttggggtggtggtggagaagacagctcatgggatttgaaagggctgcataaaccagttcccaaaggatgcctatgcagcgaaaccagcccgggaccagcgcaaaataatactagtaggttttatgtctcccatggatgctctgctcctttgtccagtgccctgtcctgtggcccctctcactttggggaccatgggacatggagcctacctggagatcagaggttatttttaaagcatttggttatttcagggctctaaatgagtatcagaatgagagagaggagaaggcagtattgaacggtatgagaccatgggtgtggtggtgtgtggccgtagttccagctactcaggaggctgaggcaggagaatcacttgagcctgagaggttgaggctgcatgcagtaagccaagatgatgccactgcactccagcctgggcaacagaacaagactctgtctcaaaaaaaaaaaaaaagttattagctagttcaacatacagaaaatatgagaataatataataccttccaggatattgtcccagcatgttggccaggctggtcttgaactcccgacctcagaatatcaaattgctcagaacaattgtgctccactcccctgtgattataggattccctgctcagcttcctggaaccagtgcctatcggtttcggaatcacacccaatgccctccatgcatctctgaattcatgcattattccagtcctatctttcctgcctttgcttttgtcctttgttcttcccctgctcacttacctgtcatgaaaacttccaacagcttcactgaggtaaaactggcacacaacgaagggcacccatttgaagcatgagtctgatgagttttcacacagtacacattctgtgctttcatttgccctgctgccatttttaggtattcttttccacggccccttcttcccatggtccctttttatttatttagagacagagtttcgctctgttccccaggctggagtgcagtggtgtgatttcagctcactgcaacctctgcctcccaggttcaagcgattctcctgcctcagcctcctgagtagctgggattacaggcgcccgccaccacacctggctaatttttgtatttttagtagagacagggttttgccgtgttggccaggctggtctcgaactcctgacctcaggtgatctgcccacctcggcctcccaaaatgcagggattacaggtgtgagccaccacggtctctttattctagaacatctcatatggttcaatattgccttctcctctctctcattctgatactcatttagagccctgaagttaccaaatgctttaaaaataacctctgatctccaggtaggctccatgctgtcctctcccgtttgtttactcatccatctgcagcactttctccagtctggtgtttggcccccgaatggggcggtggagctcctcccgtactttctgtttggacactagagtgactggggtactttagagtgtgaaaatgggtctactaatatctatgctggaccatcttcgaccatgtggtgtgtgctaaccctaaacagaaccctctcctgagatcctgacacccagcctgtgctggcatggcagagaccacacagctggaaggaaggagggactgtctctctgtagttccttttatctgaatgtgctccgaactgtgggtccctgcattgggggaaggagggagtctgtatggcatagccatctgggtcccagagtctcccaagaagctgccctaaatcctgccacatcacagctgccaaaaaactccaaaggcagcacctcccttagtggtggctccagaatttcaactctgggactgcaatctggaaggaggctgtgtgtgcaggggaaggagtggtatcttaaagctgtgtttgcacagcacattgcattagaccttaaaaatgtccaccatccatttcaaacagtgggagcactacttataaaaattataaaggcctttagaacccaccctccccataaattaccaccggcaccataggtgattccacatctgacccatcaaacacctatcagtccttgttcttcaaaatgagggcatatttgagacctagtatggcttccagtaacctcccagaaggcctcataaagctgagttgaaagttgttctttctctttctttgttctggtcttatatgcaatatgtctggcagaaaattctagaacattctagaaaaatgcaagtgatgcattggccattaaggaagggtacaggtcttcagccatttttgtgtaggttttctgtcatttcagctaggattagaggtgaggtatgtgtatacatggccaaccatctgtgttcccattaccacatacctagagctgtgtttggtatcattcagcaatagaatcccagatttttttcatatattcccacttcctcagcttcttagatgctaccgttcttttcctatagctaacctacccgtatatcacccatacacactgaaaactgcatccgtcatcctactcaacaaaataatggctctctttcaggacagagggaaggattgaaaaaatttctaagttaatattttaatttcctgtcatagtgaaaacacaacatattacactgtcactgtctgtttttctttctttcttttcttctttttttttctttttgggacagagtctcactctgtcatccaggctggagtgcagtggtgcgatctctgctcacttcagcctcctcctccagagttcaagcaattctcctgcctcagcctcccgagtagctgggattacaggcgtgtgccaccacgccaggctaatttttgtatttttagtagagatgaagtttcatcattttggccaggctggtctcgaactcttgacctcaggtgatccacccgcttcagcctcccaaagtgctgggattacagatggaaaccactgctcctggccaactgtctgtttttcttgtctgtttcccccagtagacttggagggcagagtcagtgtctcttatctctgtacatccagtggccaacccagacacagaagaggtgctcaaaaattttctctgaatgaataaattaaaaactcttattgatttcaaaaacagttactgggtataatttgtgccacgcccctcgctgtaagccagaaaaagacaggagaaatgccgggcagtgaggaggccaggtcaggctggtgaccacagacatataagctgctcacccacaggctgtgcggtatgctccactggtcttgttgctcaggatgcaaacaaagagatagcagatatttgggctcatccagggatgcctgctagccagggaggcaccacagaaaagcagtatgagaaggagctctcacatactggtccagggatggctgaacaggtggacatggctcatgcatagagagaggggcggtatcgcacagtggagtctggctgaagctggacagcactcaccatggggctgtgtgaaatattaataataagatatgtattatgtgtctttggtctctgctcctcagtccctgctaaagagctgctaaaatccttgtcacttcctgagtgacaggggcactaggtaatctttttgttgttgtttatagttagtttttctttctttttttaattatactttaagttttgggatacatgtgcagaacatgcaggtttgttacatgtgtatacatgtgccatggtggtttgctgcacccatcaacacatcatctaggttttaagccctgcatgcattaggtatttgtcctaatgctctccctccccttgcccccaccccctgacaggtcctggtgtgtgatgttcccctctgtgtccatgtgttctcactgttcaactcccacttatgagtaagaacatatggtgttgggttttctgttcctgtgttagttttctgagaatgatggtttccagcttcatccatgtccctgcaaaggacatgaactcattctttttttatggctgcatagtagagaatcttctgttttagtatttggtgtttgaccccagctcctaaatcctttggaatttcctgggtgataggagtgtcttttgttctaatgaagcgactcttgatggaattctagatgggtgctgggtcaccagaatgaccaagccatgatgacgagcttggggctttcagccccactccccattctccagagaagggacagaggctggaaacggagttaaaaatcgatcctgcctacatgatgcagcttaaataaaagtccctgaacggaggggttcagagagcttctgcgtcagcgaacacatccccatgccaggagggtggcgtaccctcgctcctcggggacaggggctcttgtgctcaggactcccccaacctcgccacatgcatctctccacctggctgtgcacctgcatcctgcctcatatcctttataatcaacaagggcatggaagtaaagcctttccgtgggttctgtgagccactctagcaattcaatcaaacccaagtagggggttgtggaagccccagtttataccccattggccagaagtacaggtcacaacctggggcttgtgactggcatgagaagtgagtgtggtcttgtggggctgagcccttaacatgtgggatccaacgctgtctccaggtaaagagtgtcagaattgagttgaactgagcacacccagctggtgtctgctggagaatggtttggtgtatgggggaaatgaatacatctggtgtcagaagtctcgtgctgagtggtgtgtgagagtagagcactggaggctggaaattgtcttgctttttttttttttttaactttcttagagacaaagataagaaagcacataaactcaataactgattgatttcttgggaaacttttatctccttgtccattgataaggtttctctgggtaatttggtttattgtggctcagtaaattaaaccaggtacatgaaagaagaataagatctttaactttgatttgaattaggtcactataataaaagcataaggacattgttgaatacagcaaagcactaaaggtggctagatgcagtgtcaacatgttacgaagcatatttcaccagttaacagttctgatttttgtaacttaaaaaaaaatactgtgaatactggtccaaaaatatgtcacagtcttgcgctgggtttgacttggcaaaaatggccatcaatctacctaaacatctttttattgtttaagcatttattatgtcattttttgttacaaaagccgagacactgtttcatcaggaacgggggtctgtagccttgctttttcagtagcacttgtccatcactgtcaaaggctttgagaaggcagatactgaaatcctaatttttagaccctatttcctgactattcataatgagatgcccagaggcaggccctgtcatcgggaagcagggacatgggtcctggagggctgagacactcagatggtccctgccctccaccaggacctgctcaggaacccaggaggagccacctgccctctctctgggctgcagccttcacacctgcaccatcggtcaatggaccccaggatgcaccctccctctggctctacaattctgtgaatccctgtgtggtgtggtggagttccaggtcccctctgtgccctctgccctgctcctcgctcagccccataaggaggtaagaaaccatcaatatcctcaagagagaggcttgttggcccccaggggttctctgctaaaaaaaaaaaacagagaatctaggagcagggccagtcaggaagggcagaacagagatccaggggtttcggggcctccaaaccaacaaaagacaatccgagggatgagtgaagcaacatctgcatgctcttctggattccaaatttattcctcctcggccatgaagaaagttggtttctgcttttttccctgaggatgggctgtgcctgtacagccttccaggtatgggaggggaggaaggaggggagggtgcctgacaggaagcaagtagttggacaaatctcattaagtcagtatcagttaattcaaacacaactaaaatcaaagtgctttgattcccaagccaattatataggatttcccccacataaattgagttcattacatagtaagtatagataatccataatttaatatggaaaattcagacatggagtgttactaatcagataaacagagcctcaaattagactatggaaaagatcaatggacctgctctaattgccaaccaaaaagaagcaagcaaaagggaaattaatcaaaggaacattctcctttgctccttctttagctaagcgtcaagaacattttgcaggtgataggaaggggctgtcctggatatccgtgcaaaagagtagagcagcctcttcccagagtggctccatttccaatggcccatatttgttctgctgcccaagagttttaataaagcaacaccggatccctgcagaagatcctttcactgcagtcaaagtcatcaggcacagcttggcttggatgacttttcaagagtaaggattatattaaaaatgactgcaccactaattatgagaaaactagataatgtggcacatgactctcagaggaagaagtatctataattatgggaaggaagtacaaaatcttaattatgctaactatttaaatagagcataaggcttgagatagaatttaagggttaggaatctgccttagtgctttgaagtatccatatacttcagaaaagggatctgaaaaagatataaaatacactgaaaactccactgtaattaactagctagagacatccatgggtgcaaaccgtaaccaaggagagaaggctgctgcaatctcagggataaaaacgaagacacaagggctcatggaaaaaaaagacaaagacagaaggagccgaggagggagttgccaagactcaagatcacatcgcaagcagaggaaaaaggtaatgcctgctgcagaaaacagccaggaagagaagctttacaaaaaccgaacagggataggggcagtggctcatgcccataatcccagcactttgggaggtcaaggcagcaggatcacttgagcccaggagttcgagaccagcctgggccagtgagatcctatctctacaaacaataaaaaattagctgggcatggtggcatatgcctacagtcccagctacttgggaggctaaggtgggaggatctcttgggcccgggagtttgaggctgcagtgagccgtgatcacgccactgcactcaacctgggcaacagagtgagaccctgtctcaaaagagtttgttaagtcattcatgctacatttccaatgtgggtagggtgcaggacgctctgttcattgtagtgacccaggctgatggcactgccatcacctctactctgccaattactgtgccagtgggaaagagagctctggaagacctcaaaccacatttaaacattctgacttgaaagtggtacatataagctttgcttacatggcccccagcaatcatgaggggacagggaagtacaatcttaccatgtaaaaggaagttggagagctagacatgttttaaaacagcattaatgaccatcacatacctaaaggggagaaagcatttggctgactttcagatttttccctatacagatattcaatgcaaaagagaataacatatcatctataaacccctaagagaaagtttcctcaagaattctgcacccagggggaaaaatgatgtagaacattattccagaacattattccagattctgctgaggatggagaaagctggaaagaacattgccccaccattacaacaacaagaagaagacattgggttctgcaaattcccaacttaaggtgaacccatcagacagctgaggtcacaggacagcaaattctaaggaaaagacagagtctccaaggagagacatgagcacttacctggggcgtatgcagtcagataccagctctagtggaaaaggtggacaagatggaagatcactgaggtaaggtagcagagaggtggaagcaatgaggaagagtcaaatgcaaatactaggaattaaaaacaggcacagagatgaagaatgcctttgatagacagggtcggcagtggactggacacagttgaggaaaaaatgaccaagtggggtttatcttgggaatgcaaggctggcttaccactcaaaagtcagtgttattcaccatttgagtggactgaagaagataatgtatagcaacatctaagcagacgtagtaaaagactgataaaattcaacagccattcgtggtattaaaaacaaaacaaaaaccactctcagcaaactaggaataggagggtacttctacaacctgataataaacatctatgaaaaacttagcgctaacattatacttaatccctaaaagcaggaacaagagaaggacatctgttctcaccatatctattcaacactctacggggcggtctagtcagtgtaataaaacagggaaaagaagtaaggggcatccagattgcaatgtgtgctgatttattttaggtgtcaacttgactggatgaaggatactcgagaactggcaaagcattgtttctgggtgtgtctgtgagggtgtttccagaggagattggtgtgtgagtctgtgaactgagtggggaagatccaccctcaatgttggggggcaacatctgatcgtctggggacctggatagaacaaaaaggcagaggaaaagcgaattattttcttttgctcttctggagctgagacaccctttcctgcccttggacatcagaacttcaggctctctggcctttggaccctgggactcacactggtgcaaccactccccgcaggttcttggccttggactgagagttccaccattggtttccctggttctgaggccttttgacttcgactgagccaaactcccagctttccagggtctccagcttgcagatgggactgtcataggacttcttagtctccatggtaatgtgagcaattctttcaataaattccctctcacctatctgtatctgtcctattggctctgtctggagaatggaagacgtaaaattgcctctctttgcatagcacatgactgtctacataagaaaacccaaagaatctgcaaaagagctaccagaactgagtttagtcaagaccacaggatacaagattggtaacaaaaatcaaatttctatgtgctagcagtgaataagagaccattaaaaaataccattaggatagcaccaataaatgtggaatactttaagcataactattacaaaatatgttaagatctatatactgaaatttacacaagactgatgaaaaaaagaaacactgaagaaatgaagtatgacttaaataaatgaagaactagatcatgaatatgtcaagtctcttcaaagtgacatgtggactccatgcaatctcaattaaaatcccagcaggattctagtagaaaatgcacaagtggattctaaaatttatatggaattacaaaggaaatgatagctaagacaattctgaaaagcaacaaaattggacgacagcaataaacagatactcgcttccaatagtccctggtcctcttgatctcagatgaaagtcagtccctgccaaggctgttgctccttgcataggccctcaggtgggggacaggggcaggctgcctcttctcctagcacctaagccactgctgccacttccagaccattggcctcacaccttaatcacaactcctgcctcctttgagcctcctgccaccagttttgatagttcctatctctaagtaggctttgtacacaaattcatgagggagtttaaaatagtgtagtctttcctttgctttcaactcttaccagtgtcctgggcaatctgaatacccatggggatgtgccatgcattcagctaggctcccagccttccctggaacttcttgacttcagtggcctttactctatgccgtttttgccacctcataccaagggcttttctcaccaatgtaccagaacagtgaataagagtgagactgcaaggtcaccagctccccctagacctgagactgcattcttagagacagtgttgttttttcaccagcattacctttcaagccacagtcactgctgcaggggctggagagtcatgaaaaccgggtcctgcatcccatgagtgaaggcgttcaagggggacgccaggaccttagaggagcctgttgaacaccccaaccagccaactgaggaacgggaggtaacgtgaggcccaaatgcatccccatactcaagaaaacattcccaggttgaagaagtgacttagcagttgtcagaatgagatcgcagagtgagcaacggctgcccgtgtcccctcccaggagggctgtgaaaggccacagcagacctcaggcactgacccaggcaggctccaggatgcagtgaggtagaatgtgggcgtaggtaatgtgggcagcatgaaatacctggtcccatgatgggatgggccctggagtgctgcagttcttgattcctccaaccccgctgcatctgtcactctggtgagctgctgggaccatccaacttggaccattcctccgtgcaaaacatgacaggcgctgtgagccaggcgtagtcctaccatggagatgagccgcatcctctctctctgtacatctttgcttgtctaccagccggagaccacccatggaggactaatcacaagcactcaaggtcaacgctttcctcctctccccagatccgaggtggctctctgcagtttcccatcccctgcatactgcattccctacacacatgctagaaccccctccatactgcaaacacaattttaccaccaactaagagttccttggactgtgccacatctttttatatttatttatccatttttttcttttgagatgaagccttgctctgtcaccaggctggagtgcagtggcacaatctcggctcactgcaacctctgtctcccaggttccaatgattctcctgcctcagcctcccaagtagctgggactacaggcgcccaccaccacacctggctaatttttgtatttttagtagagagggggtttcaccatgttggccagactggtctcgaactcctgacctcaagtggtccggctgcctcagcctcccaaagtgctgggattacaggcgtgagccactgcgcccggcttgtgccacatctttttaaaaagttttggcacagttttattcaggggaaacagaagaattgggttcactcttcttatgtatttttaagtagccaattttgcttttcagaataaaacactcggaagaaaaaataaaataatataaacaatttttccaaatcactttttttttaaacatcaaatgctacacataagaatagactcccaggggagactgtctgatttttttcctccaaatatcttttaaaaagcaaaataaatccccatttgttccctgatggtataacagccaaaaatgtcagaaaagccgtagaatgatcccatcatcatttgtaaagacctctttcaaccatttgcatccgaatttgcagatgtcagaggtaggacaatgaaatggcaaaaatgcaaagtgagatccagaaagcaacactttcaaaatcaaaatatataatcctttcaaatgttctctggaaagatattccctcttgcactgaacctaccccgggaagttaagagctgaaaggaatctatatgttaataaggcttcctaaactgtctgtaaggcatggaatgaaatgcatgcacaagcagcgcccagcggggtcaccttcaaggtcagcctcacagcgttgcagttctcctgcagcgggttcagcttcagcgtctccccgaggttgctgcagccggacgactggtgctgcagctcacagcagacacacacctccacactgtcaaacttaatctagacagaggaacacagacagacctcaccgttaacaggcattcgacccccgagggtacgcgtgagtgacacagttcagaacacaggaaaatggctcagttcaaaggagcctgtttcagtgtgtttaagtagtacagcaaaaacaatttctattgacccaggccatcaggaggacttcaaattcctatcttaacagcaatgtatagaaaaagcaaaagtacatttgaagaaacttaagctatacattagagaaaatggcaggtggattacaaaatgagataaaggtaaatagattgaaagtcactcatgctgatgtatgcacggagatgtgctatcctagctctgtgccttggctcattctccttccacagtcagaaatttcctgcctcacttcatggcctatcaaactcctgctcatccatcaagacccaactccagcgccaccctcgaggccttgtctggttttcctgcctcactgctactgaagactgactttatccagctacaggtgcatcttatcaccacagtattgacaatggcaacaagttgtaggtgttcaataaatgctgaatgaataaaaacggcttggaaaatggaaaaccatggaagaaaaaaatgcatttcaagtattttaaaaagcagtgttagacgaagagagagtatgagagtctcagtgagagggaagagaacagagttaccagtgcctaggagaaaagcagctttaaaaaagtaaagtcctagccaggtgtggtggtacaccacctgcatttgcagctactcggcaggccagggcaggaggattgcttgagcctaggagtttgagaccagcctggctgggtaacatactgagactctgtctcaaaaatacgtaaataaaaaataataaagtcctagatgtaaaactactaaaaaagaaaatcaggccaggcgcggtggctcacacctgtaatcccagcactttgggaggctgaggcgggcagatcacaaggttaggagttcaagaccagtctgaccaacacagtgaaaccccgtctctactaaaaatacaaaaattagctcggcgtggtgctatgcacctgtaatcccagctactcaagaggctgaggcaggagaatcgcttgaacccaggatgcggaggttgcagtgagctgagatcatgccattgcactccagcctggatgacagagcaagactccatctcaaaaaaaaaaaaaaatcagtaaaatctatgcaattttattcaaaataacactgaacatgaaacaagttattttccttagactaagaagtgccctgctttccaatagataatatgtttacagcagccaactcgaagtacaaatacttttcagacaaatattggccatttataaccataacaaataatttttcattgcatgaatattgctgagactgaggccatacttataaaacctccaggtatcaacatgtccgcctctcctaaatactgggggaggggtaatggagcatcctcagagccaagaaatgtgctgatattcaccagaggaactcagcttagcttaagacttagcccctgccaccccctgctccatgtcaggtgggctttgcgagtggctttcagcaggagaatatgggtagaggtgtcagcttgcagcttctgaacttaagacctccacaggcttcatgtttctgcaccctctccctggaacttccaatatacagcaggaaaagaacagattccagggagctgccagctctccagtcccagcaggaaacccgtggagcacccctgcagaactgttctgccctatggtacatgcacacacaacattactaggtaagatcaaaccatttttcaaataattcaaacaaattatactcccaccaatagggtgtgaattcaggctaatccacatcctcaccaatgcttgctaatgttggacttagacatttttgtccatgcagtaactaatataatagtatctaatttgggggtgggtgggtttgttttcatctttcctcattttcttaaccgttcatattgtgaaacctaacacacatacacaaaaagtgcacaaagcaaacatattcagttcaatgatttatcattaagcaagcacccaccggcccatggccatgttcctaaaaggccttccatgcctcattccctgtcattcctcccacttgctgcaccaaaagctcaccacattccttactttttaaataatcacttctaggcttccacctttatacatttaccactatagtttagtttcacctggttttctaacttgatacaaatagaatcatacaatatttttagtatttggcatctttcattcaaaattacaagattcatctaccttactgcatataaatatagttgatcatgttcactgttgtatattacattgtgtgaatatgctgccatttatatatctattctcttgtcacgggacgtttggattgttgctaatttttttgcaataagattaatgctgtttgatattctgtactagtctgctggtacatacatgtgcatatttcttttgggtacaaaatacctattgatcagagctgctgggtccctggggattttcagctttagcagagaatacaaagccactttccaaagtggctgtaccaatttacacactcaccagcactgttcgagggtccccattactccacatcctggcttgtgcttgttttagtctttttaattttagataagaaagtactggaagaggtacttcttccttgaaatgagggactaagccaagaaaaaaagggaagatgggatctaacacagaaaagagatagaggaagttctaagagaatgggaaaaggatgtcctagcatggtaaatatatagactgcctataggctgacttgttcagactgaagcaggaaacaggctcaatggaaacgtctctaagaaaatgaagctgacagaacgcttgatgggtaggactgtattcagaggagattttcagttctcctgggaagtttgagagtaaattaggaacagagacactaaacaaataataaaacaattttaactcagcataaaagacaaatcatatatagtacatggttttgttatatatgcggcttgtaaatattttctcagtctatagtttatctttttatcctctcaaaaggatcattcattgagtaaacgttttaaattttgatgaaggccaacttacatatttttgctcctacacttttggtgttgatctaagaactctgcctagccctagatctttctcctatgttttttctaaatgttttataattttatttttacatttgattgcatgacccattttcagtcacttttagtgaaagatatgagacttgggatgaggttgactatttttgcctatagatgtccaattgttccaacatttgttgaaaaatctatcttttctttgcttaattccttttgacttttgtcaaaaattagtcgggcatatttgtgtgtctctatctggattctctctttgttccattgatctatctttccaccaaccaccaagtcttgattactgtggctataagtctggaaatcaaaaaattaattcctcccatttaattcttatttttcaaaattatttgtctctccatatacattttttttttgagacaggtcttgctctgtcacccaggctggagtgcagtggcaccatctcagctcactgcaacctccgcctcccgggttcaagcgattctcatggctcagcctcccagatagttggaattacaggagcacgccaccatgcctagctaatttttgtatttttagtagagacaaggttttgccatgttggccaggctggtctcgaattcctggcctcaagtgatcctctcacctcagacttccaaagtgctgggtgtacaggcgtgagccaccacacctcgtctccatatacattttagaataagactgtcattgtctccaaaaaaagtgttgctgggattttgatagggattgaatcaaacccagtttcttttttttttttgagatggaatttttgctcttgttgcccaggctggtgtgcaattgcgtgatctcacctcactgaaacttctgccttctggattcaagcaattctcctgcctcagcctcctgagtagctgggattacaggtgcccgccaccaggcccagctaattttttttgtatttttagtagagatggggtttcgccatattggccaggctggtcttggactcctgacctcaggtgatctgcctgccttggcctcctgaagtgctgggattgattacaggtgtgagccactgtgcccagcccaaacccacatattaactggggggaaatggacatatttactacattgaattttccaatttatttatttcctcattgttaacgcagttttcagtgtatgttttgttagatttacacttatgtatctttttaagcgatttttaatttcagtgtccatatgctattaatatgcagtattactgttactatacagttcactattaatacacaagaaatacaattgaattttgtatgtttatcttgtatcctacaactttgctgaactcacttattaattctaagaggcttgtttgttctgtttgttttttaaagattctttgggattttctacatagatactcatgtcatccacaaacagagttagttatatttgttcttttctaatctttatgccttttattttattttcttgccatactacattggcttgaaattacagcattatgttctatattgaaaaaaatggtacgaatgagcatgcttgccttgttcctgatcttaggggaaaagcattcagtctccattaagtgtgttagctgtaggtcttttgtagatgctctttttcaagttgaggacgttctctatgcctatttttctaagtttcctttttagttatgaaaaggtgcttgagtttgtcaaatgctttttctccaacaattgatacagccatgcagtttctcttctttagcctgttgatatgatagaataaattgactgatttttgaatatcaaaccagttttgaatccctggaataatccctcttggcaatgatgtatataactcctttcagatatgttgaattttattcgttattattttgttaaggatttttgtatctatattacattaataagggatattggcctgtaattttatttttctatactgtctttgtctggattttggtagcatggcaatattactttcacaaaaatcaatttggaaatgttccttctattttttcagagaaattgtgtagaaatggtattaattctataaatgcttaatagaattctccagtgaaaccatctggacctggagattttgtttttggaagttttagaattataaattcaatttccttaataattatagggctattcaaattctctacttcatagtgtacgagttgtgttagttcgtgttttccaagaaattgatctatttcatctaagttgtgaagttcatttgtgtaaagccattcctattattcccttattatccttttgatgtctgctgggtctgtagttatatcccggtttcttcccagacattgggaatttgtgtcttctaactttttttcttgctagagttttgtcaatgttgttgatgttgtcaaagtatcagctcctttttcattggtttttctccattggttttctgttgtccatttcattgatttctgctctttcatttatgatttcctgacacctatttgctttgggttgattatgctgctctttatctagtttctttttttaattttatttttagttgagaaataattctatattacatatttatggggtacagtgtgatgtcttagtaatgtttacattgcagaatgattgaatcaagctaattcacaaatcacctcccattttaaaaattttttttattttactttaagttctgggatacaggtgcagaatgtacaggtttgttacataggtatatatgtgccatagtggtctgctgcacccgtcaacccatcatctaggttttaagccctgcatgcattaggtatttgtcctaatgttctccctccccttgcccccaacccctgacaggccctggtatgtgatattcccctccctgtgtccatgtgttctcactgttctactcctacttatgagtgagaacatgcagtgtttggttttctgttcctgtgttagttttctgagaaagatggcttccagcttcatctacatccctgcaaaaggcatgaacttattctcttttatggctgcatagtattccatggtgtatatgtgctacattttctttatccagtctatcattgatgggcatttgggttggttccaagtctttgctattgtaaatagtgctgcaataaacatacatgtgcatgtgtctttgtggcagaatgatttataatcctttgggtatacacccagtaatgggattgctgggtcaaatggtatttctggttctagatccttgaggaattgccacactgtcttccacaatggttgaactaatttacactcccacaacagtataaaaccgttcctaggccgggcacggtggctcacgcctataatcccggtactttgggaggccgaggcaggcggatcacgaggacaggagatcgagaccatcctggctaacatggcgaaaccccgtctctactaaaaatacaaaaaattagccaggcgttttggcaggtgcctgcagttccagctactggggaggctgaggcaggagaatggcgtgaacccgggaggcagagcttgcagtgagctgagatcgcgccactgcactccagcctgtgtgacagagcgagactctgtcttgaaaacaacaacaacaacaaaattgttcctgtttctccacagcctcaccagcatctgttgtttcctgcctttttaataattgccattctaactggcatgagatggtatctcattgtggtttttgatttgcatttctctaatgatcagtgatgatgagctttttttcatgtttgttggctgatatatttatctttttgtggtgaaaacatttaaaatctactcttaagcaattttgaaatatacgaggcattatttattttagtcatcattttgtgaaatagatcactaaaacttactccaatctaactgaaattttgtaccctttgatctatatcctctttggcttcaactgtttccctttgctgtgatcaactggacaggagtccagctctcctgaaacagttcactctcccacgtctcaaaaacattcaaggaattatctcatatgatcacatctctaggctaggcattaagattgaagtagctatcataaatggcaagacattttcctcagtctgaaggatcatccggggaaagggaggggagatcagcttgtctggaaagcatgatttatcaaataaaataacccttcaatgaccccagggaatagacatccaaataaatcttttccatcagttatttcactgagtttgtgattaattcttaggaaaattctgaaaacctcctggttagttccctgacctcgacatctgggtgtgcaggcggctgacagatttattttaagagtacccctcagtgttcgggtcattgggaacgacaccgcagagctttgcaaatgaggccacagtaatttttcacaaatctctttggggcacttaacagctagcctgccccccttatttatggtctatcagcctgtctgggagtagaaagggcttatacaacaaaaagagggggatgcccccacgattctcttacagaagtacaaatgggatgggtatgtgaccttcagatattctcaaagggaaggcagtgtgggaaggctgagcatgtaggcagagcagggcagagggctgggaagaggctggcatgtgtcaagcccgagaacttacagtgggcacaccaaggccagtatccttggatgtgaggagcctgtttcgaggaggaaggaggcgcagcacgggtgacagagtcagactactcacagtcctaactgccatggagtgacccaggacaagccatgtgacctctctgggcttcaggttcccggaccccagtgaggatcaaatgagattagacaggtaaaaatgcagagtgccaacgctatttgccggtgttattgatgttgctattatttacattaaagaaaaaatttgtagaaactagaccctaagttttcttcccaaaggttcaaacaaagctacaaaaactagaccctaatttttaaattgtggtaaaatacacacaacataaaatttaccatcttcaccatttgtcggcatacagttcagtggcattaaacatattcacctcgttgtgctaccatcaccaccatccacctccacaactttttcatctttccaaactgaaactctgtcaccactaaacaaatccccattccctctcccacaggcccccaacaactcccattctactttctctctctgtggattcactactccaggtacctcctgcaagtggaatcaggcagtatttgtccttttgtggctggcctatttcactcagcatgtcttcaaggttcatccatgtggtagcacgtgtcgagatttccttcctttttaaggctgaagaatgttctatcagatgcatctaccatattttcttgataattcatctgtagatggacacctgggatgttttcagctcttggctgctgtgaataatgctgctatgaacatgggtgtgcacatatctatttgagtccctgctttcaattatttgggtaaattcccagaaggggaattgctggatcatgtggcaattctctgtttaatgatttaagaaaatgtcataatgttttccacagcagctgtgccattttacgttccaccaagagtgtacaaggcttccaacttctctacatcctcaccaacacttattttctgggttttcaaaaaatcatagtcattgcagtgggtgtcaggtggtatctcactctggtttcgagttgcatttccctaaccattagtgatgttgtgcaccttttcatgtgcttactggccatttgtatatattatttggagaaatatctattcaaatcctttgcctgttttcaaattgggttgtttgtgttcttgttgagctgtaggagttctttatacattccggatagtaacctcttatcaactatacaattggtaaatattttcacccacggagcctcttctgttgattgtgttctgtgatgaacagaagtcaattcaactttttgaatacttgtaggtttccatcactttcacaaaaactgtcagtaacctgttgatttctccctaacccagtaatttttgcttcctttgtctcaagaatgagccaccttaagtcttgctgcagaggtaagcatctcacttgcctcactcagtccttgtcctgctttctgagcaatgccactgtcctgcagcatccctgctggtggtgggagagggtccccacaacaccagccccaatgacacaggacgacataactgcctttctctggactactattaacaaataccacagacggggtggcttataaacagtagaaatttatttctcagagttctggaggctgggaagcccaggattaaaacaccagcagatttggtgtatggtgacatcctggttcacagatggatcactgtgtcctcacctggcagaagagacaaggcagttttctgggacttctattataaaggcactaacccactcatgcgggctccacccacatgacctaatcacctcccaaggaccccacctcctaataccatcaccatggaggttagaatttcaacatagaaattcgggggtgggggacacaaacattcagaccacagcaaaaacccttatgctggtgatgctcaaggcacttaaaggcactggtaagaccccaaaaactccagtaatcacagtgcaacatgggtggaccctgatgacattatgctaagtcaaagaggccagataccacagatcacaccccgcatgattccattcaacatccagaacagaaaaacccacagggacagaaaccagcttagcagttgtctgggactcagtcggggacaggggccaatccggggtgcgacataaagggtatggtatgtttttttgaggtgatgaaaatgctctaaaattgactggggtggtgacgcacatacggtaaatatactaagaaaacactgaattttacactttaagtgggtgaattgtatgatacgtgaattatatcacaataaaggtgtttcagaaaaaaattaccaccacacgtaattactaactcatttagtttggttttaatcccttccgtgttctgcctaaacgttttatattcacacacgtgtcaccaacatcgacagtttgggaccaatcaaaactaccttcaccactgtctccccggcataaactcagggccaacatagacatgctccgtaggttggatgacacggagccactttcccgcgagtggctcaaagctactcgccaagcagctcctgcagcagtgccctcagccagcccctccagctcttccttactccagagcatcaaggactgggcacctttttgttcctggagagatgctgaatgcagtccctgccagacctgaggacaaagccggcccattattggggtgtttcccctgtgctacacactaggcgtggaagcatttggactggcattgtgtccagaattggttcccgcccgtggcttcctggtctcaccgacttcaagaatgaggccgcagacgttcccagcgagtgttacagctcttaaagattgcacgaacccaaagagtgagtgataacaaagtttattacgaagagcaagagaacagatcttccacctcctacgagcggtgtgccgctgccggttggggggcggggggggtggccagcttttattcccttatttgtccccgcccatgttctgtttctgtcctatcagaatgcccttttctcaatcctcccccacgattggctacttttagaatcctgctgattggtgcattttacagagcgctgattagtgcattttacagagcgctgattggtgcattttacaaacctagctatagggtgctgattggtgcgttttacaatcccctggtaagtcagaaaagttctccaagtccccactccacccaggaagtccagctggcttcacctctctcttccttactccagagcacgagggactgggcacctgtttgttcctggagaggtgctaaatccagtccctgccaggcctggggacaaagccagctcatcactggagggtttccctgttctgcacaatgggcgtggaatcatgtggatgggcgtgtcactgagggatccccccagcctccccactaggttgggaatgcagccatcagtgggggtcaccccaccttccctgccaagctagggacacaaacccccacgctggcccctcctagcctgtagcccccctgtcccctggggggcttacaaatgccgggacttctgagaactgagactgccttttgtgtcccctacagcagggatggcaaacacagaccacacatcccaccatttccctcttttgctttcaccctcccctccccccaccctgagtccagataacagccttagaatcctactcaacacactgttctgggcacttaatgccaggcagaggaagctggcacacaacgtgaaacctacttgccatccctgtcctacctataagtagatagggccaaaaataggagaaaataaaatgtttatgaccaaatacataaagacattgtaaaatgttgatgcttgctaggagggaattagctgactccttaaaaacatgtgtcatctactttgaaatgatcgagaaatgctggcaaatagggcagcctcagagtgctctcaagcctctgcccagtggcaggggaagcaattctctctgtgcttctgcaggaagcgacagctgaggtttgagggaggcgccagcacaccacagatatcagattcctcagtaaacagaactcacatacacccctggtgggagtgaaaattaatacgaacaacttcggaaaacacacagtttggcagtatctaccaaagctaaacatacctatacctatatacctataggtataccctacatcctataacctacagacttcccctctggtgtaaccaacagatggatgttcatccaaagcaatacacgagaatagccatgcctgtgtatccacaatagcctcacactgggaggagagtggggaaaacaaaactgcgaggtactcacacaatggaaaattggaaaccagagctacttgcaacaagatgagtgaatctaaccgacatgttgaatgaaaaaagcaagaaataaaagggtcaattacatatgattctatttataaagctgaaagccaggaagaattcttttgtgacattagaagttaggatagcaggtgcccatgaggagtgtggtatgagtgactgggagaaggaggggcggggctcccggggatgctggagatgttttacttctgatctaagtgttggttccatgggtttgttcacctgtcaagagttactaggttcagtacttacaatgtgtgctttcttctctggctatgtctgagctaacacagaggattaatttttaaaaaatacacaaatctgtctggtcgtggtggctcatgcctgtaatcccagcactttgggaggccaaggtgggcagactgcctgaggtcaggagttggagaccagcctggctaacatcgtgaaaccccgtctctactaaaaatacaaagattagctgggcgtggtggtgggcacctgtaatcccagctacttgggaggctaaggcagggatatcacttcaacccaggagtgagaggttgctgtgggccggtatcaccccactgcactccagcctgggcaacagggagagactccgtctcaaaacaaaaacaaaaacaaataaaaaatacacagtagtccaggggagagtctgttgcttatgactgagtggacctcaaggcctgcctcagtttcccacagagagagaaggaccatggtcatgaggagaccttccagggatggtggaagcaaaagagaaagttgcattttgattttggttcctccgcctggaaagtgcgggtctcacacagggaaaaggtgggcttcttccaagactcagcctgagcatctccctctgctctcggggactgagtttccctcttcctgtgagtctctctgtgccctggtacccctgcagggtcactctacccagctgtcaccccctcagagcacaaactgctccctggcatcgggtggctgctcacaactgactctgaaattagtggaaggatgtaaaagtaaaaagttggatgcaaaagtgtcacctgggttaattcaactggattgtaaaggtttcaagaaggttttgtataatgctttttactttctgcattttaagatgctttgacatcttggggtctactaatccaggagagactgccctcccagggctagctaattccttcagataataagaaactcacctgcaagcccacttttcctatgcagaccaaccaatccacagcccacacctcgaactacacccttcatttaactctcacaactaagccactatttcccctgccctaaatcatcccagggccaggtaaggtactagacaactgggggctactcctacagccaacaggtcaaaccagccaattctcacctgggtcaaacgtgcctgcacattcttccccacaaaaaccacaataaaggatctggcccatgctgtcccctagatcaggggtccccaagccctgggccacagaccagtactggtccttgacctgttaggaactgggtctcacagcaggaggcaagcagtgggtgagcattattgcctgagctccgcctcctgtcagatcatcagcagcattatattctcataggagcgcgattcctattgtgaactgtgcatgcaagggatctaggttgcacgctccttataagaatctaatgcctgatgatctgaggtggaacagtttcatctgaaaccatccctgacctggaccctcccccagttcatggaaaaattgtcttccacaaaactggtccatggtgccaatatggttggggactgctgccctagatccctctgagcttctctgtgtggtcttgcctgggtagcatggcccttcctcttggaaactgcgagtaataaactcttctttcaaagcagtggtctctgtgtctggcatcccaccgtaatggactacaacaaatcccaggtaccttttaagataggcttgcaacttaaagatgatacagccttctctaactatctcttatcccaattcatctctttcctatgtatattttcaatagacacctgtgcttcaaatgcattaagatacgtcccagaatgcaatccatgggtatgaactgtgcaggtaccacatgttactcctaacacttaggatcagatgattaatagaaggggattgtctgtaaaatatgcagttattcaggttactacataataatggaaagagtaaaaaatcaaattatttcttcagtcttttactacgaagatttctgcattttgtttttgctactgctataaatgagggaggcctcatttgtcctatagtaaaatgatgaaaatctgcccatcatcccctctacgatgaagccagtggagagtcatggtgttctgtgaccgtggtgctgtgtggcagagtgcactcaaccacctctcagacacactcgatgtgtgccctgcagccctgaggctgctccacaagcccctcccagcatgacccagcccctgttccagtgacttcagatctatgtctcacttcacttcagaattctttaggacaaatcgttttcagaatatgggaaattactttcccttgtctgattgccctggctaggacttcagtagtgtgttgaagaggagtggtcagagtgggcatccttgtcttgttccagttctcagaggggatgctttcaacttttccccattcggtattatattggctgcgggtttgtcatagatggcttttattacagtgagatatgtcctttgtatcccgattttgccgagagttttaatcataaagggatgctggattttgttgaatgctttttctgcatctgttgagatgatcatgtgatttttgtatttaattctgtttatgtggtgtatcacatttattgacttgcatatgttaaaccatttctgcatccctggtatgaaacccacttggtcatggtggattatcttttgatatgttgttggatttggttagctaatattttgttaaggatttagcatctatgttcatcaagaatataggtctgtagttttcttttttggttatgtcctttcctggttttggtattagggtgatgctggcttcacagaatgaattagggagggtctcttctttctctatcttgtggaacagtttcaaaaggattggtaccaattcctttttgaatatctggtagaattctgctgtgaatccgtctggtcctggacttttttttgttggtaatttttaaattgtcatttcaatcttactgctggttactgttctgttcagggtatctaattcttcctgccttacgctaggagggttgtatttttccaggaatttatccgtctcttctaggttttctagtttatgtgtgtaaagttattcacagtagccttgaatgatcttttgtgtttcagtggtgtcagttgtaatacctcccccgtttcatttcttattgagcttatttgggttttctctcttgttttcttggttaatcttgctaatggtctatcaattttacttatcttttcaaagaaccggctttttgtttcatttatcttttgtatttttttgtttcaatttcatttagttctgctctcatcttggttatttcctttctttttctgggtttgttatttcctttcttttgctggttcttgtttctctagttccttgagatgtgaccctagagtgtcagtttgtgctctttcagtctttttgatgcaggcgtttagggctatgaacttgcctcttagcaccgcctttgctgtatcccagaggttttgacagtttgtgtcattattgtctttcagttcgaagaattttttaatttccatcttgatttcatttttgacccaatgctcattcaggagcaagttattctgtgcagaagctctttagtttaattagatcccatttgtcagttttggcttctgttgccattacttttggtgttttagatgtgaagtcctggcccatgcctatgtcctgaatagtattgtctaggttttcttctagggtttttatggttttaggtctaacatttaagtctttaatccatcttgaattagattttgtataaggtgtaaggaagggatccagtttcagctttctacatatggctagccagtttaccctgcaccatttattaaatagggaatcctttccccatttcttgtttttgtcaggtttgtcaaagatcagatggttgtagacgtgtggtattatttctgagggctctgttctgttccgttggtctacatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattgattcttcttatccatgagcatggaatgttcttccatttgtttgtatctcttttatttctttgagcagtggtttgtagttgtccttgaagaggtccttcacatcccttgtaagttggattcctaggtattttattctctttgaagcaattgtgaatgggagttcactcatgatttggctctctgcttgtctgttattggtgtataagaatgcttgtatttttgcacattgattttgtatcctgagactttgctgaatttgcttatcagcttaaggagattttgggctgagatgatggggttttctagatatactatcacagcaaaagaaactaccatcagagtgaacaggcaacctacagaatgggagaaaatttttgcaatctactcatctgacaaagggctaatatccagaatctacaaagaactccaacaaatttacaagaaaaaaacaaccctatctaaaagtgggtgaggatatgaacagacacttctcaaaagaagacatttatgcagccaacagacacatgaaaaaatgctcaacatcactggccatcagagaaatgcaaatcaaaaccacaatgagataccatctcatgccagttagaatggcgatcattaaaaattcaggaaacaataggtgctggagaggatgtggagaaataggaacacttttacactgttggtgggactgtaaaccagttcaaccattgtggaagacagtgtggcaattcctcaaggatctagaactagaaataccatttgacccagccatcccattactgggtatatacccaaaggattataaatcatgctgctataaagacacatgcacacatatgtttactgcggcactattcacaatagcaaaggcttggaaccaaccccaatgtccaacaatgacagactggattaagaaaatgtggcacatatacaccatgcaatactatgcagccataaaaaaggatgaattcatgtcctttgtagggacatggatgaagctggaaaccatcatctcagcaaactatcgcaaggacaaaaaaacaaacaccgcatgttctcacatataggtaggaactgaacaatgagaacacttggacacaggaaggggaatatcacacaccagggcctgttgtggggtgggaggaggtgggagggatagcattaggagatatacctaatgtaaatgacgagttaatgggtgcagcacaccaacatggcacatgtatacatatgtaacaaaccagcacgttgtgcacatgtaccctagaacttaaagtataataataaaaaaaaaaaatgtaaaaaaaaaaggagcaagttatttaatttccatgtatttgcatggttttgaaggttccttttggagttgatttccagttttattgtactgtggtctaagtgcttgatacaattttaattttcttaaatttattgaggctcgttttatggcctatcgggctatcttggagaaagttccacttgctgttgaatagaatgtgtattctgtggttcttggatgaaatgttctgcatatatttgttaagtccatttgttccaaggtatagttcaaatccattgtttctttgctgactttttgtcttgatgaccttgtcttgtgctgtcagtagagtactgaagtccctcacgattactgtgttgctgtctatctcatttctttggtctgttagtaattgttttatgaattttggagctccagtgttaggtgcatatatgtttaggactgtgatattttccggttggacaaggccttttatcatttgtgatgattaataccaagtgtcaacttgattgaattgaaggatacaaagtattgatcctgagtgtgtctgtgagggtgttgccaaaggagattagcatttgagtcagtgggctgggaaaggcagacccaccctcaacctgggtgggaacactctaatcagctgctagtgcagataagactataagcaggcagaaaaatgtgaaaaggagagactggcctagcctcccagcctacatctttctcccatgctggatgcttcctgccctcaaacattggactccaagttcttcagttttggaacttggactggctctccttgctcctcagcctgcagacagcctattgtgagaccttgtaataatgtgaattaataataaactcaaatatatataatatatatatatatatatattccattagttctgtccctctagagaacctagactaacacaccattatacaaatgtcccactttgtctcttttaactgctgctgctttaaagtttgttttgtctgatataagaatagctacccctgctcccttttggtgtcaatttgcgtgaaatgcctttttccacctctttaagtttatgtgagtccttatgtgttgggtgagtctcctgaaggcagcagatggttgttgagttctgatgctcctgaagcatggagttctgagtttcctgagggcagcagtgggttggtgagttcttatctattctgtggttctgtatcttttaaggggagcatttaggctatttacattcaatgttagtattgagatgtgaggtaccattgcattcattgtgctatttgttgcctgagtactttggtttttttgtttttgctttttaacttgtatttttgttttataggtcctgtgtgatttatgctttaaagaggttctgttttgatgtgtttccaagatttgtttcaagatttagagctccttttagcagttcttgtaatggtggcttggcagtggcgaattctctcagcatttgtttgtctgaaaaagatggtatctttccttcatatatgctgcttagtttcactggatacaaaattcttggctgataattgttttgtttcaagaggctgaagatagggccctgatccgttttagcttgtagggtttctgctgagaaatctgctgttaatctgataggttttcatttataggttacctagtgcttctgtgtcacagctcttaagattctttcctttgtctaactttggataacctgatgacaatgtacctaggtgatgatctttttgtgatggatttcccaggtgttctttgtgtttcttgtacttggatatctaggtctctagcaaggctggggaaaattttctctattactcccccaaatatgttttccaagcttttagaattctcttctttctcagggacactgatcattcttagggttggtcattttgttacacccgagcgagttccatggtttgcaaacatttaaaaatgaacttatgtttctaaacattctgtagctttcttcttcctattgactcattagcaatatttgttttttcctgattataaaagtaacaaatactcaatgtagacattttataaaacatacaaaagtaaaaagatgtaaattaaaatcatccataataaaaatggcttaatactgtgaaccattgtttaaaaaaaagaaaagaaaagaaaagaaaaacaccacactttgagacaaattaagagtcctttatttaagccggcggccaagagagggattgacgctccaaaattctctcagccccaaagaaggggctcgatttaacttttatatcttggtttaggaagggggggtctagttaaaacaattttacagaagtaaagtaggcaaaagttaaaaggataaatggttacaggcaagtaaacagttctaggtgcaggggctttaagacaattacaaggtgataggcccggggcttggggcgttatcaatcagaggaattcctaggaattgtggatacagcttgccacagtatcttatcagttaattgcattcttggatgtgctgggagtcagcttgcagaagttaagtccttgaggaaggggctgccagtgaaagagccaagatagaatctgtctggttctcttagctaaggaagagtccattcagatggaaacaaggctaggtgattaaaggaaaaagggagagtctaaaaacatggttagtaaaaacgaggttgggcattacaatttaacatagtcccagacttcttggaggcttcgttcatattttttcttttttctttatctttgttggattgggttaatttgaagaccttgtcttcaagctctgaatttctttcttctacttgttgaattctattcctgagactttccagagcactttgcatttctataagtgtgtccagtgtttcctgaattttttattgttttttccttatgctgtctatttccatgaatatttctcccttcacttcttgtatcatttttggatttccttgcattgggctttgcctttctctggtgcctccctgatttgtttaataactaacctcctgaattctttttcaggtagatcagggacttcttggtttggatccattgttggtaaactagtgtgattttttgggggtgttaaagttttgtcatattaccagggttggttttctgattccttctcatttgggtaggctctgtcagagggaaggtctagggctgaaggctgttgttcagattctttttttcccatggggtgttcccttggtgtggtaatctccctctttgcctatggatgtggcttcctatgagcggaactgcagtgattgttgtctgtcttctgggtctggccacccagcaagttctatcaggctccaggctggtactcagggtggtctgcacagagtcctgtgatgtgaaccgtcaatgggtctctcagcgtggatatcagtgcctgttccggtagaggtggcagcggggtgcaatggactatgtgagggttcttagctttggtggtttaatgctctatttttgtgctggttggcctcctgacgggaggtggcactttccagaaagcattggctgtggtgggtgtggagaggaacctacggtgggcagggccctagaactcctaagagtatatgccctttgtcttcataccccacgctcatggatgggtagaatcaatattgtgaaaacgatcatacggccaaaagcaatctacaaattcaatgcaatccccatcaaaataccaccaccattcttcataggattagaaaaaacaattctaaaattcatacaaaaccaaaaaagagcccaggtagccaaagcaagactaagcaaaaagaacaaatctggagtcatcacattacctgttttcaaactatactataaagccacagtcaccaaaacagcataatactggtataaaaataggcacacagaccaatggaatagaatagagaacccagaaataagcccaaatatttacagccaactgatcttcgacaaagcaaacaaaaacataaagtggggaaaggacaccctcttcaataaatggtgttgggataactggctagccacatgtaggagaatgaaactggatcctcatctctcaacttacacaaaagtcaactcaagatggattaaagacttaaatctaagacctgaaactataaaaattatagaagataactttggagaaacccttctagatgttggcttaggcaaggatttcatgaccaggaacccaaaaacaaatgcaataaaaacaaagatagtcgggacttcaactaaagagcttttgcatggccaaaggaacagttatcagagtaaacagacaacccacagggtggcagaacatcttcacaatctatacatctgacaaagaactaatttccagaatctacaatgaactcaaacaaatcagtaagaaaaaaaaaacaaacaatcccatcaaaaagtgggctaaggacatgaatagagaattctcaaaagaagatatacaaatggccaagaaacatatgaaaaaatgctcaacatcattagtcatcaggaaaaggcaaatcaaaaccataatgcaataccatcttactcctgcaagaatggccataatcaaaaaatcaaaaaatcaaaaaatagtagatgttgccgtggatgcagtaaacagggaacacttctatgctgctggtgggaatgtaaactaatgcaatcactatggaaaacagtgtggagcttccttaaagaagtaaaatagaactaccatttgatccagcaatcccactactggttatctatgcagaggaaaagaagtgattatatgaaaaggatacttcacacgcatgtttatagcagcacagttcgcaattgcaaaactgtggaaacaatccaaatgcccatcagtcaatgagtgtacaaaggaactgtggtgcataaatatatatatatatatatatatatatatatatatatatatatatatatatgatggaatactactcagccataaaaaggaatgaattaatggcatttgcagtgacctggatgagattggagactactattctaagtgaagtaaatcaagaatggaaaaccaaacatcgtatgttctcactaatatgtgggagctaagctatgaggatgcaaaggtgtaagagtaatacaatggactgtgggtacttgaggggaaaagtaggaagggggtgagggataaaggactacaaataggatgcagttatgctgctctggtgatgggtgcaccaaaatctcacaagtcaccactaaagatcctacgcatgcaaccaaataccacctgttcgccaataacttatggaaaaataaaaaataaaaataaaaaagaaaattggaaattaaagctttaagtagagaggcgagacagtaggccagaagtcgctgtgcttaatggcagcagccctggccacctgcctgatttctagggcttatttgaggctgtgggctggggagacccgctgggctggctcaggggtctgcgtgggctggctccagtgcccagcctagaaccttcagggacttggcctacgcaaagcctggcctactagttttcatttagcgcatgtgaattcagagaaaccaggatcagaaaggttcctattaggtctgttatgattctgtccaagctcattagaatttaaatttttacctttaaacgcacgttatttttggctctgcattgcatttattattatattttatgcaaagaagcctggcctttatgaccgatcagtatttgtgatttttcacttttcatgcaattaaagcccattagaacacagccacgtggcacaggaaatgcactcatgtggctgaggaaggagaggagctgccgcattctttgtttctaattgtgctttatctgctaattgcgtttctacctgctccacaggaacggtgggaaacttacatcgaaaaatatatatctaaaggaatttagaactcctttaaaatctcaaatctgatgagaatctagggttttctttggtgcatgaacgtgtatacacaaaacatttaggaaaaagttatttaattccagaaaatagaacctttattatataaattatacaattaagtcttataacattcgttgaccttttagggaaaaaaaaaaactacctgcttttcatttctagcatcagatatttcacctttattttggtcttcatttcgtcatattccgtttgctaattcatctcttgctctgcaacagatgttcaaattatttgtgaaatagtagatctgagtcacaggcttttaatttttcatttcatgtgtgccatcgtgaagagggagagagagacaggatgagaataaatctgaggactgtgggaatctgcgatgccagttggaactcctgccaagaaggaaattgtcaagtgagagcaccaagccagaatctggagttctctttgaaagcatgtcttcctaggacacagcaaccgttcctacagccctgggaatttttacaccaccttttaatgcaaatgacactttttttttttttttgagacggagtctagctctgtcgcccaggctgcagtgcagtggcacaatcttggctcactgcaacctctgcctcctgggttcaagtgattctcctgcctcagcctcccaagtagctgggattataggtgcccaccaccacgcccagctaatttttgtatttttagtagagacagggtttcactgtgttggccaggctggtctcgaactcctgacctcatgatctgcccacctcggcctctcaaagtgctgggattacaagtgtgagccaccacgaccgacactttcaaggacagcttagcttgctgagttagtaacgttcacacaagcctcctcttgaacaggaaaataagactggcactcctgaggcactcttatcacacgagagacatggaataagttagagattcctcctccctgtcttgccttcgtctccttctgaggctcttctgttaataatgtagacttgcacttttaggcccgactcagaaatttcattaattagcacggtcatcaaagtagagctccactttgctgacagaaagggagaaagggctaaagagaatcgtgctgggtaacaggaaaataaggaacactgcacgattttccaccacagagacccaagcaagaatgttcgcagcagcagtgcttggaataacaaaagattggaaagaatcgacatgaggttctgtcaagttaacttgggaaaacagtgtttcaaaaacattaaattaggagctctcctgcatgacttctccaacttgtaacatttcagtgtgtgttgttgtcagaggtgtttgaaccagagtaactccatcttggataggggctgggtaaaataaggctgagacctactgggctgcattcccagatggttaggcattctaatgaggtaggaggtcagcacaagatacaggtcataaagaccttgctgataaaacagtttgcagtaaagaagctggccaaatcccatcaaaaccaagatggtgacaagagtgatctctgggtcatcctcactgctacactcccatcagcgccatgagtttacaaatcccatgacaatgtcaggaagttaccctatatggtcaaaaagaaaaggcatgaataatcctccccttgtttagcatatcatcacgaaattaccatgaaaatgggcaaccagcatcccttagggctgctctgcctatggagagccattctttattcctttacttaataaactttcactttactctatgggctcgcctctaattctttcttgcgcaagatccaatagccctctcttggggtctggattgggaccccttttcggtaacactgtcaccctccaagaagagaggctgagcatgctgagtggaccacgttttcctcctcctcttccttcttacatttaaaataacacccatttgcatctcccgtcactcatgctcaggagaatgtgctgtgagaagtgcagaatgagatgttcaggagaggttcaggggcctgcttcagtctccagacattccagcttccgagggggccctgcagggccaccagctccctcacgctcaccccactaggaattactctatttacagacaaaaatgcctgccagttggtatttgtcctttcctagaacataccataaatacaaagcaataaagaataacgtttttatgagtttaagtttttgtctggtctctaatccagcagaatagcatgtgatacaatctcatgactttcagagctatacaggagaaaactgctcatagcagtgtcgtgtgtttccaggcaaaactgaaaacatgaatacagcactggacacctggtcagtccttaacaaattactctccgttgctcaacttcaatgacaagaacaaatcaaacaaagaagctgggcagggctgctgctgactggtcacctgacggccaatggacagtgacttttaaagtttactttcttttattcttgggggagatcatatagtatttgagggtatagttggggaacaccacattaaaaaatcgcaattcttagcttctcttgaaaagtttcgagttccaggttcactaggccgtgggtggcagccgctccctccagacaagtcctcctggttctgggctggagagagtttgtctggcttggctcccggcagcctctgggattctgtttcttcctctctgcaaagaaaggtgcccagctccaatggctctctatcttccatgtggggacacctcttctgctgtcatatctgcacctgtgagcctgttccttcgtagacatgctagcggggagtccagtggacacagacacacatacatgggttgactcagctacgtgtaactggatatcagtttagccactaataccccctaaaaatgagctataaatccgagaaacagttcggatggtcttttttcccactggagaccacacttcttgcagacactaaagccctgctaaacacaatgcgggcccagtagaactcctgtagtggcgctcctggccagggtgggggtggagggaatggaaaggtagccagagaggctggttctggagcccctgcgcctgcagccctttccccagtccctgcaacaggaaggcctcatccttctacactgcaggtatcccagcagacgaaaagcaggcactctctggagagggctcagctgacagaggactgacagacgtcccagtgcacatgaagtaaagtctgaagcttgcccgcccccagctcgcgcccagctctgcctgtgaacacagatagctccacctctgtactcagaagtgtgtccagaattgatgggttcttggtcgcactgacttccagaacgaagccgtggaccctcacactgagtgttacagttcttaaagacaccgtgtccagactttgttccttctggtgttcggatgcgttcacagtttcttccttctggtgggttcgtggtctcgctggctcagcagtgaagctacagaccttcgtggtgagtgttacagctctcaaatcggcgcgtctggagttgttcgttcctcccggtgggttcgtggtctcactggcttcaggagtgaagctgcagaccttcgcagtgagtgttacaggtgataaaggcagtttggacccaaagagtgagcagcagcaacttattgcaaacattgaaagaacaaagcttccacacttgtggaagggaactgcgccgggttgccactgctggctcgggcagcccgcttttagtcttatttggccccacccacatcctgctgattggtccattttacagagagccgattggtctgttttacagagagctgattggtccgctttgacaggatgctgattggtgcatttacaatccctgagctagacacaaaagttctccacctcctcactagattagctagatacagagtgtccactggtgtatttacaaaccctgagctagacacagggtgttgattggtgtatttacaatcccttagctagacataaaggttctccaagtccccaccagactcaggagcccagctggcttcacccagtggatccggcaccgggccgcaggtggagctgcctgccagtcccctgctgggcacccacactccttagcccttgggtggtccatgggactgggcaccgtggagcagggggcggtgcacactggggaggctcccgcagcacaggagcccacggaagttggggaggctcaggcatggcgggctgcaggtccggagccctgccccgcgggaaggcagctaaggcctggtgagaaactgagcacagcagctactggcccacatgctaagcccctcactgcccgggccggcgggctggccggccgctctgagtgcggggccgctgagcccatgcccacccagaactcacgctggcccgcaagcaccaggcacagccccggttcctgctcacgcctctccctccacacctccctgcaagctaagggaacaggctccagccttggccagcccagaaaggggctcccacagtgcagcagcgggctgaagggctcctcaagcacagccagagtgggcaccaaggccgaggaggcgcccagagccagagagggctgtgagggctgccagcatgctgtcacctctcagaagcaggagaagtcccgcccaagagaaaacaaaaactatacacactgactttcggggatctcccaagaaatgctagatgattagatgatccacccgagtccatatagctgtgacagatgatgaaccttgaagatcttgttgcattttggtggggaactgtgggaatcgggcagggaatcactttcacccgcagcttaccaggacctatctacagggatgacaaaagcatcccctaacaggtggctggagacctgaggctcaccaagtgccccagtcatgaaatcacagaaaaaaactaccagaggccagtgcattgctctccctgcctggcaggtgcaaagtcagtggagagaagtagtatcacggtcgagcatgcggtgagaacaacgcccacggaaccgggggacacatggcaagggctgaagctgcaagttctgagcacgtcagcccctgcgcctcacccccaccttcctgttctccaaactgaaatgagcctccgggccttgtccccaaccacttccctgcatcctttaggcctcggcttgcaggccaggtgctcagagaggtattggccacgtccaccacacctccccacgtctttcctcggaggacttcctgttgtctgaaactgtccaccgcagctccccgtgtctttccttggagcacttcctgttgtctgacactgtccaccacagccccccacgtctttctttggagcccgagctgctcaccagaagggagcggagccaggatttggcttgtctccaggacttgtcttgacactgccgtgttcctagcactcagaacatgccggacacggggcgctccctctgtaaaatgtattaatccactgaatcaaagaatgactgaatgtacaccatggacagatagatatttctatggaaccactgttaccttaaaacataccaatttttattttgctgggaatgtttactttgctaggaaagtttactttgctaggaaactttgggggtttggaatcaactttcaaattgcagcttttgcatggaatctctttatctataataatagcaaattcacatgaagaagaatgaaaacagaatgatgttcctacaaacggaaaaattctgggccatcatgacaacgcacaaatagctgtcaaatgctaaatttctcatgaagccaagagaggccaaaactatccctgacctgtgattagtacaataaaggctgtgcctttgggcaacaatgggaacagagatgaagacttcaagccagacagtccagcagccccagcctaaggctatgttctcctgtaatttattactcaggatgaggaagctaaatcagggttgccctggttactatggggctcttccgaggaccctggcgacataattggtgttggcttggagactgaggctttcaattctgagattagagtgctggtaatagaggtggctaccccctcaagaagaaattcaaacaggctttggaaaaaatgagatagtctcaaaattaaggtcctcctccaaaatgtgccactgactgtcttaacctgtggtcctgacagattcagcaacaatacataattggctcattcaaataataattgccttttaaaaatagtaacaaacagaatcatgaaacgcttaaccagatgatgtcagctaactgaactaggttgtcacacacagagagagcagcgtctgctgtgaatatcctgctcagatcacccttcggcagacatttcccgagttactgccacagccccgtgctggacactcagaggaggaagaactctggggatagcggcttggaggactggctggagggggaatgacatgggatgtggcccaagaaacagattttccaaagagaaagggacagtaatacagagaacaggcaggaagagggagataggactggaatatagttcattaaaatggaattcagccaggggcccttctcaggcacccagaaccctcatggctctgccaccaggctgagaatagcaaacaaaggtgatcgggtcccagaaatctgaaacacgtttttgagcatctggggatctgtgccctgtgtttgcaggctggtcttaaaggcgcctggagtttacagggggcggtgagcaaggcaggaaaagcggaggagcggcctgcatatttagggtgcaagggtctgcgatgtcaccctcacacctacacccacagtccataagggtcatcaggctcatcagctgggtggtcgctgcaggccagaaagggctgggaggacaaagcacagaacagggatgcccacccctcctgctgtcatgaggctaaatctgcttcccccacacccagccgccaccagggagagaaggagaagacggaaggaaagaggataggaggggctgaataccttctggaaagagacaaagttaatcctggggagactgttttaaactggtaaagggggaaccactctgcagtggtaagagttgaattcaatttttctaaatcagtggccacagaagtaactcacttctacatgccaagtagaaatcagttacagaaaatgaagaacacatttctgcagttctgagccaagatatgagaattttaatcacaccacatataacagaagtcaacaggattgagactaaacatctctcataaacataagtagacaaaacttgccgatgagaaaaaaaaaagaaacttgaaaacatgatgctaagtgaaagatgccagacacaaaaggacaaacactgtgccgggcatggtggctcacacctgtaatcccaacactttgggaggctgaggcgggtggatcagtttgagaccagcctggccaacattgtgaaaccccgtctctactaaaaatacaaaaattagctgggcatggtggcgggcgcctgtaatcccagctactcaggaggctgaggcaggagaatcgcttgaactagagaggtggaggttgcagtgagccaagatcacgccactgcactctagcctgggcaacacagcaagactccgtctcaaacaaaaacaaaaacaaaaacaaaacaaaacaaaatactgtatgcttccacttacatgagtgacctagaatgggataaattcatagagacagaaagtagaatattggttatcaggggctggggaagcagagaaatgaaaagttattgtttgatgggtataaagtttctattagggatgatgaaaaagttctggaaatggatgttggtcatggtttcacacaatgtgaatgtacttaatgccactgaattgcacacttaacatggttaatttagtaaactttatactgtgtatattttaccataaccaaaaagaaaaaggactctcactttcataagtagaataatatactgtttaattattaatttagaagcccaatcaaaaaaggaaaaaaagtcaaaaggtacaaattatcagtgagataacagaccttgcacacagaggaacttaacatattagaaatgtacaaaaatattgtaaaatatttactaaataatactatgaactattttatgctcatgacttaaatgatgattcaaagcccaaatagatcacaaatgtaaaaaaatgcaaaaattgccaaataactatatccttagctatcatcagtctgacagtttaattggtgaatcttttcttttcttttttaaattaaaaaatttttattaggaacatttttgtccttggtaatacttccgaataaagaaatctatgaaaatgctatggaaaattaaattaaacaacatataaaatcacctgggcacctggaagatggtgaagaaatattttgtgacataaatataaaactgaactatcaatttttaaaaagctttagtgtttcgttaaaagtatgaaaaagaaatttaaaatatgcttaaataatcattagagatatattcagaaaggaaacttattaaatgtactacttttttcattctccatggtaaaactgagaatgagaatcttggtaaaggttaaaattttgaaataatagcgtatctggggacatcaactattccttacatcttgaacacacaatctttctatttacactgtaaacatgctcagttttgaacctaccaccccctatacctgacattatctttgctctatctttcaattcttaattgagcttatggaaagagacataccaatgtctctacctttttttccccaaacctttctcctcaaaccactactatctggtttctgcttccactacatcatatctgaaactaaaatgtcaaagcaatcacgttgccaaatgtgaaaaaggatttcccagaccttttgggagttggtatcattgcttcacatggcattactaacctgtcccttcttgtacttgttttctcctggctttggatatggcattctttctgccctgcatacttctctatcattcctgtttggtctcattagctagatccttttctctacttgctcctgtagtgcagactctgctcttctcattttatcctctttttctagacaatctcatccactcccatggtttcagttgctatctataaactatctttatctctatctcagaccactttggtgacttccagcatcatacagccatccaaccatctgtgagatttctccatgtggatatccaaagacacttcaaacttaacattaaaaaaaaaatctcacataccttcttctcccctcaaatcagctgttcctcctaaaatctctaccttggctgatggttcattatcaccctgtcaagacacctggatatcatactctcattcatttctaacttagtctcaaagtcccatgaattcaacctttcaactatttttaaaatctgtccattcccacttctcaccactattgccttaggttggatccttcataatctcttaggtggactatagcaatggcctcttagatgttcttggcgtttccaatcttatttcttccaatcaatcatttataatgttgccaaaatgatctttccaatacgtaaatctgatcacatttctcccaagctgaagtaatccctacagctcttaaataattagttgcttaaagaattcatttactcactcatttaacaaatattatttaccacataacgtatgattttaggcagagaggaaattatagtaaatgaaaatatttagagaatatgcagaaaggtagatattaaacaatcccctaaataaatgtatgattacaaatttgacaaatgcaatgaagaaaaataataagtcacaaaggaagaaaaagaggagacctactagagattgtgaagttatattatttttgagagaataatatctcggtaagtttaaaaaatgagtagaagtcgctcaacaaagaagtagttttggtagagggaacagcacgtacaagggatctgaaagggaaaggagattagagtgttaaaagaaatgaaggtaagcctatttggcaagagcttagtgaaggatgggatagtggcctgagacaagattattgacatagaaaccaagtcatgtagggtttgtaagccaaggtatggatttgggttcttttgaaaggctatgggaagcaattaaaaagttttaggcagatgaatcacatggttatatttacatcttaaagtttcactctggctgctggtagagaatagattatagcctgagtggatgtgagaagactagtaaagggattattccattagtctaggagagaaaaatggtggtgggcagtctctattaacttttagaagttatctttaggtaatgtgagcctgcaacgtgaagttcctagtactttaaaagttataatgctgatgaacaaaaaggtatgtaaaaactcaggatttaatctaattagatacattttccaccattagaacatttctgctcagagatcttattacaaagctacatttctgatagtctactacgatgcagcttctgccaaagccactcagtactaacctcttacacagcatctctacttacatgattaaaatgcatatcatacttgacatagtcaaaagataaagaaccacttgatttctacttccaagctactcaactccctagtaaatggccttaccatttaccctacccaggcactgatgtaaaaaatctgagagttaatcataatttttctcttcctctcatatcccatatcatatgtaaattaagtatcaacttaaattgaatataatattcaatgtaatgctatgaaaattattgtatgtgattaatgagaatataaatctggctataaaatctctgatagtgatatagtatttatatccatatatccttaggaaaaaattccctttaattatagagtagttataaacagtagtctaatatagtatgctatagttgtgttttgccttaattattcttcattgttaatacctctataataaacatataaaataaaacgcttaatttcttagtttgcaaattaatttaccaattcgttcattctttctttgtcaagaatggaaaaccttatagcaatacaggtcatctcaggtccataaagagtaatttaagatcagaaattcatgtcaggtccatgaggaataagttttcttttcttttctttcttttttttttttttgagacggagtctcactctgctgcccaggccggagtgagtggcgcaatcttggctcacagtaacctccgcctcccaggttcaagcgattctcccgcttcagcctcctgagtagctgggattacaggcgtgggccaccacgtctggctaatttttgtgtttactagtagagatggggtttcgccatgttgtccaggctggtctcgaacccctgacctcaggtgatctgcctgcctcagtctccaaaagtgctgggattacaggtgtgagccaccgctcctggccccataaggaataatttaagatcagaagtacaaagaaagttttctaattgattttaaaattagtttctgaatatttctctaagactatagtttaaattcgatctatttcacaccaaataagtactacagcaatatttaatttctgcgttactattgacatatgagtcatctaacatgtaaactttcagccaaccaaatattatggctttagtgctaatttaaaaaaaagtttttgaaaggaacatttgtaaaatatataaaggcattcatctgccttctttttttttttaaagagatggggggtctcattttttttaaagagatggggggtctcactctgtcacccacactggagtgcagtggtacaatcatagctcactggagccttgaactcctgggctcaagcaatcctcctgcctcagccttcttagtagctgggactacaggtatgcaccaccacacccgcctaattaaattgtttgtttgtttgtttgtttgtttaagagacagggtctcgctatattgaccaggctggtctcaaacttctgggctcaagcgatcctcctgccccagcttcccaagtagctgggattacaggcggtgtgccaccacgtccagctatctgcttttttaaatagaggaagtgaatatcatgttaagttattcttaaagacttaactaagattacttatcatactttgtcacaatatatttaaaatacttcattaaattctgaggtgagatagtaaaccatttgtgctaaccctaaatagcctttttagtttttgaatagtcttcctatctccaaccttttcagatgtcccttcatgtcagaatgtcttcctctgctaatccttctctgtgctgtatttgatctgctagtaataaagcttgataaacaagtaatctgtttatttcatcaggctctattcaaggcttggagattgactctataactttcccacattgaaaagtgcaagtggaagtgggagcttctgattgatagcttttgagcttacctccgggtttgtaactgtattctttagttaaagctatcaggaatttggctaccagataagtgagacataaaaccaagtatcattactaaagcaatctagtgatacagaatattactgtgtttaaataacttatcctacataaacaacaaggtagtgttaacctcacactcacaattctgcatgattttatgacagatatctaggatttaaaaaatggatatagcttatatccattataattttgttatactgagagagttcaaagttggcatcaagggtcaaaggtagaaattagcttacatagaaaataatttgtataggccaaacagaccttttgtatacaataccacctactgtaatttagtccacaaaatactgactataagaccataatcaaaatgaaatgctatgaaaggtgtgcgagagcttagtttatgcactgtaataaagctatggatggatgggcatagcgcatctcctgttgcacgcactctgttgctcatcaagttacatggatctgagctgtttgttaaccacagaagaaggtgaatcagtctgatgatgtgtgtggtgtccagatgcctcaacagactgcctttgttcactgtctggcgaagattaaaaaggagtagaatgagggctttctgtgggagatgatgtcaaatgagcctgagctgacattgtagaggatgtagatggctgaagaaactgttcagctggagtatctacttccattgcagtttcactcacttccaaatcaggacttgatgggaccataggaagagttgaaatatctgattgacttgttccacctctgggtcaagatcttcctcatcctctattgctttgtgcaacctcacttgcttcttcgaaccgtcttgataacatatcagacattctctgcatcaatgacacattgggactctgctctccatgtcattctcgttcactctcaggccttgatctgggtccagtatctgaccaatcaccacgaaggctcaaacgcttaactggtggttgtcgtaactcttctcttctctcttccgcagaaggagttttaagttctcgtgctgtatcatctttcgggtcaaaaagatatatgtaatctgaagagtaactaatgagaatctcttgaccatcttcactgtaacacagaaatgtcactctgcaggacttattattaagatgggaagcaataaaatgggcaaccattccagtagtccctcgacctgcataattccctgtagctcttgtgcccagcattcgcctatcatatatttgtactgagctataagaacaaccaacggcaaggtaatatggtattggtgggcaaatagcaacagatgtggcagcacgtcgacagctaattaaaatatcatcttcacaatcttcttttgtgcagctagttttgatgcgtgtatcaaaccacctaccagttctatcttcaccacaagagagaaaagtgtaagggtcattgggtacagtcataatctcataagtagttccattgtggcaagtaaattggcattgtctgttggtttctgcatcttgctcaacattggtataaaatattactccatctccagagcaggatacaatctgtttatcatttgtgcaaggtaagaactttgcattagatatgtttgcttggtgccccgaacgaattgttgtcaaaacctttctgctgtagggattactaattactaatttggtgtcatctgagccagataaaatatattctccagtgtcattccaacagattgtattaacacagccatcatgcacatttagggttgcttgaagtttcaatctttagataaattctcttcttcccaggtagtggccccacagccaggacaggtcctccagcccgagggaccttttcctcatgtcccacaacagatgtgggcaggagccaccccgagacatggctctgcctgagcgaggtgggaggggagaccctacctgaatcttttcaaagtgtcataaaacagatagttctatagtcttgatatcattatagaacatttaaaaaaataaggaaagcttctgttttccaaaagcacttaataatgattggtcctgtttacaggttgtgatattttgtatactccttcttttacctttttttgctgtaagatatctgcgtggttgccttctattgtcttttcatcttgcttgtccttaacatgaaagtcctggccacaccttagcttttctttgctaccttaaagagagtctctaaacatgtgaaaattaaacaccacagttctaaataattcatggatcaaagagaaagcctcaaagaaaaaatcaagagaactgaatggacacaaaacatatcaaaatatgtggagtgcagctaaagcaatactgagagggaaatttatagcactagatgcttacataagaaacaaggaaagctcttaaaacagtaagctaattcctacctcaggaaactagataaagaagagcggctgggcgtgttagctcacgcctgtaaacccagcactttgggaggccaaggtgggtggatcacgaggtcaggaattcaagaccagcatggccaagatggtgaaaccctgtctctaccaaaaatacaaacattagctgggcatggtggcgggtgcctgtaataccagctacttgggaggctgaggcaaaaaactgcttgaacccgtgaggcagaggttgcagtgagccgagattgagccactgcactccagcctgggcgacagagtgagactccatctcaaaaaaaacaaaacaaaacaaaaaaaaacccaaagcaaacagaagaaaagaaatcataaagacaaaagtacaaatcaatgaaataaaaaacagaaaaacaattgatatgaaaacttttaacaggagttggtactttaataagatcaacaacactgacagaagtttagcaagaaaaatgctagaaaacaaaaattatcaatatctggaatgaaacaaaaatataactacagaccctgcagacatccaaaggataataaaggagtaatatgaacaactcttcacaagtaaatttcacaacttagataaaatgcatcaattccttgaaaaacacaaactaccataattcacataatatgaaacagataatttgaatagccctgtaaccattaaggaaattgggaagccaggcacaatggctcattcctgtaatcctagcacttttggaggctgagatgggaggatcgctggattccaggagttcaagaccagcctgggcaacatagtgagacttctctctataaaacataaaaaaaaaaagtagccaggcattatggcatgcacctgtagtcctacctactcaggaggctgaggcaggaggattgcttgagctcaggagttcaaggttgcattgagctatgattgtgccactgcactctactctgggtgacagagcaagatcctgtctcaaaaatttaaaataaaaaaagagaaattgaattcatagcattaaaattctccaaaataaaacctccaggcctagatagtttcactggagaattctaccaaatgcctaaagaataattaacatcaattctacataatcccttccagaaactagaagtgaagacttcacaacacattttctgaagctagtattactctgatactgaaaccagacaaagatagttgaaataaaaaaaagaaggaaggaaggaaggaaagaagggaggaaaaaagaaaagaaaaacaaccataaaccaatacctctcgtgaacttagagcaaaaaatccacaataaaatatgtacaaaccaaatccaacaatgtgtaaagattactacatgccatggccaagtgatatttgttttaggtatataaaactgattaacatttgaaaatcaatgaaatccaccagatcaacaagccaaagaagaaaaattacatgattatattaattgacaaggaagaagcttttgacaaaatgaaatgtgttttgcccattttctaattggcttgtttttcactgttgaattttgaaagttcttcatatattttagatactagtcctttggcatacatgtggctcactaatattttctccctgtctgtagcttgtcttttcaacctcttcaggtggattttcggagacctggtttttaatttttcttaacattttccttttataggtgatgattttggagtcaagtctcagaattctttgcctagcactagataccaacattttttctcctatgttttttctaaaagttttgtagttttgcattttatatttaatcccattaggttggtttttataaaagggatgaggtttaggttgaggttcactgttttgcctatgattgatgagcacatgaaaagatgcttggaatcattagtaatcagggaaatgcaattcaaaaccatcatgagatactactttgtacccactaggatggcttaaaacaaagtcagaaaagaaacgttggcaaggatgtagagaaactggaaccctcacgcgttgctgctggaaatgtacaatggtgcagctgctccgtaaaatggtctggcactttcttaaatgattcaactagagttaccaagtaacctggcaattctattccgaggtattaggttgacgcaaaagcaattgtggtttttgccattaaaagtgatatacccaagagaaatgaaaatatatgcacataaaaacttgtatataaatgtttatagcagcactgttcataatagccaaaaggtggaaacaacccaaatgtccactgatggatgagcggataaacaaaatgtgcttaatccacactatggaatattattcagacataaaaaagaatgaagtactgatacatgctgcaatatgtatgaaccttgaaaacattatgctaagaaagaagccagtcataaaagactacatattatgtgattccattcatatgaaagtccagaacagggaaatttataaagacagaaagtagactagtggtagcccagggatgggggcaaggaaggagagtgagagctaaaggtacagggttgctttttaaggtgaaattgacttcaatgatgtttacatacatctgtggatatattagaaaccactgaatattataccttaaatgggtgaattatatgatacatgagtgtattagtctggagctaggcgcggtagctcacgcctgtaatcccagcactttgggaggccgaggtgggcagatcacaaggtcagaagattgagaccatcctggctaacacagtgaaatcccatctctactaaaaaaaaatacaaaaaattattcagcttggtgggacgtgcctgtagtcccagctactcgggaggctgaggcaggagaatcgcttgaacctggaaggcggaggttgcaatgagccaagatcatgccactgcagtccagcctgggtgacagagtgagactccatctcagaaaaaaaaaaagaggtttaattggctcacagttccacaggctatacaagaagcatggcagcatctgctgccggggaggcctcagggagcttccaatcatggcagaaggtgaagggaagcaggcacgtcttacatggccagagcaggagccagacagagaggagcgaggtgctacacacttttaaacaactagatctcatgagaattcactatcatgatgacagctccaagaagcatggtgttaaaccatgagaaaccaccccatgatccaatcacctcccaccaggccccatctccaacactggggattacaattgaatatgagattcgggtggggacatatatccaaaccacatcaatgacttacatgtcaataaagagatataaaattgttttgttttttgaaaaaaatctaatattttaataagccactctctcaagccaatacaaggcagctccagcacacccctgcttcaggagatgtttatgccacatgaagggaggaaaccataatcctttccacatccctcaggtagacgtggaaataaggataaggtgaaaattacaaaaaccaagctcatcatgcctccttcccttgccaccaaatgcttgtatttctttttaacacctgttccccgggttgtataaaaagtcctttgctaattacttttaggaaaagggcgacattctggccttcacctcccagaaaccacgcatcatacttgaggcacacaccagggaagaggctgaggtcaagttcaccaatcagaaacacaaacagacaaggaaaaagaaggcagcaatcagtttccatcaaagccctcagccaggtgtcagatctcccagggacacccctctttaatttgggggggacataggtaaatatgtgtatccagaaagcctggagcaagtcgagagaggcatttgattagtatgcagatcacaggcacagctgggatcagggctaaccagactttcaaggataaacagctgacaaggatatgtcatgttgtccctgcagtgtgttgaatctaattaaaaaggacttagggtcagaaaaacactggtgtaataatgggtaagcacaacagaaatcattttattgtttacttacaggaaacaatacttttcccgtttacatgcttgacgtggccagcaaggaagagctcacacttcgtacaaaactacacactagttttgcatctctttgttgtgacacacaacctctggtttagattctttaaaattatctgtatgggacagtttctctcattattcaaagaatgacttttccccaaaataaataagatatattccttccctccgctgtcgggtgtttctcatgctctcctcttttaattgtcagtataattctagagtaaaagtcctatgtgctatggtttgaataagctccccaaaaagcatgtgttgaaaacttaatgtttggctggacatggtggctcacgcctgtaatcccaacactttgggaggccgaggcgggcggatcacctgaggtcgggagttcgagaccagcctgaccaacatgtagaaaccctgtctctactaaaaatacaaaaaattagctgggcgtggaggcacatgcctgtaatcccagatactcaggaggccgaggcaggagaatcgcttgaacccgggaggcggaggttgcagtgagcagagattgcaccattcactccagcctgagcgacagagcgagactccgtctcagaaaaaaaaaaaaaaagaaagaaagaaaaggaaaacttaatcctcaatgcaacagcgttgggaggcgggggcctatgggaggtgctttggtcagcagggctccaccatcaggaatggattaatgctgattataaaagggcttgaggctgtgagttcaatatcttgctctttctttggccctctcttgccctttcaccttctgccatgggatattgcagcaaaaaggcccaggctagatgctggcccctcaatcttggacttcccagcctcccaaaatgtgagaaataaattacccagtctgtggtattctgctatagcagcacacaacagactaagatgcactgtcaagccaaaatataatgatttgtgaacggctaacagcacaggttggaatctgatgccagctaactcccaaggtctcagattccctacctgtctcccatgcatagttgtcagaagtaaatgaatgaacgtacagaatgtgctcaagcagtgccctgcacacagcaagggctcaggaaagttagcgaccatcatatcatcatcatcatcatgatcatcatgcagtcagtattaggtttgtataaaaatatcaaagagcacattttaagcttatgtccaaacatatactaaaatgtgttaaatacgtatcttttatgtaattttccacctaaatttctagtttctgtgacaatgctaagtaggaaaaatattttaattcattcaatgctatcataatgaagattttgtttgttttctttataatgaaattagtgcctgactatatctaaatttacagaagaaaaagaacgtatattcactgaggtcaggcctgcgatagcaaaacagaggggatgggctaaccgcttctcagcaggggtaaagtactctctgctgcctttcaaagatgaagcagccccctagatatacagcaatgtatgaaatggaactttgagtagggaaaacattgcagacaaatgcatacagtataagcatatttgcttaaaaataaaactatacagttggatgactgtgtacatatacatgtacataaatatatatgtgcatacacaaaaatggatacatcataaagcaattgcctgtgtggtagggagtaggaggcagagagaggagggagactttgttttgctccagtttgtgtacttcttgcatcttttacaatgagaatctattactatttcatttcatatttaaaaagaaagggaaaatagttctattcatttaaaaccaaatattcatcaagccatataatgcattatattacattaaattgcatttcaaaagcatcctctgttatgctttcatttaaaaatacagtaagaaaagtatgatgggaaatcccaaacttctgcagaatgaattgaaataactgagtcattaaaaatcagtttatttcccagtgctttgggaggctaaggccggaggatcagttgaggccaggagttcaagactagcctatgcaatacagtgagacccccccccaccaccacccttacaaaaaattaaaaaattagctgggtgtggtggtgcatacctgtagtgccagctgcctggaagagtgaggtgggaggatcacttgagcccaggagtatgaagctacagtgagctatgattgcaccactgcactccagcctgggcaataggtgagaccctggaccctgtctctaaaaaattgttttatttgtatttttatgatttatttatttgaagacatgttctcactttgacacccaggctggagtgcagtggcacgatcttggctcactgcaacctccactgcaccccctgcgtccccctgcccccggttcaagtagctgggattacaggtgcatgccaccattcacacttaatttttgtattttttggtagagatgggatttcaccaggttgtccaggctggtctcgaactcttgacctcaagtaatctgtctgccttggcctcccaaagtgctgggattacaggcgtgagccactgcacctggccaaaagaattttttaaattaaaaaacgtgtatattttttaaaaatccattttttaaataaagttttgttgctgtcatattttaatgtgcatggagcctcaaattaaaacataatgaggcattttaaggggcatttgaaaatcaataatgctcttttctaattaatttaagtgaaacagcatgtttgcttgaaatcccaaaatgcctttttaatttcctaaggggctcttcagacaggaacagttgggaggcactcagtggttcactcacatgctcccctccaggaatggtgccaggccctggatgtgggacaaggcgcagcacagacatggccttctcccttgtgctgctttgccatgtagcgaatgatggggaaatgtcagggcttggagaaaaagagacagaatgctcagagaaccgcagagctggggagccccttggacgagggctgagggaaggcccttgcatcgatgtcccaccgactctggaatctagaggtccagaaggagccacctagagaccagctgggaggaagaacagctgtggtgcagcgtgcaggggcagcctgaagtagaaagaccctgagattctagcacagctggcaaggcagggacgtggtgcccaggagtaccactgcaggctagcgaagctggaggagccagatgaaagcaggcactcacacgccacggcgaggatgctggacagcgctccgagtccagtgggaagcacgtggctgagtttatgttgtaagaagctctctcgccatgaacacacacacacagacacacaaatatgtgaatacattttgatcacaacaagctgggaatccatgttttgttgtatttaacaaaaacccacaaaatacatccaaaaactattcctatacaaagttacagaaaattttagtggattgtaaaaagtagaaattaggggccacatgttctcatgcaatgacgttagaaattaacagtaaaaggaaagcaaaaaaccaaaaagtctaactacctaaaaagttaaggacatcaatctgagcgatgattaggttaaagagaaaagcaaaaatgaaaattacaaaccaagtggaactaagtccacaagagcactgtgtatcaacaatgccaatctatacagtattattactgttactcaactataaaagggggaaaattaacaatatgtgaattaagaaagtagaaggggttaataaaataaaaacatacatagtcaacccttccctcaaattccccatttcctcccgagacccccggctctagggaactattaatctactttgaatctctaaagatttgctaaaatgtttatttttgaactgtaaaagaatattatctgtagctttataacaataaattggaaaaaacagatgaaatatacaatgttcgaaagacattaacaaaaatgatccccaaaaagaaagaaaacacgaataacataatgaacatgggaaaatacgttaaaagtagtcaaattacctcccccaaattaaaataaacctagataattcccaggttatataaactgtttcagagcataagtcaaatcaaattcttccactttcattttaaagtatgcataattctaagatgaaactggacaaggagggcacctcaaggtaaactgtaggttatctcatttctgaatgttgatgcaaaactcttaaataatatattaacaaagtgaatgcagcctaatgtataccttctcagcaccaggaccattgcctatttctgcaatgcaaaagtgattctgcattaggaaatccattaatgcaaatcactacattaataaactaaaggaggaaagccatatgatcatcttcagagatgttaaaaggatggtgataaaatttacatgcatcttgattaaaaaaaatcttagaaagccaggatggaagcgaatacctcccattaataaaggcatctctcagaagctgatggcagacattactctacatggtaacccattaggagcaatcctgtgaaagccaggaataaaacaagggtgttaaaaaattccagtgttagtcaacctttttccctgtaaatcctcactgtgagtgaagggtcacatcgggtctgggctgacgcatgtgcgccaggaaaaatgacccaaaagttctgtcctctcaggtcactgcttccttttctcggacactgcagcgttgagatggatatggaaggctgtggtcatctcatgtgctgggaaggacgcctggatcagggaagcagcgtggtggcctgcaggccttgggcctccgtgaagacaaaagtgttataaaaacaactgatggaaaagtgaactgtggcttctcagtgagagtctcccccacgcaggcagtgaacaccgcatgtgggtgagagggaaatggagctgcgggacctcccagtgatgtgaagatgctgtccctgctgtgtctcctgtcctgtgtcctatgaagctcagcaaatggggagatttgctaatagaaaccatctctcagcagcatgcttggtggtgggtcactaagagcttctcattaaattcaggagcaagaggtggatgatgaaataccatcatctaatgttattttaacaaaacatcattatccaatgttatttgaacagttttagccacagcaactacacagaaaagcaaaacaagatgtacagatactggaaagcagaagaaaatgtaatcatttcctctgacaaactatgggatcaaagattcaggtgtacattcaactgcttgtacagttcaatgcaagtaataaaaaactgcaaaaagtcttacatgcggcgagtagcctcttcagtataaaataataactaaaacaggcatccaccagagcaagaaaatatttacaatacctaggactaaatttgaaacatggaaagttcatatgtatattttagaaaactataaaagtgtagtaacatttataacaaaataaatcctagatcgataaaacacataaatatttaaaaaataaaacccgaaaatactgaggggatagtagaaaattatttataatcttggagtgggaaaggcttttctaggaaaaacacataacccagcaatcaaaagggttaaaatacgtaaatgaataaaaccaatgtgagtacagaaaatacccacacaaagaatgccattcaaaaagtcaaaagatgcataacaaactattaaaaatatatgtttgcaaccaatataacaatagccagtttccttaacataaggaagtatatatatgtatataatatatataatatgtaaattataaaaacaacaatataacagtaaaataggtaacaaacgtgaagtggcagttaacagataaagaaatataagcaacttataaacaaatataaagatgctcaacttcacttttaattaaagaaatgaaaattacataataaaattgtacaattttgtcagattggtgaagacaaaaacaattctgacaacacacaagtttggatctgggtaaccaggcacaggctcagactgctggcaaaggtgtgaaggggtgccttgtgtttggagagcaatttaggaataagattctaaatttaaagtgcactcatgctctgactgcagggacggtcttagtgatttttttctctagatctgtttgcattccttccttgttcactgctacacccccagcacctaggccagttccccaagcagcagcaatagccactcagtatctgttgagtaatgaatatgtacaaagaatactattcaatcgggcacagtggcttacgcctgtaaacccagcactttgggaggccaaggcaggtagatagtttgagttcaggagtttgagaccagcctggccaacacggtgaaactctctacaaaaaatacaaaaaaagttagctggttgtggtggcacatgcctgtagtcccagctaattgggaggctgtgacgggaggatcacctgagcccagggaggttgaggctgcagtgagccgtgatggcaccactgcactccagcctaagcaacagagtgaaaccctgtttccaaaaaaaaaaaaaaaaaaaaggctgggcgcagtggctcatgcctgtaataccagcactctgggaggctgaggcaggtggatcgcctgaggtcaggagtttgagaccagcctggccaacatagtgaaactccatctctacaaaaaaataccaaaaaaatgtatctgggcatggtggcgggcgcctgtaatcccagctactcaggaggctgaggcaggagaatcgcttgaacccaggaggtggaggttgcagtgagctgagattgcgccattgcactcctccagcctgggcaacaagagcaaaactccatctcaaaaaaaaaaaattatttgcatgttcattttagcaaaagactagaaacatcttttaacttatccttcattaaggggtggttatatgaattatcacacatccatccagtggaattatccgctactccctgtttaacagcagagaagacctccaagtgctgatgtgaaaatgtcccaggctacatggttgactacaaaatccatgttgagtagcccacgtgtgtaaaaaaaaatccataaacaaaaatatgtgcagatgatgactggaaaggcacacacacacacacacacacacacacacacacacacacacgcaaaaccctgtagcaggaaggggaggtgctaggagcccagaataaaagattgactttagtttagatatcctttttatgcagagaacactagctagtcttaaattatgcagagaaaaaaacacaatcaccacacaaacatatggaaatgtagtaggtatcctaaagaaaaacaaaaactggagtgaagaagttgaaaagaatttggataaatcaaagcatacactgtatgttctggaatggaaagacatggtattgtttagatgttttaattttccctcaaagtaatctacaaatttaatatgatgccaattcaaatctcaaatccattctttccaagtcttggcaaaagaaaatcaaagtgcatctagaagactaaacatttaaaaccaggcaagaacattttaaagaaatagattaaaagtccgggatggggtaagcggtagaacttgtcctaccatgtataaaaatagattataaagtcaaggtaatttaagtggtattgctctggaatatgaataaacagacatatgaatgttgaatgaatatgaataaaaagtccagaaatagacaaatgggcactactatctgtgtgcgcatgtgtgcatgcaatgataacactggcagagttgatattggttgtttcttcaccacccagcatacatgtccagcttccctcccccaaccctgcttaatagcagccaactttgtttccggtatgtctgtaaaaaaaaagtagcccatgtgtgactgaattcagtctggtaggacaggtaagcaaattatcatcctcctgtatccaattaaacactccctcccagctctttgactctaatgcaaacagacccagaggtaaagaaccataggaattgtccactcctgcagaactgcaccctggcaagttcagggttcccactgtaggccccagtctcagtcagatttctgagccaacagaagaagcttccttagaaccagccagttttcaagcctgatctctagcctccttgatgattcaataggccccactatcctcacaataaatggcccgtggctttcttagtaattgtaacttgctgcaaatgatttttaatgatctgggtgacatttcaaatcagcagggaaatactagagtattcagaaaatggtttcaggtaaactactaaactgtttagagagaaaaagttcaattcatcgagtagactgtaaaatactaaagagttaactatattaaaaaaaagcacaccataaccaggaagttattggggtagcataatcttggaaaggagacaatctttttaagcatgattctaaggtaagattacaaagagaaacattggtaaatttgaatatataaaaattaaaaagttttctacttttctgacaaaaattaaaaggcaaataacaatccagggaatatatttgcccaatataagtcaaaggattcaaaactataatatataaagagctcttataaatcattgataaatatttaaatctataactgagtacagaacacatacagacaaaacagagaagaaaataaaatataaatggtgcataaacatgaatatatgacataattacacatatatgtataaatacatataagcttatgtatatgcaattataaatgactaaaaagtttaatcttactagtactcaaagaaattcaaattaaacaatgaaatcatcttatatctttcaaattagcatggattaaaaagaataacaactttcagtgctggcaaaggtgtaggggaagagcattatcatatattgggaatataaatgggtaaacttccctaaaaggcactatgtcaatatgcaccaaatactctaaagatacattcatttttatcatgtatatctaattttaggagctgtaaaaaggattcaatttgtataagaataatggccatctctctaattgcaaaaagcagagatatggttaaataaacaatgttacattcatacatatagagtagtcactaccaataaagttgtagaatattttaaaacatggaacaggccgggcgtggtggctcatgcctgtaatcccaccaaggcaggcggatcacctgaggtcaggagttcgagaccagtctggccaacatagtgaaaccttgtctctactacagtataaaagttagctgggcgtggtggcccatgcctatagtcccagctacttgggaggctgaggcagaagaatcgcttgaacccaggaggtagaggttgcagtgagctgagattgtgccactgcacaccagcctgggtgactgagcaagacttcatctcaaaaaataaataaataaaacatggaacaatgtgatcagttaaaaaagaaatcacaaggcagcatgaagtggatagcacatttaaatacattaaatatatatgtatacatacatgcatgcatacccatacatccatatacacacacattatgcacagaaaagactggaaggacataatcaactgggtggtaggactgtgaagtgttttgttttttgaatttctatagtaaatgtataatttttatatatgaaattttgttttttgaatttctatagtaaatgtataatttttatatatgaaattttatatatgaaaggagcataccttttatgtgttgtataggttttgcaatattctatgaagaactcagggtaggtcatgtccacactgaacaggtgtattagtccattcttgcattgctagaatgaaatatctgagactgggtaatttataaagaggtttaactggctcatgcaggctgtacaggaagcatgatgccagcatctgcttgacttctggggaggcttcaggaaacttacaatcatggtggaaagtgaagggggagccagaaagtcacgtggccagagcaggagccagagagaaagcaaggaagggaggtgccacacactttaaacaaccagctctcgtgagaactcactccctcactatcatgagggcagcaccgagggaatggtgctaaccactcatgagaatctgcccccatgatccaatcacctcccagcagtctccacctccaacgctcgggattgcaactgaacatgagatttgggcagggacacaaatccaaaccatatcaataggaaagggaagcaaggccgagaaacagtgagtgacttgtcctaagtcacataaccaggaggtggtgaagcatggctttgatcctggattgctgactccaaatccagtactgtttgtgctgcacacattgcccccaagcaaatgaacacactggtttgtagctctgagatttctggccttgtatgagccaaggcagagggacacctaggatcaagttctaaagtgagggaaatattgatgattctgtggtaccatcaaccaaacagatgtatgtgagagtacatatctgtggtacatgatgttctttttatgtatccgtggaggtatagaaagcggtaagaaatagaggagaccaaatctccctttcctatacttccatgcagtctgcgatgtgggaaaacggtctgagattaagaccaggaggggtcagcccttcaagcttgggcaatgtgtgtgggctttctttttggtgtgaacctccagacactgagtttcccttcacccaatcactctgtctcccccacacagagccctgcactggaaaatgagagtctaagaaaaaaatggccagttccttgtaggtcaccagattttgctatactcatagcacctagtatttaggaataaaaaggctggccaagttatgaatacaagatggcaagttatcctttcagatggagatggggatccaggttgtgtcaattgtcaatcttaagggggtctacaccataccgagaatacttctgtgcacatcatatagggatgaaatctgatcaatgttctctaggccacattcaacagacaataacaagatgaagccccaacaattcatttttgtaactcagtgggcagcttcagcatcgaaactgtgccagcgacactggtcctgctggccttcgtagataagaatgcagagagcagcaggctttccagtggctgcccctgtgaatccaaacaacatggtcccaagccaagcaggcatggtcccacagcagaaaagcttctggtaattcagcaatcacttctcagaatcatagccacaggtagagcaggcagagggcaactgtggagggacatggctctgaaaggtagcctgctattgcttccaagacaaagaaacgaaggcccatgtccccatacccagggaaccacagtcctatcaggagtttaagtatattcataccagaatgcaaccaaacacactgcaatttctgtcacagccagatgtacctattacagtaccatgagctaagttattttgaaatgatcgttctatccaacaaacaagttgttgatcttctacaacaagctcgtccaacccaccacgctgcatgcagcccaggacggcttcgaatgaggcccaacacaaattcgtaaacttccttaaaacattatgagatattttttgtgacttatttttttttagctcatcagctgtcgctaatattagtgtattttatatgtggcccaagacaattcttctaacgtggcccgaggaagccaaaagactgaatacctctgttctacaatgtacacagcacactgtctacaattttctgaatgtggcccaacacaaattcgtaaactttcttaaaacattatgagttttttttgtgactttttttttttttttttttagctcatcagctatcgctagttttagtgtattttatgtgtggcccaagacaatgcttcttctaacgtggcccaaggaagccaaaagattgaatacctctgttctacaatgtacatagcacactgtctacaattttcctggatctgaaagaaaattctttttaattgagaaatgctaactatattgttttgatatattcgtcatccagcataatatgtacatcagcacttaaaactgacttgcaaactgatttttaaaaattcaatacaaataagaatcaatgcaacaaatgctaaaatataatagttactaaggatatttattccaaaatagcactacgttgtgatccttaaaaatatactactagtagctgatttacaagaagaaaaagttttaattgttctacttataaatcagtaagtgaattgttatctaacttatagaaataaatcagcttaacctaaataccctaaactagaaaacatcagaatgaattgaaagtgtacatgagaacctaagaatacagtaaaattatttttaaaattgctcttgtacaaaatcaaatcctatgacctttatgaaagggtttgcatttcattacttaccaactggcagccttctagggagttgactagctgagcattctgacaagagagaattgaaccagccaaattcagcattacacacactgcagaaagcagcatgaaaaaggttatctggaaacaaaccaaacataaaattgattattcacttggagaggctcaaaggaaaaatgacatggctttacaacagctttcatttattatacaacagttgatcacataattacatgaataacatgtatgtgttttaaaggaaagtggtaggttatttctcaaacttccaaattcatatgatctgaaatagaaaaagtaagatctgtaggaagccatagcaagctaccatgattttgtttaaaacctatgatgataaaatatttaaggagttaaacttgaaagactgtgcattatatactcttaacagtgacaagttacacattattaaaggaaatcaagtgaaagaagtatatttattagaaggcctttaggtttaatttttattacagaaaatttcatacacatgcaaaaccaaagaaaacagcataatgaaggcacatgtgtccatcacccaacatcaataattaatccacttacggccaactgtgtttcatttacagcccctaccatctgaattattgtgcaaccaataccaggcatcatataattttacccttaaatctttctaaaggaattgagaagctttctgaaaacatagccaaaatagtcatcatatctataataaataaaaattcattaatatcatcagatactgagttcacatttccctaattgtctaaattttttcacactttgaatcaggccacacaggatacaaagcaggtccatgtggtacaactggctgttaggaatcttagacagtctatgggtttcccatccactttttcctctgtgaaatttactgaagaaaccagttcatttgtcctaaagagtttcttacagtctaaactttctgattgtagtcctctatcattaaacatttctctagcctctgtatttcttgtaatttggtgattaaatacagaggtttggccaaattcagatcaataaaaggcaaatattgtctctctctcttttttttttttttgtgatggagtctcactctgtcgctggagtgcagtggcacaatctcggctcattgcaacctctgcctcccgggttcaagcgattatcttgcctcagcctcctgagtagctgggactacaggtgcgcacaaccacacccagctaatttttgtatttttagtagagacggggtttcaccatgttggccaggacggtctcgatctcttgacctcatgatctgccctccttggcctcccaaagtgctgggattacaggcatgagccaccacgcccggccaatattgtctctctttttgtgatgttagcggccatttttaatgatgacagactcattaatttattagggtttccaaaatagtgctagtctcactctgtcattttttctttatgaataagaatacatatagagacacagacttttcctcatcaactgttttgttaccctgaggtatagttcatatatgaaaagcaggatatatacttgactctttctgttcattttccaggctttaaaataattttaaattttgcaaaatgaactcaaggaagtctgtatgcttaattagcactctttctgcacctatgtaaataattaggccaaatctaatgaagaaagaccctttttgtgatggagaataacctttaagattaatctgatcaagaggcggggagactggcattaaaacttgttaaagagcaaaaaaaaaaaaaaaaaaaaaaaaaaaaattcactggatattctgtctaatgcacacttcagggttatttctgcctttcaatgtctttatgctatttcaaaactctgcataaaactgataaaactgatagtttatcaactgatagttgtataaaactgatagtagtgcaaatgattcttgacgatacaaatgtaaaggaattttgtccagtagaacgtaactgattattgccccactgatattggccacttttacatttatttgtaaatttatttcagcattcctgattgcttatatgtgtgcagtgtttgaattaacctttgaactgcttgtaacatcttactgatttcctcattaaataatgagttagacatagtctttgacacatgtctatttttttaaaaagctgattcccggccaggcgcagtggctcatgcctgtaatcccagcactttgggaggccaaggtgggtggatcatgagatcaggagttcgagaccagcctgaccaacatggtgaaagcccatctctactaaaaatataaaaattagccgggcatggtgctgcgcgcctgtaatcccagctactcaggagcctgaggcaggagaattgcttgaacccaggaggtggaggttgcagtgagccgagatctccagcctgggtaacaaagcgagactccgtcaaaacaaacaaacaaacaaaccaacaaacaaaaacctggttccctagcatcctccaaaattaacaatatcatgaaatagtattttgtctgtttggtggagaggggagtgagtttgagtcattatgagccaagaacttaaacacatttgatagttttaatcatctgcatcattagacagagtccactcaagttgacacctgggtcctttcaacacaactccagtagaccttgacagctatctggctttctgtatgagaagatagtacaggatcatcttacagttttctacccaagagacctataatcagccatttctccagtaagtccaggttccattcaatgagaatggtattcagataccataatttttgtgctacaggtgctgtttgctacttggagcttcattgttttcagttgtcagacatatcatgagttcacaattatgtttctgatttaaattcaacactactaagttttcacaatgagataccatctcacaccaggctattactaaaaagtaaaaaataacatgttagcaaggatgtggagaaaagggaacacttatacactgttggtggaaatgtaaattagttcagccactgtggaaagcaatgtggagatttctcaaataactaaaagcagaacgaccattcgacccagcaatcccattactaggtatatacccaaaggaaaatacattgttttgccaaaaaataaaaaaccccaccttcacccatatgttcaccacagcattattcacaatagcaaagtcatagaaccaacccaggtgcccatcaatagtggcttggataaggaaaattccatggtacatatacaccatggaatactacgcaaccataaaaaagaacacaatcatggccaggcgcggtggctcatgcctgtaatcccagcactttggggggtcgaggcgggcggatcaaaaggtcaggagattgagaccatcctggctaacacggtgaaaccctgtctctactaaaaatacaaaaagttagccaggcatggtggtgggcgcctgtagtaccagctactcgggatgctgaggcaggagaatagcatgaacccgggaggcggagcttgcagtgagccaagatcacgctactgcactccagcctgagcgacagagcgagagtccgtctcaaaaaaaaaaaaaaaaaaggaacacaatcatgttctttgtagtaacatggatgtagctggagtccatattatatgaattaacacaaacaaaaccaaatactatatattctcacttatagggtaggagctaaactttgggtacacacagacacaaagatggggacaacaggcactgaggactccaaccggaggttggggggaagagctgaaaaaccacctattggggtactgtgctcactaactgggtgatgggattatgagaagcctaaacttcagcaccatgcaacacacccaggtaacaaacctgcacatgtacctcctgaatctaaaatttaaaataaatatagtcatacataacaaaaaaaccgcaaacaaaactataaggtttttatgtaaccatattaattttacatctgtatctcctttcaaccatgccaaaaactatttctcaacataattaatctgttggatttaatttcacaatatccacacaacagtctcaaaataacaccaatacaactgccgaaaaaaatgactgaaaatagtttaacatttatatttctttttattcttacattacattctaccagaaatagtcaaattatggtgttttaaactcacatggttcctttatatgtggttacgctactgatcaggaacccaggttcattccttttatttcattttttcttgtttaagaattgtttctaaaactgagtttcatttctaattacataaaatgattccaaagtcaggtccataaatgaagtttcacataagtctggcatttattctgttcctccactctatttcctcccatttattaataggcaagcatttattttttaattttatattttatcctcccatcattttttagtaaaagtatataatagtagcataatacacacattttctttacttactttttttgcacttaatatggtgaagatcactcgaaataagaacacacaaataaccctattcccttctacaactgcctaatacttcatggcacagatgaatcacagtttatttttttattatttatttatttatttatttatttatttatttatttatttatcttgagatggagtttcactcttgttgtgcaggctggagtgcaatgcagcgatctcgactcaccgcagtctccacctcccaggttcaagcgattctcctgcctcagcctctcaagtagctgggattacaggcatgcgccaccacaccggggtaattttgtatttttagtagagacggggtttctccatgttggtcaggctggtctggaacacctgacctcaggtggtccacccgcctcggcctcccaaagtgctgggattacaggcgtgagccaccgcgccaggccaaatcacaatttattaagccagatccctactgatgaacatttgggttatttttagtcctttgctatttattataagtagtgttgcaacgaactgccttgttcatatatctttttataggtttcccagcatggctttgggatatattcttagaagtggcattgctggatcaacggataaatgtttgtttaatgtgctagacattaccacattcctcatcatacgactggtactatttttcattcccactaacaatgtatgagaaggataagatcttactttttctgttaataccttaaaaatgtaagctaaattaaatttaggaaaataactggtattaccattctctaccgtaactataatgtatacccctcagctgtagttaaatttattttccttaaaaatgtacatgggagacagaattcataagaggatattttgttcatttaggaactatttcaagttcataatgttagcagtatctcagcaatggttttaataactgcagagtctgacagcatcccttgggaaagttaggtcacatagaaagggccaactttgctgggcgcggtggctcacacctgtaatcccagcactttgggaggctgaggcgggtgaatcatgaggtcaggagatcgagaccatcctggctaacacggtgaaacccctgtctctactaaaaatacaaaaaaattagccgggcgtgctggcacgcgcctgtaatcccagctactcaggaggctgaggcagaagaatcgcttgaactcgggagatggaggttgcagggagccgagattgcaccactgcactctagcctgggtgacagagcaaggctcagtctcaaaaaaaaaaaaaaaaaaaaagaaagaaagaaaaaagaaagggccaacttaaatttttcatattagaagttacggcagtcccatatcattcaaatgatatgtaaataaactggcctgcacagctttgaaattgaggtcaaaaaatagttgctgaaaacatcacgaaagcaaacctacacagaagccaacaagagactaccctgagacttagtaagtgctgaacaacacagatgctacgaaagtcaaggaggtaagagacaataagatctttttgcctgtttattgtttttttttaattgtggtaaaatatccataataaaaacgtacttgcattttctaatttgttttttaaactgtggtaaaatattcataacatgaagtttacctttattcccatttttatgtgtgcagtttaatgacattaagtatgttcacactgttgtggaatgatcatcactatccatttccagagaatgttttgtcttctcaaactgaaactccatacccattaaacaatcattccttatcctccctcctcctagcccctagcaatcaccaccattctactttctgtcccttgaaatttgattactctagatatgttacatacgggaaatcatacagtactcttcctttggtgactggctgatttcacttatagcataatgtcttcaaggttcatccatattgtagcatgtgtcagaatttccttccttttcaaggctattcgaataatattccattgttccagaaattggtcctgccaatgaaacaacttttctgagtgggcaagaactttgaatcaactatttcataactctggaagctggctgaacacttgtagcatccagagggataatctgataaagaaagaggttggcattcaaggaaatctccatcaggtctttggctgaccatggatataatggaatagagactttagtgatcacacacaatgaggaataaaatctgctcaaaattagtttggaaaagtcactaaagaaatggatggctacagctctcaaaaagcagttatcaggcatcattaaggagggaagataatctgatttcagagtcaccacattacaatattcaaaatgtccaattctcaaatatttccttcttgaccaatctctagcacttgaacaaaatattaacatagattctaacagctcaaggccacatccctaggatggctctagctccccctaaagtacctgcctgagaaaattcaaggctgccaaaagagtttactgttagttccagccgacacttgaagacaccctgtgtcccagcatctgtgggagggtaggagcctaactttgataagcactagctaacaatcccagatgggtttcacacaggccaatccctactttccacttttggtaatttttcacttccttgactttactaaccaccccctacaccctgctcaccctccctcctgattcttcattcttcctttaaaacacctagtgaagcctggcacagtggctcacacctacaatcccagcacttcaggaggccaaggcaggcagatcacttgagcccaggagttagataccagcctgagcaacatggtgaaatcccatttacatatatatatatatgaagaaaaaaatgcaattattaaaaaatcaaaacaaaacaaaagcccagaaacctctgtacaaattgaagttgagttcagttaacaccgggctcttttccatagtgtaacagtttattactcattaaaatctgccctttccgttttaactggtgtccagctttgtgtatctctggcagaaacacatgaattaacaaaagtgattcaagacaaaatagaaattctcaatatctgtataacaaggaaggagactgaatcaggaatcaaaaatcctcccaacaaagaaacgtctgggcctatttggggtctctggtgaatactctcaaacatctaaggaattaacaccagtcttatgcaaactctctcaaaaactgaaggagagggagcacttcctaactcatttcatgaggcaggattaccctggtaccgaagtcagacaaagacactacaagaaaagtaaaccatagactaacatcacttatgaatatacacagaaaatcctcaatacatttcagaagattaaatcatacaaagtacctactctgaccaaaataaagtgaagttaaaaatcagtaacagaaagaaaactggaaggaaacaaaaggaaattggattctactccgtgaccaagtgggatttacttcaggaatgcaagaaagtcgatcaatgtaatacacaacatcaatacattgaagaagaaaaaaaagcacatcatcatctcaacacagaaaaaccatttgacccaatttgagaattcttatctttcagagacacgtgccaaaatatttacaggtaaaatcatatatggcatttgtttctaagtaatctggactagggaggaatacaaagtagttgaactgggtggggatacagacgaaataagattatccacatattgaatcttgtacctcatctttctactttcacgtttgaaattttctaaaataaaaaatttaaaaacagatgaaaagacattttaagagaatacttttaaaataaggcaggaaggaaactggaaatatgttaatataatactaaaaagcattattaggaataaagagagtctaaaagcaacaattctccaggaggagataatgatgctaaacctgtttcgcctttacaaatacagcctgaaaatatataaaataaaaaacaagacttaacaaaatcataatgagagatctttcccattgcttagaaatagattacgcaataaaaatagactatataatatttgaacaacacaattaacaagctttaggtaataaacatactgtgaacatatcaaaaacacgtacacagctgcttgggaggctagcgggggaggactgcttgtggtaaggagctcaagaccagcctgagatacatggcaagatcccatctctaaaaaaatagttttaaaaattagctaggcatggtggtgctcgcctgtaatcccagctgatcaggaggctgaggaaggaggatcgcttgagcccaagagttggaggctgccgtgagctatgattgtgccactgcattctagcctgggcaacaagcaagatcctatctctaaaaagttttttaaaaattagccaggcatggtggcgcttgactgtagtctgagctaattaggaggctgtagcaggaggctcacttgagcctgcttctactgcactctagcctgggcaacaagcaaacttctatctctaaaaaggaaaagacaaaaagaaaacatactgaattcacttcttttttaaaggacacttggaacataccaaaagctaaccacatattaggccaaagaccatgttaaaatattttaaaaactgattttatacgcaacattttatctcactcaaagcaattttttaaaaaatcaaagaccaacaacaaaaagcatagttcaaatccaaatattggaaaatttaaaaagatcactcacttgcaattagaatcaaagacaaatcaaaacagatattaggaaatatttagcattgaatataacaaaaatacatctgagaatttatcaaatatgagcaatattgtaaagataaatatattgccttaaatgaattagaaatgaaaatcaattgactaagtatctactccagaaataaaaaaaaaaagaaccactaagtaaacccaaggaaagtaaaaagaaaggaaacataaagtaattaaatcaaaaagggaaacaataaaaaagatcaatacaacaaaagtttcttgaaaatactgataaaataaataaactcccagcacaaatggctccagaaaaaaaaaaaaaaagggcgaaggcaaaaaataattctgggagtacaaaaagaaagagaatctataagtaaagatgcatggtgttatgatatatacatattggtttccttccatggttcctgtttcctaactcccataatcttcgttatactgttggggttctttaggcctcaggcaacagaatctctctctctgaccttctcctgtctttctttcatctgccccagtcaggcctctgattgtgggtcaaaagaccctcatttcagaaaagagtcctgccccaaaccctagaggaaggaatgctacacagagaggccaagaaaactctgagcagacaggccttgctggctttagctcgtgtgcgtttttgtccaatcacatttctgcacagttgtcaatcatgcctatgtaatgaagcttccataaaaacccaaaaggacagggttcagagagcttccagactgctcaacatgcggtggttccggtagggtggcgtgcccagggaaggcatggaagctccacacaccttccccataccttgccctatgcatctcttcatctgtgtcttttgcaataccctttataataaaccagtaaacgtaagtgtttccctgagttgtgtggactgctcttgcaaattatttgaacccaaagaggacatcatcagaaccccaacttgaagaccattggtcaaaagttccagaggcctggacttgtgactagtgtcctgagagtgggcagtcttggggactaagccctcatcctgtgggatctgacactatctccaggtagatagtgttggaactgaattggaggacacccagctggtatctgctgcttcctccgtaggggaaaccccctacacatttgatcacagaagtcttcttctgtgttgatgattgttgtggtgtgagagcagaggaaaaacgaagtttgagagttttttctctaaaaaagatgtaaaagaattatttttaaatcaaaggacaatactaagaaatgctttctactaattatatcagaaaatatatgaaaacatcttctagaaaatacaagtgaccaaaaccaatttcaaaagaagagaaaacctgaacataatcttgagaaaaatatcagtaaaaatctacccacaaaaaacaccaggcccacagcctttcacatgtagatttgttccaaactttcgaaaacatctaatcttctgataacagggcaaaaggcaagcttcccaatgcatttataagaccaaaaggttttctatttcctgaacaattcagtgcaatagctgttaagtgggacagaacaagttccatgtcctgggagaggccaaggtcacctgagtggggttagagctctagcaatgggtggagggtgactgcacagaaaagccagttatgtgggacattggagcccacgtgggaagctaagcgcacccatgtggatggtgtggcagagaggatagtggattggttatttataagaggaattaatcaaataagtaaatatggtaaagataataggtgctaagtttctcaaaccagaatacacacagcggtgctgtattgcaaatggcagtatcagtgtaatctcatagtcttcagtgctgtgtagatgactgatagataaatatcctataacttcatcacctagagggctggaagcaatgatatttcccataggcatgagcaaacctagcaaccttgtttctgaattccattctccaccaaaagaaaccggagctctttaggaaaaggattaattccaggcctagggcagggagagttaaagtctgaactcctgggtgggcgcggtggctcacgcctacaatcccagcactttgggaggccgaagtggatcacgaggtcaggagattgagaccatcctggctaacacggtgaaatccccgtctctactaaaaacacaaaaaattagctgggcatggtggcgggtgcctgtagtcccagctactcgggaggctgaggcaggagaatcgcttgaacccaggaggcggagattgcagtgagctgagattgcaccaatccactacagcctgggcgacagagcgagactccgtctcaaaaaaaaaaagaactccctctctttttgtgccaacaagcaaggaaatgctcaataaatgatgttggggcatgttaaagatgcaaaagccagctttaaggggctcccactggccaaatcagggacaatttgagtattgaaatatgtaatgataataaaagattagataataagttaatgataataagagacccatgggtctatacaaagtctcaaagtgtctccacacaagttatttgtttaccttaaaggagaaaactctgcagtggaggcacatgacagaaatccaccttaaccaaagtgatcaaggtttcaaaataacaggacaaattgaaattttgtgccacctgataggatccaaaaataacacagcattgcttctgtgatattcttcccaaagatgcataattcaaatccaatcatgaagaaacagcagacaaaccccagctgaaggatgttctacagaaaacaggcccgtattcttcaagtgaaggtcataatagtcaaggaaagacttaggaactactggcaataggaaggagactaaagaaacataactaaatagttcagggaacaaattattttgcactgggcttgcaacttttctgtaaatttgaggttatctctaagtaaattagcataacctcaaaaataatgataatataggaaaattaaagactaacccccccttatgtcaaaagatgcaaaattatacattttgagctatatgtatttaaaaattttatcaacaactgtttgtctccaaaatgcaagaatgtttagatatcagaaaactgtatgttattacaccaaattatatgccccaaaaaacaaatttacagagtaaataagacattttaatcatattagcaggtaaataaagagcatatatacatccaaagtcattcatagttttttttctgaacatctctaagcaagctaggactgaaggggtaactaaatagcccaataaaaggtatttataggggaaaaaaactcttaacagcaaacatcacactctatggcaaaacttaaaattatttcctttaaaatcaagaataaggaatcagaaacatccttagagcctgctgtaactgcttcttttcaataatatattgcattttcagccaatgcaaaaaagactaaaataaaaggctttaagaattgaaaaagaagacaggcatatgatgctaaagaattataggctgggcgaggtggctcatgcctgtaatcctagcactttaggaggccgaggcgggcagattacctaaagtcaggagtttgagaccaccctggccaacatggcaaaaccccgtctctactaaaagtacaaaaattagccggacgtggtggcgggcacctgtaatcccagctactcaggaggctgaggcaggagaatcgcttgaatccaggaggcagagattgcactgagccaagattgtgccaatgcactccagcctgggcgacaagagcaagactccgtctcaaaaagaaaaaaagaattacagtatggtatttgcaaatggatagcaaataaaccaattcagtcctagccataaatttatctatacatgggacattgctacaaaatactgagtgtcataaatcagtgtggaaagtataaatgatgaaaaactggtgctaggctatccatataggaaaaatacaaaaactatttccatacctcacatcatacacaaaagcagattaaaagcataaaatgtgaagatcaaaactttgaacacttagggaaaaaaggcagaaaacatatttacaattttaggattaggggaattttttaaagcactatacacaaatgtagctcttataaacactaatgatcgtaacacatttaggtcaaatgatctgtatgaccaaaagaagtgaaaatgtgggagaaggtatttgcactagatagatagagcagaccatggattaacatgtagaacatataaagatgtcttacaaatcaatagaaataggtctaagacatgaaatctgacactcaaaaaggagtgagagcaaaagataggcagatacttaacattactagtaagcaacaggtataagttaataccgtaataaattatcatttcacactgtaccagaatggctgaaaagatactgaaaaggccaagtgttcacagggggtgaaggtggagggattggtaaacaaaaacaaaacaaaactgtataaaatgttgatgggagtgtaacttgacacaagctcaagagcagcttggcaatagtccttgattgctccatttgtttctggctggagaaactcacacatgtgcctaaagaagtactgtacaatgcctgcaaatctcaaagaactggaaagaccttaaatgtccagacattaaggaatggatagttatttttcccccataaaagaacaattaaaatgagtgaatcaggtctacatatatccacatggctgaatctcaaatacataatggtgagtgagtacagcaagttgcataaggacacacgtaacaccgcttatataaatcatgaaagcccacaaaataaaactctatattggttatgtatatatacatgtatagtaaaattataaagtcatacaacagcccgatagccacagacttttgttacctctggggagggtgagaaggaaaagatataaggccttgatgtggcctctgatgtttcatattttaaaatttgaaacaagattatcgatggtaaattgctaacacctctgagaaaagcggggggaattttgcctcagatataactggtggtgactgctgggtaataatttttattatacaggtgagaatgcgagtatcagagggcatgaggaggagaaagctgagtcagggaggtaaggggaccaggaggcaggaaggagtttatacactgaaataaaatgcagatcaagaagaaatgcctgtaagggccaaacatattccactgatgaaacaaatgcaaatcccaattcaacagaatgaaataaaacccagtaacctatcacattcctccatactcactatagactcttttaaatgacattccgtccagtgttgatgaagttcacttttttccccgagttaaaaatatttgccttatttcaaggttaatttgcagcacctccccctaaaacaattaacttatttgcccactgaataaaacgtgttgaatctctgcattaaaaacagcatctgctacacgtaatggaggaacacaatgggactatgaactcttctagttcatttagtgcataaaactattatatagctattatttttctcattttacagataaattgagattcagagagcttaaaacctacccccacaaccaccatgctgacaagttagcatgagccgtaattcaaattcagtttgccagacagccccaagacccatacccttttccctatacctaactccctaggaggtagatcttatgtcctgctcttatgttctatgtggggcacactcaccatacacgttatatttccccatacaatagagtgagactagaggactatcttttgaaccaggaattgctctcctaggaatgatttggaaaaaaagataaagaaaagttatatttaaaaagtggcagctccagaccaaggagaataaaaaataaaaacattaaagaataacaaataaaattctccacatcacggactaaaaccattttacaggtcaagaaacatctgcatacaaactaaggaacctatgtaaattcatatactagttatggtggggccaggatctcaacccagacagtccgattcccaaacaggcatggttaatggttacgctattgttttataagcctttttgagatccacagtgagaaatatatttcacctcatgatcctgattttgtttcacacaaaagtgaaacaacttctacaaaacagcattgaccttaatatgtagcaaaaactttaagatgttgatttccagtcatgaaattctctcatgacccacgatttaaaaaacacacaatgcttaagtgcttcaaaaatacagtatttattgtaataactacagtagcaagaagaaaaaaacgaagtggaactacgtgtttagcagcagagctgaataattatgaatataaacaattactattgggagaaaatacattacactcattgcttggaaccatgaataatacttatatatgtacgaaatatagaaaaataaaataggttaacataataaggatataggcaattattttttttaattttataaaaacttttatttttccttacaaactggggtagttaggagacctgataatagcttttttattttcttggcaccaaagcaacttacttatgtgttccttcttgcattatctgttccagatcatagtcaagttttccaattcgttttactaagctagcaaaattttttataccaaaaagagtaaaatcaaaacaaatgctcctttgtttatagatgaaaatctggagcaaaataacacaacattaaaaaaacaaaactttgcaaacacatcctaaagctacacacattgaagcgtttacagcaatatgctccctgggttcgttctcccttcccccaatcctctaaactgtgcctttgggtctcagacccttgtcccgggggtccctctgaatccacctttcaagaggatggagctgggccactaggctgaggtctggccctgttctcctcatctgccaaagcctcacagtactgcgctggccagtccttggggtcttgattatggaccttggccacaaacttaagaactttcatcttgctggtttccaggttggttcgcgggccccactggaattcgtagtcgacggggtcggtgtggggtatccgccggtattccaggtaacgctgtcgcacaaagtcctcagtaatgagtttctttggatctccgaaaattaaatgcttcttggtggggtagacccctaagcgccgcagaaagtcccaggcttcagtttccttgatggtgttgcccttcataaagatgagccctaagacgatcatcaggaggcccgtagtgggcgtgccttggtcacccctcatctcggcatcctcctccacaggctccagggtgttgatgaggatgtaagtgttgctcttgggttcaagttccaccagcttatacccgaagacgtactggaggcgctcggcggcccgtttgaagaggtcggggaagatgtccttgtagtccccgatgacgtgcttcagtatgtcggcccgcttgatcggaatcttcttctggtctttaatcagcaagaactgcaccagctcggacactttcagctccagctgcttctggctcctgggccccacggcgggggcggcctgggcccggcgggcgccctgaggcgaggggccctgcgacccctgcgagccgcccggcccgcgggacgtgctcggggcctcctcggcaaagccgtctctgagaacccgggcgtcttccccggcccgcgaagccccggggtttccgctatggctccagtctctgtccctctcggcctggccgccagagcggccccggttcctcggtttttgcaacatgtctccggcggcaggtgccggcgcacactccggtaggcaagcagccgcggcggggattgcgggtcggcgacccgctaacgccggtgcctggaggcgcgcgcagtgtcggctgagactgcgtgctgcgtcatgaagcctgcgccttgcgtcagggcggctgggcggtgcgcctgcgcggctgcggcgggtaccaaaaggaacagcgttttccgtgcagccctgcaggtccgggcgatgatttttagtatagtgaagtgttgttaccaaaccatgcaaacagagagcgagaaccgaaactcctaaacaagtgtgtcgctaaattcagaccacacaggctcaggcaagttttacagacagtattatgagtttctaaatcgggagcatttgtaaacggaaagaattcagaggatgaacgtgtgagaaaaaaaaaaggtgaagaggaagggccgaccgtggaagtaaagtaaaaacatttatttctacacaaaatgtagaaggacataaaagacccagagggctcttagttttcgtccctccacccaatttcataccctccatcccactgcccccagttactttctctaatgccccgtggagtctgttaaaaaccaaagtcggctgcaggctttctgcgcaagcaggacttcagtttcactatttccgtatttatattctctgcattaaactcctttagctagacaactatgagaagaccacaaaaaacgtgtcagtattaggtaaatgttttagcttggtcacatgggtttatcttttggaaaacaactgctttcgtcacaaccacaattttagcagaaatgggtaagaggaatgctgcaaacaaacgtgcactctcaagagattactacttaatttggggcatcactgatcaagaattgcaataatgtggagctcttaaatttcttaattcataatatattagctttgaggaaaaaaaagagaacactgggggatttatctctcatctatgatgtgatatacagtctctactgtatattttaattgtgcaactcaagtagccaaaatgagtcatttcattaactcaaaccatcagcagtctgctgccatgacttctacagatcttagcaaatttgtttcttctctatttacttgcaaagaagaaactgaatttccctgtgtctttttaaagctacccagaaagtggataaactcttcaaagaaccaaattgagttcctctttaatgcaaatatattcaaaggaaagcaatttagaacacattatctgagtaatagcatcaaacacaaccttattaaaattttgttaattgttagtagcataacacttttgtttgtaattcagtaggaaaatgcaatctgataatggcactggaactgcaatagtaaatgtaaaatcatattccatgaactaatgcaagtatgctaaaatctggtatgcaatgagtaataacttactgttccacacaagatgcaactatatcctcaggcatcaattttaatgacaaaggcctactatgaaaaacaaatatattatcaaggcattcatttttttacaatgagaaaattcatctgcttcagtttccttgcaaattaaaatctggacttaggttcatagaagcttcctgccatctagaattctgcaaaaggtccctactgcaggatgtggatgttgtattgagggaatagagagaccgtctcatattgttttatattgttttatactcagtacctgttttaagaaaaaacaacaaggaagtaaaaccaaatacaggcagcccagcgccaggcccaaaaccaggcctgggcctgcctggcctaaacccagtagttaaaaatcaactcataacttagaaaccgatgttattcatagattccagacattgtatagaagaacattgtataaagaacagaactgccctgttctgtttctctctgaccaccggtgcatgtagcccctgtcacataccgcctgcttgctctgatcaatcacgaccctttcatgtaaaatctttagtgttgtgagctctttaaagggacagaaattgtgcatttggggagctcggattttaaggcagtagcttgccgatgctcccagctgaataaagcccttccttgtgcaactcggtgtctgagagattttgtctgcggctcgtcctgctacagtgccttgagtcaaaaaagttcagtgaccgagatataaggggaaagtggaaaattagataaaagctattgtcaacagttgggctggtttttcagtgctctttcttgctaaggtattcatgtacgttaccaagcagcccaccagtcagactacccctgtcactgtgaaaatcagcagtgtcctccagcagcacgcttacctagatagcagactgtcattactcaagatagaggagaagagataccagtttttaagtctcaaaacatctctctacactctttccagaagaatgcaggtgagaaaatgcagacataaaataagagtattagaatgaagttttaggccctgcatggagaagtcatccagacccacattccaccttggattgatactggaagccatggatgtctggggagaaactgtggtgataacaatactaacattagtaacaataaatataaccgacaacagccaatgattatagtagttgctgctccatctccatgtctgcagttttactttctgtggtttcagttacctgcagtcaaccacagtccgaaaatattaggatattttcaaagagaaaccacaatataacttattacactatatttgttctactttattgttagtgtcaactgaaggatgacgaggttcataaatttggaaagagctttatttctcataaagggttgcagtctgcggggcggccattccaacaggctaggaagacaacctcatgctagaagccagaaacagacacttcaagggagggcaaagggagcaggaatctatgcagaatggggtggccaaatatacatatttaataagctataggaggagtcatgaacatttatgcaaggagaaatgtgcatatgcgcaattgcacttcatgtctctccctgggacccatattccaaaattggcagtgttagcatgatccagggtaggagttttcagccctctgacatcaaaaggtgaagtagaggacatgaaaaccctgactgcatgtcttccatagactggccagaactactccatggttggtggtcttttaccaggaagaactgctggtcaattgtgccaaaactgcaaaagggaggggcagcatcaggtggttggtttataccagcagtggagtcttttgaaagggctgatttctgtttagctcttagggaagaaagcctaatggcatttagagcgggtgagggtttccaaggttattcggggtccccttggccaagagggggtctgttcagtcagctggagggcttaagatttcatttttctcatcaattattgttaatctctattatgactaatttataaattaaactttttttttttttttttgagatggagttgcgctctgtcgcccaggctggagtgcagtgtcacgatcttggctcactgcaacctccgcctcctgggttcaagagatcctcacatctcagcctcccgagtagctaggattacaggtgtgtaccaccacgtctggctttttttgtatttttaatagagatggggtttcaccatgttagccaggctggtctcgaactcctgacctcaagtgatccatccacctcagcctcccaaagtgttaggattacaggtgtgagccaccgctcctggcgtaaattaaattttatcataggttcgtgtgatgattaatgtggagtgtcaacttgattgaaggaagcaaagtattgttcctgggtgtgtcagtgagggtgttgccaaaggagattaacatttcagtaagtggactaggagaggcagacccacgttcaatctgggtgggcaccatctaatcagctgccagtgcggctagaataaaagcaggcagaagaacgtggaaggacttgacttgctgagtcttctggtcttcatctttctctcatgctggatgcctccttcccttgaaagtcagactccaagttcttcagcttttggattcttggacttacactagtggtttgccaggggttcaagggtcttcagccacagactgaaggctgcactattggattccctacttttgaggttttggaactcagactggcttccttgctcctcagcttgcagatggcctattgtggggcttcaccttgtgatcatgtgagtcaatactctagtaaactccctttcatatatacatctattctattaattctgtccctctagagaaccctgactaatacagtatgtatctatgcatagggaaaaacattgtggatttagggtttggtgctgtccacgatttcaggtatccactgagggtcttggaacacatcctccacagacaaggggggactactatacaaagtgaatggtgggtcagaccttattccaggtggtttacaggtatgacttcatttaatccccacaacaaacctatcaggcatgtgcatttattatgtttctcttctcacaaataaactgtcacaggagaagattattaagttttgaggctctatagcgagtaagtggtaggtgtgagatctgaacacagccaatctgcctccagagagtgggcttttaactgtatactgattcagagcaaacatagacatggtgtccttgaaaaagtaagggctttgggatcagatgaactaacattagaaacctgtacgatactgacactcctcccggtttaagtctccaagtcaacaaaatgaggcctaaacctggcatcaggggattaagtgagataggtttacccagtacctagcacagtgcctggcagggtagtttgataacaatttgcttctttccagggatttctgttaaggaaaatatttgaggactacacaaagttgtatatactgcaggggaggcaaaaccttccctccaccctcgaagggccccagctggacctgagacttaaactaatataaaatagattaacaggagaaaagcattcaaacttcatttaagttttacaggacacaggagcgcttgttagggaaatgaagaccgaaagaggtggcaaaacctaaatgcttttatatttggttgaacaaagagaggtaattgtgggaaaagtaaattatgtggggaggataaagggagataattattttaacgaagttgtttgtacagaattcacttggctttgaatccccattgagtaatgtttctttcctcttggtacagtaaagctatttttcacatgggagtttttatctcctgttttcaggaagaaaagaggaaattcaaatgcccttcttgcatctgctatttttcaagtgcctttagctcaaagtaatccttatgccaaagtggcatattttgggcgggcagcatattctgccatccttcagtagaacgatgagaaagatgttcactgcagcaaaacacatgtacacaagaatcaaaagggctggaaagaaatatatatatcaaggtactattaaagttaatttgcttttaaaaataaaaatcaaccctgattttcttgcttgggagatgaataaaaaatatattttcaatgaagtttaacttcaaagtgacactatgccatagcagctatgcacattcacatgttcaatacattcagtgtgattcgaatatggcatttgtgactttctgttcaggcagtgaagtcacaaagacaagtggttaaaaaagaaaaacattttcaaacactttatgttaatgaccttcatgctttaattactagacccaaaagaaaaaatcaaaagtctttgaggcaaaagctaagctagctaagatttcaagtgcaaagaacaaggaaatgcctactacaaattgctctttagatgtttatagtaattaaatgttttattttgtcttttcgatagcaaatgcctgccaagaaactctaatcatctttattatctactagattctcctcttcattcatggtatttcttgtgaatcagaaaaaggctttaatttttctgacagcaacacagtgctaaaagcaggtgaggacttcttaggaagaaaggcaatgatcaaagcatgcagccaccacatatgagctgttctctgccttttccagtggaagaaagtgggccaatgtgcagcatgtgagcaagggagttgggaggcaaatactattttggtgggtagacagcaggaaaagcaatccagacatcttaatggttgcaataaagtcccttgtgtccacacatttacaacagttatatatattcattcatagcaaagatccctcctgcctaggtcacatggtagactacctaataacactttgtccctcataaatgaatattttgatgaagcagcaacagagttttccttggctggtggaagcgggtggagaggtgagccttgacaagatagtgctttccaagcattgcagccatttggcccagaagcctggtcttagactctcttttcaagaaatgcatcttccagttatccagggccctttacttatgaaaatcattagggcctattaagttataaaattacaaacatccaaggtcttgatagtggtcactaagattctcttcgtttgcttggtttctaatccctttgttctgtatcctttccctttagaaacagcctcttcccacctttaaaagaccttagtatagggctgccttcctttcctgagtgcacaggattcaggccagacacagtgactggttcagaagttcagtcagcatccttccaggacattcagacagattctcgcccctctgagctcacaagctgaggggtgatgtaagcctagccacttgtgcccttgcttctgaaaaacctgcctcagggcgaagccaactcaaaagagatctaagagatgggaaacaatcttaatgctgccatttgaatccctggatgctgagttcaagatcagactcctggagataatgaattactaaagcatctccttttgcttaatctgctttgagttggttcctgtcacttgaaagtgaacaaggtctggctaaatcagtagccaatcctattattcaggggaaaaaagggtagtaagaaatgagactttggagctagggaaggttaaaaccaatgaggagttttgaatataatgagaggtgaattgaaaacaatatgacatttttgttatgtttcttcccagtgttctgtggttggggaatgtgctcatcattttagttggtggcaacaggggtaagggagagacaaattatgaagaactgtacttttccatatggaaagtatatatgggccaggcacagtggctcaggcctgtaatcctagtactttgggaggccggggcaggcagatcacttgaggtcaggagttccagaccagcctggccaacatggcggaaccccatctctactaaaaatacaaaaattagccaggcctggtggcgggtgcctgtagtcccagctactcgggaggctgaggcaggaatcgcttgaacccaagaggcagagcttacagtgagccaagattgtgtcactgcactttagcctgggccacagagcaagactccgtctcaaagaaaaaaaaaaaaaagtacaaatgagctaatcaatctggtgatttacctttgcagaaaggagttttacacaatttggaatataaattaaagcagcggtccccaacctttttggtactagggaccagttttggggaagacaatgtttctatggaaggtgcgggagtgggagggtggtttgaggatccccgcctgcagttctcagtagggctcacatccctatgagaatctaatgctgccgcttatctgacaggaggtggagctcgggcagtaatgctcactcgcctgccactcacctcctgctgtgcggccaggttcctaacaggccacgaactggtactggtccacagcctggggtttgggaacccctgccttaaagcatctcctactctaaagtggctgtgttctccatatttaacccagagcacttccccacttgctataccacgcaagatgacagaaacctcattcttccagactacgctttagcctaaagtagagatatatgcacaggacagaggtatgtccacaaagagagctgacaaagctaatatccagacagggacaatgcgaataggttatgagaaaactgaacacgttgaaatggaaaaaaaataaattagagaaaaaataaaaatattcaaggcagacaagaaagaccccatgtatacataactggtggtcttgagggagataacaaccataaagagagaaacaggtgactgtaggagtcctggggagctgggtttacacaggccccgcctctctgatcccacccccaccccactgcagctccctcccttggactaataaccacagcaagcatgcttccaggactggagggtaatcagaggccatgggttccccaagatctgcagaagagatccagtacagggttcctccctccctgagacacaagtgagagcttagcaatgaagttgcatgcggagaagagggcttgccccttcccaaggaagtcctgggaaaagcaaggactgtgtggtacttgtggggtctgtgctggcagaagcccgtgtctcccttctgagagagtccacagctgtcccctttctgagaatagtcctccaagaccctgtcccaggctgttgttctttgggagaggcaggctaactgctgccaggcttcaaggttgggagagccagcagtttgccccctgtgaggcctgggctccaagaggcccttcatagtacttcaaaaggcatgtagacagtgtgccctctgatgcatcgtgaccataaaagcaaaacctgctgggcctcttgctacttgccacctcatactttttcagtgactcccaacaacatgactcacagaggaaagggagaagcacagaccccattccagttatcccactggatatccttggcctcttttctgcagatctgttgaccacagatgtaagaatttatttctggagcctcaattctaatccattgctctacatgtgcactggtttcctggggctgccacagcagaataccacagacttgggggcttaaacaacaaagtgattcctcacagttctggaggctccaagtctgagatcaaggagtcggcatgtttggttcctcctgaggcttctctccttggcctgcagatgaccacgttctcactgtgttctcagctggcccttctctgtgcatgtacatccctggtgtctcttcctccttttgttgactataaggataccagtcctgttggaccagagccccactgtaaaggcctcattttaacttaatccacttaaataacttatttccacacacagtaagtctgaggttgagtcttttgaattctgggggagacactgcagcccatcacgtatgttgacgtgtgccaccgccacactgcctggttactgcagagtgttagtaagttttgaaattagaaagtataagtgctccagttctgttatttttcaggattattagggctattctgggtcccttccatctccatatgaatttgagaatcagcttgtttattcctgctaaaatttagttgggatttttttttttttgagatggagcctggctgtgtcaccaggctggtgtgcagtggtgcaatctcgcctcactgcaacctccacctcccgggttcaagtgattctcctgcctcagcctcctgagtagctgggactacatgcgcacgccaccacactcagctaatttttgtatttttagtagagacggggtttcaccatgttggccaggatggtcttgatctcttgacctcgtgatccgcccaccttggcctcccaaagtgctgggattacaggcatgagccaccgcgcctggcctcagttgggattttcacagggctcgttttgagtctgcagatcaatttgggtagtactgacatcttaaaattaagtctaccgatccacataagtgggatgctagttaatatggacaagtgaatttattactcctccaaaaaactattttcacaaactttatatcaacatgagaaatcatgttgtatctttctacctggagggagcaagaaagtcaggtggtgtgccttttgtacatgggcaacccaatttcttatctagactttcttttgctcgcctggaaaaaaaaaaatgaggtattgcaaaaatgtgataattgctttccttagtatgaaaaactgttaaaatgagtaaagcctgtgctcaactagaattctcacatttccgttttgatgtatccgcatttcacagtaaaaaaaaccctcagttatgtacatatgtgatcctgaagtacccatgattaaaaacaaatatttcaatctacaatgttcagttctattagatcattaaaagacgtatctctactcgcattctctgaaaacgtgtaaatcatgctcagcatagtgacaactccactaggacaggccgaccaactcatttgttacaaagtctctggccccctgagtgaggagcccccagaaacctaatgtgaaaggaaacttcggttttctccccagctgctttccttgagtttgcatgatatgctttggctgctatgtggagctgtcaaaagccttgaacagacaaaataaagaagaatggcattccaggaaataaacaagcttaatctcagttggacagaaggaggtacaaagaaggcctggggaaggaagaggaagaggcaggatacagggaagacagaatggactctgtaacctcaggaaaaaatagcaaccttataaatacaaagatgttccctggcagacacatgtcagcacctgggttatgaaagaccagccaatgcccccccacacaggttagaatcacattcatcaggaaggaagagagcagaaggaccctgctgcctggtgatgtctcagctggcgtggctgcagctttgcttccagcagccggggaaccgccatgggaaggcgtttcctcaaaatgcatgaaaggcggaggagcttggttttctgatggtttgctgccccttgaagttggcaacaccatcccttcatctgcatggataaaccggggcatcctttttgagaagcagtacttttttttttaagactttattaatcccacacgtttgagagaggtggttgggaaagcaagtattaatgaattaactgcttcctaggattcaatcagtcattaaaaatgtacccgtgaaattttcttgagctgttcaattgtttatcattatccaagtggttcatactctcatgcatttattttccttccacatttacctctaagcaaattacctaattcaacatggttattattctggatatttaaaagctgtgtattgggaaatttcacatagtaatatgaatacacctgttacgcttaatcctttgtgcctaggtgtgattattagatataatttatagaaattctgccgaactcattgtaatttattatccatttatggttttacttgattagtcttacttaaggatgatattttctaaatgtataaataaatgatacagcctattaaagtggaggttatataataagtgacgggtttaggagtggacatgtgaccgagctctggccaatgagttgcaaggggtatttttggaggcatctgagaaatgtttacttgctcttaaaaaagaagattgtaggaaaaaaagaaggaaaactttcctgttctactggacccccataccagacatctgcatgtactgcctcaagcaggggcaactgtctcatgactgagtagagctaagccaccacatcaacacatcgaaactggcagaggggaaagctggaaagattctaggtccttgaatttgtgaggctgctgaaccagctaaccctgcggcaaccccgctctggacttgccatttgacgtaataacttccttcgttattgaaacttgtgtgaattggtttgtatcacttgcagccaaaagccaccccaaagcttcccagctgacatctgtagactagggagtcccaacaagaggaacagacttcacctggtgaagccgtgccaacccactccacctgtctctgagatctatagacatttgaatgtgagcgtgaaatgctgctcaagttcaggtagactacagctcaagaatgtgagactacaggttggtagtctgcctccctctctaaggcaaagagatatttcaatgttacctgggacctgagaaagggggagggtctatggtttgcccagataactaaagtctgtaggttagaaagtcaggatttgtttggaagctataaagatgtatcctcatatgtcatggacatcatgtgatatggtttggctgtgttcccacccaaatctcatcttagctcccataattcccacatgttgtgggagggaccccacgggagataactgaatcatggggaaggtttcccccatactgttctcatgctgatgagtaagtctcacgagatctgatggtttcataaggggaaactcctttcagctggttctcattctctcttgtctgctgccatgtaagacgtgccctttgccttctgccatgactgtggggcctccccagccacgtgaaactgtgagtccattaaacctctttttctttataaattacccagtcttgggtatgtctttatcagcagcacaaaaacagactaatacatcatcctaacttgaatgatgcctgtcctcagtgagtggtccattgtgagtatccatcaaggagttttctcccactgcacactggacctcaggagttaccacaagctccctagcactcttcaaattgttcctcgtttccagcaagtcatctcttctccacccacctcatgaattcaatattttagatgcctgtcacattgcctgtcgctgatccctgactcttgagaccccactatgtgctacagtcttggtcccctgtttgcttggaagaagacaggaagttttaacccgaggctgtagagggcttcaggcataccggtctgttcttgttgcctggactcctccagcacatccaagtctgccctttaaccgtttcttggctacaactggtctcaatatggtgatggccaggggacagatgagctttgaaagcctcgggccaaccagccagatgttctcttgcctccagtggtcactggtgatgcctggtatgggggtgtgtccagaggttgacccactgttgctccccatggcctatgatagagggccatgctcacacagggagctgggaccaaagaccagagtccagcaagaatctctggaccaaaggtcaggcagtctggagacagtctgcatctctggcagaccccagggtgagaagcagctatcccaggccagagtggggtcagctggccaatctgggggctctggagcagatgagagggagcctgtcctgcacacttgaaagagaagttgcaaggtagtaccaaggacaattcagctctacttgattctgaaaagactatccccaccctcaccataaggagaagagacagtgtagtttgccagtgcaactgcggagggaaaacaatcccaccctatctgcctctatctcttcttctttttttttggagacagagtcttgctctgtcacccaggctagagtgcaatggtgtgagcatagctcactgtaaccttgaacttctgggctcaagtgattctcctgtctcagcctttccagtagctgggattacaggcataagccatcatgcctggccccatctctatcaatccaccatggcctgggggggattttagctatcatagcctgcagctgggcccaaaccagcgctggggaaactccacacccaccaaaacaatgcagcacagcaaactcatgtgccccctaagagggacagtggtttgaaggaaggagacagccaaattctagaacagatggctactacagagcagaactaatgacagatacagaaatagactatataatataaacaatgagaattcataaggagatattattagagcacaaaaaatgctgccagaacagaaaaatgcttgattttttttattgttttgttgttcctggatcctaagagaaactccaaatgctcaactttttccatttaaaaatttagtagaggtactgtataaaagaacggtccccactaaaaaccaaattactattttaggaagataaaatgaaagacgtatcccacagcacaagataaaaagttaatgaactaagaatcacgagttaaggatcaagatatggagggtggatgcaggaggatgcatcctatgtaaataataggagttgagggagaaaacaaaagtatgagagaataaaaaaagaaatgccaaagaaacaaaaccaatcgagtcttaagattgaaagggttctgaaaatgctgaatttagacacatccttacaaagctgctgaatttccagaatagggaggaaaatcatataagcttccagacaggaagaacacattgcttttagaaataaccagtctaggggccgggcgcggtggctcatgcctgtaatcccagcactttgggaggctgaggtgggcagatcacttgaggtcaggagttccagaccagcctggccaacatggtgaaacccatctctactaaaaatacaaaaattagtgaggtgtggtggtgcaggcctgtaatcccagctactcaggaggatgaggcaggagaatcgcttgaacccaggaggcagaggttgcagtgagtaaagattgcaccactgcactccagcctgggtgacagagagagactccatctcaaaaaaaaaaaaaaaaaccaaaaataaataaccagtctaatatcacatttctcacctgcaatcatggaaagtaatagatcatgggctaacatttagtggctagggagaagaaagaactgatgaggaatcctccaccaggcaactacagagaaatcaatgattggacctgcagtcaggaaacacagcttctctgcatactctctgtgaatactccaggatacgctaccaaagagccagatcagaacaagggtccaagggagaagacagagtgcagtgatcaacagtgagagtgaatctcgtaatatttatttttaaatcttcatgcacaatggtaacgtcaatgcaagttataacacaatttttcttgaggattcttgaaatgaaataatgaaaattttagttagatcctagccccaatctcagcatactccaggaataaggagaagacaagggcgaaggagtgaaaagaaacatgattcccagggtttctcctccaggtgggatgagatgaagaggacactgaaaatattcaggcagaagggtgtgctggtaattaagctacgttttctcaatttcaaatccactgctccctgacgctggagtgggggctctttaagctgtggttttcttttgttagatggtgttctattgggttcttccagtaagaggcaatggagggagcctgaaaagtggggagaggagatgaacttgcttcttccttttctcttgctctccatgtcagtaccagcctggcagtacccctgccctgggcttcaacctctctcaggacttccaaaccagctttcttgtgctctctcagaagtatgaacaatagcaaagcacttccctgcagatatgaaaaagactgaaagagaatactatatacagcctttcccaaaacatttgaaaaacagagaaagtgggcaaattcctagaaaaacacaaccaagaaaaactgatgcaagaagaatcacaaagtttgaataattctaggagcttctgaatctggaattccaaacttcccttcccagaaaacttcaggccaagatgacttcactagtaaattccactgaacatttgaagaagaaataacaccagccttaaataaatgtttccagaaaagcaaaagagggactaatccccattgtgtcttatgaaggaagtttaacctccatataaaatctgtcaaggacattttgaaaaatgaagatgaaagaccaatctctctcatgaatatacgataaaaaaatcccaaacaaaacattaacaaacagaatcaagagattcagcttgagcaagctgagttcagtcaaggaaataaggttggttcaacattcaaaaaccaatcaagataattcaccatattaacagaataagggagttctctcatatggtcttcccccaaaaaagaaaagtcatatgataaaattcagcatttattcatgattttttttaaactaacaaaacaaaatttagcaggctagaaatagaaaggaacttaaacaatcactacaacaacttccattaaacatcatatgtaaaataatgagaatgttgcctcaaagataagaaataacaaagaaagctgccatcatcacttcatcattttactggaagtctcagtcagtgcaatcagaaaaaagaaataaaagttacaagattggggaaaaaccccaagttatcttattttcaaatgatgtgattctacatgcagaaaattcaaaagaatgtaaagataagttaatagactcactgaatttatcaaagtagctcgatataaggttaatagacatacatcagctttatttctattttccaataacaaaatagaatgaaaataacagcatatgtggtacattttcccaaagatggatgcaacgcaatctcccccctacatgcccttttgtaccaaaatgtgggtggctgaaccttccatcaagggacagggactatctgtccaccctctcaaatgtgaactccttttgtggcctgctttgaacaatggaatgcggcggtagtgacactgtctgagtcctggagccccggcctcggaggctgacacctctacttctgtcctctggccacggtccccactgtagtgctctccttgcacggacagagctcagcccatgccactgactagggatgacaggaaaggctcagcagccagcatcaaagttccaaatagaagagtgaggccgtttagaccattatgtaattgagtgtcctgtttttaaaaagtatttcttctttctccttcctgcctgttccttgtcttgcccttagcatgagataatagtctttgctctccctccttctaccaggaactccctggcacaatgtttccctcatctaattatgtttttgtttagaagttccagagactaaatcttgaaacaattcgggccactatgggattctccctgacctgcagattacttccaagctgcagttaatttgcaactgggctgtacccaagatggcaccagcccattcaccagatggggcaataacgcaagatagtcataggaacaagtcatgtagactggcacctcctcatcactcctgcatgcccctcataccaaacaccctttttaagcccttaaccttgacccaaaaagctgaaatggtttctttcaggcactatccgcggccatttccccatggaatggggaagaaagcttttgggataaagtcactttcctttcactgtattgcatccttgttctcggctttgcaagcagcaaatagccgtgcctgcattcggttacaattggattgctccagctacactgcaatcacagaagaaagtttaggcaagaccagcaaaaaaaaaaaaaagaaaaaaaaaaaaagaaaacccatggaatcctgaggaatgataaaactattgttgttttaagccattaccttttgaggtggcttgtggcacagcaatagataaccaaaacaccatactcaatcacaataccacacacacatttattttgtttaaagtagaaatatatctaatgagagatatgcagtgcctctactcagaacattataaaacaatattgagataaattacgtgagacccaaatacatgttcatagcagacatgctacggtaaagatatcaatattccccatattcatcaaaagcttcaatataatcccattaaaaattccagcagggtttctttatacaatttgaccaatttactaaaaagctcatgtgaaaatgcaaatggccctgaatagcaaaacaagtctgaacaacaaaatgctgatgttatagataccaagtcttatttataaatctatagttattaagacaatctggtattaatgcaagtatagacaaaaagaccaacaagatcgaacagagaatccagaaagtgacccacggttaggaggacactcattcgtcacagagatggcactgcacagctgtggggaagggactgtcttttgaataaatagcccaggatcaattggatattcatacagaaaaatgaaattacattttttaaacaaaaatttactttcggtaaactgtagttctaaatataggtgggaaaataaagctatttgatgataacaggagaaaaactctgtgaccctgaggtaggaaaaatattttttaaatcaagacaccaaaaagaccactgaaaaggcaagcctctgaaagcaagaaacacatactgttctgtatgcatatttgtatacgtgcgtgtgtgcatatacagtcatgtgccacacaatgctgttttaggcaagtctgggccacgtatgtcacagtggtctcgtttgactgtaacgcccagcacagtgctcctgctcctgtttccccatcatcaccaacacctggtgttgtcagggcctctacactggctgttctctctgcctggaaagttcttcccacatggctcactcccttgcctccttcaggtccccagcaatggtgagatcttccctcataactctatattaagtgtagtaattaacggtacaatatttctactgtaccttttctgtgtttaggtatgtttagaagcacatatgctcaccactgtgttacagtcacctatagtattcagcacagtaacgtgctgtacaggtttatggtccaggagcaatgggctgtaccctatagcctataggtgtgtagtaagctgtaccctcatctaggcttgagtaagtactctctatgatgtctacacaacatgcatttcccagaacacctttgtcattaagcacataacacataactatatatgtacatgtgtatgtatgtacatacatatatgtatatatccgcccaacaaatcacaaataactcaatgacgggatcatttccagaacatacaaaataaataagaaaaatgggcggggtgcagaggctcacgcctgtaattccagaactttggaaggctgtgggcagattgcttaagctcaggagttagagaccagcctgggcaacgtggcaaaaccctgtctctacaaaaaattagaagaaattagctgggtgtggtggtgtatgcctgcagtcccagctactctgaaggctgaggtgggaggattgcttgagcctaggaggcagaggttgcagcgagccaagatcacgccactgcactccagcctgggtgacagagggagaccctgtctcaaaaaaaaaaaaaagaaaaagaaaagaaaaatgcacataacacaatggaacataagggcttcaagaaaaagagcatctaaatgtcaagtaagcatgaaaaggcactctaccttattagcaatcaaggagatgcagaacaaaactgtaatgagacaccatgactcaccaccctatggctaagatgaaaatgactgacaacatcaagtgcgggtgataatggggaaaaacaggaacattggtggggtaatgtaagctggaccaaccactgtggaaaatgatctggcattatctactaaagttgaacctatgcaccccgaaatttcactcctagagagtgcacaaaaagatttgatatgaggcacggtgtggtggctcacgtctgtaatcccagcactttgggaggccgaggtgggtggatcacctggggtcaggagtttgagaccagcctgatcaacatggcaaaaccccatctctactaaaaatacaaaaattagccaggcatggtggtgcgcacctgtaaacccagctactcaggaggctgaggcaggagaatcactggaatccgggaggtggaggtttcagtgagccaagatcgcaccactgcactccagcctgggtgacagagtgagactccatctcaaaaaatatatatatacatatataagtgaaagttcacagcagcattatttgtaatagtcaccaaattgaaataatctaaatgtccatcaacaacaaaatgcataaataaaatgcaggatgtatacgacgaaacactgtacagcaataagaaggaggaactacggctaaatgcggcaacatgaatggatctcattccttcactgcttttgtggatctggccctggcctcccagggcacaggtaccagagggaccctcctgcaagtccctcctcacctcaccaccacaatggtcctcaaaaaagtcaaactctttaaaatcccccaccagtctgcacaccgggcagcccctgttgtctagcctcacctcctactttccctgagggcactctcccgagccataacttctcctcgcagtctgttccttgagtgtgccaggcgtgcttccacctcagggctctgcacgggttgtcctctctgcctggaaagttcttcccctgcagaatcacgcggctcactcccttgcctcctgcaggtcttggggaccatgagccctttcccatgactctatattcaggtatcaccccatgtccatactcccgaggttttgaacgagttttactttttcaccataacactcacctgcatctggtatatgatttatctgcccattctgtatgatcaatctccctgcacaagaatgcagctttgggagaatgagaattttgcctcttttgttcactgttatatccgtaggagccagagctcttctaacacacagaaggcgctcagtacaattctgttaaaagaatggccacataagaagacagaaacacaaatgctgactgatgctgtctgtgcttagacagagcttgtctatccgtgggcctcaccagtaggttcctctgcctgtgatttcctttctctaggccgtgaacttctatagaaaggactcttgcagctcctgccagggcattgttgagactagcagccagcactgtgggagccaaagggagtgaagctgaggaggccgatggagatgcggcctcatctcttcaaaggctctcacttaatcccaagtgacttaatcccagtgttcacagaacatccatgtgcccccctgcagttcctgcctcccttgcagctgggatgggccatgtgcctgagtctggtgaatggacatgtgagtagaaggggtgtgtcccctctggcctgaggtgctcaccatcaggtgcctcccccatccctttcttccccctagacagcaattctgggggccatggaaggggtctcattacctcccttcccacacagaggaaagctgccctgaagagctatccagtccatactatgcatttgtgactaagaaacaaacctttgctacgttaagccattgaaatttcaagggtttttttgttactgcagcatagactatctcatcctgacgatcttctgtcaggcacccccactcctgccttagctgtactagacatccttgtactctgatgtctctctggttcaacctctgtctgctactggggtcagatggacagttacaaagctgcacaggctccatttggggctctgagggggttgcctgcatatcacagactgtaaaccagtgctccttttgccccatccacattcctgccttcagagacatctggtgactctaattcctgagcccttgcagggccctgaggcacaaatcagcttgtttcttcctgccccaccctggacccccagctctcagcatggtggataagcagaaagaaatcgaagccaaccacacaatgatacacttctcgtgcttccaaaatgctgctgacattttccatctgttcatctcctctttgtgagtttgaatcttttttcttttattcttttattgtcattttaatggtgcttcaggagaaatagtgataaacaataactatttcgtgaatacctatttattttgaatattcattgtaaccactgctaagaacagcaaaacttttaggtttgcataggttttttttttcttccaagaagttcagagtacatttaaaatatcagttcaaagaacaaaaggaaaatattattattaccattttaaatcagataaagccctgtgaggtctgaaaaactgccccaccacccaatgtttgccaatgctgggacacaatccaggctcccatctcatgatctgattttctactagtggacactatcctgagtgctatcatttatatccatcttcccacctttcataggaattctatctgcataacccaaagaatacctgctggagactgacacttactgcaactttgccagcactttcatgttcttaacaaggcatttcaccagtttaactactgatcatcactgacaggcttcagtacataatttcatatatgaatcttcatccatctttttcttttcttttctttctctcttcctttctttccttctttttctctttcttcagtacataatttcatatatgaatctccttccttctttccttccttccttccttctttctttctttccttctttctttcttgtttttcatggagttttgctcttgttgcccaggatggagtacaatggcacggtcttagctcactgcaacctctgcctcctgggttcaggcaattctcctgcctcagcctcccgagtagctaggattacaggcacgtgccactacgcatggctaatttttgtatttttagtagagatggggtttcaccatgttgtccaggctggtcttgaactcctgacctcaggtgatctgccctgctcggcctcccaaagtgctgggattacaagcatgagccactgcgcccagcaatgcgttttcatatattccataaaacacagaagtgtgtactaagatcatgtatatgtatatggcttggaaaatttataaggtctccatctagaagctgtacatctttggttttaaaaggagagggctagagagaggataaatccaatcagttgcttctttcattcctcacttcttttctactgttaacatacgtggtcataaagaataccagatgcaggccaaatacatttgccatgagaaaaagataaaaatcaaaacttatggcttctcaatactgcttagtattaaagcacaatgctgcattctctactacagctgtgtagttacaagaatctatttgagtggccatgtgtcaaagataatggcacaaaaaggctgggtctatatggctcatggcccaacatccactgcttaacatgatgctttttctggattaagatcttcaagtcaggcaaaggctccggaggaggacagaaaaccaaagtgaagagatgcactaggtagggaggtttttgggttgtaagtgatagaaactcaactcccgttacctcaaacaaaaaggggaatttattgactctttttttttttgagacggagtctcgctctgtccccaggctggagtgcagtggcacaatctcggctcactgcaagctccacctcctgggttcacgccattctccctcagcctcctgagtagctgggactacaggcgcccgccaccatgcctggctaattttttgtattttttttttttttagtagagacagggtttcaccgttttagccaggatggtctcgatctcctgaccttgtgatccgcccgccttggcctcccaaagtgctgggattacaggcatgagccaccgcgcccggccaaatttattgactcttagaaccaggaagggttcccccaggtcccaggcagagagtggggatgcaagcaggcccagaagcaggtgtgagctgctgtgggcatcgctctgtccaggccgtcccctctgtccttggcttggctctaatcctgcagcatggcttacttcacactcggggaagcgtggaagttggccatgctgagcaactctcttaatggagagatggagtgtggggtccacaccctccacccccgctccactgcctgcacaccatgccaagtccaggtattctagggaatggaattctttggggttcgctgccatgcccaagacagtgccttcatgctgtcctcacagcgcatcctgcagtaactgtggggaaactgagggtggggggagattgtctgggaagaggagctgggcctacaattctgatgctccctgcagcctaacctccaccccccatgtcactgccaaggaatcttgcagcccagagcagacagcaagagcctctgcccactaggtctggtgctcagaagcaaagagggccctctggggggacagtcaacacaaggagacttagggtgggtatgggcagccagagccccagccccaggagctgggattagggcccaggaatgaggaaacagggaggggaaagcacattgaccaatcctggaagcagcgttattgaaaggttctggaaattcaaagaagcaggcaatgtgtgggcagactcccgttagtggccagagcccagaaggaaccaactttgccttcaacctcagcccactccctgctaacagagggagatggtgacgagtctgaggggcagaaggaggtccaggcatagaattgcacttgtcctgggtctctgcaggtcagcagtgggatgagtagggagacagcccgccctgggcctccacagtggggaaatgaggcaaacgtgtctcttttgctacaggaccaagtccactgtcctagaaaggtttagttgacaaaaaaggagacattcacacatttcctccagcagacccactcactgttatttgttacctgggaaaccaaacagccatatataaacaagggtaaatcttagaatcttggaaatgaaagtgccataatttccaggatgatattaaaacgccgtgactttctgaaaagggttccagcaacgtggttgacagaaaatattgtgctttcttttccacaaggagattgaatgtgtcttatttacagttacccagaaaacaatgatgaaagtagctaagtctgcattctagaggcacaggtcaaggtgtctgaggaacaatttggcatcttggaaagtgaagtcccgaggctgggaccctgtggggagccttcttcattgcaggctccaagccgccagtctcctgctgtagggagaaggctgtcggtgctgcaaggatggagggggatgtgcagagcccaggcactgagagaagcttcttagagccagaccatcgggagggagaaaacagggtgacaggggtcagttcatgaagacccttggattggatttcattccaagaacagtgaaaaacccatgtaaatcaggacttcgtgaatgtgcttattctaacttccagaggaaataatgaatgaactgtctactgaaaacccctgcctgtgctccatctgaaatgctgcctccctcaaagcatgaagctggagtcagcactgacgacgatgggcagctggagtgggagaagaggagtggcatggcctcagggagggccaggtccccctgcacctctttcccacttggtgtcccccacctggtcactcccaggaagccactgctgaattgacagccaggcctctactgagtcaagggcgacatctggagatgtagaatcagacataaaactcagcacagtactcatcccttatccttagggggatacatcctaagacccccagtggatacgtgaaactgcagatggtaccaaaccctacgcagcagtttttcctatacttacatacatatgatacagtttataaattaagcaaataagagaataacaatagctattgataaaacagaacaattataacaatatgccagtaaaactactcttgtgttttgccaccattaagtaatatgagggttccttgaacggaagcactgcgatgtatgtctgataaccatcctggctactaagtgacggccacgtggggagtgtggacagcctggagacgctggacaaagggatgaagaaagacagcaggagatttttatcctgcgactcagaacagtggatttaaaacttgtgagttgtctgtttctggaatattccatttagtatttgcagcccatggttgatcaaaggtaacagaaactgtggaaagtgaaaccttggggaagaggggactgctgtataaaaaactttgaaaccttttccatatgtgtgtgggctccatccaatcacgtgaaggcctcaagggaacaagactgacctcccctgagcaaggaggaattctgccagcagaagggctttggatcgaactgtaactcttccctgggtctccagtctgctggcctaccctgcaggtttccacaacaccatgagccaattcctgaaaacaatctctctctatgtatatatacacatcctgctgattctatttctctagagaatcccaattaatagaaacagtaatgtagaaaagagatgatggtggcttggatgagggggtagcagtggaggtgatgagaaatagttacattcagggtgatttgtaggatttcctgaaagtttggattataggattgagagaaacagaagggctaagaatgaatctacagaagggcaaatgtaagatgctatagaaggcagaattagacctattttaaaaaacacatgaaatcctcagaacaaatattggaaaaagagatcctttaaaaaattgttacaaaactacaaaataactaggcccaaaatcgacagaaaatattatgaacctaaagcaaagtaaaaactctgaaactctacagaaaatcataaaacttgatgttttttaaattaaacattacatatattgaatactataaagatgtcagttctactaaaataacatataaatccagtaatcctagttacagtaacaactggattgggatatgtattagttttctagggctgctgtaatcaagtaccacaaattgggtggtttaaaacaacagagcatccatcagggagagaattggtcaaatcagagctttctagaaaggccatcccttaagagcaggtctatctcagctctagagtaagggttactctaggccattggttggcaaactgtagcacatgggtcaaatgtggcctattgccctgttatcatatagcctgtgaactaagaatgacttttacattttaatgaagaaatatatgtcacagaccatctgtgacccataaaccctggtcctttacagtaagtttaccaacccctgctggaaacctaccataaaaaatcttaaaaacaaactcaaaagcaccaagctaatccacaaataaatgaactaactacctgccagaacaaaattcaacactctctgaagcgaacaaaatctaaaatccagacactcagccgtatcacatttacaatgtccagcatacgctcaaaacttaatagatgaattcactagagaataagtttcagacaaccaaaatgaccaaagagacactgacaaaagacatatggaaagctcacactggccaaacttagaacagtgtacgcatcatagggaataataattgcagggagtaaaacatgtctatgaagttcataatgatctttacaaaaacaccatttggccacttctagaggatgctcaaaaaccaatgtattctcctgatgacagataaagggaaataacaaagcacagtagataactagtaccatctctatatcaaataatcaaactaataaatgatgaggaaattgtagaattagaatatcatcagtttgcaaccttcagtgtattaatgaatccaggcatcacacattaaaagttgctaaaatcacagagaacaccagactttggcatgcctctttatgaatgaacagaatcccacctatcatcttaccaaagagaaagaactggagtctgatcaggcctctaaatcctgttgcttattaacaggaaatatacagaacacaggaacattttgaactgcagcaaaagtaggtaatcagtgaatccatgcggggtctacaggtgaaatgcttcggctcttgaacagctagactataaggaaaaatgacccattaagataaaaggagacaaaaagactttaaaaaaatccaacaaaacaaaactaaactgcagtgtctgaaggatgcacatttagtgttgaaacaataaaagaatctagcagctgaatgcacatggtttttaaacttgtggaacatggacaaaaattgaccacacatggggcagaaaagcaagcttcaacaaatgtcaaaagtttgaaacagaaaatgtatggtttctgacaaccgtataattaagctaggactatataacaaaaagatactagaaaacctatgttcacaaattaatatccttctaagtaacctatgaatcaaagaagaaataatcaatattagaaaataatttgaacggaatgatattaaaactaataggatacaagtcaagctgtgtttagagggaatttatagccctgagagcatttattagagaagtaaagctgaaaattaatgacctaagcattcatctcaagaatttagaaaaagaactgcaaattaaatcttcagaaaagagaaaaaaaaggaataataaagacagaaagcaatgaaataaaatttcaaaatacaataaaaagggaaaaacaattcattgataattaataaaactggcaaatctgaggtaagattgatgaagaaagcaaactgcaggcatagataactactatcagaaatggaaaggaggtatcacttctcctacaggcattagaaagctaataagaggatattatcaacaaatttataggaatacatttgaaaatttagataaaatggaggattgcttagaaaaatacaacccaccaaaactgacacaagaagaagaaatactgaatttgaatatattgtaactattaaagaaactgaatcataattcagcaccttccatgaaataaaatcctacagccagatgacttcaacagtgaattaattctaatgaccatttaaggaagagatactaccagtcttacatgaactcttccagaaaatagaaaaagaactattcactgtgttttctaaaggcagcataatcttagtaccaacctctgataagacctttcatgaaggaaaatgatatgaaccatctctctcatgaacataaatgcaaagatcctaaacaaaactttaacaaacgtgacttgaaagtgaaaaaaagaaaaaagaagagtaatgtccatggaaataaactagaagtacataaaaatgataacacaccatgaccacataaggttggatccaggaagcttggtctatccataacaggttgaagaaatattttatgattatgtgacagatgaagaaaattacagaactgtgttcaacaagtattcatgttaaaaaaactcttagcatacttggtttaggagttttggctacagcttactggtgtttaacaaactccttcggcctcagcagctgaaaaccactttcctatggtcatgaggtctgtgggtcaggaattctccaggcacagtggagatggcttgtgtctgctccatgatgtctgggcctctgctggaaagacgcagtggtggagatgaactgctgcctcttcagcgtcaccttttacctaccactcagccccaggtcacgtggctgcagcacactggcttcttgactgttccttcaactcaccagccaggctccagcatcacagaccttacttgctcttccttctgtctggggccttcttaactagacatccacctggctggacattcttctttctcaagtcacttctcagtgggatttctctggcctccctatgaaaaatcaaaatccccatcctgtgcccactgaccctctctggccccctttctgcctgtaattatcactttataatatataatatagttaacttatttaactatacttttattctatgtcttccctcatgaggatgtaagcttcatgaggcaggtatattttgtctaattttattcattgctgtatccccagagcctagtatataataaagcacacaaacattagctgttgattaaatggatgggtaggtagatggatgagtaggtgggggatggatggatggatgaatggatgggtggatgggtaggtgaatggatgagtaggtgggtgggtgggtagatggatgggtgggtggatgaatggatggatggatggctaggtgggtgggtggatggatggatgtgtggatggatgtatgggtgaatgggtagatagatggatagatgaatgggtaggtgggtggacagatggatgggtaaatgaatggatgggtgggtgagtggataaatggatgaatgggtaggtgagtaaatggatggataatggatggatggatggatggatggatggatggatggatgggtaggtaggtgggtgggtgggtgtacagatggataagtggatggagaaatggatggatggatggatggacggatgaatgggtagacagatgaatcggtaggtgggtagatggatggatggatggatggatggatggatggatgatggatggatgggtgggagggtgggtaaatgcatggatggatggatggatagatagatggataaatggatggatggatggatggatggatggatggatgagtggatgggatggatggatgttgaggcatggcatcaccaatggtagataatcactgggttaaaatggaatatatgttgctattaggaagaatgaattaaaactctatgtgttgttatgaacaattaccaagatttattatgagaaggaagcgaggtacagaacatagtcttttttttcttttgagatggagtctcgctctgtcagccaggccggagtgcagtggtgcgatctcggctcactgcaacctccacctcccgggttcacaccattctcctgcctcagcctcccgagtagctgggactacaggcacctgccaccatgcccggctaattttttgtatttttagtagagacggggtttcaccatgttagccagacagtctcgatctcttgacctcgtgatctgcctgcctgggcctcccaaagtgctgggattacaggcatgagccactgtgcccgaacagaacatagtcttaatatgctccttttatttccatttaaaaaataatttctatacaggtaaatatgtgtggatatgcatcatcagtgttttctgaaagaagtaaaaaacactattcataatggaagttctagggagaaggactgaaatacaggtgggaaggatgccttacttttccatttagcacttttctgcaaagtttggattttctaaccatgctactcatatttttattttaaaatatcaacaggagttttttgacagtatgatcatggactatttaaaacagtttttctttacaattcttgctacctaaaataatacttgttataaaataaaaaataagggtaattttatttaacagaatcgagaaaagcaatgctagtttttaaggacttccttgaatcactgagaggtcttcttttgtcacataaggattagataatgttcaatattttctatctgctaaggcagaagtacttttacttatgcatgtccttagagttttcagtaacaaaaatttcagataatcagagcactttgttctctacaccgtctgcttttctgtgattttacggtaataggcagtataacagagttgacagaaaaacacttagtaaataaatatggtttaaaactttttatactaagttttatgtctgattctgtgtctccagatactacctttgactaaggagaggcatggttgtacgttcaatgatggctccctgggaatgacccaatggaagtagcattttggaaaccctggttctgtaatctgaacgttgtggcccatgagattaacatatagaaacctaattcccagtgtgatagtattaagaggtgaggtctttggaaagtgattaaatcatgagggcgtaaccttaatgaatggaattagtgtccttataaaagaggctccagagaacttcccagccccttccaccatgtgaggacacagcgaggaggtaccatctatgaagcagaaggtgagcccttgccagacaccaaatctgcttgtgccttcatgttggacttctaaccctcctgaactgtgagcaataaatgtctatggtttgtaagttacccagcctatggtattttgttatagcagcctgaacaaactaagacacccggggtctttgtttgttaactatgcatattgaagctctaaacccatgcccatttccctgtttttttcatttttgatgtttgctcagtttgtggcccattttcactcttcatcttcatattgcaaatatctgatatgacagtcgagtggaagcttctcttccaataagaccatgtaacaaaaatggaaaaccaaaactattctgaaaaaagccatttaaaaaatgcataccaagattttaaaaaaattcctgttaaatttatcatgagtccaagctgttcattcaacttatcgtcttggtatttgatacaaaaaatccccattcactgactttttaaaaagtagaatgatgctggtgagttaaggaggtatagagtcccatgttttaaaggaagatgcagctcactcacactgcagcaatatcctttgccggctgaagcaaaataaaaatcagttctactgaaagttgataaagtttaagtccattaacagcgagagtactttatattagatttgcaaatgaatgagaaattaatggagaaaagagctctcacaatagcttcaaaatgggcatatttataaccctattctgcttgccaaaaataattacatcccatttttttctgccaaccatttaaactcatttcatagaaaacggaaaaagagggttggtgcaaatgggatgtttcccgcaagaaagaagaacggttttggaacccttgagcaatttgcaaggcgtgtcaattttggaacgctctgtcttgaaatattcgctttttttatgtttatttgtttacctattgtttattctccaaatcaattacacaacatttatttccaaatgccacaataatggaagactggcatcacatttggaattgattctaatgctgcacagccgcctgctgaggatcctgatccggttcatgagctgaggctgatcccagcgaccccagacctgaccaactctgcattacccagggaggagcaggccagtctgagcagactcaaaggggccgcttctactcggagccactttgcatccactccaccctaagcttctaagatacttcggagcccacacgacactccttcacaggggctgggtggcctggcctgccacttgaaatatggggctgctggcacctgctgtatccttctcagccccaggcatagctgctgaaaaggtgacaggaagagtctattttcatgtcatcacttagtttgtatttgtttgcagctatttcagccttttacatttgtattatgcattctgaacaagttgctatttgttttcttagttgatgtagtcagctgcacagaaatgcttaatgcttttctcagatgattccaaccaaactgactttgatttcagacagatagcccatggccatgctgacacataaaaccaaccatgacactgggttttttttcagccttttattttttttttaggtttagggacacatgttataggggtactttttttaggtttaggggtacactgtcatagagctaaatggcatgttgttgggggttgttgtgcaggttattttgtcacccaggtgattaagcacagtacccgacaggtagtgttttgatcctaacccccctcccccaccctccaccctgaagtaggccccagtgtctattactcccttctttgtgtccatgtgtacccaatgtttagctcccatttataagtgagaacatgtggtatttggttttctgttcttgcattaatttgcttaggataatggcctccagttccatctatgttgctgcaaaggacatgatctcattctttcttacggctgcatagtattccatggtttatatgtaccacattttctttcttttttctttatttttgagatggagtctcactctgtcacccaggccggaatgcagtggcgtgatctcggctcactgcaacctccacctcccaggttcaggcgattctcttgcctcagcctcccaagtagctgggactacagacagctgccaccatgccctgctaatttttgtgtatttttagtagagatggggtttcaccatgttggctaggctcatcttgaacctctgacctcgggtgatctgcctgctttggcctcccaaagtgctgggattacaggtgtgagccaccgcacccggctgtatggcattttctttatcaacactccactgaaaatattgaacagatcatcgaggcagaaaactaacaaagatatttgggacctgaacttgacacctgaccaaatggacctaacagacatctacagaactctccacccaaaattaagagaatgtacattcttctcatctgcacatggcacatactctaaaactgaccacacaatcagccatgaaacaattctcaacaaatgcaaaaaaactgaaatcatagccaccacactatcagaccacagtgcaataaaaatagaaattaacactaagaaaatcactcaaaaccatacgactacatggcaaacaaccatgacactgttacagccatcttacctgttccctccttcaagacctcccttgcagcctgctctcaactcaccaaccagagtgggcctttaaaaaattaagccaggcaatgacactctctgcttaacacctcccagtggctccctacagcacacagagtaaaaggcagaggacttagattgacttacaaggccctgcagtttccttccctctcccttcctctatgatcccctctctttcctccccactgctcacttccctctagccacagggcctcctggttgctcttagaactgtcagtcccactcagggcctccgtactgactattccctctgcctcagacattgcaaggcaaactccttcacctcctcactccctcacttggctcaagagtcacatgctcaatcagctctgctgtcaccatcctatttacaatgatagtttctgcccccatcactccctcagccaactgtaccacgttctactttctaacagacgttaccatttttagtctattactatatgccttcattaggatgtgagctccatgagggctgagatcttggtctgatttgttccctgatctatctcaaatcctcaaaacagtgttaatagttgaaaagcactcaataaatattggttgaatgaacaaataaagggcttatcaaatgcaaagataaatttttcatttaaattctctgccagaatttctggttccagaagatgggcagaggacaagtcatactggagcttgcacggcacaatgagttcagaagactattctgagtgagactggaagacaaatgagaattttgaactggggagtgacatgaggtgacttacaggtttttaaaagttcatcatggcttctgtgtggtgcacaggattcaaaggcaggagtagcgccagggagagtatttcagctgccttggtccagcaagagattaaagtggttcagaccagagaagctgtgctggaggtgatgagaagtggctggaccctggatatactacgaaggcagagctaacaggtcttgttgatgcactttgctgagagggagaggaagagagggagtggcgagagtcaagggtaactgttgaagttttggcctcagaaactgagtaaatggcagtatccattactgggacagaacagaggggagaagaacagacttgggagtggaatcaagaattctgctttggatgtgttaaaatggaaatgcctaccagacatccatatggaggtgctgactggccagttggatacatgagtctggagcccaaaaaagaagctgaactaaagatagtttttaaagccatgggtctggttgaaatcccattagagagagaagctggatagagaggaagactcggggcttcgtgctgaagcacttcccctttaggaagaaaagccagcaagaggggctaaagaagcagccagtgaggtagggaagggctgagcagctctaccgaactggaagccacatggagcatgtgtttcaaatgttgctgtggggtcaggtgagaagagtctaatcactgactgcgggatttggccatatgagggccttggggccccaggcagcgctgcgataccccagtgggttgttggtgatccttcaggatgggaagcagtgcccactggggcaagtagggtggtacaggctgactgtgggaggcgcagggctcagggaaacctgagcattcagcatagacaggaacctggagtcaggatgacaaggaaaatctcctgaattgggcacaaggatccttgggggggatgaggaagaggaattgagcatgctgcatttcctaaatgtggggcattggggtgcaaggcggtgcacctgaatatgaaaggaaatagccatcctataattccagaagcttgaagacaccaagagagttacactcacagagaagaaaaaggtttgcttttctcatggaaaaggttatatgtaacaagtttaggataccacatgacaatgtcttagttttaattaacttttataattcagcacatttttaaaagcacatacttgtatttctgataatgctatgccaggtttttacacttgtttcatattttttctcaagaggaagttatagtagtgtatctaagatatactgaaaaataattggtaattttttttttttttttttttttttttttttttttttttttttggagatagagtcttgctctgccacccaggctgcagtgcagtggtgtgatcacccaggctggagtgcagtggcgtgattacccaggctggagtgcagtggcgcgatctcagctcactgcaacttccgcctacctggttcaagtggttctccaacctcagcctcctgagtagctgggactacaggcgcatgccaccatgcctgactaattttttgtacattttagtagagacagggtttcgccatgttgcccaggctggtctcaatctcctgagatcaggcaatccaccctcctcggcctcccaaaatgctgggattacaggagtgagccactgcacccagctggcaaatattcttttttatttttaagttcatttgccaagaactcaattatttatagtggtacttctctctagctttctgtaactaaatgagaacattaatttcaaatgtatctctctactaaaatcatacagggtgttctatccttccttttatacaaaaaaaattgacaattatctgacgaaataggaaaatttgaacagccatgttttaaaagctgatcatgtcatgcttcagctaacataaaaaaaaaaaacctgaagtcaaaataaacgtttaaataacctgaacatgctgataattgacattgctttctatcataatcatcactttaacactgaaagatgaagaacttgctagtggtttaaggtagatcaggcattggatacagatccttcccattggtgtttactatccaactgcaagagatattggatgaaatatgaacatagcaaaacatttaaaaaggagaaattagatttagagaaaaaactaacttacctattgctatggactaaagtgtgccctctccattcatatgttgaagccttaaccaccaatgtgactatatttagagatagggtctttagtaggtacttcaggctaactaagatcacaagggtagggtcctgacccacaaggattggtggccttagaaaagaagaaagagacagagacctctctctctctacctgcacacacatggagaaaaggctatgtaaagacacagtgggaaggcggccgtctgcaagacaggaagcaagtcctcacgagaaccagaccatgctgccactttaatcttggactttccagcctccagaactgagaaaaactaaatttttgtgtttaatccacccagtttacattattttgttatgacaccccaagatgactaaaatacctattaatgagtttttaaaaaattattttagaagagaaacaatatgttgggttgtaatgtcaacaaataagtaataatgtgtttatatatttctatgatttttctgagagagaaaaattttaaattgagtaaatttctccccctaggatgcctgtctacagattacttcttccataaactctgacctcaacaattactcctaacaggaattcgaactgtcttgatgcttgaccagcctggccaacacagtgaaaccccgtctctactaaaaatacaaaaattagccgggtgtggtggctcacgcctgtaatctcagctaatcagcaggctgaggcaggagaattgcttaagccagggaggtggaggttgcagcaagtggagatcatgccactgcactccagcctggctgacagagactctgtctgaaaaaaaagaaaaaaggaaagcgtggtgacttgttttagacactttcactactgataatgacagttcacaggaccaggcaaagcagagactcggcacagtgccacagggagaccctgtcctgggcgccgagtggacctgcccctgagtcagctgcctccccttaccagcggtgcggccctagcgctcactgcatttcctcccacccctagtttcttcctcagcaacacagggataggagctcccttgcaggtgactggaggcagtgaatggtccacatatataaagcagctgcagtggtaccttgcacataacaggaattatttttagaatgacgttgaagatgttcagaatacccaaccccaacatatggagctctggcatactgttttcagttaaagacccttgaaaaacagcagaggcaagaaggacattctaatcaccccttttcttcctgaaaataggagataaacattgccatgtgaaagatgtcctccctcaccaggagaatgaaacattcttcgatggggaggaagagccaagagaccctgtgaaatgattcttactccttcagcctccccacacagtgtacctgtccccagctgcctctctttgtccatcttggtataaaagcatttgtgttttgctacttctctgggtcttcatttccttatgagggctcctgagtcacataaaacatatataaattggtgtgctttttcctattaatctgtcttgtgtcaatttaattcacaggcccagctgaaaaccctaggagattagaggtgaaattctgtctcccctataattgaatgtattataacacaaaaatatactcagaaagaagtcattaatttgagtatagtgataatgatagctatcagagtaatcccttttaaaatagtttcagttcctgtaataccaaggcccactcacatgttgtagtattgttaccactgtcgcggtaattagtttccatgacacaaaatcacctcacttgctttcccacagaggcagcaatatgctaaaagagcagactctagaccaggtctcccggggtccaagtcaagtgtgtgttgatgaccttccctgaaccctggctttcttctctatagaaagtgctcagtgggccaagcacggtggctcacgcatgtaattccagcactttgggaggacaaggcaggtggatcacttgaggtcaggagtttgagaccagcatggccagcacggccgacatggcaaaaccccgtttctactaaaaatacaaaaaattagtcgtgtgtggtgctggcatctgtaatctcagctacttgggaggctgatgcaggagaattactcgaacccgggaggcagaggttgcagtgagctgagatcatgccactgcactccagcctgggagacagagtaagactctgtctcaaaaaaaaaaaaaaagtgctcagtggtaatgcctatcccataggacgactgtgagattttgaacaataacatatgtcatgcctgtgcttgaagcctggcatgcatggccctcaggaaatgtgtacactgacctgggcataggactgagactgtcagagggaaacacggggcctgggagtagaccctgcatgctccgagggtctgcttccatgtgacgtggactgaaggtccctctcctgattcttcatgagatgagccagacaaacatcttatgagtgtcaccagcagcaatcaagacaggaagaaaggggcatcatgtcctgtcatgaactagaaagggggggcaggacagaaataagtggagaaaaggagatcctgaaggttccatgtcctccccagccctcacctatgtgagcacaggtgagcagacagaagctgagaattcgcactaataccttcaagtctggggtgatggggtctgagttgggtgcaggtagttctaggacaattttttaaaatctctttaaaacagaagctcctacgcagcaactcaggagctcaaccaagaaagaaagggccaggactgagggacggatgacgctcactggagcagaactgccctggctcggtcaaggggacatctctagggaggtcctcagagggaagagcaagaacccaagacctagcaaggatgtgctcagcccctgggggatctccccaccctgtcctaagttagacagtcaaggccaaaggcaacatccatgtctgaaatggagcctctgacaggagaagagaaactggccctggtgggtctgaaggctgtcggggcagggaagaattgtccgggccaagcccaggagcacaaggagagtgggtacatcaaggtgcatggaagcacaccacagcttatttggcaaacagaaggtcagcagaaacagagcttgaaaatggggaaagaaacatcaacccagacgccaaagctccccacaagaacttcatggaacctaatacacacataaacttaacaaaggaaggactcaaagtgagaaaaacaagactatgatgaaaagaaagctagagacagaactaaggaaaccaattacagcgtgagaattaaaaccccatcactgcaaatctagtaaataatttagaaacagcaaggaacagagtagacatgagtgaaaattcaagataatggcatgggggaaggtgtgagatctccacagtaattttgtagaagaaggaagagacaaattacaatgaagaggacccgtaaggagattgggaatttttttttttaactctagaaacaaatgtgctttgtgatgagagacctgtaatctaaaatttagtattctctcttcagtttcatttcaattctcctgttaatttcaaacaaagacaattttttaaaacatacacattattcttccatagcttgtgtcttgtatcattatatgatcgatagatttctgaatttatgaccacataacagtctgatcgtttctggatggtatacttctgggtaattcattgcctttgctgttgtacttttctgtatttgcttaaataatttatgagagacatgcattgttttttatttttaaaagtataatcttggccagatatggtggctcacacgggtaatcccaacattttgggagggcgaggtgggcggatcacttgagatcaggagttccagcccagcctggccaacatggcgaaaccctgtctctactaaaaatacaaaaattagcagggtgtggtggtgcacatctgtaatcccagctactcaggaggctgaggcaggagagtcgctacaacctgggtggtagaggttgcagtgagctgagatcgtgccactgcactccagcctgggtgaccgagtgagactccatcccccccccaaaaaaaagtatgatctttaaagggaagaaaatccactcaacattctttcaataagtagatattacacactatattgtaggcactgggattatgagctaggccaagaccttgcccagcttccagataaagtcatggaggttatagattcaggaagacaaacattactccaaatacagttcattccagaaatgcaagagtgattcagcattagcatatagtccatcctgttaacagagctaaagagaaaaattatatgatcatctctacagatgcaccaaaggtatgtgaaaaaatcagcattcattcctatgagaaacaacaaaacagaaactgagggataggataaagtcatgcctaacaagatagaaaatacatatttatgcaacacatacctaacctcaaaagccagcatcttaattaacaaagaaaaactaacttttcctgctacagtctggaacaagacaagcactcactctttaacactgggtctgaagtattagcccatgtacttagacaagagaaatcaactgtagaaataacattcatgaaagaagaagttaaaattatctttatttgcagagcatatgtttatgtactcacatgtggaaaaacaaaagaatccccacaaaacaagcaccaaaaaaaaaaaagaaagaaaatctaataagaaagctggttgtataataaatataggcataccttgttttattgttcttcactttatcatgcttcacagatgttgagtttttttacggattgaaggtttgtggcagccctatattgagtaagtctatgagcaacatttttccaacatcatgtgcttactttgtctctgagtcatattttggtaattctcagtacatttcaaactttttcattattactatatctgatatagtggcctgtgatcagtgacccttgaagatactattataattgttttggggctccatgaactgtgcccatataaggcagtgaacttaactgagaaatgcatgtgttctgattgcttcataggctggccgttcccctgcctatctgttccctgagacacaacaatattgaaattaagccaattaataactctacaatggtctctaaatgttcaagtgaaaggaagggtcacacgtttctcattttaaatccaaagctagaagtgattaagcttagtgaggaaggcatgttaaaagacaagagcagccaaaagctaggcctcttgcaccagttagcaagttgtgaatgcaaaggaaaagttctcgaaggaaattaaaagtgctactccagtgaacacacgaatgatcaagaaaacagccttatcgctgatttggagaaactatgagtggtctaacagaagatcaaaccagacacaacattcccttaagccaaaatctgatccacagcaaggcccgaactctcttcagttcaattcaatgaggatgagagaggtgaggaagctgcagatgagaatttgaagctaacagaggttggttcctgaagtttaagaagctgaggcagcaaatgctgataacctgcaagtccagaagatccagctaagataactgatgaaggtggatacatgaaacaacagattttcagtgtagacaaaacagccttatactggaagaagatgccatctaggactttcatagctaaagagggaaagatgacgcctggcttcaaagcttcaaaggacagactgactctcttgctaggagctaatgcagctggtcacttaaagttgaagccaatactcaaccattctgaaagtcccatggcccttaagaattatgctaaatctatttcacctgtgcactagaactagcccaacaaagcctggatgacaacatatctgtttaaagcatggtttacttaatatttcaagcccactattgagacctaacgctcagaaaaaaaatatgcctttcaaagtattactgtttattgacaatacacctaagagccctgatggagatgtacaagaaggttaatgtcatttttctgccagccaatacatctactctgcagcccacgggtcagggagtaactcactttcaagtcttattatttaagaaatgcatttcacaaagctagagatgccatacatagtgatcctgtaataaatctgggtggagtaaattgacaaccttctggaaaggattcaccattctaggtgccattaagaacatttgtgattcatgggaggaggtcaaaatagctacattaacaggagtttggaagaagttgattccaatcctcacaggtgaccttgaggttttcaaaatttccgtggaggaagtaatcacagatgtggtaggaacagcaggagaattagaattagaagtggagcctaaagatgtggctaaattgttgcaatctcatgagaaaactttaatggacaagcagctgcttcttatggatgagcaaagaaagttgtttcttgagatggaatctactcttggtgaagatactgcagacattattgaaatgacaacaaagggtttagaatatgatataaacttagttcataaagcagcagcagggttagaggactgactcaaattttgaaaaaagctctactgtgggtaaaacgctatcaaacagcattgcatgctacggacaaatcttttgtaaaaggaagagccaatcaatgcagcaaacttcatcactgtcttattttcagaaattgccacagccaccccaaccttcagcaaccaccaccaattagtcagcagccatcagcatctaggcaagaccctccaccagcaaacagatgacaacttgctgaaggctcagatgactgttagcatttttgagcaataaagtatttttaatcaaggtatatgtataatttttttagacatatgctgtggcacacttaataggcaacagtataatgtaatcatagttttatatgtactgggaaactaaaaaattggtgacttgctttattgtgatattcgctttattgcactggtctggaactaaacctgcaatatctctgaattatgtctgtatacaaaaatcaataatgtttatccataacatagataaacagttagaaaatgtaatagaaggccaggtgcagtggctaatgtctgtaatcccagcactttgggaggccgaggcgggtggatcgcttgagctcaggagtttgagacgatcctgggcaacatggtgaaaccccgcctctaccaaaaatacaaaaattagccaggtgtggtggtgcacacctgtagtcccagctacttgggaggctgaggcaggagaattgtttgagcctggcaggcggaggttgcagtgagccgagatcgtgccactgcactccagcctggtgacagagcgagactttgtctcaaaaaagaaagaaaatggtgacatgcttgtgaaagtaaagagtattttgaataaatggaaagaaatatattcttggataagaagatacaacagcaaagagatgttaattctcctaaagttaatctataaatttaatgccatattgattaaaaaaaatcatcattgtctcctagaagctaggcaaactgattatatagttcttggaagaacaactaagcaagaatcacaaaggaaactccataaaagatcaataaggaaggctagcccttccagatattaaaatgtatttaaagcccccctcttggccgatgaattgacagaccaataaaataaaacggaaatatccagaaacaaacacatttgtctatggtaatttagtatatgacaaaggggtcatttaaaataattgagggaaacatacacttttcataagtagtactgataaatccagatgggatggccatatggaaaaagaaaaatacacatctgtttctcaccagttatatcagaactgattccaaatagattagaaacttaaatggagacagagagaccccactttaagtattagaaaaaaacatggaattcctctctaaccggaaagttgagaaatatttcctataactcacagtccaaagtaataagggaaaaactgatgaacttaactacataaaatacaaatctttacatatgaatactaccagaagcaaataaaaaagacaaatgaaagacaaatgataaaccgcattatgcagtaaacaggaataagaaatgtctttatacactgctacagactgaccccacgcgatatcactaagttataaaaccaaaggctggaacaatgtgcaaggtaggcacacgtacatgcagtatgtgtacagcacatgtgcttgcttataatttagaaatgaaaggacaaagcgaaaatctaagagtagttactatagggccggggggtggggagacaaggaatacaaacaggacagaaatgataactagaattttcaggggaaaacactttactgcatagatttgactttgtaacagtaaatgtcttatataattatgaaacaaaattaaatcaaaaattaattaaaatccctaaaatcaaaagcaaaatgaaataagtgaaccagtaaaacgggcaggtgccttaaccacagagagcggtttaaactgactgtaacatatcaccatttaattgtatatctcaagtggtttatttcctgaaggataatcaagagacatgggagctctggtggcctctgctcactggggccagcaagggaaaataaagaagagagacagagagacttaagagacctaacaacccaatgcaaaaagagagaaacaggcacacagaaatttgaacatgaggtatttgatgataaaccaaattattggtatctattagttgtgatcacggcattgtgactatatcattttaaaaataaaaaataagggccaccttctcttttagaggtaggcatgtatgtattttgacacaaaataatgtgatgtctcaggcttgctttcttcatccaagggagaagtggtggggtactgatgacgcaagaatgtccaggagtggctggcagctatagctgagtaatggatgcatagggttcaatatgtcattctctttacttgtgtatatagttgagatatccacaatgtaaatgtcgaaaaatatgaaaatatgggttcagataataactctgctacttagtcacacagccagtttgtaaaaatttcctatgttttgggaacctgaattccttccttttaaaaagaagacacataaacctaagttacaagacaaattagtatatgataaagaggtcacttaaaatcactgggggaaacaaatattacaaatttgttttattacatattacaaagcctgtcatatagcagaactaaacaaaggccagttattttttattttggtatgaatttaactatgccaaattactaaaaatattttcctaaacatcacatcaaagtaagatttcacatggagttttaaagaggaaataaagaatgaagccttttggttttataattacacaaaatagcaatactagaatagaactaaatttatgcccaaatgtattcctcaattagtgcccaattcaaataccagatacaatgatgttattctgagtaacacccataaaactacatataactattaccataaataacatttaatttgtgggaccgcagttgctaagcctgctgtacctaaaactttgctgacatattctgcctactgtttcataaaaaacacacagtaatcagattaggtcaattagaaagctacaggcaaaacattgttccctttcaaatgtcctggtaaatagaataattttaaaatgaagaaatatttgaatcaaaatagtcaggaacagacctcaaagcattaaagaactagatctttatactctcgagagttgcattcaaagactcaatcaaattcaagttcatcacatatgcaaaacggaacacgaatctcccattaaaattatcataactgctggcttattaaaatgcttgagtgcattagacatagcatagaaaaattcaatataatatcactccaataatgtttctatattaatctagaaaacatggggaatggccctaaagcaaaaagtgctgctacaggctcatgcagaattgaacttatggctgttgaggccaacccacctcaaagaggcaaaaactgtcacagcagcaagatccagaggccttcatccgacccgggtgggatgaagagaagaattctcagcactgacccacagaaggaggcgggaggctgtggtgagatgaacagactagcgcccactctggctagctctcaaggtgagatgagggtgtggcttttgcacggtggcaatgtcgatgattttgaaacctcatgacagtgtttctgaatgtccaccgaaacatggctctcacaggcaacaaaacactcctgattagaggtgtaaattttccgcgtttccagagagctcttcatatgttgatggaaaattcccagcaacaaacttgaaggagtaattgcaggcaggccgtgttttattgcacttcgttgcattgcactgcacagatactgcgttgttgataaattgaaggtttgtggcaaccctgcaaggtgcaagtctatcagcatcatttttctcacagcgtgtgctcacttcatgtctctctgtcggtatattttagcaatgaagtatttttaaattaaggtatgtacacttttttttttgttttttgttttttgagacggagttttgctcagtcacccaggctggagtgcagtgtcgcgatctcagctcactgcaagctccgcctcctgggttcacgccattctcctgcctcagcctcccgagtagctgggactacaggcgcctgccagcacacctggctaattttttgtatttttagtagagacggggtttcaccgtgttagccaggatggtctcgatctcctgacctcgtgatccgcccacctcggcctcccaaagtgctgagattaagggtgtgagccaccacgcccggccaaattaaggtatgtacactttttaaagatacaatgctactgcacacctactagactacagcttagtgtaatcgtaactttgatatgctctgggaaaccaaaggatgtgtgtgacttgctttattgtgataaccgtcttattgcaatagtctgcaacagaacccacaagctctccaaggtaggcttatacattttcctattggttggcttagtgcaaaagatgaacccaaactggcaaagattaggtagaaaccagtttctgcaaactgaatgctccctttctccaggaacatctaccatcacatagccatttcctctacaaaactgttaccaaagagaagccaatttgtttacagtcatatgtaaaattaaaagcaacgattaactgtataccacctaaagtacctactctattcaaaacaaagctatgaaaagtaagaacatctcattttgccatctgcactgcatactcaaaccaaggcagagccctgagaggaagtgccagggagaccctcacaaccgccatgggtactgaagacacgagaaatagttaatggcaggccacttcttacttcacttcagatgaacggaaatctgaaggcttccatgttctataaactcttgggttttcacattagagaccagtggagagaaagagaaagtgcaagccagacccctgctttaaagcactgaccattcttttggaacaagaagctcagacagccccagtttcctctgaagtagcacaagtcaatgcaggctgagtgaacagaggtcctgggttgttcaagtgccatctaattccctattgaaattcactgctgccatcagtccaatggcagagcatctgtgcccctggactagggaagcggagatgcccagatttctgacacataaaccactgggtgagaaattcatctggaataacaaatttatctttaaaaagccaaacaaggacatccagtttcagttccaacacgtaaaaagcttggagttgtcactcccatccttatgataagaaaaaagctgaacaaacagaaactcagcaacctttcttggacccctcagagagctgaggttgcagaacaaactgccactgggaaatctgaagagatgggaatgcacagggtcccggctgagatctgctcacctagagatgctgctgggccagcccccagttggagcctccaaacgttaattctgacaaattgctggaggctgagggtggaccagcctccaagtgagactgctggggctgcagttttagggggacaccctacacttttgtgtgttttgcctctgagaacatcaccagattctcagggttaagagccctgatggctgtagcaggggagggaaaggctagtcctagtgacaaatgaacagaaccttctccataacaaaggcctgctctccaacacagtattccatctgggggaaggcgttttcctgaccccatgcccgtgcagccttcctgtctcacctaaggcaggaataaaaggctagaaacgcttgttaaggtgatagcccagagatacaggcccactaaaagactgaaatttcatcatcagagtaaaacacaccacacacacaccttcccaccacagcaacagggctgcagtataactaccacaaattacagttgaaggagctgctagacacaagaaagcattcttagggaaatccaaagacaagaaaaggacaaaaacaagagaaataggtgaatttgaaccctctggcacctacagctacagcaaatattaagagcctaataacagccatattaatataaaacctcacaggtaaggcctgtttcctttaattcttattatctgatacactatatttggttttcagcaaaaaattagaaggcatggtaaaaggcaaggaaaaaagtctgaggagacagagcaagcaacagaaccagactgagacacagcagagaatttggaaggactaaatggggtatttaaaaccactgtgatgaatatgctaagggctgcaatgggaaaaatggacaaatatgcaagaacagatgggtggtataagcagagatggaacgtctgagaaaaaatcaaagaaaatgctagaaatcaaaaacactgtaacagaaatgaaaattgcctttgatgggctcataagtagaccagacacagctgaggaaagaaacagtgagcttgaagataggtcaacacaaatgtcccaaactaaagtgcaagaaagaatgagaaaaaataaaaataaaataaccaccataaaacactcaagaacagttgtataatttcagaaagtgtaatatatgtataacaggaatattaaaaggcaaaaagagaatggaatagatgacacatctaaagtaatataaactgataaactttccaaatgtaatttaataatgataaattaaattacatttattttatttaataaaataagctgatagctttccaaacagaccccaaaccagagatcaaagaagcttggagaacccaaacaggataactatcaaaaactctacgctgaggcatctcattcaaagtgcagaaagccaaagtccaagagaagatctagaaagaaaccagagaaaaaaataacaccttaccatagatgaacaaatataagaattacagtcgatttatcatcaaaaggcaagcatgaagagcgtggagtatttaaagtgatgaaagaagaaatcccaccaacctagacatgtatatccagcaaaattatcccataaaagtgaaaaagaggctgggcgcggtggctcatgcctgtaatcccagcactttgggaggccaaggcgggtggatcacaaggtcaggagttcgagaccagcctggccaagatggtggaatcccatctcaacaaacaaacaaaaaaattagctgggcatggtggcgggcacctataatcccaggtactcgggaggctgaggcaggagaattgcttgaacccaggaggtggaggttgcagtgagctgagatgatgccactgtactccagcctgggtgacaagagtgagactctgtctcaaaaaaaaaaaaagaaaaaaaaaagtgaaaaagaaataaagactttttcggagaaaggaaaatgcaggaaatgtgtcaccagcaaagtgacctgcaaaaaatgttaaaagtagttctttgcaatgagaacatatggacacagggaggggaacaacacacactggggcctgtttgggggagtgggcggggagggagagcattaggaaacatcactaatgaatgctgggcttaatacctaggtgatggattgataggtgcagcaaaccactatggcacacgtttacccatgtaaccaacctgcacatcctgcacatgtaccccagaactaaaaattaaaatttaaatttaaaaaaaaggagttctttgaagaaaggaaaatgaaataggtcagaaactcagatctacacaaggaaagaaaagagctttgaagaaggaataaatgaaggtaaaataaagtcttatttttcttatttttttaaaaatttgaatataaacttattttttaattgacaaacttatatatatgtattatgcacatcatgttgttttgaaatacgcatacattgttgaggggttaaactgagctaattaacacatgcactgcctcacatacttattttttgtgttaagaacacttaaaatatattctattggcaattttcaagaatacactacattgttattacctatagtcaccacattgtgcagtagatctcctgaacttatcccttttatctaagataaattttttatcccctgaccaacatctcctcaaccactcatatattttcttattcttaattgatctaaaagataactgtttgcttaaagtaatatgaaagaaaaataaatcccgggaccctaattcactatggcaaagggaaaaattaagttggaagctgagtcacacaagaagctgcctttccttttgttgcccagcagacagctaaagataaaaggccagacagaggccagctgtctccacgagtgctgctctgtgtttactttatcttgtgtaaagtgtcgacttgctgagcactagatgaatatataatcgattatttctatgtctcctccttttcacgtgcaacacgtggattcagtgatgtgaccacacccaccctccttcccttcctgcccacttttcccctttaaatactgaagacctcaaaatcctcttgggaaaaagtaagatcacagattgttcctgtggttttgtgttcctttttcccggatgcatccttaaccttggttaaataaacctctaaattgcttgagacctgtctcagatacctttcggtttacggtaataatagtcaacatctattgagtgattatagcatatggataaatgcaatgaatgatagcaatgtcataagaaatggaagaaggaaacagagaatactcatttataaggtacctgtgatactgtgaaatatttggtcttgacctctttttttggcaaacaattcctaaaatccttggaatccccaaagtccttttgctaatgatgctaatgttaactgacagcttcaggatggggttgctcactggaaagacagaggcaggattagagggttgggactttcagcccaatcccccaaccccagggagtggagagggcctgaaggctaagttgatcaccaatagccagtggtttaatcaatcatgcctacacaatgaagcctcgataaaaacccaagaggaccgggttcagagagcttcctgatagctgaacacacggaggttcctggagggtggcgtcctgaagtgggcatggaacccaagtacaccttcctcctatcttaccctatacatctcctcatcggtgtcctttctaatatcctttataacaaaccagtaaatgttaagtgtttccctgagttctgtgagctgctccagcaaattaatcaaacccaaagagaaggctgtgggaaccccaaatgaaagctgattggtcagaagtcctagaggcctggacttaggactagtgttgggagagggggcagccatgggttccaggctctgcaccagtgaggtctgaggttatttccaagtagaagatgttaaaattaaattagagaataagcatctggtggccactccctgctgtgtggggaaaacccccacaatttaggtcacagaaggttctgtgttgattatcgttgtgctgtgagagcagaggaaaaacacagtttgagaaattttttcccaaacagtacctattctagatatgaaccagtattgtgttatttgagagtgaatatagagtagttgaaaatgtagagtgaaaactctagggcaaccactaaaataatttgtaaaagaagtgtaattgatatgctaaaagaggagataaaatggattcattaaaaatgctctattcaaaccagaaagggcagggaaaaaaagggaaagaagtgaacaacaacaaaaaatgttacaaacatagtagaattttttttttttaatacagggtctcattctgtggcccaggctagagtgcagtggcacgatcattgttcactgcagccccaaccttcctgagctcaagtgaccttcccatcttagcctcctgagtagctgagactacaggcacacatctagctatttttttatttttattattattattttttagagcctggtcttgaactcttgggatcaagcaattggcctaccttggcctcccaaagtgctaggattacaggcatgagccactgtgcccaaccatgtagatatttttaactacatcaatccaactgtgcaataatcactttaaagtaaataacctaaatatcccaattaaaagacagaaactatcagagtagataaaataaaaagccaactatatgtagtctacaaaaaatccactttatatataaagactcagattagaagtgaagggatgaagaaagttatagtgtgctatgctaatcaaaaggaagttggagtaccaatattagtttcagagaaagcagactttaggacaagggaaattatcagaggtcaatacgagcatccatagtgatataaaggtcagtttccaagaagacataacaatccttaacatgtatgcacctaaaaacagagcgtcaaaatacatgaggcaaaaactgacagaactgaaaggaaaaatggacaaatgtactattatagttgaagacttcaacattttcttcttagtaattgatacatcatcaacatctatagactacatccaacaacagcagaatacacattcttctcaagctcacagggaacattcaccaagactgaccacattcttggccagagaacacacgtagacaaatttaaaagaactgaaatcatacaaagtatgctcttagaccacagtagaatgaaactagaaatcactaacagaaaaagatggaaattcccaaatacttggagattttaaaacacatttctaaatagcatatggttgaaagaagtctcaagtgaaatgaaaatatactttgaactaaatgaaaatgaaaatacaacttatcactattgtgtatagcaaaagccatactcaaggagaatttgcagcactaaatgcctataacagaaaagaagaaacgtttataaccaataatataagcgtgtaccttaggaaactagagagagaagagcaatccaagcataaagcaaacagaagaaagaaaatactaaaaattaaggcagaaatctgaatagaaaattgaaaaataatagagaaaattagactcagaaaaaaggatacacaaattattaatatcagaaataaattaagggattaccaatattaatccatggacattaaaatgataacaaaggaactctatacctctaaatttgacaaattagaaaaaggactaattccttgaaacatacaaatgaccaaaactcatacaaggagaactagatcgtctgaacaggtttaaagctactaaagaaactgaatcaataattaacgatattccaaaaaagaaagcagcaggcccaggtgatttcactgacgaatcctactaaacactgatggaaaaaatagtatcagttttctgcaatttcttctacaaaacagaagcagagggaacgcttcctaatttattctatgaggccagcattaccctaatgccaaaaccagatacatagagcataaaaaagggaaactacagaccaagatctctcatggacataaagttctcaacaaaatattagcaagactaaaaatgtatgaaaagaattatatacttcaacccaatgggatttattataagtatgcaagactggtacaatatttgaaaatcagtcaatgcaatataccacatcaacaggctaatgaggaaaaatcatatcacatcaattgatgcagaaaatgcatctggcaaaatctaacactcatttatgaaagaaaattctctacaaactaagaacaaagatgatcttcctcaacttgataaaaagtgtttataaaaagctaacatcacacctaataatgaaatactgcacactttcccccaaaaaagaacaaggcaaggatatcctctctcactacttctgttcaacatcatattagaagtcctagctagtgcaataagacaagaaaaggaaataaaaggtacatagattgaaaagtcagaaataaaactgtctttgttcataaatgatatgattgttcatgtacaaaatcccaaagaactgtcaagaaactctcaaactaataagctagcataggtcacaggatacaatattaatatacaaaagtcaattgctttcccatattccagcaatgaaaaattggaatttgaaatttaaaatgtaccattaaacactgcaccaagaaaacgaaatacttaggtataaatctgacaaaatatgtataagaactatatgtagaaaactagaaaactcaaatgaaagagttcaaagattacctaaataaatatagagatattccatgttcatggacagaaagacaatattgttaatatgtcaattcttctcaactagatctataaatccaatgcaaccctaatcaaaatccaaaaactattttgtagataaaagctgattctcaaacttatatgaagaggccaaagacctagaatagccaacaaaatgctaaaggagaagaaaaaagaagttgaagcactcacaatacccaatttaaagatttacaataaaaatagtataaacaagtcaacatggtattggcaaaagaacagacaaagagatcaatttaatggaattgagaacccagaaataaagcccataaatatagttaactgatctttgaaatatcaacaaagtcattcaatggaaaaaagagaagatttttcaacaaatggtgctggaaaaattggacatctatatgcaaaaaaaaagaaacctagacataaaacttacaccttactcaaaaaattatatcaaaagggatcatgcacctaaatgtaaaatgcagaactataaaagttctttaagaaaacacagaatatcttggtgatttggggtttggttcaaagacactgttaagagaagaaaaagagaagtcacagactgaaagaaaatatttgtaaaacacatatctgataaagaatttgtatccaaaatgtataaagaaaagtaaaactcaacaataagaaaacaaaatgtctaactttaaaagaaggtggctgggcgcggtggctcaagcctgtaatcccagcactttactttgggaggccgaggtgggaggatcacgagattaggaggttgagactatcctggctaacacagtgaaaccccgtctctactaaaaatacaaaaaaattagccaggtgtgctagcgggcgcctgtagtcccagctgctcaggaggctgaggcaggagaatggcgtgaacccgggaggtagagcttgcagtgagccgagattgcaacactgcagtccaggctgtgcgacagagcaagaccccatctcaaaaaaaaaaaaaaaagagggtaaagatctgaacaaacatcaccaaagaagatacaggaacagcaaataagcatatgacataatgttcaatatcatttgccagtaggggactgcaaattaaagcaacaataagataccattacatacctatcacaatggctaaaatccaaaaatggacagtatttgttgtcagttgctgatgaggatgcaattgctagtgaggatgcagaccaacaggaatttttatccattgcttataggaatgtaaaacagccacttaggaaaacagtttaaaagtttcttacaaaacgagacatagtcttattgtatgatccagcaatcatattcctaggtatttacataactgatttgaaaacacctgcatgtgattgtttatagcagctttatttttaattgccaaaaactgtaaacaagcaaggtatcttaaataggtgaatggataaacaaactgtggtacatctacataatgaaatgttatttggccataaaaataaatgaagaatccagccataaaacaatatggatgaatcttaatgcatattgctatgtgaaataagtgaatcttaaaaagtaacatattgcataattccaatgacatggcattctggaaagggcaaaacggtagtaatagtgaaaagatcagtaagagttcagggagagagggaaggattaaataagtgaagtccagagaatttttcagggtggtgaactatttttatgatatgtaattgtggatacatgactatgcatttgtcaaaacccattgaactgtacaggccaaagagctaatctgcagatatgctaacttttaaaaagtatttaaaaggtgggaggatctcaggatcctaattttgcaaaatgtgacaaaaaacaatctacgaaacaacctcactgaaaggggttggggggaaaaggtgctgacttaagtaactctgaaaatcatggagtctgtaatactaaaggccaaagaagctgtacatcagtgatgaactctagttgataaatttgtttcccaggtgggcagtggttaatagttctgataccactactcacgtattttgaaactgaccattaagtaaatggatggcagatggtgagaaccaggtttctcactgctggagtgggaacaggggaggaggctggactgatccacgctgtaaaggattggcattgaagacatcactatgaactcatgtttagcttaatagactattgatggttatatatagaaatagttacaggttacaggtatatacatgtgttggtatacactcatatacagtcgtcctcccttatatgtgtggaataccctattctaatacccctgtaggtgcctgaaaaaacagataatgctgaaccctatgtatactatgtgttttcctatacatacatacctttgataaaatttatcattaggcacagtaagagattaacaatgatccctaataataaaatagaacaactaggctgggcgcagtggctcacacctgtaaccccagcattttgggaggccgaggcgggtggatcacgaggtcaggggatcgagaccatcctggctaacatggtgaaaccccgtctctactaaaaaatacaaaaaattagccgggcatggtggcaggtgcctgtagtcccagctcctcgggaggctgaggcaggagaatggtgtgaacccaggaggcggaggttgcagtgagctgcgatcgcaccactgcactccagcctgggtgacagagcaaggctccgtctcaaaaaaaaaaaaaaaagtatgaattgttcatctctaaaatttgctatttaatatttttggaccatgattgaccgcacctaactgaaaccacggaaatgaaaactgcgaataaagaggaaccaatgtatttccttgttttgtcagctgagtgaacctagaagcaaaggcctctcccccacccagtaataacaagcacacctggcactgagattttggtttctaatgccaacctccaaccaaaagaaccagagctttcttggagaaatggccaatttgcccatggactagggcaggaaacatacaaaatgagccaggaacctcttgtggtgccagaaagtaagaacgtgataaaaattaataacctcacaatgatgggggtgtgtcaaaggaacacagaagccaacttttaacaataaagtaacattggattataactgtgagtataaaataaatatccatgagtccatatttctataaatacatgattgaacacacaagtaaataaatagtaaagaagggacaaatctcccaagggaaaaaattccaaatactttatgtagatactccgccctcagggaagaggaacatgattccccactccttaagtggaggctgcacatagtgacttccttccaaagaatacaatataggaaggtgggcaggtagaacttcacagtagagaaaactgccaatcactccctcagtgatcacctggctaggtgatcaagtcaacatcaacagtgatgccttactgatagtatgtccccctgatgtgatgagataagaacagtcttggccgagcgcggcagctcatgcctataatcccagcactttgggaggccaaggcaggtggatcatgaggtcaggagatggagatcatcctggccaacatggtgaaacccggcctctactaaaaatacaaaaaaaaaaaaaaaattcagccaggagtggtggcatgagcgtgtagtcccagctactcaggaggctgaggcaggagaaccgtttgaacccgggaggcagagactgcagtgagccgagatcacgccactgcactccagcctgggcgacagagcgagactctgtctcaaaaaaaataaataaataatggtctttacctctctggtcttcttcctccaaatccagtctaatcatgagaaaaacatcagagaaatcctaatagaggggcaccctacgtaacactgaccagtactgctcaacactgtcgaggtcatacgaagtgaggaaagtctatgaaaaagccacaactgtgaggagcctaaggcaacatggcgacgaaacgtgatgtggggttggatggtatcctgggagagacaaaaaacattaggtaaaaactaaggaaatatgaataaccatggactttacataatcataatgtagcgatattggctcattcattttaacaaatgcaccatagtaatgtaagatgttacaaacaaagaaactgggaattctttacactatcttggcaatttttctgttcatataaaactattctaaaggatgaactttatttaaaaatccaaatggcaatcacaacgcataaatatcacagccaaccacaccccaccccacagtaagttgcttttataaaccaacagctgctggttgctgcagaatccccagggccaggctcaggggctgtgtccccactatacccagggcaagcccctgagctgccactgccagggattcaatcccccacccaaattaatttacatgtggtgtgagttttacactgacggaatgagggcttaatgtttgcttggtgtaaaactgatgtatggaggaataattttagagcatgacttttagaaggaccaaagagggcagcttctcaatcggcagcaggtggcacgaggatcaatagctgacgtctgtgccgctggacagcaggcccgccgggaggagggaaaagcacaatggacacacatgaaggacccagtgaggactgagtgatgggctggggacacctctcatactaccctgtcatgaaggccacagtgcaacacaggagatggggaggtcaggtcagaacacctgtccggggcctctcgatgggcactaggaatctgagacgagtccttggcactgatgctcaaaacatctttcatacctccagaaattgactctcctaatccagtttcgagcaggagggactcatctatctatgtgcaactgacagaattagagggttcccttgtgacatctaaacatccccatgaactgagcatactgtatgaacactggtgcaccgatattcagcaatgacagcatgatcgttaatccaccaaccaaaaatgcaagctgagcggctgggaagacaagtcacttgcccttgcaggctccgtcttctcaccccaacaattctacttaagtaaagaaaataaagcacaaaagctttgaaaccacggctgatagtgcaggctcctcaggggaaaggcaggcacccgacagaccaagaatctggtttccacacccatcacacctgcagcactgattcaccagtgcagctgaggtgatggaagcagggaaagtctaaggggagggacaccgaatcatccccaaaaccacaacagaattttctctgtgaacctctccaacactgtcagcctgattcttctgccaggattaactgaatataaacacctaaagcataaataatccgtgtcaataatttaggtgtacagtaagataaagtgcactgctcaataggcaaaactacagacaaaagaaaatatactttaataaaatttacactagtaccagctaaacaagaggtcgaagaaagttgttaaatttctcatcgcatcctcaaagatataacaaagttaaacaggaaattacaaaaagaaggtggttttaaaattcagcaaaaaaaaagatgaaatcatcgtgaccccagtgtaactctatagccatagctttacatgtaaacactggatttaaaatgcaaaatctgtggttactttagaccactgagactcaattatttatgctgattatttataggtagcttctaatggaagttgattattgaatattttcaaagagaaaaaaaaaggaataaattctcatttcgctaaaaagctttgagtttttttcctgaagggaagaaaatagattaggtggtgtcctgagttcctctgcagcctggggtgctggcatgaataaataaccgtggtaagaagcaagcatgctagcagccaagccacagacaatagtgcccaatgcatcgcccatcttcagaaacgaaacatgttgcataagacattttcctaaaaacttcatacttggagccgggtggggtggctcatgcctgtaatcccagcactttcggaggccaaggcgggcagatcacctgaggttggaagttcaagatgagcctgaccaacatggagaaaacctgtctctagtaaaaatacaaaattagctgggtgtggtggtgggcgcctgtaatcccagctactcgggaggctgaggcagcagaatcgcttgaacccacggggcggaggttgcagtgagccgagatggcgccattgcactccagcctgggtaacaaaagcgaaactccatctcaaaaaaaaaaaaaaaaaaaccctttatactcggactttaagcatgagtctttctaaagtgcattctaattagagcacatggggctagataggggtgactggcagaaactggggaggtccgaaaatgcccccctcagagaactgacctaagaaagcagctagagcctgaggagacccactggaggtcacatagagtgaagtgacatgaagaaatggctatggacacagtcctgggaaaccagggagaggccagagaggggtcacagtctgtctttagagcagaactagaattaacatcaaacgccaccataagcagaaaatagaagctgatgccacctctgacctctgagctgagaaaagtgagtccatacagggctcatgaaggccttagaagggcctgcagagaagacaggagcactgtgcccaggaggcagcctggccagcagtccagagacatccagcaccccccgccccacttgacacaggcgcatcagggtgagcacctgtgatgagaatacccactccctgtgcacacagtacctgcatggccctcccgggcacccggctttggggggacacgtgggcagcgagctacacacagaccctatccctccagcaggatcccccttcctcatttgcattccatttagtgataagattttccccatagccttatccattttctcttactccccaaggaaaaataatcagaattattagttttggtggttatcctatgttatggggtgaatctgtccttcccccaaaattcacagaaattcctaacctccaatacctgagactgtgaccttattggaaataggttcactgcagatgctattgactaagatgaggtcatatgacagtaggggaggcccgcggtccaatctgactgtgtccttaggaaaagggggatttgaacaccgagacatgaacacgaggagaacgccatgtgaataggaggcagagacggggtgatgcatctacaagccaaggaacgtcacgtcacggattaccagcaaatcacaggaagctaggagggagacctggaacagattttccctcagggcctcgagaagaaatccacgctgccaacaccttgatctctgctttccagtctgcagaactgtgaaggaataaatttctgttgcttaagccaccttgtctatcgtactttgttatgggagcccaaggataggaatccagcctgtaatgtgaacttcagttttacagagatgttccagcaacttccccgggacatgataacccagaaaacaagtgaagaaggtcccgggggatcctgctgttgtcacacttcaaggtccctgtgcctgactcatgggaacccccaggccttccatcggagactacgcgactcttactagaagctcaggaaggtacacaacccagggcaggcagaacactttatctctaatgagcagcaagcagggctttcaaggcagttaagaatttcctagctgttttcttcctcatcgcaatcaattctgaaaggcatgttttcatagttcgaggattctaagggctacgatgaaagtctctgctattaggttaaacatttgaacaacatattaaatattcaaatagaacattaggttgaactttgactgagcgtattaaaatactttaaggttaacactgaaaaggaactttttgtagtaaattaaaggtggcttctcctcctgaaggaaagtggagtctaattcctagcctctcgcacaccggccggcctgtgacttgcgtgatccagcgaatgtgacagaggtgacactctgggacacgggaggctgagttgtaagaagcctcttggagcctcttagaatgctggctctggcagaagccagacactatgtagcaagtatcactcacgtggtgaggaagcccaggtacccacatggagacgccatctgaagacagaaaggtgtctggccagccctggctgctctgtctatcccagccaggcatgtgagtaaaggaacctttttggacattccatcgcagcagaaatgacatgcagaagacccagggaacccagccaacagtgggaaccaagatcccaaacgtatggccccagcacagctgccccggccatctccagccatcagtgagggttctagtcactggtctgtctctgggtcatcctgctaaattcctcactcacagaatcatgaaaagtggttgcttagtgccactatattttggggtggtttattgtgcagccatagataactggagcacacttttctgtgaagtattttctttccagactcgaacagttagatgggtttatccggaggctacggtgtaattgaaattccattaaagatgctttttaacaagtaagcaggactaatgtatcttcccactgcaaaggcctgcactatctttgccaaaccacatcatactctgtgaagtcatccagtacaacacgtaccccaagttcatactctttaacagctctctgaatcaaatggagacttagtcagggtgaacagtgtcactgcaacgcttgcaagcaaagtaggattcaaccccacagcagaggtcagaaatgccaataaaaatgaccttctggggtcatttatgggtttcacagctctgatttcaagaggtaccagatatgccaaagaaaatgtggccaaagacctggaaatacgggctcttctgattcagtagggccaggggtcgctgccccagccagaggtcagccaccttggggtcagccaccctggcactgcccagctaagacagtccccacagaacctgagagctggctctccattgtgtctctccagagaaacagccccaacttctgttggttgtctgtacagacttcaaaggaaaaatatcttcctcctatctcatgaaaacattccttgctggggctggacgcagtggctcacacctgtaatcccagcactttgggaggccgaggcgggtggatcacaacgtcaggagattgagaccatcctggctaacacggtgaaaccccatctctactaaacatacaaaaaaattagccgggcctggtgtcgggcgcctgtagtcccagctgctcaagaggctgaggcaggagaatggcatgaacccgggaggtggagcttgcagtgagccgagatcacgccactgcaatccagcctgggcgacagagcgagactccgtctcaaaaaaaaaaaaaaaaaaaaattccttgctgggacataaacccttttcctatcgtcatacttgtccaaactgtgagttcacagccaatgataattggatgcgtggcctctgctgggtagataacctatgccaaactgttttcaaatagacagaaaaccaacattaatatggtttgttgttgttgttttgagacagagtctcactctgtcacccaggctggagtgcagtggcgtgatcacagctcactgcagccttgatctcccaggctcaaacaaccctcccaccttgcctcccaagcagctgggactataggcacacaccaccacattcagctaaattttatttttttagtagagacaaggtctcactatgttgcccaggctggcctgaaactcatgagctcatgtgatcctcctgcctcagcctcccaaactcctggaattacagatgtgagccaccgcgcccagccttagtatgttttaaaagtcaaaagaaaacagtgtactaacagtgacctgaatctgcctgcacttggaggctcaccgttttcacgtgctcacgtatgccatctcctttaagcctcaggtcaagtccatgtcatgctcatttcagcaaaaatgtcaggcagctctccctggcccacagctggctcctggtagggcagtcaaagtcagatctaccagatgccagcacccatgagaaaaggatctggatggtgccaacctaataccccctccatccccagccaccagcagcgccgaggtccttccgtccatgctgtgtgcatggcttttctcatcccctctctgaccccagcagctgggtgagcatcttacagatctccttcccagatcccgtgcaaaatggccagaattctaggtctcaggctgttcatttgtttgatgtgaagttagacttagttaccttggtgttaggagagaacagtgtttaaattatgtgtggcaaggaaaattaatttgagattatgaattccctgcagcgttcaaagagtatcatggagcttaagagcaagttggctgggtctcagtttattgacctggaggaatgtggaaatgctaagggaaagcatggagctgaagagtgctgtgcggactgtcaatccatttccatctgaaatcacactggaaaacagaaaagcctacctatggatctgtgtgggggcatggagaacagtgtgggtggagatgcaaaaagctccacctcagagagctgggagggaagcggagtcagggagggctgcctgcctttttctgtagacattcccctactgattgactggtgacagtgagattttatcacgtttgtaatttccagaaggggaaggcacaatgactggttacagtgagattgtattacatttgtaatttacagaaagggaaacacacaaactgcaagagaaatagatccctagagagcgtggtccaagaaggctgtgtccacatttccacattccctgtggctgaatgcccagactttgagatcaaccccatcaggaagaaagttaaagacagaggctaatcagagtttggcaatgctgagagcttccacgtgccaggtcctgcctgggctctttacctatattacgtcattcagttttcacaacttccccatgaggtgtcatccatgttacaggtgagaaactgaggcacagagacagtagcaatttccctatgatcctaaagtgatcagaggtacagctgggattcccatccaggcatcccaaagcctgagctctctatgttgtgacacttcatagttgtgttgacttttatcaaatcattcaacctctttgagggtcatttttcttatctgtcaaatgaaggtgacaacaacaccttctttttgcaaagattcctttgcaaaaaggaatcttacatatctttatcatatgtatctatatcatcatacatgtacgtatatcatctcgcccagtgcctgcagacaggagactgcagagctatgtgcccaaccaacctcacagggagggcacttttgagtgtgggcaaggtgccatcaaatccactgataagggacagtttagggagtgaggagtgcatgtcccacagcccctctgcatataaggagtgaagaggagggtggtgatgaggtaggacaagggttggaataggagatgagactaagaaaccaggcagctcaggaggctgaggcaggagaatcacttgaacccgggaggcagagcttgcagtgagccaagatcgcgccactgcactccagcctgggtaacagagcgagactccatctcaaaaaaaaaaaaaaaagaaaagaaaaaaaagaaaccaggcaggcacagatggccacgtggagaggtcagcccctgagagggctctggaccacagcctgaacaaagagcacggatgcaggcagctgccttggaggacacagaggatgtctctttgtgtcgcctccatagggcactggtgtctggaagagctcctcggccagccatcacttagatggctggctgactgggttaactttccacccactccctcctccaaccacccagcttgatgttccttcaatacctcttcaacactcatgaggagggacgggagtaaactggttttcttttaataaaaaatattatgcctttctttttaattgcaaagtaaggtttttaaaaataccatttccaaataaaacggttgtgggaggcatagtaaacatttaaaatttacatcatacaatgaattattgattcccagcaaataatactccccactcagtttcagattttcagctgaatgtagcagggcccgagagcctgtgccaggcccagtcctctacatcagggaccagggaacacttggatggggtggggttttatgtgtctctccactgccctcaaaggcactgccaatctcagcaacaggaaggtgctgactcctgactcaccagctctactgcaagtccatcacctgcaaaacctcagtgatttggtccagtgatgtgctactgcccagcactagtggagttggcacgagatagggcccctggcagctgcccagcggcccacccctccattcggctttgatgccatgggagagggctggggccagtgacagtcaagacccatgggcccaggccttcagagtggctcttagcataagggagaagggggtcaaataagggagaaacagcagggaaaattgaaaagacattctaatggctagtggggtggagatggaacaggtaaccaggtctttctggggacagacaggcatgatatgagagatccatccaaggatccgtgtttaactgggacaggtgtgcagcttcgggatgtggggatgaactgtgaagtgaagacagaaagaaaattcgtgcgctgtaacaggctcagtgctctctctaccatatgtcaccataatatttcaatcattagatctgaactaaatacagatttaatttaccaaataacgttttaatgacaacagcagtggcccccagcagcactccaatttacgtacaacttcgagataaattacatcgtttgacttgcgagaaagatgtctaattaggaagatttccagatataaagaactgtcactgtaaggcatgtcatctcatcactctaaagtcactcattaacatatgaaaacattcccgtttaataaactgcttatgtcaaacgaggtcctgaagatgggacgtgggtgaaggtgctgcccagtaggcggctcaactgattcatcacctgatgttatcggccatggccatccctccgccttcagatggagtcgccagatagatatttttgccatacaaggttcttatttcattttatcgtattctgattttctagctgggtatatttcagaattagtatttgtgttaggataagacactaagattctcttgaagcactggtgttttacacagtttatcttaaaggctgcttccaagttgctgcaagataaaactgacttaaggagtctgtcaattagatgcaaccatggtaaccagagaaaactgcaaaatggccataattctgcaactttgccccaaatgaggacaaaaccaccctgtatccaatacaatacatatactgggttttgtagtggcatgaagaaatgccttctgaagttggcccagtttaggaggtatcaggaacgacatctcagtgggtttttgcaggaagaataggagtttgctgataaatttcatgcttcctctgtagacaatggggaagcatcagaggggacgtagcagggtgttgaagtgacaagttctacagcagggagggtggatttggagcagggcagggatgaacagagggccagtgcaggggaggggaccactcagaagaatgctacattcctttcagaccaaatgtgtttgcagcctcactgggaatgctgggttagaccctacaccaaaaactacctggaacaagagctgttctaataatgctaagcatatgtgaaactgtgatgattctaatattggaactttttattttaacagaaaaccaattatcgtaggaagcttctaccatctctcatccaacagtgttagcatgactgttactaatacattgaaaaaataaaaatagataatggagatctggcaaggtggccgaggaaatcacatgtatgagagatgggtggatgaaaaagtcccaaaccccttcaagaagcatccgtgccatttcaagctttccagaacttcagagtcatggactgtctactcctgtttctctgtatcctccccccaaccccagttttaatttccattctattttccctttatccatttactatttcacttatttatgactcaaatatgccaggccccatgggagagctgggacacacagtgaactaactggagccagcaccatctcacactatcactcccgccttccagtgaaggagagaaccaataaccacagggctggttagggaagtacaactgtgccacatactcccaaggagaggccaggtgcctctgaaggcttatagagtagacatgtcctgcccatcacaccttcgtcgtttgtgtcagagctacaactaaaatctagaattcctaatttccaccctactcactctgcctcattcatttttcggtttattcatttgctcattcatttgcttatacctttgttcactgcccattcattctttcaacattcgatcagttattcatccattaattactcacagggcaggccctcttgtctcagctcagctacaaggcacagaggcataacaaggctaatgaacactcacgggtcataaccagggtgctacgggcacattggccagtgaaagctgaactggtctgggcagctcgatgaaggctctgcagaagtggccctgacaagtgctagtgaatcactccacaacatgcaaacctgatcactaacataatatgcaacacacgctcacatgttccaggtgccgcgcagacaggacccctgccccttgaaagtcagagtcaaaagggggagtggcgaggaagcaaaggctgcatcttgtgtcaagcgccgtggaagggaatagtgaagtactcccgggtcttgggggccttctataaagaaggtggtagcatctgggcctggagcctgcaggaaaagaaccgggagaagcaccttacaagcacggagagaaaccgtggaaagttacagaaactgtcaggaggcccgtggcgctggactacaggatattgtcagatgaagtcagcagcttgagcaaagcattgcaggtggaggaaaatttttttaattttttcctatatgtgtcaagaagccactgaaagctttcagacgactttttattgacagaatcctatttacatctttaaagaagtatactggttggaccctcaagcccatagaggggtaatgttgcaagtagaaaagaccaccccttgctctaagtgatgaggcagattccaacccttggccaggccgccatgcagggcagaaggtgccctgattctggctgctgcagaagttgggggatggcaattgaaaccaaagaggtggccatacagatggcgatgaggggacggactgcaggtaacttttgaaggaacagctggtgggatttgtatgtgtatgggcagggaggtgagggaaagggactgctgtgcgttccatgcatcttgattccattatctttgtggccctaatgcaagctttcagctctataggaatgcgaaacaactgcagatttcccatcgggcacatgccagagataagtgcttcccagagattcttggttgttctcagtcttctgcatcacatgccatagtgcgacgaagtctcccttccgatgtacaggtctctctgcaggatcaaattccagaaccgggattcctgagtcaaagcgtgaattaacctataattgtcttaattctgaaaaattatcctcctggggctggttgggggggcattttacactcctcttagcaaaatgtgaaaaggtctgtttcaccccagcctcagtgaaagattatgttctccagcttgtgggtttttgcctgacatggcaggtgacatacaatatcttactgttgttttaattgtaatttctgttaccacgaggttcacagtgttttcatgtgattaggccatttctgtgagctctctgaccccgcccatttttcttttggatatttgtggtctttttcttataaacttctagaatgcaggaactattcacgatctgaattagaaatatttctcccagtttggtactttgcttctaagtttgcatactttcttagaaattttattttatttatttagccacgtaaaagtttttgctttgatatggtcacatttatcaaaatttgatagctgcaaagaatactatatgagctggtaaaaaggaatggggggggtggttcttcggtccagatttagaaagatctccaaatgcattgtgaagtggaaaaagcgaaggtacatattctacccctttttctctgagaaagagaatgtgggcacgtatgttcttatttgtttatattttcataaaggaagtatgataggttattttatatgtcagcttggccaagctatggtgcctggtcatttggttaaacactagtctagatgttgctgtggctgtccttttagatgtaattcatatctacaataaatagactcagttaagcagattaccctccatactgcggggggcctcatccaatcagtcaaaggccctcagagcaaagactgaggttccccaagtagaaggaattcctttcaagactgtgacatagaaagcccagctgagtttccagcctgcagaattcagactcacaaatgaaacctcaacacctacctaacctccagcctccctgctgccctacagatttcaggcctgccagcccccacaatcaggtgagtccattcctttaaaaaaaaaaccaggcgctctctctctctttctctctctttctctctccctctctgtctcttcctctcattggttctgttactctggagaaccctgattaacacgggaacacttggaggattccacaaaaaatgagtacagtaactgtgtgtgggaaggatgagggaggggtggtaatgggaattctcagtttaggccttgttatagttagaaactttaagccgtgtaaatatctcacctactcaaaacagaaagtaaaatttggggcaaaatcaacttttaggtataaaataaaataaatgctctataaattaagcaataaaggttatttgttttatagaaatttaagatacaaaaaaagagaattatccaggtttatccaaaagatgaactgctcaggaagaagacaatttttaaaagcactgagatgcaattcttttaaacatgaacctatataccatatttaaatccatataatattctacaaatctggtgtatcctccaagcatttgatacaaggtttaactctcaccaactcttccactcctgaccccaccaggtgggcaaacataacttgtggcaatctgcaaagaggccaggccacgacctgggctggagtggccagcctgtggctggggagactttccagggaacaggtgccacctccccaaaacgcttcacgctgcgtgcaaggattcagagatgtccagggtaaaccaacactttttaagccaaatctaaatgtttaataaaaactaagaatgatgcataacaagagcttcatcctggaagtacacaccattttacaggaaactcaaaccctaaacatatgtaatcttgtttgtagcagggaacttcctccctgctagattgaagaaaagtattaccatctgggacacattcctctcaccctcagaagaaggggctttatagaagggtctttacttttattagcagcaccctgctatgcacctgctgatgttcataacacatggggctttctgggccactccagtgactgctgagctggcacctgatgacatttcttcaagtaagttgccttagttgacccagctactgctccacaccagaggtggagtggggaggagtgtcctctggtggaaggtcagtgccacagagaaacactgggcactcagactgcattcggtcctgggacagacagcgtgtccccaagcatccacagtgcagcgtccacagagaggcctgactcccaggggctgacagaggcagaggacagagctatttattgaaatgaggagtgccctgctaaaagaaactgcatgcatagcattatagagccaggtaaactcatggtgaggagtctgtgttttggattaaacacgcacgcgcgcagacacacacacacacacacacacacacacacacacacacacgtctgtgtttaatcccagctctattacataactttctggaggttgtttccctttgccaaggctgcctttccctacattaagtgggaacaatataatcccaccataaagaactgtcatgaaatccgaacgcaatgatgaccactaaggctacaagtgcccgtaccgtaggtagtaagtgcttactaaatgctggctcctcctccgtaactgatgggaatattaggagacatataggtctttggatagttcttgaaagctgtctctagaggctgtatttggaaacatatcacatggatcatctcttgaatgaagttcctcgtgacccttaggcctttcaggagtaatgccagggtccttcctgtgagcagctcagccgagtggggctagcggggagcagagatggggctgggacagagcacaagcacagccctggggtggggtagacagggatgctgggcaagcacaccccacctccgctccccgccaaggctgtctgctttctgcaccaaggccccttctacccctgcaagcccacctggccccctgcacacaggagagttgatgcccccagaggaaacaattagggggaatgggaacaaggccccgcatgccctcttcagggggacagttctgggacattctgtacggctccaggcaccccccaggctcacagtggcagccctgataacaccccccagggattccttctcctgccccacatcccccccagctcctcacacctgcttccttgtcctgggctctgcttctgggctaaaaacaaccccagcggggagagctgttaggaatgcaaagaggagaccaaggacttgaggcccctcctatcacctcatttacatccccaggagtgcaggccacactgcccatcaaaagcacgtccccgtgaggcaagatgatgatgatcgcagcggacatttattacctgccagacaccaacctaagcaccttattattaactattttaattctcacaccaattccacaaattactatgagtttgttttccaaaagaggaaactggggcacagagaagctaactttctgaggctgcccagctggtgagcagcagagccaagcatcccgctcggcgaacgagctccagagcccatgcactcaaaggcagaagctgcgctgcacaacgacgccaagaagagaacctggagggtccaggctggcagaaatcagggagggcaagggcaaggaggaagccaaaagctaagaacaaagtcagacaaacgccgaggcagaagccagggaagcagagcatgtcaccaattactggggacatgctctgagagagagggtttgagaactgccactcaccggccggggactgcttgttctaaaggtgcctcaggctgaaatccagctgggcctgtgctccaagccaggagtcctggcacaaaaacacggatctttgctctttctgtccgcagggcctgggatctcagccccaccccaagacagtagaagagaagggacccaggcaggggctgtggtcagtgtagagcctctggtttactagggaagtcaagcctgctggttcccattttctccataaattactcccattaaagtcaaatatccacattaactaaatttttgatatttcacagaatggttccacaaaaagagtactttcatttagctttaaacagccctttctgctgacatccaaattcgtatttcacttccctctcatctttaattaaagcttattatcctctgtgtaaaccaagaagatttatgacattatttagtgagttttctttttttaaattataaataacagtaaacttcagaaaatgctccaatttcacagttatttgttttcaagatttttggccacacactaaagctaaagctaacctccaaaaggcgcaagtcacatcttaaatgaaagctctgatcaaatctagtcctccccagcttctctgggcataaattggaattttaagccataggccaagagttaaaactatagcttctgatttgcttccaatgcgatctgtaactagttattcatggtccaaagaaaagtttggattcatgtcagaaccgcctcatacacacagccatctgaaaagtcccagagaagccctgtttaaatgcaatccaaactgatcctgccatgtttcttctaaaagaaggaaccatttcctgtctcgtgtatggtttcttttcctttctttctttcttttttgagacaagatcttgctttgtcacccaggctagagtgcagcttcaccattatagctcactgtcttgactcatgcagtccttctgcctcagcctcctgaatagctgggactataggcccatgccattgtgcctggctaattttattttattttattttttatagagacaaggtctcgctgtgttgcccaggctggtctccaactcctggcctcgagcaatcctcccaccgcagactcccaaaaagcttggaattacaggtgtcagccaccacgctgagcctatggcatcttaatttttaaatttttcatctcttttcactattttttctacaggagatcattatttcatttaatatagatacccatagtcacaaagagacttaggacttcagaatcagaaaacaaatcaaaaaaatacaatgtcctactacaagaaaatagtttttaccttaaaaaccatggagaaaggaaagtgctaggaaacgatggaccaaagtgattgtgattgaaaagaagataaggggcaactggaacaaagcattcacatgaagtccgtcagcacctagaagggctcatcaggagtctacgcaggctcgccaacacagcagcaactgcaacactcactgctcttttactgacaggatcaaggcatgtagacacggtatctgcgaggcagaggtcaattcagatttttaatttctctcctgcagcccagagccttgtattgggagaccaaacttccattcactgtcatggcattctggagggcacagagagtcaggtgtaacaaatatagaggggcaccatctgggatgggtggggagtattgtcagattctgcgtcagggtgcaaggggtgggcgagcttaccagagtgaggggaaatctataaggaatacatgtccaaccttgcactagagtttgaaaaaacatcaacttttaagtgctgaatcctgaatgcatttattgagtccaaaaatatctgtgtatgtcttcaatgtgtcaggcactgttctcagtttgggcatgcggcagtgaataaaactgtcaagtaaatttcacacagtgagagggcaagaggcttgatacatcatatagggtattagaaggtggtaagtgggggaaatggaaacagggggaggtctaggacagggagcagcaatgttgaacgggtctggcctcactgaaatgtcaacagaacgagaagagggccgcagggctgcagctacgtgaggaacaatgttcccgactcagggagcagtgtggaggcgtgtggctggagctgagctggagaggagaatccaggaagaccggctcgggagtgggaggggtggttgcagatggaggagttggcttttagcctgagagaatgtggagtcttcggagcatttccattacaggagtgacaggatttggaatgagctttgaaaggttcgcaaaagtagctctgaagaagtggggttatgtggcttctgcaatgtgacccgcgatttggcacaaccttgagaactccagccccagtaggaaaatggccaaaggccataaagaagtcacacaagaattcacagaagaatattttcagccccatggtgtcatatgagtaaaaccacacagttccatttcagcaccaggtgggaacctgtctcctataagttaagcggtataaatgaaaatttaatcatgattttccctttcatagaattgtggcctaacttctgaattctgataaaataacttaacattggccaacaagatcactcagcatctgagacctaatttgataaccataactcaaatatctcatcaactgaagttgcaattaacaaaaagtccagttggcagagcagggcctggatgatgaacgattcacagctgatctggggctgccgcctctacggcggtgtcttctttccagaccccccgaaagttcacagactgtcacacatgcacacaactcccgtggccctgcaaaaccagctcccatcaggaaacatgtgggctccttcctgcatggtacagtgaaaagcaaaatcctaacgtacttactcgcattaaaaaaaataaaatgagaagactcagttttatgtctacacaactgcaaaaacaaaacaaaagtcagagatgtgaactccagattgttaacatatctgctgaaacaaacagaacagtttaatcaggaatgtgtacaagctatattgcatacaaattggcatcaatcatgaataaatgaattttggctttttgcatctcatgtatgggacttatttacatggcatactggcaaactggaatgtaaactaacaatataaatgatattgcaatttaggagcatccccaagctgccagaaataggaagaaggcagtgttttggtttcctacagtatggaaaacttatagtgataacccaactaattcatagcaagggggagaagacagcacactaacctttaataaattaataggattgggaggctaaggcaggtggattacctgagctcaggagttcgagaccagcctgggcaacacagtgaaaccccgtctccactaaaatacaaaaaattagcctggcgtggaggcgcgtacctgtagtcccagctacttgggaggctgaggcaggagaattgcttgaacccaggaggcagaggttgcagtgagctgagatagcaccactctgcactccagcgtgggtgacagagcgagactctgtctcaaaataaattaaataaataaaaataataattaattgattaattaattaattggagctgttttcccttttctgcaggtactgaaaaccatcttatgcctgcctataggcatctccatttaagggcttcccacaccctgaaatacaaacactaccaaccaagctataaattatattgctttctactcctgtttctactagctatttctttaaaatttgctaaaatctgcctacaaaactatctaaacttggtgtctattaagaaatagggggatttttcaactctaatttgagttctttaataactatttctgtttgggttttctatttcttcttaagtttggctatattatttataaattaagccatctcatctaaatcttcaaatatattggcataaggttgctgattatcatgtctgaaatctcttgtttatattattttcctttcatatttctccattattcatgtttcttctcttttattgtaatcaataacaggtgtatgtacttataactcttttcaaagaatttttgattgcctctattgcttcttggatatccatttcgttacttttcctttaatcttacttattctttttgtgaatgtatgcatttactttgattaagaatttcaaacagaaatttaagtttatctctggtgtttgtgaaatgtgaaaagtaactgaaaactgcaaaaacaaacaaaaactcctaaagctcccaccaaaagttttgcaataattattaatatttcataagagagggtgggtatggtggctcacgcctgtaatctcagcactttgggaggccgagttgggtggattacctgaggtcaggagtttgagaccagcctagccaacatggtgaaaccctgtctatactaaaaatacaaaaattagctgggcatggtggcgtgcgcctgtaatgccagctacttgggaggctgaggcagggcaatcgcttgacccaggaggcagaggctgcagtgagccaagatcacgccactgcactccagcctgagcaagagtgagactccgtctaaaataaataaataaatatatatataatacacatacatttatacatttcataagagataagagaacacatcaatgcagtcacaagtcacttaatgacaaagatacaatctgagaaatgtgtcattctgagcaatgcaaatggtaacttcatcattgtgcaaacctcagagagtgcactcgcactaacctagatggcatagcctactatacatgcctaggctatatggtgtagcctattgctcctgggctacaaacctgcacagcatgtactgtactaaacactgtaggcaactgtaatgcaatggtaagtatttgtgtatctaagcatatctaaacatagacaaagtgcataaaatgtgatacaataccactgtcctatatgtggtctgtcatcgatggaccattatagacatcattatgcagcacaaaactgtattttattcattccacagatgacatgggagtcttcttatttttgtaatcaataataacaggtgtgtgatcaataataacaggaggagtgatatgctaattaggaactaaggatgtgcaagataaatgtttatactccaagaatgaaacagaaacgaaaaattaaaagtaataacaataagatgattaacaatatcaatagcaactaacagtagtttcttggttacttatcacatgctaggtaatgttctaactatttcatatgaaatttatttattttattttattttgagacagggtctcactctgtcatccaggctggagtgcagtcattgcaatcatagctcactgcagcctcaaactcctgggctcaagcaatcctcccatctcagcctcccaagttgctggcactacaggcacatgccaccacacacagcttttttattttttttttggtagagatggggtagggggtttcactttgttgccaactcttggtctcaagctatcctcctacctccacctcccaaagcactgggattacatgcacgagccaccacgtccaactaattttactttctgtagacagggtcttgctatgttgcccaggcaacaatgtagtggcacaatcataactaactataaccttgaactcctggactcaagcgatcctcccacctcagcctcctgagtagctgtgactacaggtgtgtgcaaccataccgggctaatttttaaattttttgtagtgatgtggtctcactatgttgctcgggctggactctaactcctggcttcaagcaatcctcctgccttggcctcccaaagcactgggattacaggtgtgagccactgcacctggcttcataggaaatttaatcctcaaaagatcccatatagaatgatggaggttaacactgttctccccactttacagatgaaatccccaggaatgaaggcggtgagagctagcaagtgggtggtgtataaggcaaatcattattaatagccacaagcacattacacagagtcttagttttaacttcaatggaagttttattgtttttgacagttgccaaagcagatcagatactgtgattaggtacacggtttcttcctgcttatgaaattacattctgaagcccttcggtctcattccccggctgcctccactctttcttgtaaccgctcgcctgtcacctgtctgatgtgcatcaccagctcattcatcacctggcagatttactaactcactcatcatgcagacactgatgagcctgtccttccgcattcatccccacaccctggctgccgctcactctgacataccgccgcctgtcactgtttgccagccaaaccgatacttttcttaggagctgctattagctcatttgtcagattattttattcctttttgcttatcaacttcccttcagacatcttttagaattttttcttcttgttctcctctgccaaccacttggctcatttgcttatcacctgatattattcacccctcatcattcgacagcttttcagattctattagtcaacatacataatgtgagttctatctcttgtttctattaggttaaacccatacaaatcttgctctgtgccaagtgacttagaatttgcatggggatgacacttacattagagcatattcactatggcacatgaatatcagttataaaactcacattccctttcacaggtcagaaaatgtgggatagcagcagccttttaaaaggtaacacacagcggcatttttttttaatgtttaaaaatatataaataatttattctccccattgcacagaatggcaatatgttctctcctaggtgattgaaaaggtttttgtctttagtctcttatggactggtgcatttgatggggatccagaaaaaaagatgggactaagtgctgcacgcaaaagagaactggccatgaagaggacccacccgccagacaagagccctgtgtgtctgcctgggaaggagaggagctcattcctgaaggtcccacctggacgggctgtttgcttatgaatgtatgcacttaggtaggtaggtaggtaggtaaatgtgtctatgcatgtatacacataagcgtatgaatctatgtctatgggtgtgtgtatgttgcatggaagtacacatgtatgcagcaggctaacactgactgcatttactgtgtgcaagtctctgcaatatgctcccaagacacagtagctcatttagtcattacaacaacctttgcaatagaaataccaatggccacccatattcactggttctcatttgcctggctgtgttctaagccttgccaccacctgggaggtaggttctatcattttcccccatgaaataaatgaatgaactgagcctcacggggatagagttactcacccaatggaggagctcttatgatccccatgttaccagtggggagactgaggcacagagaagttcagaaagtcacttgaggccatacagtaagaaatagagtctgtacccttaagcacatcacactacttcccagtagagaaagatcaccttctgtgatgcttaattttacgagccaacttgacagggctaagaggtacccagagagctggttgagcatcatttctgggtatgtgtgtcagggtgtctccagaagaggctaggatttgaatctgtagactggagtagagaagatcaccctcaccaatgtgggtgcacctcatccagtccactgagggcccacatagaacaaaaaggcagaggaagggcgccgtctctctccccttgagctggaacatccatcttctgtccttggccatcagagcttctgcttctcccaccttcagactccaggacttaacaccagcagctccacccctcctcctgttctcaggccttcgggctctggctgaagcacaccaccagccttccagggtctccagcctggagatggcagattgtgggacttcttggccttcacaagtgcatgaacctattcccatgatcaatgtcctgtataccccattggttctgtttctctggagagtcctcctaatacactttccttttaagaatgtataaaaagacatacatatgtgtacacacattcacagctcaattaagacccttctatcatgagagaatggagacacgttctaagacactaggggatcgggggtgggagagggcctggctccaaaatagatattttgatgaaaccagagtaaattcttagaaattttctgagtctcacggtgataaacagacactgtctctatgaaacacgcacaagtttcaatgatagaaaaggaagagatgagaatagctagcgaccagaaggaaacacaccaagagaaaaggagactgccccaaaacagaaagagagactggaccagttaaaactctgcactggaaatagttaagaccaggccagatactgcaaaaaaagaaaaaactggtaaaaatattttctgtagagcagtattttacatttcccctcattttgctagatttttctgtttgccctccagatccaccatacacctttactgctgcctggaggctgatcttgatgaggcttccctgttttccactgggttcagacttgggcagcactgaggggagactggagtgggcaaggcatggcaactggggtatttgtttcctctctgctggaaaggaccagtgcctgcattctctcaccaaaggccacccctgtctcagggtgaatcctacgaattcaggtctcactccaggccccagagccactccctccctgtgctgttaaggtccaggagccagggcagctctcagctatggctagccctgacagcctcaccatttctgcccctacctttgtaaatagtcaccccattaaactccccattacccaatttaaatatgtcatctgcttcctgctgggatactgagtatgaagtgctccaggcatcccccaggacagagcccctgtatcatgatctgttttataaaccgtggttctggacagtaatttgagtttttaaaggtcccattggcttttttttttttaagcttaaaaaccaaagatgaagtttaaatttgagaagcattcatgagaatgccaaaaaagggacagagtgatacaaataaaaaaaaaaaacctcacacttggaggatcagaagctgagatttaaatgattaataatgcatgcttccagagaagagcccagaacaaatcattctgttctcattatgtagtgaaacttacactggcttcagacctttcctcaaattgctaatgccagaaaaactgattgctcaagaattctgaatctaaccaaattactcttacattgaaagtaacagatggctactttcatttatacactgtgggaaatatatatcacccatgtccccatggtgaagagatgaatgaaaattcagaacgtaagagagctgaagtcagatagtaagcaaatgatggagagtggaatggctgagctaaataaggggtcccacgaagaggaggctttataacctgagttccctatgtaaaattaaaatgtgaagggggttttagatgcacagaataaaaaatgctaatttactcatttttccataaggaaaagatgttaaaattgactttttttgggagtatcacttacctacgaggcaatgttctctgttccaatagcgatggtggtcacccagggacttacatttgctgaagctcattgaactctattcttaaaacaagtgcatcttgttctatgtgaggatgtgaggatgagaagatttttatctttggttttggtaatttgataaatgtagggttgaggatacttttgaaaaatcaacaagatggtctagaagtgaagaagatatgaaatgtatatatatgtgtgtgtgtgtatatatatatatatatatatatatatattttttttttttttttttttttttttttgagacggagtctcgctctgtcgcccaggctggagtgcagtggcgtgatctcagctcactgcaggctctgcctcctgggttcacgccattctcccacctcgcctcccgagtagctgggaccacaggcgaccactaccacacccagctaattttttatatttttagtagagacggggtttcactgtgttagccaggatggtcttgatctcctgacctcgtgatccgcccgcctcggcctcccaaagtgctgagattacaggagtgagccaccgcgcctggcctgaaatgtattttttaaaaacatattgatatagaagttaaaaataaggtaccaaggataagtgcatgagaagatatgcaagtcctctgcagaaaaaatcttaaaactccaatgaaatactctggaaaagaccaaaacaaatggagggatatagtattccatggtcaaggccatttaggatcacacagatgttaattctccctaaaatgatacacagataaaacacaactccaataaacatcccaataagggagtctttcataaaatccaacaagctgattctcaagtctccatggtagagcaaagggccaagaaaagcccagatgcctttggagggaagagaaagctgggggcccttcctcctcacaggtatcttgttgtacaggaactaccaaagcagaccaaaggggcagaactgagtgcctagaaacagacacacagagatacagaaagtgtatttacaacaaagtgggcactgcaggtcatggtaaaaaacagattctagtgccactacaattggtcacgcataaaagaagaaaagagaattcctgtctcacagcatatacaaaatttaattccaagtagattaaaggattaaatgtgaaaagcaacacttctgattctgtaggggagaaaaaaaaagaagcaaatgtttttacaacttcgaggtagggaaggatttcttaataaaagataatcacatacatgcacagaaagtatccccagtgaaggaattaataaattaataaagataaccataagaaaaatgacatggtaagtcaaagcctcggagggggtattttcacatattccaccaagaaatcagcaccagaagatatagtataaataacttttataaattagtaagaaaaagagaaatgacacaaatgggtaaaacacacaaactcacatattacagaagaagaaacacaacataaaactggttgatctcagccaggcgtggtggctcacgcctgtaatcccagcactttgggaggccgaggcgggcagatcacaaggtcgggagatcgagaccatcctgcctaacatggtgaaacctcgtctctactaaaaaatacaaaaaaattagccgggcgtggtggcgggcgcctgtagtcccagctactcgggaggctgaggcaggagaatggcatgaacccgggaggcggagcttgcagtgagccgagatcgtgccactgcactccagcctgggcgacagagcaagagagcgagactctgaaaagaaaagaaaagaaaaaaaaaaaaaactggttgatctcattaggaacaaggagagcaccaactgggactggagatgccgtggcacactcaccagactggcaaacctctcaaggcatgccatgaagaatgcggaacacttggggcacctacatgagtacagttgctttgggaaaaccatgcgacatcatttcatcaatcacactgcccatgacccagcaatttcatgtccaagtgagtgccctggaggaacccatgcctatgtacctgaggagacgggcatttaaacattcacagcaacacaggtcacaggaacaaaatattatatacatggcccatgcagccactgaaggagaacagacaaacatattgtgatctattcacaccatggaagactgcaacaacaatcaaaataattgatgtagagctacacatgaacacgtatgaatcaacaaatatcatggtgaatgaaaaaaagcaagtaatcaaagaacataaagtgcaattccatttacacaaagttcaaaagcaaaagtaagcagtacattatttagggatgtgtacatatgtgtaaaagaatgatgaaccttgaatctctgctctgaagacaggcaggagaccagatgggaaggagcccacaggagggtcctggagtgggcagcttacacttctggtgctggttggtggggccttcaattgcctgcttcatagcaatacatgaatttcattgtacgtgtcatatatttcatgtttaataatattttattaataaatatttcctaatttaaaacagaaaagatgaaatacattttaaacataactgtcagtagaaaaaaaagctagattcctacagtctaaatatttacataaagtaaagcactctcaacgtggtatttatcagaaaaaaaaaccagaataaaagacagaagtgccgaagaaacgtgtaaaaacaagaagataaaaagagtgactgaaacaatccctaaataagtaaagagatttcataataactcaatcccttattttaaacaatttgatttctataagatatgtacctgaaagaaaatgtcagagagaaattaaagaaaaactgatgggcaaagatatcaggcacattcaaactaaaggaaagcaagcccagtgctctaatttaaacaaagccaaattcaagacaataaaacactaaattgagacaagaccactttatattattaaaagatataatctacagggaatgaacagtaatatcccaacatccaaacagagcaaaatgtgacagaaagagccgcagtgaatatgaacatgaatatggatcatgtaggaaaaagctgttatggaaaaaaactgcaaaagctaacagtagctgtgggccagggcagaacacgaaggagtgttttctaagctgtttccctgcattttccaggttttctgtaatacacatctatactcacttatcaggaaaaccataactgtaaagatctgtgttttggtgaggatatcacacgtttaagaaaggcagactcctttcttcctccaaaagtcactgctgaaagtcatgatttttaaaacttctttttttctgaaccccaagacggagtcttgctctgtcccccaggctggagcacagtggcatgatttcagctcactgcaagctccgcctcccgggttcaagcaattctcctgcctcagcctcccaagtagctgggaataggggcatgcaccaccacacccagctaatttttgtatttttagtagaggcggggtttcaccctgttggccaggatggtcttgatctcctgacctcgtgatctgcccacctcagcctcccaaggtgctgggattacaggcgtgagccactgtgctcagccagtttcaatcaattattctatctattgttgaaccacacaaactaaagagcaaaacaaatttgaaacctttgagtcttccttcccttactaatcagaatttttatattttgacaaggaaacatagatctacagcaatttgattaaatacacatgaaaatcagggtaaaataaaattgtttcaacttcatcccactatttattgtatatcataaaattattcaggaatcaaagataaggttcatgaataatattcttcattaaaagagggtggatgtttgaaagaaaatctggtaactaatagcctataaggtagaattttttaaaacctgggtacgtagagagagttcctcagaattgcatattaaattcactttcaattagtatggttcagcattttattctgatgatttatttgtatgcttggtaatactttttaaattaactgtgccacagacagacatatcacatacttcacagttataataattttttctaacgctatatctttataacggtaattgccttctttctgaaagaatacgcattttgaatctagtgacacttcatttattacttttcttatattagagctacctcagcatattagattttttcttaatgacttttttctattaggagaccatgaagaccccagggcaaaggaagtccattaggaaaggggggcattttagaggaggcaggaatttctaaggtagacatcagacaattcttgtcaagaacagactgaacacgagatcctccatttcctgtgaactatagattaattttgatatctgtacaaacaagattatgaaatttgcaatattcatcattaatacagtgaattaaattcctcacatagcaaaacatacatcaagtatgtcactgctcactgcacctcccactctcagttgacacatcaccctgcacagctcctccctggacaactccagctgaccagagtacctgcttataccacgtggaacaggagaccgaggatcctctcaccctgacagctgccttgctctctcctggaacatagcagcaggtgattattcagtgtgggggcaaaaagagtccctatcactcctctggtctgagagccagatgctagagtatgtccaggaagcacttccgagaagctattccctggacaggctgagccgccttggggcagtcacccatctcctgaagccaggagtgctggagcacaggctgagaatgactctgaggctggagagaagactcaacaacctgttggtggctccaccacggctgtccctttctcccaaaactttctacagctcgatttactcctggacccctgcacctggtgcttttcctgcttcctggattttgtcttggttgttctgctggcctgcaaggagtctactctctgatctacccgcccaaactccacccatccaataatatttgggctgaatcccattctcactgtaagattcagtctgaatcagtcttctcctacttcaaccttagtggaagcagcatgacacaatgaaaagagcatgccctctgaaatcagacacacctagactcctccatccaagctttagcaattacccttgtattatgctacccaagtacataatccctttgaaaaggacatgctcttcaaatgcagctgtgaatacttgtcttgggccaatgtataaaaagcaccaggtaggcaccagtttcctcttatctttctaaataaaaattatatacaaaattcatttctcgatttctaacttgcagcaatttcctcccattatcttatacaactttatgtatctttaacattttattgatatttttatttccccaactcatatcataacctcacctagaacctaaacctaaataccatatcttaaccttcttagtttccaagtcattgcacggctcagggccctgtgcaatgcatttcattactgcggcacaacaggctctgagcctcatctcatggcaattctgacgaccactctgtgctcacggtgtgctgatggtgtcctttatgtatccaggacagatagaacaaggaactgctgaccaggcaggttacagaatcagcccagggttagacacttacaggtccaatggggaagcaccccaggaaacatgtaacaaagcctccattagcagcagctggacaaattcttcccctcttctggaaacatccttaagctttgctgatgcccacacctggggatactaagtggtttattgtaatcaagaaatgtatcatggtcttggggtccagctacatgcaactcacttcacagcacattaaccaacagacacggatcacaggaaaatcactccagccataaagaaacacacagactctgggactccatccagaggcacatcccagggcttctgagctcccagagacggcccccactcagtgctgttccacagaccttaccacccactcagtctctaccttcacaggaagagagtaacattacccagacagggctatgagaataactcactctttctcagaagcttctcagccagtcagaagcagcaatcagggaaaagttgattacaattgtttccaggtgaattcaagatgatgcatttaattatgatttttgagcacataattaccttattgggtatctttgtctaccttgtttttaatctttttttttttttttttttttttttgagacagagtcttgctctgtcacccaggctagaatgcagtggcgcgatctcggctcactgcaacttccgcctcccgggttcaagagattctcctgcctcagcctccagagtagctgggactagaggcacacgccgccacacccagctaattttttgtattttagtagagaaagggttttaccatgttacccaggctagtcttgaactcctgagctcaggcaatacgcccgcctcggcctcccaaagtgctaggattacaggcatgagccaccgcgtccggccccttgtttttcatctttctattctagctcgctgtcacttgcaaaaagttaagtttttatatattttcaataaaaaatgtgcctgatggattaaaagagtttatacttccaagtgaagtgacttaagcaaataaaaataattgtcatgtttcaataaaaattagtattttatcaacaactatttttaatttcacttggtcttgagtggtttccttatgttatactttagtctgtttcagtctcgtttttctggttagactatctttccctgctgatatttaatactgttagtaaatttaaaagaagcgtattagtccattttcataaacgaggtgggaggttgggatacttaagctgctttatgagcacagcaaaattctgcattgttttaaggatctgtacaaatatgttttcaccctacttccttcttttcttctgcacttaataaatgaaagcttcatctttaatgtgaccaagcaaaatacattctcttaaaaaaaaaggtcacgaccttgactgtaagaaatccccaaagtggatttataatgaattttccgaataaataatgactccaaatacatttacattaaaaatattaacctttaactcacctatatttttaatagcatataaagtgatatttgagctcaattcatggcttcgaaagaaagccttgcaggctttctataactcatattaaaggttaagatgattcataaatttttttccacagaatatggcaaacagatgactttgtagtgtgactgggactgaatttctgatgggcacagcaggaaacatttctgtaagtgcaaaaattcaaagacacttttgaaaagaagttaatatatgcagcgtaagattttaagctttcttacattgaaaaatgatcagcatagcaatgaagagagagaaataaaaaaaccactaatccaggctgaagttcattcatcacacacttccaattccttgatatctgcatgttacattaaatactgcagtggagaaaaacaaaaataagagaatccaactagaatggaaagacaatcaaagctatttttcttcaacagttgtctataagtttccaataaaattggggctatgacaagaatcgagcatttatacttatgcataaagtaagggctggtttctctaatagggctaattatcggacacctattaccaccactccggggacagcatcaatgaatcaaactccacaggactagaaatattctgactagtgtccaggataacaggagagctaccagggcttttggtgccacacacctgggtttattagggccagaattgctctccataacctaagaaccacccaaacatccgcaggataaatgcaaaaccctgggaaccctcttttttttgagagaagaaatatggaaggaaaaaaactttcctctattttgtagcttctaattaaaaggaatccatgaaagaattaattgcacctaaacgtattttactacgtcttacgttgtactgcagtaagtcttaagatgagctgcagaggggaatggattatgccttactaaggcatggaaagaggtttttttggttatattttaaggtctcaggtaaggcactgattaagagccagttggcctgggctggaaacctgcccaccacttgcctgccacacacctgccctgtgcctcagcttctcttttggctaggatgataacagagttgtctcactggggtgtcataagaagtaagtgcagcaggcatctatctgaacagggcccagcatatagcagtttcccaccacgcttgttattgtggaaggtacacagaaatggtcggatttctctgctgtgacgtccttccattcagctctcttgcggtaaaacgcttcagtctaagtgccttccttcacccagctgaaaggcagaacacttactcccgttttggataacagtgcaagctgtgagtcataactggtgtgggagacagagatagatcatgcctttccctattgttagtcatttcaaataaactgaatgtatcctggtttgggggtgatgcctttaaaaattttttttaatttaaaatttttttagttgactttatttttagaacagttttaggttcacagcaaaagttagcaaaaggtacagagagtcccatacactccctccctccccagaggcacagcctccgccactaccaccagccgccagcagagtggtgcatttgttaacaactggtgaacctacattgccacaccattatcactcagagtccatggtttacattagggtccactcttggtgttgtacattctatgggtttggagaaatgcataatgacctgtatccaccattatattatacagaatagtttcactgccctgaaaatcctctgtgttccacctcttcatccctctttcccaacctgtgacaaccacttatcttattactgcctccacagttttgccttttccagaatgtcatatggttggaactatacagtctatagccttttcagattgacttctttcacactgtattatgcaaagtttcttccatgtcttttcatggctaaatagctcatttcttttttttttttttctttttgggacagagtcttgctctgttgcccaggctggagtgcagttgtgtgaaatcggctcactgcaacctccacctcctgatttcaagagatccttccatctcagcctcccaaatagctgggattacaggtgcccgccaccatgcccagctaatttttgtatttttagtagagatgggatttcaccacattggccaggctagtctcaaactcctgacctcaagtgatccacctgcctcggctcccaaagtgctgggattacaagctcatttctttttagcactgactaatattctattgtctaatgtaccacagttacatatccattcacctagtaaagaacaaggttgcgctttttttaccccactgctctgggaatatagtttccaaaaattataaaaaaaaatacagagccgcttttagtatttctgaaggctgctctgatttgtctttgtcctttaaaagtctgcagaaaaaaaaaacaaaactgaatctaataaaggtgcttctgacatttctgcaacctaaacacgctttacttggtatcttccgtaccctcacaccagaagacgacacctttgttggttctgtttgttaaagactcagaagccagggccccagcaccacccagcaaccccccgaatcaaggtgcagcagaacccagcattcacgctgaaacacgtgtcctgtgctctgatgtagacccaaatctaacagccattgacatggactgttagatgacttccgttatcacctactgggataaaacctattttgttttggctaataaatactgttctatgtcattactattattattattttcgagatgaagtcttgctctgtcacctagtctggagtgcagtagcatgatcttgattcactgcaacctccgcctcccaggttcaagcgattctcctgcctcagcctcctgagtagctgggactacaggttcatgccaccaggcctggctaattttttgtatttttagtagagacagggtttcaccatattggccaggctggtctcaaactcctggtctcaggtgatccacccgcctcggcctcccaaactgctgggattacaggcgtgagccactgcatccgaccttcattaaatttaatgtattatttaaactaggatttttttatcagctttattgaagtataatttacataaaagaaaacccaaccatttaaaatgcacggttcctgacaaagtacagcctgataaactcatatggccatggaagcaccaccgcaattaaactacagaacattccatgtccccagagtttcccttgtgcttccctgtagccattctcttcccacaccccagcgccaggtgaccactcatctctcctccatcactagaatttcagaaaaatggaatcatacagtatgcagtcttttgtgtctggcttcttctatttagccatttgcttctgagattcacccacattacatgtatcaacaaggagaatctttttaaccccagaaatactctggctggaaagtagaaaactattcagcaaaagctactgtagaaaaacactccaagatgattaagaactgtattccacccctctcaaataagacccttgaacaacaagtgattcctattttaggacagcaaggagattgccaagtgatggatacaatgtatttattttttaaatatcttgctagctaaagacctttaaagatatttggagagagatgacatcagaaaaagtggcaaagacctaaaaattcactcctccataagaggaaaaaataactgaatgaaatggttagaatcaagttgctcataactctggaaattaaccaaaggcctgcagcaaccttggaagcatttcttcaagatgaagagctgaatctcggtaagaacagtaggatttggggcattttggcttgccctagtcccatcctccattcctcatctctacagtacccttgaaaaataaaagctcacatgcctggtgcagcctggaagccacttgagggaagggaacaaagctggatcttttccaaagtcccattcccaaataattctcatgatgtgaccattctggtgattccctagaagaccatacttacaaacctagttatatttgacctgaccctgagctcacccagtgtgaacagtcttttccctgggggtgactgtcaaatacatttgtaggcaagtgttttcactttgcagctgcctaatcagtagataatagttggggcaaacaatatattaatctaaacacttaaaaaaaatcctggggaataagatgcccatagcacttttgaaacgccccaatatatctctgggaatacagagtgccacatgcatgcatagcgctgtgcatatgcccaggaaagccctgagaaggctctaagctctcagatgacaactgccttgcagaatgtggaaggtgtgccccaagagtcacacagacccccttgtcaaagactgggagatgtactggctccaggcatttaaagaaatctctgtccaataactaggtaactcctaaactaacttggtagacaattcagtagccacacatgacaaagaataggctttacagaattcattcagaaaagtcatcaacaataaactatagtggacaagaagaatttgctttctagaggcaccacattatattagtgaaaatgcccagttttcaacaaaaaaaaaaaaagagaaatatgaagatacaagaaagcatggcccatattcaggcaaaaaaaaaaaaaaaagcaatcaatgtaagtgatccctggcctggcacagtggctcatgcctataatcccagcactttgggaggctgaagtggggagatcactcttgaggtcaggagtttgagacctgtctggctgacatggtgaaactccgtctctaccaaaaatacaaaaattagctgggcatggtggcacatgcctgtaattccagctactcaggaggctgaggcacgagaactgtttgaactctgccaggaggcaaggctgcagtgagctgagatcatggcactgcactccagcctgggcagcagattaagactccatctcaaaaaaaaaaatatatatatatatatctagctcacatatacatctcatacacacacatatatatacacacatacacacacacacatatatgacccctgagaaaggcatggtggacttagaagacaaagactttaaatcagttatttaaacgtattaaaagaactaaagcaaactgtctaaagaactaaagaaaaagatgacaatgatatctcaccaaacagaaaatattaatgaagagatagaaattataagaaccaaatagggctgggcatggttgctcatacctgtaatcccagcaatttgggagactgaggcaggaggactgcttgaggccaggagtttgagaccagcctgggcaacatagcaagatactatcattaacaaaaaaaatacacaaaaattagccaggtgtggtagcactcacctgtaatctcagctactcaggaggctgaggcaggagggagaatcccctgggcccaaaagttcaaagctgcagtgagctatgatcataccactgcactctagcctgagagacagaacaagactctgtctgaaaaaaaaaataaccaaatagaaattatagattgaaaagtacgataactcaaataaaaaactctctataggggttaaagagcagatttgagtagaccaaagaaagagtcatcagttaacctaaagataggttaattgaggttatccagcctgagcagcagaataaacaatgaagaaaaatgaacagatcctaagaagtgtgtgagccatcataaagtgtaccaaagtgcatgcaatggagtatatcaacaggagaggagagaaagtgaaaagggcagaaaatacctttgaagaaactatggccaaagacttcccaaatttgatgaaagacaacaatctacacatccaagctgaatgaaatctgagtagaataaactcaaagagatccatgcctagacatatcataaacaaactgtcaaaagccaaggccaaagagagaagcttgaaggcaaaagatcagtgacttaccacatacaaggggtccaaataagattaacagctagtttctcattagaaaacatgcaggacaggaggcagagcaaatggcaagaaaaaaaaaagtgtaaaccaagaatttcatatccagcaaaactatccctcgaaaatgaagaaaaaatcaagacattaccagataagccaatgctgagataatttgtctctatggaatctgccctaaaacaaatagtaaaggaagtcttttaggctgaaattaaacacacacacacacacacacacacccaggtgcacgagcgtgtgcaaaactagatagacagtaaattaaactcacatagacataaaaagcatgattaaagataactacatggatgctatggtttggatgtggtttgtcccagtcaaaactcaggttgaaatttaattgccaatgcaacagtgtttggaggtggtgtctttaagaaatgattaacttaagttggattaatgtctttctcacaagactgggttagttctctgcagaaaggattagttttgataagagttaattgttataaaatgaggttgcctctcacgtttttccctttttgcctttccctttatctgccatgtttggaggaagcacaaggccctcaccagaagcaggagatgcgattgtccaatcttgaacatcccagcctgcagaaccatgagctaaataaacctatttttttaaataaattacccaatctcagatattctgttatggcaacatacaacaaaaggtaagacatacagaaaacaaatagcatactgggagacataataattcctcatcagcaattacattaaaaaattaaactctccaattaaaaggcagaaatttcagaatggattttaaaaacatgatccaattacacactgtctataagagattcactagagtttgtcagtaaaaagtagaaaataatatactgtgcaaatgctaaccaaaagaagtttgagtaactatcctagtattagacaaaatcatctttaagacaaaaattgttactagaaacaaataaggacattttataatgataaaggcttaatcattcaagaatacagaacaattatagacatatttgtacataacaattgtgccagagtagcaaagaattagcaaagaacaacattctgaacagctgagctggtagctctatactgaaaaatgagaaatgtcatttgcctaaattattgacaaccggaagactgcaaccgagatcaagtgcaccctagaaagccacaggttttctatcctggctgcatattgaaatgatccacagagtctaaaactatagataccccggccctatgccaagaaatcctgatatagtgagtctgaagtaacatttcttaaagtgccccaggtgttctgaagtgcaggcaggataaggagacacgggcctagagtgtgagagcatgggctctgaaacatacagcctgggtttcaacctgagctctgcctcttactcgctccaaaaaaccttgaacatgactgaaccttgctgtacccacatcatggaagagtgtctggaacacatcatagaagacactaagaacagatttaaaaaaaaaactatcccagtaatgtgaaaatacatattctttattcatgtcgctagttttcagcatttagaaaggcacttataaatgttagccattactgtcgttgtcatcatcatcatcatcatcatctgtcatcatcatcatttgcccaggacaggcacaacttgaggtacctctgaaccctcacaatggacactgaagttggggaagaaagagacaaatggcagctttacctggtggaaaataagctcagctcttccctcttgagcctgcttcatcccccaggaagactaaagtggatcttgccagtcagcacaacagagctcccactttcaaagatggccttcacattctggaccacgcatactagggtggagtttaggaaaggtaaactgtgccaccctcccataccaccacacccccgcaaacacacacacacacacacacacacacacacacacacgaaaccaactaatccaacaacaccaactttctaccttcattaacatagtccttcttttgtaaatataaataggacaatgaaagatggcctgatattgagtgggaaaaaaatagcataaataatgacctagatgattaaagagaccagttaacctgtggggggaggtgagaatatctgataaacagaattctaattaatatacttgaaggagattgcacccattaaatgagtgtttcataaaatgtgaacatattgctatgaaaaaaagcaattagagaaaaacacagttcttagaaaataacataactgtctgtcaaaataaaaaattcaacagaatgatcaaacagtagaatggatacagctgaaatccaaagtagttatctagaaaataaaatagaagtgccccagaaagtaaagaaaaagagaaagaaaacattagaaaatgttaagaatcccataggatcaatttagaaggtagagcatctatccactaggaattcaagtaagagaaggcaaaaataaataaatagatagatagatagatagatagatagatagatagataaagagatacaatcaaagaattaatggaagaaatttccccaacaatttttcttgaactatccaatagacgaataactagaactagtttaataattcactatggtctgtgataaacaagtatgagatcaatacacataatttttccagaaattatggcagaaaatacagttggttcttgaacaacacaggtttggactgcataggtccacttacacatggatcttcttctacctctgccacccctgagacagcaagaccaacccctcctcttcctcctcctcctcagcctactcaactgatgacgatgaggacgaaggcctttatgatggtccacttccacttaattaatagtaaatacattttctatttcttaggactttttgaaatgatattttcttttctctagcttactttattgtaagaatacagcatataatacatctaacatacaaaatatgtgttagttgactatgtgatcagtaaggcttccagtcggcagttgcttacttgtagttaagtttttgaggagtcacacattatatgcaaattttcaactacatgaggggtcagtgcccctaactgccatgttgttcaagggttaactctatatccccatctctaaatattatagatattattttccaggaattaatctataaaatcaatgcaatcacaaaatcaaatcatggccactgtgtaactttacaaactcattctaaatttattgaagaatgcacagaagagcaaataatatgtgaaaataagtcatttgacttattataaagctggactagttaaaacaatgtagtgttgtcttagaaatgaactgatagattcattacacaaaataaagattaacaaacagacccatatctagcagtgaggtggtggaaaacatttcaaatggcaggagaaatactgaatcgttcaaaaaaaataatattgggaaaatggtcatccgttaggaaaagataaagttagagtcttcataccatatgtaaaaataagctttgattcaattaaacataaaaagaaaaattaaacattttagaaataaacaggtgaataatttcagaattatggtccaagagagatcttttacagtgtatattttaaaaagacactttgttaaaaattaaaagacaaacaaactgacaagacaaactgggataaaatattagtcacttaaaacagaaaagtattatgatcttaagaaaaataaaaagaaaaaataaaaataaaaataaggaaatgaggagaggtcccctccaaggagggacagtgacagtgaaggagaggagtgatttgaaagactagaaggtaagaaaatgacatattaataatttggttcaatatattgaatcaggtcggggtgaggaaggaaccaagggaacctgagtttaggttttagaataaggcaactgaaggaaagggagaaacattcctaatgagataggggagcaaaaagaaattagtttgggtttggagtagattgagttggggtccttgtaggataaatgctaacatggaggctcctccagtttagtctcactaggcagattcatttgagttaacaaaaaactaaactatagacctcatgtgaaaaattataagattgtgttgtgtttctgttttgctttcttttcattctctttattatttttttattttgctttcttttatttttatttttattgtctcctacttgagttgctttattgaatcttcttttgtagacaaataagaatcatataattgtttggatttaaatggttattttcaaattgcttaagggtattcgaaaacaacttctttccttgcaatttttaaaatgtccctttctaattgcttacatgttaatacagtcacacaacaaaataatatgcaactgtttaaaacagtttgtactaagaaatattagtgaatggagcaacagtcatgaaatactcctaagcagaaaaaaaaaggcaggttacaaaataggtgcactatgaatctaattttcataaaaatatgtacgcatctgtgtatgcatggggaaaaatggaaggcaaaacagcaaaatataattgtctatctctaagtgttgggatctgggatgatttttaaaaattgtcttgtgtttttatgcatttgctaaattcaaaacaatgaatatttaatatactagagtttaaaaattaaaaaaaagaaatctcacacatcaatgtaacacagtctcacagaaaaaatatgtacaagcaattcatggaagaaattcaaataggtaatggaatcttattctttgtttcgtttcggtcccatctattctttgtttcctttttcctgttttctgccttcttttgcattaattggatattttttattattccattccatttcctttgttggtttcttagccaactctttggggtttttggttttattttgtggttgctttaagctttacagtatacaactttaatttatcatagtttaccttcaggtgacattagacttcatcaagtatagtctaagaatcttacattgtatagttccatccgccctcctttacagtattttcacacaattacttattcaaatgttataaaccccacaatacattggtgcatttttttttcctatttttggttctttgcatgcattcagcttcttgaatctgtgggtttctagtttttattccattttgaaaaaaaattactactatttcttcaagtattttttctgtttgccctcactccttattccacatatattagtgtttctggaaattattccacaaagctctgtgatttttttccatatttttgttgaaaaaatgttttttctctgtgttcttcattttggagaatgtatattgcattgcaatgcctgtaagtccactaatcttttttcttgtctcaaatctgccattaatctcatccagtgaatttttttctctcttacattgtagttttcatcagtagaagttcaactgggttttttttatacctccatgtgtctacttaacttttggaacatacaattttaataactgtaatctttgattagatgatagacattaggaatgttatctagttggtgctggatacttttgtattcctatgaacgttctcaaactttgctctgggacacaggtaaattacttggaaactatctgattcctttggatcttgcttttaatatctgttaggcagaactggaacagcatttagctcaaggctagttattctccactactgaggtaaaactcttctgcatgctgtatacaatgcccaggtgaatcatgaggtttccaatctggatggtgggaaaaccctaattttgtgactggcacttttgtctctagtcctctcagatagttctttcatggcctcagtttctctacctacatgcaagagctgatcagtagcagctgaatattcacagggcttcctctccaaatctccagaaccctctacttgagtaagtctttcctctctggcactttgttctgcaaattctagccaccttggactcccaggctcagtatagcctccttaactcagcaggactgccaggctcttcccaggttcctgtgctgtggcctagaaaccttctcacaacaggaggctgcagcaatccatccccagaggatccagaggcacacctttctctacagttatgagaaataaatacgcgagaggaacctcagcatccctgaactcttcctggaggccacaaattacagttggaatttctgtgctgccatctaactagggtccctaaatgcaatgaagatgatgagaccccagggttgcaggggccaggtggcagctcttaattgccaaaggcatggtggatgtggttactgtgaagcacagagagccaaagcagccatcagagtagactggctcaccgagatctttggtgttggctctgaaaagccctgtttctctgattgagccgtgatggatacacgtttctgtctgggttgataaagcttagcaataaaaataaaccaccatctgagtaaggcaaaaagccagatccctcaaacaatgtaatataaaatgcaaacaatactaaacacattattggatctatatggtactcatattcccatagattagtgcttcttaaagtagatttactttgctttaaaaaaaaaaactgtcctaaactgtaactaatttgttattggtaaaaataaattctaaaaaatgttttcaactccatggttattagtttctcaacagtattagttattatgaataatctaatatccagttcagtgctactgtactcaaggttttaaaacttataccgcctgtgattgtgggagactgtttccattattcatacataagccatcacaagatggttcactgaatctttcaaaaaatcatctaatcagagctatataatctgatttctaattggcatccagcataatatagaacccgttatagtttaatgtaaggaagacaatgatctcaatcatagaagacactaagaacagatttaaaaaaaaaactatcccagtaatgtgaaaatacatattctttattcatgtcgctagttttcagcatttagaaaggcacttataaaacactatggtaaacacacacacacacacacacacacacacacacacagcatttcccttcttcccctccgacattgcattcgccagcctacaaagggaggcctccctcactgagtgctcacagtgagctgctgctcccctctctttgccctcccgcacatcagtcactccggcagggactgtacagctctccttcatctcgctctgtgtgtctgtaagcgcagaatgatgaaaagaaggagctgcagcagggctccggatggccttgtgcttgggagccctgcagaggaaagctgctgccaggagagcaatggcagcaccaaaacgctccagcagcaggggccactcatgcctgtactcagccagccaggcctgcagggcgaatggagtggctgcaaagaccttggagctgtgggcccaaaactgcttcttctcactatcctgagggatacgcccctttcagagagggcaactgactgtgtggtgtttatggaaggagttggggggagggcaggccagtgtgcccccctgggaatgaactagaaaactcactgctgcatctttagttgacacctccaggaagaaaaaaaaacaaatcattagcacagacaataaaagcaggagcttttattttaaaaatcattgaaatcaagacttcaagtcatgctagtgctaagtcccagggcagggtactttgctttctaggtcttcctttccttgcataaggtctcacacgtcatctggaaaacctcagttccattttgtggtccctgggaaaccatgaagggcttaacgaaggggagtgacacaggctggcagacactttacataccacccacggcatctgtgtgtgtgtggagaacggattggagaagagccagctttttggcacacagatctgttaggaggctactatatgagatgccaggcaaggacctgccctagaatggtggctcaaggcagagagaagacaggggcagctgcatacaaataaaatgagtcacggccaggcgcagtggcttacacctgtaattccagcactttgggaggccaaggtgggcggatcacgagatcaggagtttgagaccagcctgaccaacatggagaaaccctgtctctactgaaaatacaaaaattagctgggcgtggtgcgcacacctttaatcccagctactcaggcagctgaggcaagagaatcgcttgaacccgggtggcagaggttgcagtgagccaagatcgtaccattgccctccagcctgggcaacagagtgagactctgtctcaaaaataataataataataataataataataataataataataaaaaaatgagccacaaggagagagcttgtgaataagtatgatgggtgaggaaggagaaggatgtctgagtgtctccccagtttctagaatgggtaggcggtggtgtcatcaactgagacagaaaatacaaagggacaagaagatgaggttgaaggaatgtaagtcatgtgatacctaattagagaagaaagataatgtccacacagactacagttggctggaacaaaggaggatttgggagtcagagaggtttgggttcaagtcctagctcattacttaaggtgtggaagccttggcctcgctttaaaaaccttttttaaaaaaactcttttgaactttaaaaactcttaaaaaaaaaaaagagtaggaaaacctactcttgccaggactgttgtgaggataaggacatacaggtcccactcgatgaatggttaccatcattgtttacagtattttctttggtattattctggatagaacatctttggtcacatttccaaaactctgcggtgatggttcctgatggttccttagtcaactcggctagaccacagtacccagatatgtggtcaaacactagtttggatgttgctgtgaaagtatttttgtagatgagattaagttttaagtagaccttgaacaaagcagattaccctccataatgtagtgggctgcaaccagtcagtggaaagaagagaaaatgacggacctgctacagggaggagggaattccacctgctgcctcccttcaggctaaagctgcagcctcagctcttccctccatctccagcctgcgggccagcactgcagactttcgaattgcccgttcccacaactgcgtgagccaattctttaaaataaataaatctgtctatatacatatacatacatatataaaatttataacctagatatatatatacatctgtgtatgcgtgtgtatatctatctatatctgcctctatatctgtatatctcccattggttatgtttttctaaagcaccctaatagaactttatattgtagattttccttgcatctattgtgaatgcctttactcctcataaagccaaagccgaggctatctcaatggtcatgattcagagagtgagtttttgctaatgaaccaaaagattgcactgttgtggtcaacacagcagaagaacattctcatggtacagataaaaaactacccagcaaaatccatacacttccgtctgcagtgcagaactgcctctgggaagtgcctgtccagagaggcagtgcctgccacaggttcctagatgggcctcatgacaggctctcctgaatggcttgaaaggcaagcaatgaatgtcagtttcaggccaagaaaattaaactgctagggttccttttctgttctctattccctttcactgacttgccaggtccctgagcccctctgtgaagcctgccacaggccacgcctgacctggacaggggccagggtagccttgccctgaactgagccactgatagtcaggaggttgctccagcaattagtgtcaccctaatgataccctaacctccctacataaggcaaggaagtcagtcaagccacatgaaccccttctcctctgcctggggcttgggaagaaattagtccatggaaggtcagtgctgaccacctcccagagagcagactggccctgctccaactatgcggcagggctggggagcgagcactctgaacattctactcctgtaggtccagctgctgctacatccccccactgggatgagtcctgagaccccagcctgcttccctggcttccctgggacactcctcagccaccaccataaggggtcctaactcctcgtcagctataagcttatgcatcctgcatggtaaaatgcccagccctgtgagattcctgatgctgaggccagggctgggggtggcgcgcgggggtgattgggtgatggacgtcatttctctcttgtcttttcattcacacacccactctgcggaaggcggcttttcctttgtttagagagcttaatctgtctgcaccatgaaggtgggtgtggagtgaggaggcagctgtccccatgtcactgaaggcagcgcagtcaccacactgcataccccgaggatgtcaaccccacagtcagcctattcactgcatttccccttggcaccaagagccagcttcaaaataatccagcaaggggctggggggaggtggggggtggggagatagtgacaaaacaagatgggccagatgttggcatctgttgaagccagaagaggagtacacaggggttcatgacagcagtctgtttacttttacgtatgtttgaaaagttctaaataaaaatatttttctaaaaggaaattccttatatgagccgagatacagcagaagaggagcctcacctgactctaaggccactcctgtcttccctgataccatttcagggcgtcatggttactctcatgaaggaagaggtgtttttaatagacaaatgtgggttatttttctattcccattaatatttactacatgtcattatctccaagtctaatcacttaaagaggagattttaaataattgattaatataaaagaagaaaaatgccacgctgtctttttcattatctatcaaaacccagaaaacctcttcctctagtcctgacacagacacatacatatattaatgcatacactgagaagaacaggcatacaaatcaatagacacaaatctgctcagggcatttttccgagggaaaaaccattaacctctctccatctcccgcgtggcctgctcctcagcacaatgccacggcaattcaagtaactctttttattttactcacagaattttagggttcccccaaaaacacaaaaatctaacatttcttgaactctgataacatatattttgcttgtgcgatcatacatatgcatgtatagtgcataaacaggctttaatgtctagatgaaatgcatgcatccacacttttttttttttttttttgagatggattctctctctgcaccaggctggagtgcagtggtgtggcgcgatctcggctcactgcaacctctacctcccgggttcaagcaattctcctgcctcagtctccccagtagctgggattacagacacccgccaacattccccggctaatttttctaattttagtagagatggggtttcaccatgttggccaggctggtctcgagctcctgactcattatctgcccgcctcggcaccccaaagtgctgggattacaggcgtcagctgcgccaagccgcatccacacttttaaaatgcccttgttggccaggcgcagtggctcatgcctgtaatcccagcactttgggaggccaaggtgggtggatcacgagttcaggagttccagaccagcctggccaagatggtgaaaccccatctctactaaaaacacaaaaaaattagccgggcatggtggcaggcacctgtaattccagctattcaggaggctgaggcagagaatcatttgaacctgggaggcagaggttgcagtgagccgagatcatgccattgcactccaggctaggtgacagagcgagactctgtctcaaaaaaaaaaaaaaaaaaaaaaaaagcccttggttcacgctcggtccttacaggaggacagcaaaacaaaacaaacacaaagaggatgccctcggagcatctcagcaagacactgaggagcgctctcagaagcacctcccatgagaaacacagtgcttctcacaagcccatcagcattcagcagtgagattttatcaagctctgcttcccgctgcctgaaaagaagttggaattctcttcgccactgcctccaacctgctcacgcatctgaaggtggaaccctgctccaaggccacctggagacgcaggtgccacttaccacaagggagagaggcctcttccaggagacgacacctatgagtcccgacagcagcacctggaaggacaaaagatacaggaaggtgagatgcttccgaaaccttgcatgggcaatcaaaacactgtgaaccgtttcaacccggagaaggacgtgtggaacacagcacacacacagtggcggggctaccatgagctgcattttcacagcttgcacccactctgagaggcacattggtctctcagggcaccagggtgctatggaggggtcactttgtgcactgcactaggtggcccgagagtgacaggctttctgaaacaccccaccctggtcctcgatgtgatttggctgtgctaggcacacgcttgtattcctagctactcgggaggctgaggcacgagaatcacttgaacctgggaggcagaggttgcagtgagccaagatcacaccactgcactccagcctgggaggcagagcgagactccatctcaaaaaaaaaaaaaaaatcacagagaacactatttggggaaaaggcaaatgcaaccccacccacgggccacctggccacctgccatggttgcatggaccctgggcatggcagaccctgcaggctccttctgccctatacacacttggctcccctgatgcacacccttctctcccctccagcccctgcgagcccctccccttcactcatcacagcttcccacctcacccgtacataggcagtgtcttctgatgaggctccagaactttctaggccctgactccaagcagcccactcctttcccaggccaagtcctgcccttgaccttgcctggggtctcaccagaagtcatcccctctctcctgcctcctccctactgtcctgatcacatgaatacactgtgacttctgtcccttagaagaaccactgcttagccctgtgtccagctcctggcctgcctgtctcctaggcggcctcctgaggccaggcaacctgaggatgacactggctctgatccccacattcctgatttcctggtgtccaggaagggccaatggatcatgaagacacagtcacttcccacccactaccatctatctggcttcagccccacaactccaaggaaacttctcccaaggttccccagcagtcaccaagtgcgacagacaaagctcggtccccatcacccggctgagggctgaggctccctcccatctgggctcctgtggcttctcactcccctgcggttcttcccacttcccaggggccgctctcctccacagcctccctcctggcctcctccctctccccaacctcttcctggtttcccaacacctgtctcctgagccctttgtctcctctccccagggctctgtggtggctgtcctgaggctcctcgagtaccatccactggtatctgcacaggtgattctcagcccagggctttgccatggccacggcatcacaccgtccacaggctctgctcctggcatctgtccaacccaacatgtccaaaaatgcagctgcagcctccacctcagaagcccacacttcctcttgcaacctctgctctccacaagagtacctcttcttccccgtcactcaagccgaaatcctggagatctttccctctcccttacccccatgtccaaccagggaggaacaggaggctaaggctcactcaacagggcagcatgtgagaaggccgaattaaaaggaaggtgtttgcagaccaggtctcctgtgaagacaaattgctcacgcttgccactgtgggcacaagccaggcatccgggcactggctggaagggcttggctgcatgtcccctgagactccaaaagcactggccagacccgggaggagggcatgatgctgacaaactcacaaggtacccttggtcacagactgcagttcaccctcaaccacctccacagggggcagaaccaggtctcagacacagcagccactatcacatcctgcaccatgctagtctagtatcaaaaacatctggccacaaaacaacaaaacaacaacaaaaacatgaaccaaagcacgcacaccagggctctgctcccaagcctctcacacgtgtattttttctgcaacgctcacaagtcctccaaacacagttaccggcgacagacattatttacagccatttcccaccgcccgggtcccctcccatggccatgccacccaggctccttgcctcgcagtccagttccagccctagggaaatccttgaccaatgtctctcgtgtctctcaggggctgtgtctcactaactctccttccaaatgcccctgaaacctctctcttgccttctgtacccaacatttgaacccagtgggcacaccatgttcccatgtcatttcacagtcagaggacaccggcctttcttggaaggagatgaccattcccgccggagctctcaccatcatttcatgtttgacatttcagaccctgacttcactcctccacacccactttcttctttttgtgaattcaaaatttctgaccataatgccatcatgttttgagctcatggtatatagttcaggggccactccgtcactaagcaggatccattcttctgctcagcaccctccatttcccggttcatctctctgccctctgccggcacgctcctgtttcacctgcccgatgacagccttgtccactcgctcttgtctccacctcctccctccccactgaagccatcctggatgcctccaccaaacaaaccgcatcaccctggcctgacaatttagaccacaaagctaggtccctgattttccagcactggaggcacctcccttggtggccccactcctgtccaggccactctgggcacctccagggaggctggcaagggaggaaactgcacagcagccactgtgtgactcacctacaagccacagagctctgtgggctgtcttccctccacacccaacctccgagacagcccccatcttccagcactcccttcctgtccccagccctcccggccccagcctcagcccccgactcttcttatccctcaagttgagggccacattccggggctctggctctgactctgccatctgcctaggatgaaacttccaaaaagtgtcttccatttttccacacgccccaacactggcctcacgcagactaagcctggacagatggtgagaagaaacatcccctagaaaatggcgtcttctacttcccatgtctaccagatgaaatcttacccgttcttcaaccatggccccaccctcctcactcacgaagagcctaggaattcaagagcccagggggcccatcagatccccaaactaccaccagagtcctgcaggcatctttaataaactcagattgaacgccttgacctcttctcagctgaagtgtattaaactatcaaaattctacagtgactaagtcgcttgtagcaggaatttcactggaagtacataaaacttccaaatcgtagccactactccacctacttctaagcctgaaggaagttaatattgcttttatcttattaagctacagggagagttcttgaccttccccattcccataagcaaagctatcattccacaaatcccctcacagaatttgactttcaacaaacacgggtgacttgctcactgaagacaatgtgcatttccaagtatcattaataactacaactaggaatggatcaaattctcctacacaaagcaaaagaataaagccattaaacttggcgtggcaggcagaattctaaaatgacccctggtgacccctggccttacagaatgctctcccctgagtaagaatatgatgggctgtcactcttgtggtcttcccccagggacatgttcaaataacatggccccagcaacactctggttgcagccttgtgaaacctggccaggtgactcttctatgggaggggggcaaggaaatgctgggtagagaagggtggggtgcctggcgagggctccaccctcaggcctgtgcccatggacctaagtgagaacgggcaatcctgttttcatgcccaaatgttgcatcttccaagaccactctggcctcccatgccccccatcctgtgcccataaaaatctgagaccatagtgggcatggacacaagcagctggatgttgaaaggaggagaagggcacaccaacagacaccagcagacactggcaggccactgacggcgggatgacacagaatttggtcgagggcagtcggaggagagtccagccactggccggcctgactccaggggaagacaccttcccactccatccccgttttgctccccatccacttcgctgagagctacctccaccactcaattaaacctcgcacccatcctccaagcccatgtgtgatctgatttttcctgtacactagggcaagaaccaggatacagaaagccctctgtccttgtgataaggcagagggtctaactgagctgattaacacaagctgcctgcagatggcaaaactgaaagagcactctgtaacacacacccactgaggctttgggacctgcaaacactcaaccctagacgatgccgtggagatggagccccaaaacactccccaaaacctacccatcttcatgttcccccttggagtttgaacagcggggcaccgaagaagcgaaccacacccttgtcacacgcccggtgaggcggataagggaactcctccggtttcaactctactaagcaaggtccagactcctaacccaagaaaactatgaggtattaagtgagtgttgtgtcaagctgcaaagtttatggtcatttgctacacagcaacagaaaacaattgttagggactaaatgtatgtgaccccccaattggagatgttgaatccctaacccgcaatgtaatggtatttggagatggggcctctgggaggtgattaggattagactgggtcatgaggatgacgccttcacaatgggactggtagctctacacgaggagaaagcgagctctcacgctctccgcacacacacaatgaggcagaccattcagagtgcaagtcagttattggtgtataaaaatgcttgtgaattttgcacattgattttgtatcctgagactttgctgaagttgcttatcagcttaaggagattttgggctgagaccatggggttttctaaatatacaatcatgtcatttgcaaacagggacaatttgacttcctcttttcctaattgaataccctttatttctttctcctgcctgactgccctggccagaacttccaacactatgttgaataggagtggtgagagagggcatccctgtcttgtgccagttttcaaagggaatgcttccagtttttgcccattcagtatgatattggctgtgggtttgtcatagatggctcttattattttgagatacatcacatcaatacctaatttattgagagtttttagcatgaagggctgttgaattttgtcaaaggccttttctgcatctattgagataatcatgtggtttttgtctttggttctgtttatatgctggattacatttattgatttgcatatgttgaataacagacaaaaagagagccaaatcatgagtgaactcccattcacaattgattcaaagagaataaaatacctaggaatccaacttacaagggatgtgaaggacctcttcaaggacaactacaaaccactgctcaacgaaataaaagaggatacaaacaaatggaagaacattccatgctcatggataggaagaatcaatatcgtgaaaatggacataatgccgaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcacactacctgacttcaaactatactacaaggctacagtaaccaaaacagcatggtactggtaccaaaacagagatacagaccaatggaacagaacagagccctcagaaataataccacacatctacaaccatctgatctttgacaaacctgacaaaaacaagaaatggggaaaggattccctatttaaaaatggtgctgggaaaactggctagccatacgtagaaagctgaaactggatcccttccttataccttatacaaaaattaattcaagatggattaaagacttatatgttagacctaaaaccataaaaaccctagaagaaaacctaggcaataccattcaggacataggcatcggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgccaaagggctcatatccagaatctacaaagaactcaaacaaatttacaagaaaaaaacaaacaaccctatcaacaagtgggtgaagggtatgaacagacacttctcaaaagacatttatgcagccaacagacacatgaaaaaatgctcatcatcactggccatcagagaaatgcaaatcaaaaccacaatgagatgccatctcacaccagttagaatggccataattaaaaagtcaggaaacaacaggtgccggagaggacgtagagaaataggaacacttttacactgttgtgggactgtaaactagttcaaccattgtggaagacagtgtggcaattcctcagggatctagaactagaaataccatttgacccagacatcccattactgggtatatacccaaaggattataaatcatgctgctataaagacacatgcacacacgtttattgcagcactattcacaatagcaaagacttggaactaacccaaatgtccatcaatgatagactggattaagaaaatatgccacatatacaacatggaatactatgtagccataaaaaaggatgagttcatgtcctttgtagagacatggatgaagctggaaaccatcattctcagcaaactatcgcaaggacaaaaaaccaaacactgcatgttctcactcataggtgggaattgaacaatgagaacacttggacacaggaaggggaacatcacacaccggggcctgttgtggggtggggggaggggggagggaaaacattaggagatatacctaatgtaaatgacgagttaatggatgcagcacaccaacatggcacatgtatacatatgtaacaaacctgcacgttgtgcacatgtaccctagaacttaaagtataatttaaaaaaacaataataataattaaaatattcaggaactatgaaaaaaaaaaaaagaatgcaagtcaggaaggagccctcaccagaaaccaagcttgctgacaccctgatttcagactttccagcttcacaaactgcgagaaaataaatttctgttaggtcacctagtctatgctatttcgttatggcagcctaagtagactaagacactacgacatccggagtgggacactggattgttgttccaaaacatctgctttctccccagacctctccaggaggggcagcacaggcttccctccccacacccctccccaatcctggaaacactgacacagctcccaacaccaatgcttgagcgcttggaactgactgtgcatgcattgcttgctgttcatcagtgagcttctgtggagccaagttggaaaacttttccctagaaaggtatagttctgccagtaacaggaatgcacccaggatttggaaacactgtgatgctcgagggcctcagctcacagcacagtagaaatcccaggccaagcccctaccttgccgtgggcatcaggctcagccacagtgctatggtggacactcatgctcagggcaagtcccttctccagccacatgccgcctgacgctgctccctgtcattgtgactccagccacctgccactctggcctcaattcattatttgtttatttgtttcttcgggagtgggacactggatcattttttcaaaacatctgctttctccccagacctctccaggaggggcagcacagacttcactccccccacccctccctgataccggaaacactgacacaggtccaaatacgaaggccaaatagattgggaaaggcatgatattgctcagggagaggaggcttaaccctaatgacggagggcctgcagaatggcttgagggaggcttttcacggcccaggtgctggtgtgcctcctccctggagaggccagctctggcccactggagaccaagggcggttgatgtaaaagcagctcagagcctctgctctgaaaccatcggatcttgaactgtttttgctcaattccagctaccagcaaggattatgttgcacattctgacatgtcagtaatcctgtaggttgattttgcaccactctcatgagaaaaagggtcatgaatctagttagccatgaaattaccgcatcatgaaaccttcatcccgtttaatttacaggtatcattattcagagtccacagttcacaaagaatatggagaaaacgaagagggttggggaagagtaacatagaattaaatagctgtggaaaaaaagccaaatagattggaaaaggcatgatattgctcaaggagaggaggccgaaccttgcgagcaccatgagttgtcacaaggacgccaactcgctcttttctccacttccccacccagcctaatagaggcaagagataaaatcagaacagagacagaacttcctgctgttgaggctgatgacaagggataacaggctgccgggaaataatggcatccttagagtcaaagacctgcccatttgattggtaccctgcctggacacagaggtctggaataaattagctctttaaatcttgtcctctaacactgaaaagttcttttacttcctaaaatcaagaatgttcttcagatcataaagtctggtccaaaggcaactgatagtgaagcaagtccttctagaacgcagtcttgaaagccaagtaaattactttcatgaaacatatggcagatgggtgcccaatagctacagagatatcaatttaccactaagaagccagcattcactgtgtgtggaaagaattgttgcaaaaacagagcaaataatattctgagtccaccaaccccccatcttccaaacctcctggactgcagctctgtgcaatattcctcctacagcctcctggagcagctgatcttcctacttcaccctccgtcaattctccttgctttgggtgtggctttctttctctgagtcttgctggggccacagaaggctcacgaggcatgcaggcctctaccatctgtctctacctttgaggacacactcattgctacccccaccctgtccatgctttctgccccctctccttagggcaacttccaactcaccattccctctcccagcctttcatcccaggctgtggtccaaacatcctccacaccatttcccttcaggggctgcaccaacacatcacactcataatgtccctgagaaaagttacctttcttctcaacctactgatagaaaaagaactctgcagctttcattatcttctcaagcagaagcaaaactataaattgatgacaaagatcacctcatgaaagagaaaaaactccttagtgttgaagtgttttaaaatattctaaataactcatgagtcaaaagatactgaaaggtgaaatacaccatggtctgttctgatgcaatgcatgcttctttgatgcacattctctcttaagtgcttggtaacaaactcatttgtccagggcctgccctgtaagatgctgcctcctcttacgggtatctactctgacattagggtagctgctggattttgttacttagtgggttattaggtagcacatatattattataatacattttaaaatatttttagtttaaaaatttcaaaataatttgtttcctttgtaatagtttttttggttttgttttttgttgctgttgttgttttgagacagagtctggctctatcgcccaggctggagtgcagtgacacgagctcggctcaccgcaagctccgcctcccgggttcacgccattctcctgcctcagcctcccaagtagctgggactacaggtgcctgccaccatgcctggctaattttttttcctattttttagtagagacagggtttcactgtgttagccaggatggtctcgatctcctgacctcgtgatctgcccgcctcagcctcccaaagtgttggaattacaggcgtgagccactgtgcccggcctttttttgtattttttagtggagaaggggtttcaccatgttagccaggatggtctcgatctcctgaccttgtgatccacccgcctcggcctcccaaagtgcagggattacaggcgtgagccactgtgcccggcctgtaatagttttatttcatgcttttaaaaaccttattctgagaagggatccacaggcttcactagattgtcatgacaaaagttatgaccccccccacccccgaccccgattaaagttcctttagagcagattttttggtgataaactcccgtttttggtttatctgtaaatagcttacttcgttcgccttgatgcttgaaaaatagttacgctggaaacaccctaggttgacagttgcatctctcaacagtttgaaactattattccactgttttctgactgccattgttgcagccaagtcagctgtcctcattctctaaagacttttgagatcatctccttgcctttagtattctgaactttttgcctggtatgttaggtgtggatttctttttaatcttctttgagagatactgtgctactgaatctgtgaatttatatttttcattcgttctggaaattttgtagctaatatctcttcagatattgtatcttcgctattctctttgccagggactccagtagctgtatgtttgtccttcacattccatcctccaaatgtcttagtttttcttccacatattccccacacatgtcattcatgacttcattctggttactttctttagctgtgtcttccagatcatcaattgtctctgcactgtgtctaatcagctgttgaactatataactgcacttgtttagaaaagttcagtgattatatctcaatatctagaaattcttttatttccaaatgtaactatttatttcaaatagttccttgttgtgtgctcatctatatgactgtgttgataatttctttaaatgtttcatacactaatgttctagattccaagacatgttgtcccaggagggtatcaaagtttgccctttgttgtctcattgtgatttgctttctttgatgcttgagcgcttggaagtgtttgactgtgcatgcattgcttgctgttcatcagtgaacttctgtggagccaagttggaaaacttttccctagagaggcatagttctgccagtaacaggaatgcacccaggatttggaaacactgtgatgctcaagggcctcagctcacagcacagtagaaatcccaggccaagcccctaccttgcagtgggcaccaggctcagccgcagtgctatggtggacactcatgctcagggcaagtcccttctccagccacataccgcctgacgctgctccctgtcattgtgactccagccacctgccactctggcctcagttcattatttatttgtttgggagtagggcagtggaccttgatgatctgcaatgcatcaaggagcatgtcttttgcagtgtatagttgttctataggagaagcatccttcaaagtgcctactcagccaaaatgccagaatcagaaggaaatcccccattcctggtgtttttattggtcccataaatacaccaataaagcaatgaatagaggctacttttatttttttttaaattaacaaatgttataagttatcaaaatatgaaactttatttagctaataaaattctttataaattccaaagtattccacatatcctattatttatttactcttttagccccagcaactatatttctcaaatcactttactttcaaaaaaacaaaatgttatcccaaattattctttccctccattttcccctggaaaaaaatattactcccatccaaagcctttctaattcagtagctttcctacatgctggtaagaaactgtaagacaaggattccattcacaaaagcaaaaaaattaaaaactatccaagaattaacttcatgatgaatgtataaggttttttaaaaggcaactacaagactctactgagacataggaaggaagatttttagtaaatggacgtatataccatgttcccaaatgaggaaacctaaagataataaaaatgttaatttctctatattcataaattaatttagtgaaatctctatcaaaatcccaatgggattctttgaaggttgacaaaatgattcaaaaatttatctgaaggaaaaatttttccttcagatagtagagaagaaacaatgtcattgaactatgtggagggaaagaggtttatgtattactggacacaattttcatcccttcattattttaagttaaaaattcccaggaacaaaaacagtttagaaagccacaatagttataagtggctcaagaacaaacagacctgtaaagaacagaatataatgtccagaaagagacttaggcatatattagggttttaaaaaattatttgttttttagattgtggtaaaatgtacatacataaaatttaccatttaaccatttttaagtgtacactcagtagcattaagtccattcaccttgtgcaaacattcccctcatccatctccagaaaacctttcatcttgcaaaattaaaactttgtatccattaatttacaccgattccccattccctcccccactctagcccctgacaaccaccattcttctttctgtctctatatgagtggaatcatagttttatccttttgtgacaggcttctatcacttaggataatggtttcaaggttcatccatatgtagcatgtgtcagaatctctttttttttttttttttttttttttgagacagttttgttctgtcgcccacgccggagtgcagtggtgtgatctcagctcactgcaagctctgcctcctgggttcatgccattctcctgccttagcctcctgagtagctgggctacaggcgcccaccaccacgcccggctacttttttttgtatttttagtagagacggggtttcaccatgttagccaggatggtctcgatctcctgatctcgtgatccgcccgcctcggcctcccaaagtgctgggattacaggcctgagccaccgcgcctggcctctccttcctttgtaagtctaatagtattctgtacgtatagacctcattctgttgagccactcgtctacagatggatgcttgggttgcttccaccttttagctatgaggataatgcttctatgaacacaggtgtgcaaatatgtctttgagacccttctttcaattcttttgggtatgtacccagaagtgaaatatggtaattctatttgtaataatacagagtggaaaacagtataaacctcctcaataattacaaatagaattaccatatggctattatttttataatagccattctgatgggtaggaagtggtagtcattttgattttttctcttttttctttctttttttttttttgagacagggtctcactctcacctaggctggagtgcagtgacgtgatcacagctcactgcactttcaacctcctgggctcaagcaatcctccctgctcagcctcccgagtagttgggactacaggtgcatgccaccacacccagctagttttcgtatttttttttctcaagagatgggggtttcgccacgttgcccaggctggtcttgaactcttgggtgccaacgatcctcctgcctgggcctcgaaaagtgctgggattacaggtgtgagccaccacgccagccattgttgtgattttgatttgcatctccttaaggattagtgatgttgagcatgttttcatgtgcttattagccatctgtatctcttctgtggagaaaggcctagtcaagccttttgcctatctttgaagctttcctcccagctttattgaggtatgactgacaaataaaaactgtatataaaatgtacaacatgattctggtatacatatactgtgaaatgattaccacaatcaagctaaccatatccatcacctcactagttaccatttcttctgagtgtttgataagaacatatgaagtctctttcagaaaatttcaaatatacagcacattattattaagtatagtcactatgctgtacattacgtctccagaatgtatttcttttataactgaaagtttataccctttgaccaacatctcccctttcccctctctcccccagccccgggcaactacgcttctcctctctgttaccatgagtttgactttttttttttagagtctacggacaagtgagattattcagtattcatctttctgtgtctggctaatttcacttagcataatgtcctctgggttcatccatgttgccaaaaatcctttgcccatttttgaattgtgttctttacttttttgttattgagttttaggagttttctatatgttctggataataatttctgatgaaatatgtgattttccagtactttttcccattctgtgggttgcctgtttactctcttaatagtgtcctttgatgcacaagtttttaattttgatgaagtccagtttgccacttttcttttgttgcttatgcctttggcatcatatccaagaaatcactgccaagcccagggttgtaaagcttttcccctaagcttccttctaagagttttataactttagctcttatgtttaggtctttaatccattttgagttaatttttgtataggatgttagttaagggtccaacttcattttttttgcatgtgaacacattaaattagtttttacaatttaatttatataattcagttatacaaggagtgacatagtaactgatgggggaaaaggctattcaataaatggttctgggataattgttaaatgtaaataaataagcagatagagaaattaaaattagttccctcccacaaaccaaaatacattacaagatgattaaaatattaaatgtaaataattaaccacccaggttactggctaaaactcacagaaaggcaactgctcctcaaaaaaatttactgagaggccaggcacagtgggtggctcacacctgtaatctcaacactttgggaggccgaggtgggcagatcacttgaggtcaggagctcgaggacagcctggccaacatggtgaaacctgtctccactaaaaatacaaacaattagccagacatggtggtatgtgcctgtagtcccagctactcaggaggctgaggtaggagaatgtcttgaacccaggaggcagaggttgccgtgagccgagattgtgccactgcactccagcctgggcgacagagtgagactccatcttaaaaaaaggaaaaaaaaatttactcagaaaaacaccttataagtaagtaatcaataaaatgcaaagtggaataagaggtcccttgctgcctgtcaagctagcagtggttagaaagaacagtggtcctcacttacagggctgtagagaatgtacatcattaagaggtgcgatgctgtcaactggcaaaaagtataataaacaaagcatgggctctatgcaaataaattcaaaacccaggatgacaaagataacttgctaaattactacaattgattccccaaaagaccaaaacactaactgttcccataaacaccaagaaattggaaatatgctcaaacagctgtaggcaaagtcttcaaaaacttctacgtatgaagatttccaaagctgtttaaattttttctgagcacagagggaaaaaagggggaacttccaaattgtctttataaaggtcagtgtaacaatcacaaacctgtaaaatatcacaaaaataaggaacagaccagtggcttttaaacagaagtacattgtttttattttatttttcctgtgctggatcaatatttaatgaatttcccccatgtatcaggcattgttggactctttcagatatttaactccttccccctcattatttatttggcaaaagttacattaagttattccctcccctcacaaagcaggttctccctgacttcaagggccaacatccaaacaaaaccaaacatgaaagacagagactcaaaaacttagcattcctcatctactacacatactagatataaacacacaaatttaaatgccaaaaactcataggacagtgcattaaaatgataattttactggtacatcatttttaaataaaaggttagaaaacagaattcagcagtacatttaaaagaatgaagaacatgggggttcacgtcaggaatgaaaagatggttctgcatattaatgtgacgaaaatgaaaaattctttcattcagtagatgcatggaagacgtccaatagaatttgatctccatcctctcttttaaaaaagaactcttagggctgggggcagtggctcacacctgtaatgccagcactttgggaggccgaggctagcggatcacttgaggtcaggagtcctagaccagcctggccaacatggtaaaatcctgtctctactaaaaatacaaaaatcagctgagtgtggtggcacatggctatagtctcagctactcgggaggctgaggcaggagaatcactggaacccgggaaacggaggttgcaatgagccaagatcacgccactgcactccagcctgggtgacagagcgagactccgtctcaaaaataaaataaaataaaacaaaatgattctgaaagtactcgtgtggtatgcagaattatgagatggcccccaaggtccccactccctggtgtacctgccctgtgtaatcctctcccttgggccgtgggtgggactgtgaatatgtatgtgattaggttacgctgcctgacaatggtggatgggaggtcccaaatcagtttgctgttgagttcatcaaaagggaagttctcttgggtgtgcctgacctaatcaggcaagacctttggttctgggcccttggtgaagtcccaatttgaggtgtaagaagttgtgctgctggccttgaagaagtgggctgccatgtggtgagatgcctctaagagctgagagcttccccacccacagcttgcaaggaagcagggctgagtcacacaacccccaaaatgaattctgccaacaacctgaaggagtttggaagtggatctttccctcgtaaagcttttggatgaagatgcttccagcctcaccaggatttcagcctgcagaccctgaggacaggacccaattaaaacactccagagtcccaacccttagaaactctgaaataataaggttgagctgtttgaacctgctatgcttgtggcaatttgccacataacaatagaaaactaatatatctagctaataacactaaaaaggaaaaataaaagaaagttataaacattggaaagaagaagcaaaatcattactatttgaaaataaagtgatcacctaattagaaaacccaaaggaattgattcagaagaataagaaaccataagaaaattcagtatgttacctggttacaaaatcaatatgttgaaaattataatactatatatagttgtcccttgaacaagaggggtgttaggggcaccaacctcctgtgcagtcaaaaatctatgtataacattttcactcctccaaaacttaactggtaatagtctgctgttgactggaagtcttaccaatcagataaacagttgattaacacacattcacattttggatgtcgtatgtactatatgctgtattcttacaataaagagaaaagaaaatgctattaagaaagtcataaggaagagaaaatatattttactattcattaagtggaagtggatcatcataaaggccttcatccttgtcatcttcttgttgagtaggctcaggaggaggaggaggaagaggagggctcagtcttgccatttcagggtggcagaggtggaagaaaatccacatataagtggacctatgctgtttaaacgcatgttgttcaaggtcaacaggatcaatatttattgtgccctgaatatatgccagatatacttactaagtttttatactttatcctgacaaccctaattagtatgtgtgactcttgtgcccgtgcacatatgtgaaaattaaagcacaaagagattaagtgacttgcccaacgttacaatgatgggcagggttaggacacaagctcttaaactatagacaaacagctttcctacatatgtgcaagcaaagactggttagaaaagagaatacaattaaaaattccatttataatggtaagcaaaaaggcagaatatcttagaatacacagatttaataagaggtgagcaggagcaatatcaaggaatccttaaacatctactggggaacctaaaagacttcatgactagatgggagggaaattcattttttaaacaaaaagactaaataatgtataagttccatgcaactctaattaaaataccaaaaaggggaaaagaaaatctacgcaataagaagtgctagggcaactggctagccacttggaaagaaatgaaacttaatctctacgtttcaacattaaaataaattccagagaaatcaaagagtaaaatataaattaaaacataaatatttgagaaatttgtaaaagaatcttgaagtaagccttttaaggcaccacacaattttaagacataatagaaacaattaataaatttaaaatgtatacgtttatggctaaaaaaacccacatttgtttgtggtaggaggaatctgtgttctcaatcccagggcctctctgcatctgcattagaagaacaagtctgtgcctttgacgtgtgaggtcggaggctcctgcagagtgggtggagtcccgtccccatcccagaataaacttggccatgggatatgcctggtggtgagtggaagtggcacatgccatcgccccgggccttctgatgcactacgtgctacctcttgccctcctccttgcccaggtggccactgccccttcaagcctgggccccggaatggacagatggcacagacacaaaccccatgagaagcttgcaacccaaagtggagccaccccagctgacctgcaaacccagaggagaaaataatggctcgctactgtcaagcactgcattttggtgtggtttttaatgtagcattattctgaaaagggccaatgaacacatttatggttaaaaaaaacccataaaaccaaaggctggtttcaaataggaaaaatatttataatacataaacagacaaaaggttttcttaatttacaaagagctcgtataaattaataaaagaaacaacagaaaaaaatggctgaatacgatgaataggatgtttagatttttaatgaacaataaacatgtaacagaatgcgtagacctactgaattttctaaagcaagtgaaaacaataagataagtatttttttcaacgagactggaaacattttggtgaagttttggtaaaacccagtgatggcaaagggcagaggggaaagaaagttcctcttaaacatttcttatgttggcataatttgatgtagccttccttgggaacaatttcatagcatctctcaaaataaaaactgtacatacccatactcaatggtttcaatcctgggaatttaacctgtggatatactaacagaaacaggccagcctatttacacaaggacgtttactacaaaaacctgaaccagtgagtagcaataaagggctagttaaaaagacttcggtatttacatagaacatgaatatgtgcattataaagtttgaggtagatctatttatgccactgtggaatgatctcgaagataaataactgacaagcaagacacagcccagtgtgcactgaaggatctctgtgtaaacaagaaggaatggatgaatgcatttactacataaacattgctctcttggaacgacgcacaagaaacctaacaatcggaaactagattaaggaggaggcgagggggaacttgcttttaaatgtgtaactttctgtaatattaacctttaatccatgcatgtattatgttaagcatatttaaaactctgcataccattgaacctagaattctacttctaagaattcccagtattaaccaaaggattatgtattttggaaactggaaacaaccgaggtgtgcagcaagagggaattacatatattcattgggtccttcctagttgctgccattaaatcatattatagaagaatatatatatatatacacacacatatatatgtatattgtattgtgtgtgtgtgtgtgtgtgtgtgtgtatatatgtatattggagacaaggtctccctctgtagcccaggctagaatgcagtggcatgatcacagctcactgtgacctccacctcccatgctcaagtgatcctcccatttcggcctcccgaatagcagggaatacaggcatgcatcacccggctgatttttgtatcttttgtagagagagggtttcactatgttgcccaggctggtctcgaactcctggctcaagtgatcccctcgctgtggcctcccaaagtgctgagattaaaggtgtgaaccactgtgcccagccacaggagaatatttaatgccatgtagaaacgttcacactaagtgaaagaagaagaaggaaaagcaggttgcaaaatggtgtggaaagtgcataatttcccttctgagaagcaaacaaatacataaagaaaatcagcagctgcatctcaaagttaccatggttatctccagacagtgagattttggcttcctctttatttttctgtttcccatggttgatacacaacagagaaaacgcactattaaaacccaagccagcgacagctggttctgcctcctaagtgaggaggcataacccatgccagtgggtactaactccctctaatgttcccatcagcaggcgggagaggtggacggggccagacaaattccaccacttcaatgtgagggccgatggcttcagaacaggtatggaaaggctctggaaacaatggcggccagtctgagtgagaggcagcaaaccagaatccctgcacagtgacggggtccaaggtggcaggatgaccaacaaggtgtgtaggggagggacggggcctgatctgcacagaaagtggttagccaggtggccatgtacacttctatgtgggctgctgctccttgatagagaataatgagaatttcagacataaatgcaagctacaagaataaattccaaccaggacccaaacgtattcaagagcctctgcccccctccctttctcaacccattgtcagaaaaaagtatgaagtgggaaggtagattgccctgcttgaaaaagagtattacataaaccatttgcaaatgacttttattctcttcttttagaaatctcctcatggcacaataataaaaacaatgtatttgttgatacagaacattaattccattaaaattgcattatgtgtaatgaaaagctatcagagtataattatgcaagcaaattcacagactcacatcaacttttaaatccactggaactatacaataggaactgaagctgtctggtagacaaattgctctttcttttccaaatcattatgaataaaggccactgtactaatgtcataaaccgcacactatttatgcaaactctcaaatccaggactgttccctagaggtgcctctgcctggtttttcccaggaccaacctgttctcagacccagaggctgtgctcccattcctgacttagccccaaagcaggctcccttctcggaattcttgcccagagagcccagttgtaccctgaagggagcctggttgcacccccaaagggttgcctgaatccgcacactctcagccctctgccccagcctgggagctgtgctctgctctgctgcccctggctggccgctgcagggcccgcaggctgctctccctcctccctgctgcaggtactgcacccaggtggccctcctgccatctctgctcacaccaggcagcgccacccacagagactggagtgcagagcccatctcctgtccccacgaggttctgagaggaggcagagggccaccaggacaggggaggaagggggcacgaggctggattcctgcaagggcacaggagtacatccagtgccgcccactcccgctgatgatagccccggtgaaaagacacaccctgggaaagggactcagtctatgcccctcactcatcacctatgtccatccctgggtttagacacttctaggatccccaaacacagtagggatatggacaactcgtgccatgctggtgacatgaagggaacccccccatctgactaagtggtcccagcacccttgtaatagccgtctccactccccagtcctgctcccctttcccctcactggcacaggcagaactcccctgtctggtcagttctgggtcgctgagtcccaggaacccccttcagcacccagcaggctgacactgatcttactcctgctttgcagaaggaacaccctcctgccttggccgcccccttgcttcctcccccactcacactccccagctgctcgttagtaagggctccctcggcccatcatctccccatacctcccctcccctcctcgcagtatctatcctgggagagcctgttccctccctggctccatcctccagggtaccctaagcctctctcagcctctcttcctcccagatccctgtgtccacccactggcctgatggaaacatgacggatgcctccccagcagcctaactcaatacagccagtgctcctggagcctgccctacctccacaggaggccccactcacccagatgtgcctgtcagggtcccagataccccacgtccctcccccacccaatctcactctcaaatccatccaaatcagggacatctactgaccagctcaccctgggccccggcccccagttcctccctccacctggtacctggctgccacctggcaggagagctactgtaagagccctacaaagccctccctgcctggactcctggtcacttctaacctgttttccacactgcagaatcatctttttaaaatgcaaacctggctgggcgtggtggctcacacctgtaatcccagcactttgggaggccgaggcgggcagatcacctgaggtcaggagttcgagaccagcctggccaacatggtgaaaccctgcctctactaaaactataaaaattagccaggcatggtggcatatgcctgtaatcccagctactcaggaggctgaggcaggtgaatcgtttgaacctgggaggtggaggttgcagtgagccaagattgcaccattgcactccagcctgggtgacagagcaagactccgtctccagaaaaaaaaaaaaaaaatctgaccatgtcactcgccccactcaatgacactgtgccctttaggggctttctttatcccttggagtaagtcccacatcttccagctcagaaggtccctgcctacccttcctgcttcatccaggtcactccatgggtggggtcacctctgcctccccctcaacccccaaacagctaattacccagactgggtagcaaacagctacaggaccacggggctacggcaccagcaccccacagtgccgctcactcatgcacctgcctttggctgctcagcaggtcctgggggcccagagcacgcttgtttcatctgcacagtgcccaccggagcaagggcctggtgccatggcacacatgagagtgaaggctgtcggcacgcacaaggttggccagcgcccacctccgggcgggagactttgtgcccatgctcctgaccagcttcacagccccacggaggcagcacggtcctgaggggcagtgtgctgacttttcccctttattttataaccaaaacaatgcaagttcaatatagaacaagttaggaaaggcagataagctgaaggaaataatgaaaccatctacattcacacggcttctcctctaactcctgttaacatgtggctgggttctatttaaatcggtttttataaaaattgggtcatcatgttgtcaataacctttccacattaccatataatgtgtcatgatcatgatggcacaccctgtaggtattcactgacatcaccttaatggctgaatgggactccattgtataaaaatacaaaatactcatgacctattattctataaacatttggaatcacaaacgtatgtgaaaaatatattttttaacaagcttatgaaaagataaacataagcctgtaatcccagcactttgggaggccaaggcgggtggatcacttgaggccaggagttcaagaccagtttggccaacatggcgaaaccgcatctctactaaaaatacaaaaaattagtcaagcatcatagcaggtgcctgtaatctcagctactcggatggctgaggtaagagaatcacttgaacctgggaggcaaaggttgcagtgagccaagatcatgccactgcactccagcctgggcgacagagcgaaactctgtttcaaaaattaaaaaaaagaatattaaaaaatatattaaatatatgaatatatttttaaaagtatttcattttttctgatctagtcattcttacacaatctgaagtcaaaattgttctgtagagaagctgccacttacaacaaatagttttgcttgtttcttcagtttactttcacatttctaaacttgatgctttgactgacttctgactatgaaaattgaggattctcactttcccctccaacacacagcagacacagccaaatgcacacactcgctctccctctcctcctcactttcccaatccaaatatagcaacaacccaccttttgatatttcagcattcagtattggcattattatgactacgtaaaatgtcacccataactgagccacaaggagtactacaattacagtgcctttaaaaaaaatcacatcacaatatgtaactggggttaattgcctcatttttcacttacatcttctacacagtcacacatgatttaacaacggagctatgttctgagaagtgcgcccttaggtgagtccatcattgtgtgaacctcacagaatgcacttacacaaacctagatggcgaagcccactacatacctaggctgtatggtacggcctactgctcccaggctacaaaactgggcagcatgttactgtcctgaacactgtaggcaactgtaatacaatggtgagtactttgtatttaacacatctcaacataataacggtacagtaaaaacatggtattagaatctcatgggaccaccattgtatacacagtccgtcattgagggaagcgttggtgtgtggtgtacgactgtatatctatcaaaaattcatcctagctctccaacagccctgaggtctccctcaccatgtatgagcacatgaagtctatcaaaaaatgagggagcaaaccaagaaaagagaagacatgggctcaagaaaacagaggctctagcccaggagagaggcgaaggggagtcgaagacccagggaagtccctaggagccatagtgcaccaggccagggcacagccaggtaaggagggagcaggtgacctgggtccaagaaggacatatctcagcaaaccagagtggtttgctccccatttttttgggttggggggagcccgagtctctctgtcacccatgctggagtgcagtggctcgatctccgctcactgcaacatacacctcccaatcaagcgattctcctgccgcagcctcccgagtagctgggactacaggcacccaccagcacaccccactaattttttggggttttttttgcatttttaatggagatagcgtttcaccatgttggccaggctggtctcgaactcctgacctccaggtgatccacccacctcggcctcccaaagtgctgggattacaggcctgagccactgcacctggcccacattttttgatagaccatatcctccactaactttcagagaaaggatttacagtaggtgaaatctgagggaccctacacgtttaacatgtaaggacagaaattttaggttgcagattattttgtctcagaactttttaggcaacgatctaatatgtgctgatctccatggtggctccagagtggtctgattcatcagcagatactggcaaggaccagctgtttaccaggcactgttctaggcacaggggatccagcagtttaaaaaaaagacatgcatagtgcctccctcatgacatcctggggagcagcagaggagggagacacaaaaataagagtgaaaccacatggcatgttacacagaatgaagaaaaataaggtgggaaagtgtgggctcaggagctgggaaatcctgggcttgtaggggtaacagatcccaaaaggaggaacgccctggtgggatggatgccggttcctgatggggatatacaggactctacaatggtgagacggtctttgtttttattcactgggtgaagtatgagaaactgatctgaatctgcaatctcctttcagttctgagaataactcctgtatcattttgcaatgatgattctacttcctttggtctctgcaaagcctatttatattctctggctgaccctctcatttactgtcttccctatttccaacttcctggtctttttttgttgttgttcagttttctgagagatttcccccaatttcatctttcaagcctttgatgatttttaaactttatattctgaaatttttcaaatagaaaagtacaaaaataagaatgttcaatccatctacttagcctgtcacgttaacaattttactatatttgcttcatctctttttctttgcttttcaagataaattacaaaccatgacattttaagtttttcaatatgcatacctaaaatacaaggacatttttctatataacctgtgaggccattaacacatctaaaatatactaattattaatagatcatctttgtatgatttcatacccaattcctattcaaatttcccagattgtccccagaataacttcttgcagttaatttgttcaaactagcttccaatgcttaggaatttgttatgtgcctacatggttgtaattttgttaagtagctttaaattttcagcttgttctttaacccacatgtctccggttttcagggtaggcaagggttttaatacaattatggtttcatcccttcacacatcccacatctctttctttgctagtataatctagaattttagattcaaactcatattacattgttttcatattatactcagtatcttttttcctttataaaaattaatttttcttttttttttggagatggagtctcgctttgttgcccaggcaatctcggctcactgcaacctccacctcctgagttcaagcaattctcatgcctcagcctcctgagtagctgggattacaagtagctgccaccacacccggctaatttttgtatttttagtagagacaggtttcaccatgttggccaggctggtctcgaactcctgacctcaagtgatctgcccaccttggcctcacaaagtgctgggattacaggcatgagccaccgtgcccggcctatttttctttttttttttttaaagacagggtctcaccgtgttacccaggctggtcttgaacaccctggctcaagtgatcctcctgccacaacctccgagtagctgggacttcaggcatgagccacctcgcctggctatattctgtgtctttcgatgttttttaaatttccactttccagttataactagtttcagtgttctgcattagttctgcttagccatgattccaccaactcaagctgctaacttaatagctcaaacgttgaatgacatcttcacgagactcctgtgagggtccccaaagcccccgatacctgagcatatcttcagggctcccaggaccaatatggactgctcgcctgctcagctatcatcacgtctgaagagcaggtcgccctagcgcaggtctggattcacagactttcccctcaatcactgcagatgctgcgtgcctgccctctgctttatcatagcagagaactctaaggcctgtctctttgtttgtatgtttgctttgctgaaaataaggtcccctacctagatgcttgtggaatcccattcttgaatttgcattgataatttcctttcctttctctctgaaacttttctggcatacttagttcatctccgcaagacagtgtgtttggtgttgcttgtttttgcactttacaaaaacagtgtcatagaaaaaacatagtattttttcatgtggtctcacaggcagagaactaattggctcctgcactgcaggtctcactcccctgcaggggctgctctggtggaagccagagcagggctgccccaggagcagccctggggcaacagagacttgaggcgacgggtctcggggaggcaagcctgaaatgtgctcggtaactgcactccagtcccctcaggagccagcacgatcacccgccgtagccaactgggtaacacacttggactagctatccttcctccctgcctccctctgccttcctgactgtgctctgcgcaaacaagagagattcctgctagtcctgctctcagtctgctttcagggtcatccaggctaagaacattcacgttcctaagattcctttatcatgttgttgcacacagctatagtttattcactttcactgtggtataacaacagtccatttcgttagaccacagaacttattttgtttgtttttgagatggagtcttgctctgttgcccaggctggagtgcagtggcacaatctcagctcactgcaacctccgcctcccaggttcaagcaattctcctgcctcagcctcccgagtagctgggattacaggcgtgcgccaccgcgcccagctaatttttttatttttagtagagacgtggtttcaccatgttggtcaggctggtctcgaattcctgacctggtgatccgccgcctcagcctcccaaactgctgagattacaggcatgagccactgcgcctggcctatataatttattaatatcccattcttctgctgatgaacatctgcactgtttccagtttttgctatcatgtactattcgttgatgactatcctggtgcacgtgggcaggagtttctgcaaggtatatgcttatgagtagaactgcaggtcacggtatgtgtgcatgttcagctatagaaaagaatgccaagttgtattccactgtattccagagtggtcccacccatttccactcccaccaagaattctcctgatccacattctgtccaaattggcattgtcaaacttcttaattgaggccaatctagtaggtgtaaacgatttctctccacagttgaattttacatgtccatgctgactggggcatgtgttgacacgtttattgaccctacatatgcccacttccatgaaatgcctatgtaagcattttgtccacttttctattgagttttgtgcctttatcctattgatttgtgggagttcactacatgaaatcataatcagttatgtgtattgcaagcatctccttccagttgtgtttttgctttcttcgtgatgtctttcaataaaaagaatgtttaaatgtacttacctttcaaacatatttttcagctttggcgtttctctgtcttgtttaaaaaattctttccaaatttcttacatcttacattttattctgtaaagttccaatgttttgctttcacagttaagtgtttaaaccacctgacactgattctcttgcatggatagccaatgatcccagaaccatttatggtagactccctgaattctgctcctggcctgccctgcatcgtttcatatatgcttcaggctctatcttatgttttgctgattgcattgtcttcctttgcacctacacttactgtctatagcttaaaaatgagtcttatacgtggtagcataaattccccccaaattcttcaggagcctcttgactttccttggcctatggctctgtcatataattttacaattaggttgttaagtcttaccctcccaacaaaaacatttgtcaggatttttaatgaaatcaattgaatctgatttggaaaaaaaaaacagccatcttcacagtattgagttagcttagactagctctctcaatatggtatatccctccatttatttaggttttatttaatgtctttcaataaagttttacacttttctgcatattcaaattacatattttttcttagatatagttctaagttccttatttttgtgctattgtaaataatgtccttaaacaatttacattttctctctgtggctgaagtataaagatacaattgatttttggtatattaaccttctagctaaccaccttgccaaactcattatttctaattgattgtagatggcttattcctgattttaaagggaatactttcaatgtttcctcattaagaataaaacagttctattaagtttgtatatgtattttttctataacttaagttctgttacgtttttctataaatctgtccattacatctgagttatcaaatgtgtagtctctcatcaactttttgatctcttctgtatctgtaattacatcttccttttcattcataataatggttatttgtaccttcttttttgttcttacacattcttaccatatttgtctattttgttagaattttcaaggagctaccttttggctatgtttatcctctttattgcagccttatattctatttcgttaatttctattcttatgtattatgttctttaaatttattcattcttctttttctaagtaaatctgatcacttcattcctattcttatgtattgtgttctttaaatttattcattcttctttttctaagtaaatctgatcacttcattcattttcaattgtcaatctttctaggtacctaaggctattcatttgcattacaatttcttctttgattaatgagttattaaaatctttttttaatttccaaatatattagggtcatttatccttttgttatttatttctaacttaattaaattgtggtcagagaatgtgatctccttgatattcattctttgaaatgttttgatatttactctacaaactaaaaaactgcaagatcaatttcttaaagatagtccctgtttacatgagaacatctctgaaagctgcagaattcagtatatgtaaattatacctggttgtgttctttaagttattacataatttttaattttctgtctgatagatcaacaatcaatatgtattgaaatttccttttcatgacagattgatcgatttctacctccatttttatgtgttttttctttatacgctttgcagtggtttaatcaaaagtatataagcataaaattgtacctatttgttatatgtaatgagcctctctctaacaaggctttttgactgaaagtcgattttgtctgatattaaaatggctctgccaatattcttttggttgacatctgcccacccaaacaactacacaaaaatctacaatttccaaactacattgtgaccagggttcattcatcacaacccctacatacgtacggtattttgcttgtgaactctcttcccctcttcctaccaaattttcttacagctttgaaatttgcctggacttcctaaaatgacaatgtcccagggaaatgttcaataatctgggtaaggagagacacacataggctcaaaataaagggatggaggaagatctaccaagcaaatggaaaacaaaaaaaggcaggggttgcaatcctggtctctaataaaacagactttaaaccaacaaagatcaaaagagacaaagaaggtcattacataatggtaaagggatcaatgcaacaagaagagctaactatcctaaatatatatgcacccaatacaggagcacccagattcataaagcaagtccttagtgacctacaaagagacttagactcccacacaataataatgggagactttaacaccccactgtcaacattagacagatcaacgagacagaaagttaacaaggatatccaggaattggactcagctctgcaccaagcggacctaatagacatctacagaactctccaccccaaatcaacagaatatatattcttttcagcaccataccacacctattccaaaattgaccacatagttggaagtaaagcactcctcagcaaatgtaaaagaacagaaattataaggaaccgtctctcagaccataatgcaatcaaactagaactcaggattaagaaactcactcaaaaccactcaactacatggaaactgaacaacctgctcctgaatgactactgggtacatcacgaaatgaaggcagaaataaagatgttctttgaaaccaacgagaacaaagatacaacataccagaatctctgggacacattcaaagcagtgtgtagagggaaatttatagcactaaatgcccacaagagaaagcaggaaagacctaaaattgacaccctaacatcacaattaaaagaactagagaagcaagagcaaacacattcaaaagctagcagaaggcaagaaataactaagatcagagcagaactgaaggagatagagacacaaaaacccttcaaaaaatcaatgaatccaggagctggttttctgaaaagatcaacaaaattgacagactgctagcaagactaataaagaagaaaagagagaagaatcaaatagatgcaataaaaaatgataaaggggatatcaccaccgatcccacagaaatacaaactaccatcagagaatactataaacacctctacacaaataaactagaaaatctagaagaaatggataaattcctcgacacatacaccctcccaagactaaaccaggaagaagttgaatctctgaatagacaaataataacaggctctgaaattgaggcaataattaatagcttaccaaccaaaaaaagtccaggaccagatggattcacagccgaattctaccagaggtacaaggaggagctggtaccattccttctgaaactattccaatcaacagaaaaacagtgaatcccccctaactcattttatgaggccagcatcatcctgatacaaagtctggcagagacacaacaaaaaaagagaattttacaccaatatccctgatgaacattgatgcaaaaatcctcaataaaatactggcaaaccgaatccagcagcacatcaaaaagcttatccaccatgatcaagtgggcttcatccctgggatgcaaggctggttcaacaagtgaaaatcaataaacgtaatccagcatataaacagaaccaaagacaaaaaccacgattatctcaatagatgcagaaaaggcctttgacagaattcaacaacccttcatgctaaaaactctcaataaattaggtattgatgggatgtatctcaaaataataagagctatctatgacaaacccacagccaatatcatactgaatgggcaaaaactggaagcattccctttgaaaactggcataagacagggatgccctctctcaccactcctattcaacatagtgttggaagttctggccagggcagtcaggcaggagaaggagataaacggcattcaattaggaaaagaggaagtcaaattgtccctgtttgcagatgacatgattgtatatctagaaaaccccgtcgtctcagcccacaatctccttaagctgataagcaacttcagcaaagtctcaggatacaaaatcaatgtgcaaaaatcacaagcattcttatacaccaataacagacagacagccaaatcatgagtgaactcccattcacaactgcttcaaagagaataaaatacctagaaatccaacttacaagggatgtgaaggacctcttcaaggacaactacaagccactgctcaatgaaataaaagaggatacaaacaaatggaagaacattccatgctcatgggtaggaagaatcagtatcgtgaaaatggccataatgcccaaggtaatttatagattcaatgccatccccatcaagctaccaatggctttcttcacagaattggaaaaaactactttaaagttcatatggaaccaaaaaagagcctgcattgccaagtcaatcctaagccaaaagaacaaagctggaggcatcacgctacctgacttcaaactatactacaaggctacagtaaccaaaacagcatggtactggtaccaaaacagagatatagaccaatggaatacaacagagccctcagaaataatgccgcgtatctacaaccatctgatctttgactaacctgacaaaaacgagaaatggggaaaggattccctatttaataaatggtgttgggaaaactggctagtcatatgcagaaagctgaaactggatctcttccttacaccttatacaaaaattaattcaaggtggattaaagacttacatgttagacctaaaaccataaaaaccctagaagaaaacctaggcaataccattcaggacataggcatgggcaaagacttcatgtctaaaacaccaaaagcaatggcaacaaaagccaaaattgacaaatgggatctaattaaactaaagagcttctgcacggcaaaagaaactaccatcagagtgaacaggcaacctacagaatgggagaaaatttttgcaatctactcatctgacaaagggctcatatccagaatctacaatgaactccaacaaatttacaagaagaaaacaaacaaccccatcaacaagtgggcaaaggatatgaacagacacttctcaaaagacatttatgcagccagaaaacacatgaaaaattgctcatcatcactggccatcagagaaatgcaaatcaaaaccacaatgagataccatctcacaccagttaggatggcgatcattaaaaagtcaggaaacaacaggtgctggagagggtgtggagaaataggaacactctttcactgttagtgggactgtaaaccagttcaaccattgtggaagtcagtgtggctattcctcagggatctagaactagaaatactatttgacccagccatcccattactgggtatatacccaaaggattataaatcatgctgctataaagacacatgcacacgtatgtttactgcagcactattcacaatagtaaagacttggaaccaacccaaatatccaacaatgatagactggattaagaaaatgtggcacatatacaccatggaatactatgcagccataaaaaatgatgagttcttgtcctttgtagggacatggatgaagctggaaaccatcattctcagcaaactatcgcaaggacaaaaaaccaaacaccgcatgttctcactcaggtgggaattgaacaatgagaacacatggacacagtaaggggaacatcacacaccggggactgctgtggggttaggggagcagagagagatagcattaggagatatatctaatgctgaatgacgagttaatgggtgcagcacaccaacatggcacatgtatacatatgtaacaaacctgcacgttgtgcacaggtaccctaaaacttaaagtataataataataaaatttaaaataataataataataatctacgtaaaaaaagaaatgttgatgtggctgaaatatatatgtatgtatcttgcaaatataattcatggctattttccatataaatcatctcaaatcaagatttgattttctctaacagatctggtctgaaaagtatagttatgaacaggagtggagtcatgggcattcactgcttctttaattgcattttctggaaaactctacagttctgtttttaacatttgatcacaccatcagtagagctacattccacaaagcaattatgttttgctcagcaaaatatcagaatggaataatatgctgcatattaacaactgtaagaatagaagccatttagaacattttagaataatgattgaggtcatttgttcagaatttacagcaaatgtgttttaaagacccactatcatggagtccactgtgaagtctaagttatgcacatcagaaactacaaatgcacaaggagcccagtattttatcaaaacattaatatcagcactattaaaaaccaaaccttttatccagcaccccctgcttaccagctctccccatgtacaaatgcattagcatttaatgcaatatgctttccttttctttaagggctttatccagatatctagaaagtagtaaagtggtagcatttaactaacacaggagtggcaaacaggtggcaactcccttcctcgacccagaaggacaaggctcatctatcaccacaccctccgtgcagagtacagaagccatcttagaatccttctaacacagtattccaggcaccatgacttagaatttgtgttggcatgccagatcccacctacccgaaggtgctatataaataggctagggcagctaggggaatacagttatatgtcttattcacaattctaaaaggcagttcgtggttgcacaggtctttcgcttccaggtcggatggagtagttagcagctcatcagtgtccccagtaagaacaacaggaaaagctcaataaaatatggaaatcaactctctgaaaatggctgagagtgacaaaattcaaacaggcttgagagaggaatgaacctccctccaagaagggagctaaactctgaagcttcttttatcctagaagtgttccaattctgggcacaagcagcagcctgagaactctggctatgcacctgctgaaagccagttctgggggaaaccccagcagggctatggttggagacttggggtccaagcacatggttgggttttcccctgggatagctttccaattctgagggtaagagacttaaattttaacaaaaagccactggaaggcagcctcaaaataaaaattgtaattaggaaacacaagagagaggggctgtgacaaatatagaagactctcatttgaaaaccctaaaaggcaaggacaaacaacagcaagactgaagcttaccagggctgcaaaccagctctgagtcagcacagtccttgcttcaatgaaggtgatgaacaccagataatctggacaataaagttagctggctgacttcaaaacaattatagttattacgcccaagaaaacagagaaaaagatgaataaaataaatgaaaagaagaatttcaccagataactataattggtaaaaattaataatcaaagagaaaatataaaactaaaaaatacaacatctaaaatgagtaactcaacagatgggtttaacagcaaattagatacagaagataagactagtaaacagcaagacaggtcaattaaaacgaatacccaaactaaaacctaaggaggaaaaaaaaatttaagaggattagagagacacaggacacaatgaatgggcctagtgtatgtgattcaagtcccattcagagaaaaagagaacagggtagaagaaatgatggccaaggattttctaaaacaaacaaaacagcaaatctcaaatcgttcagtaagcgctgcaaagctaagctggccatttacacaaaagaaaaagaaacctaaataaaaggaaaaatcttaaaagcagcaaaggagcagatctggacgcacatattaccttcaaagaagtaacaaaaagactggtagtcattttctaacaaaattgatggaaaccaccttttaagtcctgaaaggaagtagctgccaacctagaattctatcaccaagaaaatatccttcaaaaaaggaagctaaaataaaaatgtttctgagacaatcacagcagaatttgtcaccagcaaacttacactaaagaaaagaaaaatgacctagagaaaaacccaaataaggacgaagaaatgaagattgatgaaagggatgaatgaatatggactgcgaccaaactttggaagttatgaaaaggacagacaggcagtactgatttagccaaattaagaaagatggatcctaaagcagcaacagcagcagcagagaagagagaacaacccattgtgcacctcagaaccctcaaaagattcaggcacgagtctcaatgggcacctctggaagtggggctaatttggtgtagaaggcttgagggatttgggggctaatcaaggaagtagatatgctgaaaggaagcagtaacacatgcaagctttcttaaaaggttatgtgggaggggaagtccctcacagtatgacatccacaggcttcaagcaaggggtctatccagaaggggaagaggacaagggaactcctggggaaagggggtcagagaggaggctgacatagccaggtgacagtctgtagcagcacagcagggggtcccagggtcagagagctttgatggtagcagtggcttggagctttataaccacaaggctctatcttaccagaggccagctcaccgggtatgcaaagcagtcaggctcttaatggctaaaaatctgctaattcaggctatttgaaaaaaattagacgtgtaaaaatttgagtttggtaccagtgggcttctgagctaacagatctcagtctgctatgaagaaataaacaacctagaggccaatatatagtggccacctttggcctctatatgacacttgggaaggagggctaagataaggaatggaaatttggacagctacttgaaaacagatttcccagccctgcaccctagcagaattctgaaggactgttcccctaaaaacatcaaaacaggtctgtgctgtggactgaccagccccagaccacaatgcagcaacatgaggcaacagaaggcattctgaggctggtcccaccatgccctctgcccctgcagcatctttttaggtgaaactaatgcagaatgtgctccacaaaacaaggcagcaaagtcagaatgaggaagacctgagatgcagaaaatgacccagtggaattccagagatggcagaaagagggaacccgggctgacagctgtgtacaggcctagaaagccaccaacccaagagaagaaaatgagtcctggagaagaaaatgggaacagaaagataacctactagagctgagctgagtcagtattactgagaggctattgcaagaggagctattgattaaggcgaggcaagtactgacttcaagagtaagttagtgaaagtgaacataccactctacacagctctgcagtgaataatatctgcataggtataaatccaaatactgactaaattaaacttgtaacatacccactctggaggatgaggaaggggaaccagagagaaaatgaaaagctaaatcctcactgccataattagaaacctacaatgatatctacaaccaattaatcaaagatagcagaatttgtatcttatttagaaatgtggagacgtagtaagtcccagggaaaaaagctgaattaaaagtagttgcctctgcacaagttagagcagggaactactgggttttcctatttgctatttgactttttaaactatgttttcatttcattagatgacataaaaattaactttaaaaacacatagacatgaatatttttccttagtaatatgaaacttacaatgctcaaactacgtaacactagcatctataaaacctacaggaaaacagctgatcattttacatttaacttcttttaatataaagagagcttactctcctaaattaagccaaaactcccagatctctcaatttttcatggtgccatgggaaaaagcaaatctgatgtttctaccctcaaaataccaaaaggattaacatcagctaatttcttcaattatgacttcatgagtaacggactctaagtcctggacagcagccaacatcctgccagatgctaaagacagcatggtggaggcctgaaagagaactcagaatgaggacatggggccgggcacggtggctcacgcctgtaatcccagcactttgggaggccgaagcaggtggatcacctgaggtcaggagttcaaaaccagcctggccaacatggtggaaccctgtctgtactaaaaatacaaaaaatttagccatgcatggtggtgggcacctgtaatacctgttactctggaagctgaggcaggagaattgcttgaacccaggaagcagaggttgcagtgagccgaggtcgcgccattgcactccagcctgagcaacaagagtgaaactccgtgtcaaaaaaaaagaaaaaagaaaaaaagaaaaaaaagaatgaggacatggccactgactggtgctgagcaggttatctctcacccaggatggggaccccacataccattatctgctctcctgcctctccgggggctcagcaacactatggcagtggactttgaattacagagcagaaagaaaggttaaattcttggacttgaataaagagaacggcagggtaaactctaggagtttgtagggggaaagtcagcaagtttgcgtgttaaataagggtagagtacaagacaactatcccagtggctgtaaggccaaagaactctgaggctctgtaatgtcggaagttgctggctctctgctatgcaaggtaaccctacccccaccctctaccatctcacctacaaaatcatcagtaaatttatctggacaaagatacctttgtaagagtagaccagggtggagtgaaggtgacaaggactcacaaaggttttgagtgtgaaacttaggtaagagagaaagaacagtgctgagacagcccctgagcatgatggatccagggggatggaacttgtactccatggaattagaagtaagtatggagagagtttgggacattgtggccaatggaaccggtgtacctaagaaggctaggggatcaagatggaatctgagatgcagaatccaatgtataatttcgggataggtgagtgtgtctttaatgttttacaaaatattagtttatcaaagaacacatataaaaatgggttccacgtcaacgaggtctgaaaacatgacatagtatacccttttcatgcagagtcacggtgcacatgagaataacacagtcaagctaaaatgcacaccacaggaaagaaaatgcttcaaccctgaataaccccgcctgccccaaatgtgaccttggaatctttttaactcagaatacacatttaacatcttgtatacacagttgtttactatacatgttagtgaaaatgctggcataggaaattatagtgggaattcagagagagataagttagggtttttttccttcacaatgaaaattccttcttctgactatacatataaatagtacaccctaatgctgctaaatttagttaacatgaaaaattctagagaagaatgtaaaattcacccacaccaccatacacaaagataaaccaatggcaatgtttaaatgtattcatacctagattttttggtttacaaagtttatttgggccggcgcggtggctcacgtctgtaatcccagcacttcaggaggccaaggcgggcggatcacgcggtcaggagatcgagaccatcctggctaccacagtgaaaccccatctctactaaaaatacaaaaaaaaaaaaaaaaattagccggacgacgtggcgggcgcctgtagtcccagctacgccagaggctgaggcaggagaatggcgtgaacctgggaggcggaggctgcagtaagcagatatcgcgccactgcactccaacctgggcgacagcgagactccgtctcaaaaaaaaaatttgatttttttctaaggactccgttcacagtacacagtttttcctttaaaaatatatcacagacgtatgtggacacccatcctccaatgatgtacattcagactatctcaatgggaaaaaaaatgaggcttacattgtgtccgcaatttattcttccccgtgggttcttggtcttgctgacttcaggaatgaaggcgtggaccctcacggtgagtgtcacagctcttaaagatggtgtgtctagagtttgttctttcagatgcgtctggaactttttccttcccacgggtttgtgctctcactgacttcaggaaggaagctgcaaaccctcaatgtgagttatagctcataaaggtaatgcaaacccaaagagtgagcaacagcaagctttattgccaagagcagcaaaaatacaaaacctctgcactacctaagtggaccccatggggctcccaccgctgactgggtggcttttgttcccttatttggccccgcccacatcctgctgattggtccattttacagagcgttgattggtcccttttacagagtgctgattggtcccttttacagagtgctgattggtgtgtttttatagagtgccgattggtgcatttacaatcctttagctggacacaaaagttctccaaatccccacctgacccagaagcccaacttggcttcctcttttaatattgctattgactctattctgcccagtctgggtaggcgccaacctctcaggtgaaaggagcacaagagaaggtaaaggctgtcttgacctgtagtgacccaacaccaggtcatccacaacagggagaagaggtactgagaggggccctgcaaagtcctggtttatttattccgttggtaaccatgaggcagaggagacacaccaggcagtgccccaggaatcctcaagctcacagctttttcaacacatttccttttctttacaactggagtctttctgaaagttgtcttctgcacaaattgctaccaaaatcctcgccagtgtctctcccactgcaggcacaagaccagcaagccttatcatgtctgtgtctccaagtatcttgttcttgctgaccaagtcatggttttctaattctactgacacagtacattctatttccatcatcaaaacccatcagacagatgacagatctgcaaacaccataatggggtgattatacttttatgactagtttttgttgttgttgttttgtttttgttttttgagatggagtctcgctctgttgcccaggctggagtgcagtggcatgatctccactcactgcaagctccacctccagggttcacgccattctcctgcctcagcctcccaagtagctgggactacaggcacccaccaccacgtccaggttttttgtttttttttttgtattttttaatagacatggggtttcactgtgttagccaggatggtctcgatctcctgacctcatcatctgcctgcctcagcctcccaaagtgctgggattacaggctgagccaccacgcctggctttttatgactagttttaaatcttctttatcctgtttggagttatatttttgtattgcattctatttgatcatacgtggacagtcctactttcctttacttggccactgccagatagctctttgccaatgccctggtctgttattttaagctatttgtgtttgtttgtttgccaatagtatctatctgatttttgctttttaccccaatctaaaagtgctgtcttttaatagaggaaattaagtaacacctttagcgtggtagctaacataactgaattatttcctagcttatttactatatttccttaatttttgtttctctaattttcctgtcttttgctattttgttcaatttttgttgtttgctttttctaatgatttggaaattatatatcaattttctaaccaaaattttaaatctatgtttgaaattatatatctaataagtatatatcaatagcatagatatctatagtctctatgcaacatggcaaaattttctacctcaacctgcctcccagattttatcaaaacaaccacattagtgtcaacaattcaaacttaactttatgtttcattggtttaattgcttacttctgcagtatttataccaatgcttcctgtttatctttaataactaaatataattattaaatttatataattctataaattattgaatttatataattattacataaagataattgattattttaataattaaataattgatttattttaataacaagtaaaggtattaaatatttaataataattttcctcatttggcttgtgcactacaagtcatttcctttattcagaaatggtatgcagaaatttggagtccactgtatttctgaaaatcactttcatgtacccattcacatacatgagcttagaaatcttgcatacagaaagcctagaggaatcttgcttaacaacctgttccttctaaaatatgcaaatgttgctgcattatcttctagcatttgactttatggattaaaatctagtattaatgtgattattttctgtagcctgctttgtcttgtttaacgcttatctttgattttttttgattactgaaattcagaaaatgttctattacatgaatcaaacctaaaacaaaaacatctcctatatgcctgtctgacgtcttacatgtatcttccatgacctttagcttttctctcctaatttccccatcttgtctcattcctctcagttgaaaaatagatcccccaggtgatatcctaattcactaatccaatgttggtcatctggtttccttctcacagtaacattttcgtgtcctccgtctgcctccactgcacttgacagtctcttcttttgcaatgtggcacctctcagatctcacaggtcataagccagagttgttttgaagttttattccatttctctgtttcactgtgtgccatttactccattggcttttggagttggtatgtgatatatcctaaacattcacaaatacttcaaaatgctatgcacactgggcgccgagtggtcagtgtgatgcccaaagcttggggcagtgcattacatacagaagtagaagagaattgtccaatcagaattaaacatgatggctttgacctactgtctgcaggaaataagtgatgagagaaggccaaagaaaactgtagccatgtggcctccagatggaccttattatcttatgggtgcttggtttctttttgttctttgaccctaggtgatttattttgttatatttaaagcaaactagcaatttctgctctataattaaaagtatgtgtatgtctttataaacactgagtatatatactattaattgctgttgttatttttccattctcaaagctttccaggcctaatcgttatcctgcaacaactttcaaagaagtgagagcaatgatttcctctcctccactgttcatacgaatcatggagaagcggggttgaaaacgaagactgcctgagccccaacccccggagtccaacttggggtacctgagatatagccctatctgttagtttcctattgctgctgcaaccaatgaccaaaaactcagtggcttaaaacaatacaaaattatcacctttcagcttttgaggtcaaaagtccaaaatgggttgggttggtaggactgagctccttctggaagctccaggggagagtccctttccttgccttctccagcttccagagactgccctcagcccttggcttgtggccccactgcactcctgagttctgcttccatcctcgcctctccttctctgactctcctgcctccctctttcccttatgagggcccttgtgactaccttgaacccattcagatacccggcataacctccccatctccaaacccataacttcaccacatctacaaagccccttttgccatgtaaagtaatacattcataggttccagcgattaggaaggacgtggacatcagtggggttgggggtacgagtctccctatacacccagaaacctgcactttgaacaagaaccagcagactgcctggtgagaaacaccaaatcacacccactacatggtggctggagctttttcctttaggacactcttcagacccatcaccttaaaagtccgaaaccaacagagtgataaatatcataatataaacaaaacaccatccttgacaatttattaagataaaatattgcagtatgtacctagacctacccagaattcatttttaagtggaaagttaaatgacagaacagaaatgtctaagaatcattggggaaaaatacaagtcaaacccaaagccaagtccactttccacagcagaatcaagatgacaccctgtggagactccgatacactcaaaaaacatacttccatgtttgtttgtttgagacagagtctcactctatcgcccaggctgcagtgaagtggttcgatcttggctcactgcaaccgctgccccatgggttcaagcgattctcctgcttcagcctcccgagtagctgttattacaggtgctcgccaccacacacggctatttttttggatttttagcagagatggggtttcaccatgttgaccaggctggtcttgaactcctgacctcaggtgatccaccctccttgcactcccaaagtgctgggattacaggtgtgagccaccgtgcccagccacttccatgttttaaagcttcacttttccatctgtcttaagctcttttcccaaaaaaaaaaaagtaaaatttctgaattgtttaaatacattattaggaaacagaacttaaaaggccagtcctcttagtacatgcccaaattccaaatgtgtcactatttctataataaatagcgccagcactgacagacttcataatgcagggtttcctgtgctgccattcaccagcacacacaaaagtgagagtaatgaaaatgtcaggaaacggcatcccatttagaaaccaggaaatacaaaaatgcagctatcagtcatccctaaggctggccaaataaaaggttttaaatatagtcacggatcaccagtgtcacaagcaacaacattcactgcacagagaggcagcagaatttgcagcattgaggatttgctgggtggctgatgagatctgcccactttgaacttgctctcaactgacatacccagatctatttttacattagctgtcaaaatgataggtctcctgcatcctatgcctgcactgttaattatctatctgcctatctgtctatccatccatccatccatcttgagatgtctatctatccatccgtccattcatctatcttgagatgtctatctgtccatccatccatccatccatcttgagatgtctatctatccatccatccatccatccatccatccatccatccatccatctatcttgagatggggtgttgctctgtggcccaagctggaatgcactggtgcgatcttggctcactgcagcctcaacctttcaggctccagcaatcctcctgccttagccccacaagtagctgggaccacaggcacacgctaccacacctgggtaattttaaaaattttgtagagacagagactcactacgttcccagggctggtctagaaattctggcctcaagcaatcctcccacctcggcctcctaaagtgctaggatcacgggcataagccaccatggccagccaatatttaatttttgaatttgggactcccacgttggagctgggattttgtacttacatgtatactctctagcacatgtaacccattaaaaacatcacctgctttgctggttgcagtccttcctcccctctgtcctaattctgacaggatccggtagaagggacaaattcgtctgtggttgaaatctacggacagccatgagctgaaactacggaccccgtagttctcaaaggaatacagagaagcaggtatggaatgccaacagggctgtgcaatgcccgatccgggccggcgtgagggcacctccatgatggggtgaggatgagggaaggagtcccagttcaagaagccgttaccaaaaggcactcctagcgagccaggtggcttcattcatccacgcctgatgtaaagccacccacataccccatctatacaatagggctgggcgcagactttcaaatacctattgaacctttacttcctctgaaacccagaagcctgtgttacagacctcaaccaccacatacacattgtctctaaggagaaatcaattccgtggggaaaacctgggaatggaggaagcggaaacaagaaagtgggaagtggggaaaggcaagaaggctttctttcagaaggtgagttagagataccacctgtctcccccattgataaaaggctcctcccatggctggctccactcatcctgccagcctcatttcaaaggccacaggctcagagaggtccctgctgagccccgagtccacagcacagccctggcccctctcgatggccttgcagttttatcttaaacatgtatctctgtatgaaatggtttccttattttttgcctgtctctcctgctctaggacgtgtactcgccaggcagaggcctggtgtgtcttctccaaagcagtatctccagctcccagcacaggcctggcccatagcagggactatgatcattatgaatgcattgagaagccaggcatggtggcacatgcctgtaatcacagctactcgggaggctaaggcaggagaatcacttgaacccgggaggcaagcagaggttgcagtgagccaaggtcatgccactgcactcccgcctgggcaacagagtgagactccatctcaaaaacaaacaaacaaacaaacaaaaagaatgcattgagagatgggtgggggaaggatgggaggaaggagggaggaatggaggtacacccatcactcggtaaaacaaggcctaatctgacctagatttaattatcctggagaccacccactccccaaaaaagggccaatgaccactctgagtcggatggattgacataaggagagagaggcagtgtccaatgaaactgtgctagagatcctcatggtccccaggttcctggtcttactgacacggctccggtgagctcccaccctcccagatgtctttctagtaactcctttgtgcgtagctacccaaagctggtttctgctgcttgccctaaatataccccattccaggagcatgtattcagggtggctgaggcacactgcgggcccaaactgttttcaagctttacatctgggcactctacctgtttaatcctcacaaggacctaaagagggaaatgcaattataatctggtattctaaggataccagtggccgggttacgtaaccccgggtaaaatcacgctggcagtaacaggggagcctcggtttatacccaggccataaatttccctcctgcgatgccacgctggcccctgcacgtatggtttattgtgataagtaaagaatcctatataacttatggtttttatgaatctaaaattttgatgaaacaggtctgcttggagtaggatccagctgtgtcattttgaatcttgtacaactgttagactgctttgagtcattctcctaaaactgtaattttattttaaattatatttaaattaattaaaaatataattttataacttgccccggagacattttacagacatgcttttagcaaaaatataacccacaaaataaaagttactttgtgaaaccctctcccaaaatttatataacatatataaccatttttcttaaaattatttttagatctaagcaatggtaaactcattagtctgttcataatatgattttatactccctggcatctgcaagcacagaacatagagaactcagcttgaggaaaaacagtaagcaaattaaaaagtaaaataaatcttagcctatgttcacacactcaaaatttaaataacagtttttctaggggaaaggagtgggaggtggaggcagagagatcaatccatttgcctctcactccaggtctgagaaccctcattttctattcttcaaattaatgaaatgaacacaagaccactctgatgaggaagtctgaaataatggaaacgccgtggcatttgcattccctttcaatgtgaacaggctattttgatagttagcaaaaccaggacaaattgcctgagatttcatcctttgttgctctaaaatggctctcgggctgtaataggccatatcactgcaaaatgcacttacctttaaataggcaggcaaagtggattgtgttaaatataaaattagtgacatgttctctcaactcatggagtctaattctaattcaaaagacttctgctcacttcagacaatgcctgttccttcttgtttataacctcaattccaattttctgcaattcaaataaatcccacctacagccctgggctttggtctcacccacctctgccccagacaccaggctcagactcccaggccctctgtctgccccgcacgcctgccatgtctgagctcttgagcatgggtctgtactgcctaggaggctcttcaccaggtttccacatcacggatgcctcgtcaccatcctggcctgggcttaaacgtcatctcctcccagtggcttggcctgaagaactgctctgatgtcttcttccccacatttgcaccatgtttgatcatcttactctggctggttagtgctgttcccatcagaccctctccccaacactgtaagctttgctgggatcaggaccctgggtccccagtgcacactgggggaatccggctgcagctggtgactcaggctgcaggagcccatgcccagggcagtgcccctgaccagtggctagaaacagcatggcagcccacacctacagggcctggcagacacctctgtcccagcatagcttcacccctcccctcctcccccagctccctgctgcagcctccccagaccctgagatccacgcagctgtgaggagccctcagctctccctgcaggcctggagttggccggctccactgctggtccagccctggctcctgcctccagcctcactcctgggcatctacccccaacaggcaccgggtataatcacctattctctacctgctcatcgcacgcccacctccatctgcaggtctttatcatggtgtaaggctcccctgggtaaagttctccatgagcataagaggcatcttttttacaactgaatcccagcacaaacaggtctcaatcacaccactgccctctcatgagccaaggaacctgcctgggccagcccccgacggtcctggcactctgtgtactggacccagccccagcactggtggctgtgactgtctcctccccacagcatcacaggtgggtgagtgtctagcctaggagggtaggtctcagccaacctcagttcactgtgtcttcaggttgcattttcattgtagtgaatactcagaatggaataatgcaatgaagggctgtgtcctgtttcaaatggaccacaggtgccccttcccagtttgctcctttcctttttgaactaatggtagaaaattccctttacccttagaaactcaactccaacagtgatttagctacattttattcttaaggctgctcatagtaattcacatatccatgagagaaagaccaatttacttaatggtacaaatcttattccccatcacataacacagctggtcaaaaatgcattctttcaagccaagatgaaataattcccagaatgtcccttttagtcaaatttggctcttgacaagtctagagagaatccccataataggcttcaaaggctggccccacagcccccactggcagctggtagggattcccagtaggggaagcctccccagaccccttctctgctactggctgtccctcaaggggtctcaaggtctctcagacaccaaacacagactcctccatgggaaaaaaaaaaaaaaaaaacagctaccttctggccctaggatctgtgcattctcctttcctaaagcgaaccaccctcatcctctcataaagaaccaaaaagcacgtcattcacctgatggctctacaccaccaaccctgttactctattcccatgccctgcttctatgtatttgttgctgtaagacttcttactacccagcattacattgtcaatttgtttgtctgtctaccctctgtctatcctagagaatgtgagcttagagtgtacaacagtacctagaaacggatgaccaaggaaatctgctgaatgaactaacgactgtgtggttaccgtggctctagctggcatgccactttaggatatatcttgagttttaggaattcaggaattcctgcaatctttcaaagggatcatggggcttccctgattgcagaattcagcaatctatgagcgagtatctatgcatttcattgcctctgctttggaagagactgttgttctgtaataggtctggtattcattaagcctttcaaaaagatgttccctggtgcataggtcaacattgcaaagtgtttccttcgccttcctaaacaagcctcacataagaagctatgtgattactggatgtttgggtgattaaaaccacatccttgcctttcctcagcatcccttcacctgttcagtgtcccacactaatccacagctgtgcaatgtatcataaatcagactcagagtctctggaagggtcatgtgctgcaaattacagaatacccagatcacacagacacatccacatggtgcaaaataaaccatgaaggagaaaagaatctcactctcgcaggtttgacctgaagcatacatgacatacatacatagagcacacatgaataaccaaactacttccactggagttaaaccttacagctcatccatgctcctcaagcagagatcagaggacactggggcagggcagggcggtggcagtgcacatggagtctcacgaagcttgagaaacaatgccttagacggtgaaaaaagtcttgtgttaaaaactaacatttcaaaatggaattttggtaaaacaatcaagaagaaagcatggcagaccatggcccgagtgttaggcagactccaagactcgagtttctcaaaatgggagtttgtggctcccagggaatctcagctatgatccaggttgagaaactgctctaaacccagtgagacttgtttcctgcaactatttaactgtggtctgttttgagagtactgtacacctgttttcctttcctccccattttcccctcttccctatcactctccaggctgcgccctactaactccatcctgcttgacaaacgtgtttgcttctttcagtgacttttccctcccattttcttttttggaaagtctgcctttgtctggcatttgtgtttttaagacagcaagaaacgtgagctcagagatctgcatccactctgtgctccccactggctccggggtgggagcagtcttcccagtctgcaaaccctcaaaggggaagtaatataaatttcaaatgaggacaccctcctaaagaagcagctggacccacattttggtacatctgcctggcactcccaggaatgagcagtggggaccatgtttgaccagcatagtgcatcctgggtgatgcttggggcaaattttcagcactgcttgtttaatttttatgtttgttaatatcctttttaggggatgataaaacttacccaagccttcaaaccatctttatagtgtagttttataaattgttatttggttctaatcaaactctgtgggagggaaaggtggacataaaaataaggcccttggattctttcaagagaatgttgctgcatatatatatacacatatatatacacacatatatatgtatatatatacaatatgtgtgtgtgtgtgtatatatatacacacacaaaatgtaaatggaactctaaagatgctctttcactgtggttgaaagtaagtatcacatctgggtaagcaactcatcccagtttgccctggagttttcggttttagtgctggaagatggaagacctccatcctgggaagtccctcaggcctggttgctcatgctatttttatgaaacatgacagcagagcacaggcatctactgagggaaccattaagccctttgctactgatgagtcaaccgatgtactagagcagccaatggcaacaaagctagatctgggatctgggcaaagtagaactcaggtgtacaaggaatgatcctatctggtgatttcactcctggggtgagaacatgcagagttcctgccattccatcgggcagttcagatgtcggagatcttgccatttgtcattttctctacaatgtcaggaatcatattgtaaaacacctgacactgacctggagaagaaaaatgtagctgtttaattcatgtgtaacatactcagattatcttatatgttagcaatactccattaggtctcgtctacctgcaaagagccctgggtcccatcgctgaggaagcgcctctactcaccctccagaggacatggacttcctgaaggaaaacagcactgcccatctggcactggggtcaatcgtttttaaactttaagagaactttttattccccaaagacattcctatgcagaatctaatatataaaacagacaaaagtggtgttctgtgagcagagatttcttttataagttcagatgtaaaatatgtattacatattcagtcgagaacaaaaaggttggaaactggcattatagagggcagctgaagtcataacagcctacaaaaatcatctacttctaaatttaattttggctgcccagtatcaagaaaattctggaaacaggttttactttgtaattttaggataccctcaaatgaaatgcattcggaagcttgaaaacaaaatgcaagggaacactgatgccaatgctgaatcatgaagagaaaccaataaatgacttctccactcgtttaagtattaattacttgggagaaaatgtttttcaaacgtatctgtaacattacggaatttccaacgatgttatattttgaaatatcaatccagtctttagacagaatttcaaacggtcatatttactttgttttccatgctgacccctaacctcctgtccaagaactcagaaggcccaaaaagatcaaatggacaggaggtgggggccaaacaaaaatgacaatacaacttcctgcttcaatcttaaattgtcttttagacgttacattccacttcattagttatccgaaaccaaagtccatgaagctgtccctgacttttcctatcccttccgaacatctcccactagtgcaaaaggccagggaagaatcaggtcattgaaaagaaatgatggctttttccagtaaacaatgatttcttaaagcctaaagtctacaatggactataaagctttccctatcaagtacataagccaaaggctcacatttaaagaaaaaaaacataactgcaatattgttgcaactagctataaaatgtaaaaatttaaaaagtaaacgtctaaattactaaaataagctgatatttagattctaagaggagatcagtaaccatgctcaagatgatcctaaaaacactgtcttctattaattggcctgttttaaaagtaacagaacacttcatataatattgcatctccaacttctattcttattcaccattctgaaactagactgagaggttggataattaataaaatcacccctttcccctggctcttgattatccttcatcagggtcatgtttgtacttctcttgtcgattgtaatcatttatttgaaacagtgtctcagcagttcattagcttttcattagtgcctgtaggttggataaaatgtgcttgaatttccaaagtaaatgcaaatccccttggtaatccagcaaggacatgaattcccagaacattttcaagtaagacagctccaatcagaacttggattttagtgaaaaaagtggtgtcctcctgaatggcagagaacccacgctcccatccagtcctaaacatcaattctgaaaatgaccatcacagtttggcttcatcttcaacctgaccgtggtattcaggaatgtcagttacttaattacaaacaaggagggcaagtcaaaagaattcaacacaaattttaaaagccaatgtatcagctactcagtaagttaaaaatatggctgccaggaccccacctggacagtcaaactcagcagctccagccttgaacacaagagacctggatccgcatcctgcctccggccctgggcagctgtgtagacctacacatcacaagctgagcttggtgtctgtatcttcaaaaaaggaaagatgatccacagttctgagactgggatggagatcacagaaataatgaaggggaagtgccttgcactgtccccaacacatagcaggcctccacaaatgaccgctttacaaagatcacagatgcagcctccccagtgttaaagtatgtcctcagtggacagtcaaaatggactccccgtggctaactgacgtgtgcaaaacgaaagcagagccaggtggccatagttgggtgaggaaaaggtcatgttctctgtgttctcagaaatatattgtaaaagtgtcacaggacctccctttctaccatccagtcaaaccagttcctgttgtcagtgctgaaatagagtgtagctggaaatgccgcagctgaccacccagagaccccctgaggccagcccatgaagacagacttgtgatgtcctccttaaagaccatccaacccggcccctgtacctgaatccccagctatcctgtggtttgcacctttatgaccttctatccccagtctctccttggagtacatttttgttttttgctgaaggctgtctctcccaatcttcagattgcttttagaaaataaagttatccttttgcctccgcagatctcactggtcttttgttaacacccgtaagggaagatagaattgcaggactgaaatgcatgccatgagacagaggaacaggtcaaacaggttaaacagaaacacacatgaaacaaggttatgtactaaccagttgaggaaaatgaggccagaggcaacaggaacttaaccatgtacatgtgtatttcccctgaaggcaatggctcagtattcactaactgagtatccatgatgacttcataaaacaaaactgctgcaaatgatgagaactggcaatacatatatttcctagttctgtcccctaatagagcatagaagcaatgatacccaatagtaaggagctcaactagcaccctggttttctaataccaaggcttcagacgatccaatcactctgagctatgggaggacattctctgataaaaggagaaacacataagcagctgatggtaggggcagggaaagcatcagaatgtaagatgaaccaggagcatcttatagtgctagaaaattggaattacacacacacacacacacacacacacacacacacacacacacacacacaaacagtagagggtgggagaagatgaagcaggagccaaatggccaaaggtcaaataacttgagcaacaaaataaatacccacactattgaattacaacctaaaggccaaaataaatagacaggagtccatattaatgtcacaatgactaaattaacaatggaggaagagaccaattttccttaaaaaagaattccaaatcagaaatgtgaaaaacaaaggagggaaacagaaagtcacccccagaacaccagggtgattgctgctgggcccagatccactctagaatgctaacatcagtgcttgaaattttaagaagaaacaggacatttgcaaggcctggaagtatctcccccagaatatttattaatcactatggctttaactcacgtccactaattctttgacacgctctcccccaggaggcaaagcttaatcctcctcctcttgagtgtgggctgaacttagtgactggcttctaacaaggagtaagggaggggaaagatggtgacttcacagaggagacatctggcagacaccagcttggccaggtgatcaaggttaactcaccagtagtaagtcacatgttgacatcatgatatgatgtgatgaggggggtaccttacctctgtggtggtcttcctcatattcgtaactccagtctaacaatgagaaagcatcagacaaacccaaattgagggatattctacaaaatacctgatccatatacttcaaagtgtcaaggtcatgaaaaacaaggaaagactgagaaactgagattagaggagattcaagagatatgatgattaaatgaaacatggtaccctggataaaaagaccattagtagaaaaattggtgaaatcccaaaaaagtctgtagtttagttatttttagttttgacaaatgtatgatggttacatgagatgctgatttttgagcaactccccgcttctgtgttaaatgattaatacaggagtcccctcacttccttttcctgttctaatgccagataccagccaaagcacatcatttttgcatcatcctacatgtggggaaatattttttattctgcatatcatagaatagtatgcattgatcataaaattttctgcagtagacttgagttaacttttcacctataaaattacaaccctcactcgtttccaacattagcatgaagaaaatggttactcccaggtttccacatcttactggagaaaaccgcaattaatgtcaccacaaatatccagtttccaacgttagctcagctgccattctgtgtgttcctgttcctcaatcatactcaattcacctgtggttcccgtcctgcctctcaccacagggtcggctgggcccaggatgacaaggggcctccctgcctcttccactgtcaccatcctctgcctcagggctgccatcatcgctctccctccttttcctgaatcccagcaccactggctcctccagggcccgctccaggggttatcccctcccctgcctccactctgtctctactcagtcctcccacccatgagcaaacacagccacactgtctccccatcccaaaaaagaacgttcctcagttcctcaaaacattaaacacagaatgaccatatgatccagcaattccacttctgggtatatacccaaaagaacaaaagaagggagaggcatgtgtacccccatgttcacggcagcattactcacaatagtgaaaaggtggaggcaaaccaagtgtccatccacaaatgcgtgcattgataaaatggagtccatccacacaatggagtgttattcagccttgaaaggaaattcagacacatgccacaacatggatggaccctgaggacactgtgctgagcaaaataagccgatcacaaaaggacaaatatgtgtgactccacttctgtgaggtacctacggtagtcaaattcttagagacaggaagtagagtggtggttgccagagcctggggagaggagggaatgtggaattcgtgttgaatggtgactggatacagagtttcagttggggaagatgaaaagcgttctgtggatggatggtggtagtcatacgaaggtgactaataatcccccaaatgcccaatcccatcacccattctcagaactccatggcatttgacactgctaaccaacttctacagcattaagcccgctgctccccagctctcgttctgcaattgttgagggacagttatgcgcacgtgtgtgtgtgtgagaatatacgttatgaattatactgggtgtgcatttatgtacatatatgcatatagacgatatttttttaattccacttactgaacatctactaccattatcagaaattacacaagtatttacatgcatcatcccatataatccccccaaattgccctgtattgcttcctgactccatctacaccatcaccagttttttcttggtttctttgctggcattgtcatatggtggagtccttggggttctgtccctcctcatctgcccaggtgagctcacgcactttcatagctcaccgccatctctgtggtgatggctctgagtcttcctttccagtccaggcccatctgctgagctccagacaccacacccatgtgtccacccaacatttcccatgagcctctcaaagtcaggacagccaataccaacccagttctctctccatccctccctcccaattcctctccagcatctatgctccttgttttataacctctgttgctgttgtccccctgaagcaccaagggaaaggaaaagcctcctcactgggattcctaatggaagcgtttgcacacagtgaccctcccagcacggaccccttgttaatagatgggtaggaagcaccaggaacagagtatgttcaaaatcagataagcgttataaaaactggtatggggtcagagtggagatcattttccaaaccaactattcgaaccaccccatcgccatctgggtaaagactgggttgtgcctccagcaagctactctgacttgggaagaccgtgtgcaactatctttgggaaacacagccgcatgctccttggctggaaatgatcagaggctctaaggagtgtaaaaagggaacacaaccctgattctaatttttattcttggagaaatcacgttttatttttcatatcaaagagggggaactctgtgggcagagtactctgccgagaaccagttctgttctgcaacttgtcccaatcatcaggaaaacacatgttccagggaagcccccatcagggcacacacagccccaaatcagggcatgctgtcacttcctctcattccctcgagagcccacctggccaaagaggctccagtggcctgattggagggcacatcaataatatggagggtccccgtgccccccgacctggaaagtcagcctcagcgatggggctctcggggcctcttaaaatgggaaaaacagaagatgaaaaggctgtttgcacttgtcagcaatgctggcactgctcactatccatactttaccctccccaattaaaaccacacacttgatctgttcacataacaaagcctcccttagagcccccagaggtgcctgctcccaaaacagcactgtcagggcacagcctcagtcctcactggacagaaaccaggggcagggaccaatcctctctctgtcccagccctttcaaaccaaagacagcgtctctgcgaaggagggaagccgcatgttttcatgctgagatacagtgcagatttatgatcggcacctgtgaggtcctcaggtacctcttgctggaacagagcaacaggtttctaaaggttctggcccttggcctctacatttgtcaccactcctgtggtcactcttcagtggaagttgctcaccagcctccttgtcccacatgtaaaagccaaaaggaggggccctacagcaccactgtcattggaatccttccaacattccccacccaccttatgcagtgggaagacaaggttcctaccagaccctccaaagcccaggaacctctccctgtgctgacatccaaagatgcccggcgttccaaaacaccagaaatccagggaagaggccctaccttggggatgagtacattaggaaatagccaaggagcaggattaagtaattatacactagcccaccaggaaaccatgacactgaacatcccatggggcccacgggtctggtgggtgtttctcgcccactgggggctggataagtgagcatgagggtgtgccccaagaagtgtccgaggcagagctcaatcctttagaggtttattttgccaaggttgggatgtacccaagcaaaagaaacacaagttacagtagggtctgcggcctgggcttttctccaaagaggggtctgagaaagagcaagcaggaggggaaaaggagagaggggtgcccatgaggcaagtggttacatcctcggaggctttgattggcattcagtgaatctgcatcttacatataaaaagaaggggccgggcgcggtggctcacacctgtaatcccagcactttgggagggggaggcgggtggatcacaaggtcaggagatcgagaccatcctggctaacatggtgaaaccccatctctactaaaaatagaaaacattagccaggcgtgatggtgggcgcctgtagtcccagctactcaggaggctgaggcaggagaatggcgtgaacctgggaggtggagcttgcagtgagccgagatcgcgccactgcactccgcctgggcgacagagcaagactccgtctcaaaaagaaagaaagacagacagaaagaaagacagacagaaagaaagacagacagaaagaaagacagacaaagaaagaaagaaagaaagaaagaaagaaagaaagaaagaaagaaagaaagaaagaaagaaagaaagaaagaaagaaagagaaagagaaaagaaggggataggggaaaagccaagtatgcattcttctcaggctcagcaaatctacattttatataagcaagcatgtgaaatcacggctatccgttgcggggtgcgggataaaaaggaaagtggttttttgcatgactcagttctcaagcttaactttccctttggcatagtgagtctggggtccacagcttccttcttttttttctttttttcttttttttctttttttttttcttttctgtcacccaagctggagtgcagtggcttgatctcagctcactgcaaactccgactcccaggttcaagcgattctcctgcctcagcctcccgaatacctggcactacaggcgcccaccaccatgcctggctaatttttgtatttttagtagagacggggtttcaccatattggccaggctggtctcgaactcctgaccttgtgatccgcccacctcggcctcccaaagtgctgggattacaggtgtgagccatcacacctggccggcagatttcattttcctttcacaaatgcgtggtctactggacaagccctgagatgaagatggctagagaggctccacagtccctggaggggggcactggcaggcggtccacggccactcaggctgagaccctggctctagaaaagggaggaagtgcaggtaccaataaggtttaaggatggatgtatcagactgtggacaaagactaaaagaaacagggctgccagcccaatactgacaccttgcttcctcatagaatagcagatgtgttggggtggcaatgtgcccaactgctatggtctaaatgtttgggtccccccaaaattcctatgttgaaatcctaacacccaatgtgattgtattaggaggtggagcttttggaggtgatttggtgatgacggtggagccctcatgaatggaattagtgcgagatactgggatttacaagaagaaatatatatctgctcttcttgtttcctggcatgcagctcctaacacttggaatctccaaggtgatgtgtctttttgtgtgctaataagatgagtggtagtgaggggcttctggacagcctcaggatgggggctgattgccaagtgaaccaaccctgtgattagagcgttggaactttcaggcccacaatcccaccaccacccctcaccttagggaagggaagaggggccaaaggttgagttaatcacccaacaaccaatgatgtaatcaatcaagctatgcaatgatgcctccataaaaacctaaaataactggatttggagagcttccagttgctgagcacatggaggttcctggagggtggcgcccagagaaagctccacacccctttccacaaataagaggttaccctgtgcatctcctccatctggctgttcatctgtatcctttgtaatatcctttataataattgggtaaatgtaagcaagaatgtttccctgagttcttgagccatgccagccatcccactcctggagaagggagttgtgagaaccccaatttatagaccatcagtcagaggtacagatcacaacctgggatttgcaactgccatctagagtggaagcatctgagccctcaacctgtgggatctgatgcgaattccaggcagacagtgtcaggactgaactgacttagaggacacccagctgatgtctgctggagaattgcttgctgtatgggaaaacatcccacacacatctgggcgaccagagaagcattctaaattattgagagtgagggctggaaaaactgtgtttttctatatctcgaacagtgcccttataaattaagaggccgaagagagctagttcgccccttccaccaagtgaggacacagcaagaaggcatgatgcagaaggaagcaggccttcctcagacactgaatctgccagcaccttgatcttggacttctggctccagaactgtgagcaataaatgcctgttgtttttaagctaccgactctaaggcattttgttatagcaaccccacacggactaagacaccaactaacactcctttcccagaccacactggcttaggagtggccatgtgacccaattcagactaaagaggtgaggggggaagtctgctaggtggttcttggaaggtttttttttcctggaacaggttccccacgtttctgtttccaattcttgctgcctggaagacagacacgctacttggagaaatagaagccctgcagtaatcctgagacaatacgcacagagcaaagccaacatgccaaagttggccagcagaaaggaggaggagcctcggtccccagtggcaccatggggtggggagtgagatcatggctttttcttgatatacgtgtatactgtttcacctgtgcattagttttgtatggctgccacaacaaattacctcaaagtcagcagcttaaagcaacacaaatttatgatcttgcatttctgtaggttagaagtcccaaacaggtctccctgtggagactctagggctgaatccattatcctgccttttcccactcctagaggtgacccacattccttggttgtcagccaccttcctccattcctgacttccagagccaggagcatggtatctcttgagccattcttctgcagtcacacctccttctgattctcctcttctgcctccctcttccacttatgggactttctctcacccagataatccaggattacatcccttttcgaggtcaactgaccagcaatcttaattccatccacaaccttaattcccctttaccacataacctaacatgttccagggattaaggcatggacatctttgtggaggggggtcactattcagccaaccacaaattcttacagcaagcaaattccttttgttatttaaaacacaaatcaaataatttttaattaaaatattttaattgaatattaaaaattgggactgtaatccaataaatcaaaaaagaaagtccaacctttaaagcacaatgaatcaagaatgctaagatttccatggagaaaagaagtcattctgggattagatgagaacaggccccttctaccacctctgctgatcagtgggcatgcctttactcataaaaaacagagtacagggagctctgcatagcacagtcttcgccaggctgaggctgcttcccagctcctgtgtgtctgactgggctagtccttcacatcccatgcaaaaggttgaatttttttattttctttgagacagggtctcactctgttgcccaggctggagtgcagtggcacaatcgcagctcactgcagcttcaacctctgggcttaagccatcctcccacctcagcctcctgagtagctgggactacaggtgcatgccactgggactacaggtgcatgccaccagacctggctgatttttttttttttttcgtagagatgggggtctcgccatgttgcccaagctggtctcgaactcctgggcacaagtgaccttcccacctggctttgaatatttttaaatttactttaaaaaatgggcttggccgggcgtggtggctcacccctgtaatcccagcactttgggaggccaaggcaggtggattacctgaggtcaggagttcaagaccagcctggccaacatggtgaaactccgtctctgctaaaaatacaaaaaaaattagctgggcgtggtggcaagtgcctgtaatcccacctacttgggaggctaaggcaggagaatcacttgaacccgggacgtggaggctgcagtgagcgggattgagtgcactctagcactgcactctagcctgggtgatggagcgagactctctgtctcaaaaaaaaaagggcttaagcaatttccaattatttaaatttttttgaacttaataagcccaacaagatctttctcctttctaattaatgctaccaggtgagcatcttgaaaaacagtggcctataggtgggtcaccattctccgttgacacaagccctcctacaacagcacctcggggagggagcctcaatgggctccagtgcttcacctatgatgggattctgtggatttaaaacgaagacacaccactgaccttcaagaatctccctggcagatatctcccaaacattcagtcctgatacaagtatcttcataactggaattcacctacttccagaacgtcaggatgagtacccaggacagctctgactgcctgttgcttaaaaccatgcccaggtcataaagccctcactgtactgtaccctaaatgcacttaagcgactgttttctacagtgtcctagtactgaatgttgacactaacctatgaaactaagtgtcatacttactgtgaggcagagaaaccatcaactgaccacaaggtttgtttcaagaacaaatcgagacgaaccaataatgcagaggctaaatttttcaaatcaataataatacagttcacatgcaagagcttttgaaaactcttccatatgataaatatcacatcacatcggtagagatggaaattagattgctcaaccaggtgaatcaaatttaatccagctttttccatcctgttttctaaatatcttgtattattttaaattagttttgaaaaatcaatctgaaagtataaaagatacaaatgaaatctgggtcttggagcccctgggtctaggagcctgattccaagaacacatttcacctgcagctccaaccaggggtctcttcccaacccctggcctgaaggtctccagcctgggatggagcacctccttccttagaaacaaacactgttactgcatctacatgaaatggctcaaaagagttaagagagaatgttgcgatcactgaagaatggtctgaatgagaaagaaagagtagtggacatttaaagcttaattgccagactcagcttttcccttaatcagggaaactgacctaatgagaacagaggggtctctgtgaagctgccaagctcaaaggaggcaaggcagcataaagagacatctgaaggcaggtgtgacatccaaactaggagaagctcagagaaagaagcaaccagggacaggacaacctccatgaaacgatgtgtttgagctgaggtgctggccatggtgctgacaggggtcagcttggggaggcccagggaggtggaagatgaaggcttgatcactgactggatagaaagacagggacaggaagaagaaggagcttggcaggtgaagtgcaggcacaaatacctacccttctctgctttcggaatgtgatgaatgtgaatgatcaccctttatgtcctttataggacaaaaacctcagcagaataaataaccaacatgttagtcacactaaagaaccactctgaagcacagaagaataagcagagtaagatgaacaagacaaaaactttaatattaaagaagaaaatagaagtttgttacaacaaaattacaccaaacttgttaacagaacaatgtggcagcttaagactcaagactttatttttctcatcctcaaaggtccacttcatggttttaattagacaaacattttgtagagtactataattctctatcttttaaatacacattcacattatggtgaaattgggaaatcctaatatttacttgtattaagaagtgtttaagcagtccctttcctctacaaactcaccggtacctgttgttttttgactttttaatagaagccattctgactggtgtgatatggtatttcattgtgcttttgatttgcatttctctaatgataagtgatattgagcattttttcataggcttgttgactgcacgtatgtctttggaaaagtgtctgttcatgtcctttgcccactttttaatgagtttcttagttttttgcttgtacatttgtttaagttccttgtagattctgaatattggacctttgtcagatgcatagtttgcaaatattttctcccatcctgtaggctgcctgttttctctattgatagtttcttttctgtgcagaagctccttaattatgtaccatttgtcaatttttgcttttggtggtgttgtcatgaaatctttgccagtttccatgtccaaaatggtatttcctgggttatcttccagggtttttatagttttgggtttttacattttagtccttaatccatcttcagttgatttttgtatatggtgaagggaacgggcccagtttcagtcttctgcctatggttagccagctatcccggcaccatttattgaatagggagccctttccccactgcttgctttgcaggtgggggtgtaaattagttcaatcattgtggaaagcagtgtggcaattcctcaaagagctaaaaacagaattaccattcagcccagcaatcctagtactgaggataaacccaaaggaatataaatcattctatcataaagacacatgcatgcatatgctctctgcaacactattcacaatagcaaagacactgaatcaacctaaatgcccatcaatggtagactgggtaaagaaaatgtggtacatatacatcatggaatatgatgcggccattaaaaagaatgatgttcctgcaaaggaacatagatggccattatccttagcaaattaatgcaggaacagaaaaccaaatactgcatgttctcacttaaaagcgggagctaaacaatgagtacacatggacagaaagaggggaacaacagactctggggcctacttgagagaagagggtgggaggagagagagattcaggaaaaaaaaaaactgttgggtactatgcttagtactcaggtgaggaaataatctgtacaccaaacccccaagtcacgaatttacctgtataacaaacctgcactgaacctaaaataaaggttaaaaaaaaagaagtgttaacagctccaaataagtaagagtaactgtccactccctgcagttgttcccactgagcctctggtggccccaccccaatccctatggggtctagaaagagtgccccggtctccctggtccttcgctgatgatggggggtggcagctctctggccggccctcggccctcggccctcgcctctcgcctgttaggtaccctggacttctccacatccttccccaccccttctcgcctctcccacaggagtctgcaggaccaggccagcaggtggctcagctgagcatctgcagacacagcacaccgaccccacagagaaaaggcactcccagaccactgtcacagagagctcatgtcgggggcgcgaggggctgagaggggccagtcacaagtcaggcaagtccatacagggacacagagagcaggcagaggtcagggcagctgtggatgactcggggcgtgactgaaatgcatgaaaggatggttcaagaacagcccagcagctcccctctgcccaccacgggagggtcttcactatcagtgaggaattaagactgcaggcagcgaagccccctccccaccggaaccttgcagggctccctcgaggggccaccactcctatcacagccactgtcctgctcatcccagtgaccttaggggccccacccccctgcaagtcctgctcactggcaagcctagcttggaggcaacgctcggggcaaagccagagggtcctccccaggccttctgtgcagacctctgcgaagaatcctgctcagcagtagatatttattgtattttaatatcagggccaaaagctacagttcgcttttcagttaagtaaatgtgtattcactaaagggttttaaaacctttttcctgaaaaaaatgttctagaccatcaaatgcctttttatattgttaacttttactcatttaaaatgcatgttttctaagccacattttacacacttttctatatagacaactctcaattaattccctaagccaaacccagaaatgtttaacacacactttattgacactaaggcacaaatgatgagtggcctctagtgttacccacaaccatctgctttctcagcagcactggcacctggtgctgacagcccctcacccacccccatctcccattccccatcccagagcaggcaagaggggaagtggatattgggaatcctgagagagcagggatttggggcaagcagtaaccagagaagggaagccatagcccttcaccctcgtcagctcccagaagcctctgaaacaccaggaaggaggcctcatgccacatggtatggaatggggctcaactaatgtgatgtggcgaataagcagaacacgggctgcttggctgtttcatctgcttctgttttcttggtagtatctggcctatcagagacaattataccacaccacagtcacagtcctacctgcctctgagtcctaagtgcagattcttaagaagaacagacgggaatcctttagcgtcacagggtaggtgtgagtctgcgctccaggctccagagatgcttctgcaagcatgctgcccaaatccacgtcttttctgctactgggagctctctcatctttaaaatacagaatgcatttctcatatctgaaggaatatatttaactggtgtctcaacataacacttaaagcaaaacccaaaagcagagggtggggggttggggggagtaaagagcagccatatcccagtggaggggcaggaggaagagaaagaaggcctcaggagacctggtcaggccggctgagcggcaggggatgcaggacaagcaggcagaaatgagtggaaaagctgagagaggccgagaggaaattaaaccggaggaggcagagccaagtaacgagcaaacatgaaaggaaatgcctccctgcttcctgccctttctaaaatcacctcgaggcaactgaccacaaatagtcttctatcacaataaaaaaggagatcagaaatttcccggctgtttagtggcctgccaatgccacaccacagtcaccggccttcactgaacaccccggtgcagggggagagaatgtaataacttcttaagaatctgcacttaagcctcagaggccggtaggactgttactgtggtgcagtgatcacggtgctgcaaggcacggcaggacaatttcacagccctgtcctggaagtggcggaggggaggaggactgtgcctcacaagcagtgtactaacccagggatgaaaagcacacatttacttaactgaaaagtgaactgtagcttttggccctgatattaaaatacaataaatatctactgctgagcaggattcttcgcagaggtctgcacagaaggcctggggaggacctgctagctttgccccagcaaatacagagcatagacacccccaccggccagagtgccctgggctgggctgcacacttcctgttgatttcttgtccaattatctcaataatacatcctcaaggaaggaagtggagaacacacagaaaagaagaaaagaaataacgtatatcaccaccaggaaataaccactgctgctaatattttgatgtgtttccaatcagactttttttttgtacatgcacattgtacaaaattggaatcctactgtatagcaggaatcttgctgtgttcatttaaaataacatgagaccttctccaggccactgaatattctttgaaagcacggttttaatggccacagaatctgggaatgacatagtataaccaccctgctattattaagatattcaagctgcatccaattttcaactatgataagtaaagcttcagtgagtctctttacatacaaatgatactgacatctccgattttaatataaacccttagaaagaggatgattgagtcaaaggtcacaaacacttcttttccagaaggttccatcacttgacatttcctccactggagtatgagagtattcatcctccagcactcacccatactgagaataattatgagactgcaccagtttggtggacccaaaaacaaaaaagaattttttaaatttgcatttctctgattacttgtgaggtttggtacttttctatttgccttttatttttcttcagtgacttgccaactagagtccactgcagattttttccatttgatgttaatgttttcttattgatttatgactgcttttagtataatagggatggattggcaggtggacagcgtatgtcctgatttaccaattctgttgatgctgtttgacacacacaggatgctaatggatgtgtggtcaattgtatcaatctttccccttattatgacttccattgcaagtagagtgtcatggcccttcagcctgggatccagactcagctcccccactcactatctcagtgaccctctctttgcctcaatttccttgattgaacgtgcaggataatgagaatgcatttaatccatatagttagtatgtggcacacagcctcagagatggccccaatgccccccacctcctataatggcattcacatgtgatccctgcaggtccagccagcaggggccagggcctgcgaacagccacggagtgagcttggaggtagatactccccagtggtccctggagatgacgcagctccagccaacacttagtgagatcctcagccagaggcaacctgcaaagctgtgccaagattcctggcccacaaaactgggaagtaatacacattcgttgctgtaaactgctacatttaagggtgatttgctatgcagcaggagattactaatgcattatacacgtaaagcacttagaacagtggctgtggcagatcacacaaaaaaggcctaacacgttgacagtcctcccatggaaagaggaaatccgtctccacctggggtagctcagcttgactgtgtgatttgctctgaccaatggagctgtggcaaacgtgaagtcacctacacacaggagcctgcctcttacaactcctgaaactctgctgtctccatgtgaagaagcccagcctgctgggggatgagactacaaagcccatcacccctgctcaccccagtttacaggcagccatcctgacaatgcagcccatcacccctgcccgccccagcttacaggcaagccatactaaccatgtgaggccatcaatgcacgaccatgaatgagctcagcaaagagagccacccagccaagcccagcctgaatttccaacccaaatcacccactgagtaagtagttgctggtagaagccactatgttctggaatagtttgttacacagcatttgatacctaatacagctgccattattactactattattgtcttgggatcagttacatgatcatacatatttcttaacagtatatttatgcttttactttttaatccataggaaacttatttttgtgtatgatattaggtgaggacctaacaatgttttgccacacagccagttctcccttctccataaaactgcaacaccttgttttcacatattagaatccagagcaggggctcccaacccccaggccaccgaccagtatcagtccatggcctgttaggaatcaggccgcactgcaggaggtgagcagtgggcaagtgagcgaagcttcatctgtatttacagctgctccccactgcttgtgttaccacctgagctttgcctcctgtcagatcagcagcagcagcagattctcataggagcatgaaccctattgtaaactgtgcatgtaaaggatctaggttgtggctccttatgaaaagctaatgcctgatgatccgtcactatctcccatcatccccagatgaaactgtccagttgcaggaaaacaagctcagggctcccactgattctacattatggtgagttgcataattatttcattatatagtacaatgtaataataacagaaataaagtgtacaataaacgtaatgtgcttgaatcatcctgaaaccatccccaccccctccctgtccatggaaaaattgtcttccatgaaaccagtccctggtgcccaaaaggctggagactgctgatgtagagaatttggtgatatcatttccagtgatcatttctattggtatagtattaatagtaaatcttgacccaataccatacagctggtttgttttcattttgtcaggataatactgcatgttctttccactgaggcatggcaggagaaatgctcactaatctgactgcatggaagaggaggggtagtgaagttgctggggcaggtgcaggaggagagggagagcagcaacatgaatcaagagacagacacagtcacagtcaccaaagggatgggggtgacgtcaaggctattttttgtctgaaacagaaacaaaacctgccctaactttctaagtcagtcggctgccaaattccacaagctgattctgagcagggcactaggccctgtgaaggggttggcaaggtgcaaggagcatgtgggacagtgccccctcccaggtgttcacagccgcagaggggagacagtgccacctacgaaaccctggagaaaatatgtataaaccaagatgaacacaaattaatataatacaaataatatagaacggaaggagagcttagaagccccacaggtcaatcatggatggctacttggaggaaagttttcagatcctgaggagtaagatcagcaaagagtggtgtgtgcaaaggcaggaggctggaacacataattcatgtggactcatcagttacttggttagcgtaaaaagtctataaacaggtacactatgcagtgaggctgatgaaggcataggggccaatctgatggaagatcttcagtgttaggtctggtcttcaagagaaatgagcaaacaatgtgtgtttttaggtaataagagtaggaaactacaggttgtgcaccttcacagggccccgtgttcttgacacggttctgtgacatatgcagcattccccagtggctccagcagaaggaactgccttccctagaattctcaaaaaggagcacgacttcccaaaggaaaggaagcacagaagccggcatggttcccaggggaagatgcctgagaggccagccggaccccagccctctcacacatccagtcggaatgtccctgcccctgccatcacttggtgcagagcaggcatgggccagctaagaaaatgacgtctttgcttattttcaaattgtactgaataacagctttgagcctcaacgtttagaaatgaaaatacaagcatgagcaaggtcctagtctaaggatccatccacagctctcaggagagcaacatcttctgtgtcccttgcagagtcttccatggtgggaaggggctgcactgtgcaggaaggcaggccctggccctggtgcctgctggaaaggggcatcacgagagacaggtgctcggggcagaggctcagctgcagtcacagaagccctgaggcttggacagagcctgtcctgtcagcgctggcacccgctgccagggcccagttatactgcctgttcctttggctgtgttaatgagggcctaactagcagtggaggcctcacttccccatcagcatgaagctgctaagtgtcccccaaaacagtcgaaagtgtcacacgggagagacacactcgagagaaacttctgctgccccttgggttccagatttgcagtttgattttgcttgcctccatcaaggaccacacgaaccccaaattccaaataagaacactgcaggccagtgggaacctactgcctgtagcctgcaggatgaggcacggcttcctcacacccgaaccaagaggaccagctgtctcagcccacagagcccaggcctggcaaggagctggagcctgtatgagtcaggcctctccacagaaacaaaactgataggacacatatatcagaggaaattcattatgggaattggctcacacaattacagaagctgagaagtcttatgatctgctctctgcaagaggaagacccaggatagctagcatgtcggtcagtctgagtctaaaggcctgaggacagggtccaaaggcccaagaaccaggagcaccgatgtccgaaggcaggagaaaatgaatgtcccaactcaagtagagacagcaaatttgcccttcctgtgcctttttgatctatctgggccctccacagattggaggatgcatgcccaaactggcaagggcagatcttctttcctcagtctgctgattcaaatgtttatctcttcctgaaacaccctcacagacactatcaggaataatgttttaccagcacccctagcccaggcaaactgacacataaaattaaccatcgcagagccacgggcacggtagagaaggaaagcaatcctgagcccaccaagccccctacccaatccctccagctcttctcaaagcctccctgcccctcctcccaattttggagcttccgatccctgccctggacttggaggtgacccaggagtgatgcactagagataagccaaggtcatggtcacgcctcctctggatcctcagtcgacccaacttctccagcaccataatgtcaaacaatcatagctaatagtacatttttatatgaaaaaggaggattctctgctgaggataacacatgcttgaacacaaacgtttttttctggtttgtactcacgttcactttcagcagaatacgtctcctctgactcttcaggaaaccattccctttccttaatggggtagtattttttccacagactccttggtacattttctgtttgctttccctcacacaaaggagacttatccagagctaggacttgctaatggcaggcgtggattcagcaggtgtccggtgctgattcccacatgttcccaggcgcagagcaagaggaacagacccaatctccagggcaggcaaacttcaccaggccagctgccacacagggttgacaagggattgttctgcacccactgactctttctccgacccatccaatcaacaggggtcccaagaagctaagatttccattatttcctgctgcggggctcagccagcctcccgcaccactccatgcgtccccagccagactatcagtcctggtccttctgagcaacccagctgtttcttaagaatgcagtttcaaagagaccttcaaagatggggtgcaaggacagtcatctggcccatggcctgtggagaagtggcagctctatgaaatcgttggtgtgacatttcctgggagggtacatttcctgggaggagagatgagtcccatcatctgccctgaggacaggcactcttctctagggagcaatgtaagcaaggccagttccaccatcctcatagattatttctcacccttactgtaagaggtcctcaattctccagtcttcacaggtacagtagtttaatcaaactaggagttgtacatgatgttatataaagattatcgccaacagccagttattatccctaactccctcagagactaactacactgacattgagaaacgttaggtgactctgcagggttgtaagccaggagggagtgaagccaaggtttgcatagtgccttggccttctcctgtgagccccacatgcagcacaaacttggcccagaaagcccatggactcccttctcacactctatgtggggaatccaacctttgggaggtgactcttccattaacacagcttctaattcagttaattacttgacttgataggttagttccctttgttactacaaacaccactacctgcaagctatggtaatattatcatgcttcattaaaagttatcaagtgatctactttctaatagaggtataaacacctaaacacagctatttcaggccagatgaggtggcttacacctgaaatcctagcatttttggaggccaagacaggagggttgcttgagatgagaagttcaagaccagcctgggcaacacagcaagaccatgtcacaacaaaaaacattttttttttaatagctgggtgtggtggtgcacgcctgtagtcccagctactcaagatgctgaggcaagaggatcctgtgagcccaggagtttgaggctgcagtgagccacgatcgcaccactgccttccagcctgggtgacagagcaagactctatctcttaacaacaacaaagacagctatttcagactaagcctttaactttaaaaatatgaaacaatgtatgtgtcagttacgattcttaaatcattatgtctgcctgggtgcggtggctcatgcctgtaatcccgacactctggaaggccaaggtgggtggatcaccttgaggtcaggaattcgagatcagcctggccaacatagtgaaaccccatcactactaaaaatacaaaaattagcccggcacggtggcgcgtgcctgtattcccagctacttgggaggctgaggcaggagaatcacttgagcccggaggcggaggctgcagtgacccgagattgtgccactgcactccagcctgggcgacagagtgagactctgtctcaaaaaacaaaacaaaacaacaacaagaaaaaacacaattcttaaatcatcacatctaactggagtcaagtcattaacacatttgagaaatttagcaataacaaaaagattattaggattcttctaagctaacaattctaaattctaactacaaaaccaaatgttctggcttaccacaacagagaataacatccaagccactatcacgtcttttccaattagtaagccattggtggtgtgaataaaacctagaagtcaattttctacgaactctagcaggaagaaaagtgattcagctttacagttatcttctgacctgtttttagtcttcatgtaacaaaaagcttgtcaagttacaattttcttatagtgcctcactatagaacatttattctatacaaatgggattttctcaagacaataactacggcatcaacacgaggatgactgtaagacatcaatattttatctattttcatggatgttggacatgcccaacactatcccattttgtaaatgtattgccttgctctgtgtgatgtttgtgataaatgtagtgtcacagaaagcctccatgactgttatttcccttcattttataaatgccaagtttatttaaacctactgtcacatgactttgttaaccaaatacaactgttgaaactgttctaaaacaatgcttatatcagtatcaacacaccagaaaacatgagttgcttctcaaaaaaatttctgatggcccaaaatatcccaatattttgctcaagaaaggtaatttttcatttgatggtgttgatttttattatgataaaatacacagaaaataaaattttccattttcaccagttttttatttttttatcattttttgagacggagtcttgctctgtcgcccaggctagagagcagtggtgcgatcttggctcactgtaacctccgccttccaggttcaagcgattctccttactcagcctctcgagtagtacaggtgtctgccactgtgccaggctaatttttgtacttttggtagagctggggtttcactatcttggccctgctggtctggaactctcgaccttgtgatccacccgcttcggcctcccatagtgctgggattacaggcatgagccaccgtgcccggccatcattttcaccagtttttaagtgtatggttcagcagcattgagtacatttactgtgtttgcaaccatcaccaccacccatcttcagaacgtcttccaagactgaaactctgcacccactgaacaactccccattcctccctagccccgtccctggcaaccaccattctattttctgtctctgtgggtttgactactctatgtccctcatataaagtgaagtcatacagttattcgtccttttgtgactgacttatttcactcagcaccatgtcaaggttcatccatggtgcagcatgtgtcagaatctccttcctttttaaggctgagtaatgtttcatgacaggtgtaaaccacattctgtttacccattcttccatcaatggacgcttgggttgcttccatgttttagctattgtgaatcatgctgctatgaacatggctgtgcaaatatctctttgagcctctgctttccatcctttgagtatatacccagaagtgggattgctggatcacatggtaattctgttttaattttttgaggaaccactactctcctttgttcagtggctcacacctgtaatcccagcactttggaaggctgaggcgggcagatcaccttgggtcaggagtttgagaccagcctggctaacatggtgaaaccccgtttctactaaaaatacaaaaaattagccaggtgtggtgggccacacctgtaatgccagctactcgggaggctgaggcaagagaatcacttgaacccaggaggtggaggttgcagtgagccaaggtcgcaccactgcagtccagcttaggcaacaagagcgaaattcgatctcaaaactaataataataataataatacaattaaattcctcaagatgaaaagtggtggccaagtgtctggtgtactctgcaagttctgagaatcactaggagtcccatcacaaccttttcagcaaagcaatattctctctgggcatgacccctatgtccagaggacagtgtcaacccaaccaggctctgggcaggtggctgtagcttatcacagaaaaaagaaatcccaccagtgagaaccctctacaataaaatcagaaacagactcctaagatatgtagtttctactcctgttgatagtttttaaaaataatgaagggtaggaagttccagttaatagtgataactcgatcttgtgcacctacctctctcctgcctcctgaaaccttggacacactcggacaagaagatgaggaggtgcctccaggggcaggagagtccaacagccttttcaaagccttaacatggacataggaatggcgactgagatggcaggtacatggagggggagtgacgaggctcaggctgattcccctgcagaacttaggagcctgtgggttggagccactggggccccaggaggcaggctgcagagacacccaccaggctggaaaccaggggttggaaagaaggcttggcccaggcacttccacctgtctcatgaagcactgtgaccacacacctcagaggatactgaaacccagtccctggagaaagtatcaggaaaggttcagcggcccagggctgagttcagcaaccgatcttcaccaggtccaggggctgcttaggggatgggagttttctaaaactgggcatgtggctgcacaattatacaatgtattaaaaaatcattgagccgtagatttacaataggtgaataggacagtctgtaaattatacagcagcaaaactttaaaaatgcacagatgagagagagagacggaagtaaccaaaataccaaggaactatcaatgtggcaagtttttgatttttttttcctgctacccaacaaaatatgagtctgagaacaagataaggtgaattattttaaaaaataagaaatgatttccatgtgacacagcaattccacttctgggtacataccctaaataactgaaagcaggagctctaacagatatctgtgcacctatgttcacagcaggattactcacagtagctgcatggtggaaataacataagtgtccatcaatggcagaacagatatacaaaatgtggcacagacacaccatggaatattattttgctacaaaaaggagggaaatattgacacatgctccaacacggataaaccttgaggatgttacgctgagtgaaataagccagccatgaaacgacacatactgcaagatgccactcatatgagttgcccagagtcatcaaattcattgagatggaaaggagaataggggttccaggggccggggagaagggagatcatgttcaatggggacagttttagttgaggaagagggagtcttctggagatggattgcggtggtggctgcacagcaatgagaatgtacttactgccactgaaccgtactcttaaaaatggctaagacggtaaatgttatgttatagatatttcaccatgatactaaaaaaaaaagataaggaatgctatttttgcacagaaaagaataaagaaaagaaggacagctgagaaacgtggaagtgggtgtccctgcaactgggggcacctgcacagcatggggcaagaacagccactttcattaccagcttctcaacacaatttcactttgactctgttatatactagacagatttttaagcattaattttaaaacatgatggagagtggcggagatgaagagaaaatcaaatcatggaagctacacaccaataagcctgatgtcaatcacaggccagatctgagaggggactatcagagcagaaggctcgtgagtacttcaggaagcaagtgccaggccaaatgcatcttgatttctcttttaataaggttatgagattggcatattagagaaatgctgagcagatgagggcctttatttcagcaagaagttaacacagtcgctcgtggaccctatgaagaggaggcgatgtggaggggccccctgggcagggggcagcgaggccgctcatggcacaacctcggaaacagcaggagcagttggtccagccacagagctccggcccagcctggatgcaggacggggaacttgtttaaaacaggctgacaccatcgggcctgtaccctcagagacgagcctcccaatcaagatgagatcatctcaacaggctggaatgctaacttttaaagcgaacagatgaatttatcagtcttacaaatgttccgcaatttggtaccacaattcattaactgccatgagctgtaggacacagtggaaaggaaaaaagcatggggctttagaggaggagcagccccttcacctgaggcagtgacgatgcggttgggagctgcccaggccatagtggaaaccacccaatgtctgcccccgatataacccccactcagcactggtgccatgtccaaagtgacaagatgcccagaagccaccagatgaaaactgggtgaccagccttcaaatgtgcaagcagaaaaaagagctatgcagggaatggggtgcagaagtggttttctccatttgcagaacttcaatgttggaagggaagtaaggacatttcttggttctccaggaagagccaggcaaacagaatcattgtccaaaaatagatttggctctagttaaagctgcctgacaactgagccacgtgacactgcaagctccccatccccagctcagggaaacggagtgcccacacatcagaaatgccactgaaggactgtgcactctgcagaggattgacttaagtggaccataaacaccttctgataccctacagtaaaagagtaacagtgatgaaaataacaacttccatttgctaagtcctgaccgcagccaggcaatcctggatgtactctaaaggcttcctgactctgagtctttgattctcaaattgtatggtccattataaatacaatcaacaatcaaaccccaacataaagatatttaacataaatcattagttctttgggatgacagttataaataatttttataattctttaaaaggaagagtctatcaagtttataataaaaattgcctaacactaacatttaattagtcctaatacctgaccgacttcttctttcgagacatcagggtatacctaacaatgttcagatttgataaggtctcgaggaagcaggtagctcctttgtttgtggcctgagatctggcattgctgaagctagattgggccaggcctggctctgccaaatactgatgaactgccaggttcattcatttatccaacaaatatttactgagtgccagttatgtaccaggtgctgttctctgtaccggcagagagggcaaccagcccctgaagctggaagcatatggtttgaggatcaggaaaaccaagatgatggcatgatggagcgaggcatgagttcagcaggaagggccagtgagagcagctccgagcaacagtgcctcaaagggcaggttaaagaagaaaggaggggagagcaagaaagcagtgagagagactacacaagagaacaatgatgtctgctttatgtttctgtcatggtcactctggctgctgggtggagatggtcagcagagaagcaggaaagacagaaaagagaccagccagcaaggtagacactgcagcccccaggagagagcccaggagaggacgctgcagcccccaggggaggacactgctgcacccaggggagggcccaggtgaggatgctgatggccccaggggagggtccaggggaggatgctgcagccccctgggaagagccgaggagaggacgctgcacccccaagggagagcccaggggaggatgctgcagcccccaggggagagcccaggggaggatgctgcagcccccagggtagggcccaggggaggatgctgcagcccccaggggagggcccaggggaggatgctgcagcccccaggggagggcccggggaggatgctgatggccccaggggagggcccaggggtggatgctgcagcccccaggggagggcccaggagaggacgctgcagcccccaggagagggcccaggagaggacgctgcagcccccaggggagggcccaggggaggatgctgcagcccccaggggagggcccaggggaggatgctgcagcccccagggaagggcccaggggaagatgctgcagcccccagggtagggcccaggggaggatgctgcagcccccaggggagggcccaggggaggatgctgcagcccccaggggagggcccggggaggatgctgatggccccaggggagggcccaggggtggatgctgatggccccaggggagggcccaggggaggatgctgatggccccaggggagggcccaggggaggatgctgcagcccccaagtaaaactggagctcctccagaggaacagcagcaggggtggagggagggaatccagcctgggtgtgtcctgcggcaaagcgatgggcagggctaaaggaaaaggagaaatcgagatgcctctcaggctattggagtgaacaatggacaagaaaggaagccatgttttaaagatgtgcttaggtagtgttccacccaaagttcaaatccaagtcactgccaaaatgcaaaatgcaaactgccagacttgtggtctgttcatctatcagtaaacagggatgaataaaggcagaacatgcctgttcccttcagaaactaaatggctagaataaagtactgttccatttccagggtggctcagctaaaacgccaaggaaacggccacctgagtgttcgatgggaacacagtgtgagatgcaggttaagaggatgcttttgaaggctgcagtgctttgtggttgggctgtcctagttataggcccttccaaggctgtgtcaaagagattcaatgcacagagaccacccggtgaaactaccacatccccctgctttcatcacatcactccttagaggaacacacgttactctgaggaagttgaacatccgtagcccaattaagaccatctatggccaggcacagaaggcagtgtccagctctgttccccttccagactggcctttctgcagcatgacttaccagccttcaatcacactctgtttctgctcccctgtgcctaacttggggtacccacaacccactgcccttctctgttatccactggatgaaagccacccagcaatcatggctagctccagctctgcccctccctgaagcctcttctgattgttcctgcctccagatgccaaacaaaccgctgcctaaagaccttgcaccacagcacaaggctcacagctctttctcctgcaagtggatggtacgtgccggacagaagacaagctgcttgaaagcaagatcatcatgcattgtttttattcccccaaagaacctaggacagtgtttccaatactgggagcaccctccttccaacagtgatcgactgtaaagccataaatatttctaaatgtatactgaacataattaagaaattccaagacagcaaatattcattttataagctggttctgggggtgggatctaacttgcatcactagaccaccaatggtacctaaatgtgaatgattaagaaaagacaggctgggcatggtggctcatgcctgtaatcctagcactttgggaggccagggtgggcagatcacttgaggtccagagatcgagaccagcctggcgaacatagtgaaacctcgtctccactaaaaatacaaaaattaggcggggtggtggcgcatgcctgtaatcccagctacttgggaggctgaggcaggcgaatcgcttgaacccaggaggcagagattgcagtgagccgagattgccccattgtactccagcctgcgcaacgagagcaaaactccatctcaaaaaaaaaaaaaaaaagcaagacagataatccaaatgaacatttgcagggttgattaaactaattaaatctttaatagtgtctgaagttgcttttcaattattaatttggatgcatttttgttaaacttctgaatatgattttaaaatatagttctaatcattagccaacacatacatttttaacaattatatgataattaaatctgttttgaaactgttgaaaattttcttatgtaaccccagttttcagggcttcaagcaactgtggagctacaaaaaaaatatattaatatgattttttaaaaagttcttccaacgttaaggtaacacacacaaaacctgcacaaaggccaccagagcagccccatgcagccaaatgcagtggcctttcttccctagggctccggcttaggataaggctggaagagcatccgaggtggttccaccccatcccgatagcccccttccagaaatgctgacacatgcaacatccaccaatggatgaacctcgaggacatggtgctgagggaaatacgccagtcacagaggacaaatcctgcaagattctgcttcttttttgttttgttttgtttgtttgtttgtttgagacagagtttcgctctgtcgcccaggctggagtacagtggcgtgatctgggctcactgcaagctccgcctcttgggttcaagcaattctcctgcctcagcctcctgggtagctggaattacaggcgcacgccaccacgcccagctaatttttgtatttttagtagagacagggtttcaccatgttggccaggctggtctcgaactactgacctccagtgatccacctgccttggcctcccaaagtgctaggattacaggcatgagccaccactcccagccgcatgactgcacttctatgcagtacctggagtagtcagattcacagagaagtagagtggtggttgccatggcgggggaggggaaatagggagttggtgttgaatgactacagagtttcagcttgggaaggtgaaaacgttatagagatggatggtggtgatggctgagcaacagtgtgaacgcactcaatgccactgagttgtacacttcaacatggttaagaggatcagtttcacatatgtgtattttaccacaattaaacattttttaataaattaattttttttaaaaagcctcccttccagctccaaaggctacctttgagacagcctcctggaagggacccagcaggtcccccgtaagactctgattaaagttgtaaactgccacctccatatttctatctatagttgaattttctttaccactaaagaagtacttttgtctccttttccacattcagtgcccctgggtcatcaaaagtaagagctaaaagcactgattttttgacaagcaagccacagattcaatatcatgtatgttcaacacagccttgaaaaccgcagaatagatttctttaaatcactaaaaggagcctaagacaagatcaaagaatggatcccaaattaactgaaaaccttcacacacataccacagacagtcacggcgtgtgtgtgaacacgggcaggatccagcaaagccactcaagattggcagaggggctgctcggtgccccccactgccacgtttgttctatgtgtggttgagcatccggagggtcctgaggcagtgccagcccactgaggtcacaggtgaagcccacaggtcctgggccctgccaagggctacaggacactcatcaatcagcaggtgagagtacatttacctgcttcgtctcggggagcctcctgccagctcccttgcaaacttcattcacctcacgcctccctccttcctgccaagttcacctctgttgcaatccagggcaggcaaatactcgtcactcggacaaccagggcccatccttcaccgcggctgccgctactaatcaaccatatggtcttttccagggaagcccagacgcacttcgaaatccttcccagtcctacaaacgctgccggaagccacaatcaactgacaagcactggcagacaaggtgatgcgtgtgactcttccacagcatcctgacagtggccagctcggggctcatgagcctgaaggacgctctgccttcaagacgtctgacatgagacagtccctcaaagatatgctagccctgacagtgagcagttcctccttgattctcttcctagattaattttttgtttaattggtaattaatgttcattccttaataccaagtcacaattaaaaattgctcaagtcacagtcatttgacaaacgtcatgccttgtttcacattagcaaccactattacaggtgatctcactagaccaactcaaaatactggctatggctcgaagtgactctgctaagtaaacagaggtggggcattggaatcactccacattttcctgccgactcctgaattcattaagcagagctcagcccaatgcactggttttttatagtgccccacacagccccagaggatctaggggacattgatggtcctgggtggggagttgctaagtggagagggttgtaatgcctgggccccaccttcatccagatcaactccattttcacatactgagcttcctcataagatttcattggtagaaaaggctccatcactaagagtaaaaacgtttcccaactgttggctaatgcattgtgcagagagtgaatgtgcacatagaaaaagctccaagaaggacttctgaccacacagcggcccctcgagctgcaggggcagccagcatggactgggatgtgctacaaatagaaagtgagggcacaggtggctgagaataggcacaggagagaacagaaagacaagcacagaaaacagagagaccccgggaggcgccgggataacagagaggcagaacagcggctacaaagtggcaggaagggctggcagatccctaggaataaagggagtagcaaagctccaagcaaatgctcaccagagcccatatgcccatcataacccacacggcagcacgggggccaagggccacaaaaggcaatgcacgcatacaccggggtaatacgtaagccccgcacccgccagtaggacagcacacctctggtgcaaaggccctgggtgtttctttgaaaacaattagtcacactgatctacaacacattgtttctcaatcttttttctacctcatgccttcttctgaaaaagaagattctgaacaagctgcaggcagcccacatgcacacgtggagatttgggggccctgatccagcagccccgggagaatcagaacctgcagtccacatgcacaactctctgattcaagatcaatgctgacagtggtcacccaaggaggagtggccctgagggctggggtggagcagagggtggaacacagcagcacgcggtgggggcccagaagggctgggccaagcaacagggcagtgggcccccacaagctggggagaggagcaccccaaaacaatcttcccccaagaaatgcaaagcaggaatcatcatgaggcctcaatgtgctcatgttacagaacaaagctctcctgatggtgttgcctttgttaccttgtctccaactctggggacgcttaaatgctgaagccaggcctgtcatgcaattcacccagcatcagcagggacaattcaggaagaggtggcaccaggaggaaaacagctctggaagggcaggtctcgataatcaaaacccaccttaaaaatggcatcatgatgaactgttcagacaaggcagctctggcttcagtgtgttaatattaaatattttatacacacacacaacacacaacacacacacacacacacacacacacacacacacacacacacacatataaatttgagacggagtctcgctctgttgcccaggctggagtgcaatggcgcaatctcggctcactgcaacctccgcctcctgggttcaagcaattctcctgcctcagcctcccaagtagctgggattacaggctccccccaccacgcccagctaatttttgtatgtttagtagagatgaggtttcaccatgttggccaggctggtctctaactcctgacctcatgtgatccatctgccttggcctcccaaagtgctgagattacaggtgtgagccactgcacccggcctataatcaattatattataagttattttataaattagtgtaataatacatgtgatataaatacaagaatctcccttttatccattttttaaagattttaggtttaagcatacaagtacttacatttgactactagaaagagaataaaaaatagattgtaactatctgctgaaggatgacaaaacagccactggctggtcagtacactcagtcaccagagaagtcttcaaagtagtcccaagaggccagttaggaagggggaaaggaggcagggtaggttcttgagggtgggggaagcaggggaggggcagctcaccagcactcactgtacagctggtttacctgttggacaggacggtgtttttccagcaatctcacttgggaaagaaggaggagcaggtggcccagcttcaccctatgacaagtgtgactttcttgcagccacaccatacccaggctgctcccaccccctcctttcccctctctggctacagctctgactaacccgggtaacctgtccctgggcagctggaatgtgccctcttctatagctgaatgttggtgtctcttttcctggaaaaccataacacttccaacaaaataaggaggccaccgagggatggtggcagctgcagttccccccatgtagaggattccctgcggcaatccagacccagcatgcctggatcttccaattctgcaaaagaattcaaagtccattctgtactgtgaactctcccaagttttaagtgttatcaaataaacatttttaaacaccgcatgagctaaagaaaacatacctgggagcggaaggccacctgtggtcttggttttaggacctctgaacaaaaagatagacttcagtgctcagggtgaacagaaaaatatgtttttgaaagaaataataacttgtcagaaagacgtctactctatgtcacgtcaataccaggcacagcagcgagggaccattggacaccggctgtcctcagttcaagaaaccgcctgaggctgctggcaaattgacctcagggccccggccgcagccacggccccatctcccgggctgaatgctgctgctctagcactcattcatgacaacgaggacatctcaaagctaggaggcccccggaggctccagttcaacaacatacccaaggtcaccccgtgggccacggcagtccggactcccacatcaagctgggcctcctggaagacagcactgaacctagccatggattctgcagacaaccttcaaacccccatctacagccttcaatagcaaaccctgaagcacagtgcgtgctgccctaccctatgacctagttacagacgggcttgcgacggttactaggagtgagagcagaggccctcattgtataaagaccagtgcccatcctgctacctcactgaaatggagggagaaagcctaaatcaccaagtttagagttggtgggcgagaagagaggctacctacggttcagggaaaccagcaaagataagccatccaggctggggcgggggccatccccaccctaccccaagtctcagaaaggctgcgcccggcgtcagggcacccctcctgggtaggggccctgagatgacagttcacacagatcagcccttcagaaaacactgtcatgcttctcaaacacattaaaacacaaatgactacggttcaggttcatggtcaagtccagtccttccatctctccctgacaatctatatgtcctggtcactgcgtggggacttaggtacctccttggccacacagttcaaggtcatttctgttgttgtttttttttcctttggagacagggtctcactccgtcacccaggctggagtgcagtggtacaatcttggctcatggcaacctccgcctcccgggttcaagtgattctcgtgcctcagcctcccaagtagctgggattatagacatgtaccaccactcccagctaatttttgtatcgttagaacagacagggtttcaccatgttggccaggctggtctcgaactcctgacctcaagtgatttactcgcgcctcagcctcccgaagtgctgggattacaggcgtgagccaccgcacccggccaaggtcatttcttcgggggatcttttgtgtagatgtcgtatcttgctcattacatattgatttttcctagttttattcatagaaagaaaccccattttcccaatgtggaagcacctccttatataaggcaaatgtatgaacatttttatcctgcagaaacctgtgtgccctacattgtatgatccagaatagattctggccctccaccataaaaagcacatgttcacaccaaagcaagcaaagacatgcggcactgagcgagagtgtgtgggagggggtgacaagaatggtctgtgggaccccggacagcctttctgggcccccagtcctcactgcacagatgccaataatcactgctgcttccaaggggtgagctggagacagaacgctgagagagtacaggctcacagcaggctgcatctgcgcacgctcttggtgtcatcactactgctggcctgagcaggaaggcccaccctgccacagcggtccctgcacagggctgagtcctgtgaccacagccccattaaaaaatgctctgtgctccatccggctcccttagcaacctcacagggtcccaacctcagagcaggatctggaaggaccgttcactcaccgcaccttggaatgcattcaacttggcggtggcccgaagctgactcccaccagggcagaggaaaaaacacaacccagtgggcaagaggggctgagggaggaggagtagggggcgagggggcagtgctgggcaaaaggaaggggacaccaagggcagacacatccctggatgtccaaatggaaagaaatgaggaggaggaggaagggtcccttgaagggccgtaccatcccgcagaggggacatgaggctgtcccagagaggggtatgggtcctgagaagctagttagcacctctgatgccagccctaatgtccactctccctggtccatggcacaccctctccaggcaggccttcccgagaggagagacctccagagaagcaggatctacggaagggcgagctgacccatggtgacaggtctcctacttccctgcccaagtggttggcatctgtatcttgttcatagtaagatctgctcatgagacaagagccactaagaaatattcacagacaagatgattgcatttggggaaaatgtgacagacctgaagtgaaaacaaaggccaacttacaaaatgtcaagagtccaacaacctgaaatgcaaagcaataatacacacatatacattttagacagcaaattatactcttcaaaaggaaactttagctctaaatttttataactaaaatctgcaattcttttctatccccccaaataacaatgttttaacaggaaactggctatttacataacgtgttcaatagcgtggaaaagcattttgtgtattttattatatgtttattgtttcagaagccaccataaagttgaccacctgccactgccaccccataaaagggaaaacgtctatgtgtagttctattggactcactgggaagccattagctgacccttcattatttttaggcttctgagctaaagtgggaggagaaaatgacgttagaatgcccgttcaccaaacagctactcagtggctgctgctgcagacaccaaggaggtcagcatggggcccacaaagagaaaggacacatccctcttcgtggtccagccaccaaggttttaccaccaccaggcagggccagacctggacatgcgtccccaataccccacctctgcccctgaccacccttgtccttcctggacacttctggacctgaggacagacatttccctcgactgcaaagatgaggcagaaatgacacctggaagcaggggacgagtgagtctctcacacttccctagagtagaagccacagaggtaccaaagtgagggcggagaaacaccaagtgccagcaaggagcggccaaacctctcacatgctgctggcgggagcagacagcgatgccaccaccctggaaaaccgattgccagccacgacaacagttgaacacaggcacactccgtgccccagcaattccactctcctaggcatacacccatccaaacaggcgcgtatgctcaccaaggccacgtacgagaatgtgtcggcagcactgactctaagacccgaaactggaaactaccctagtgccatcaacagcacactggtaggtaagtgcactcatacaagagagcactctacagcaataaacatgaatgaaccactcaacaatacagatggctcttcacaaacacactgttgaaagtgtaagagatcagacactaaataatacatgttgtatgaatccatttatataaagttcaaaagcaagaaaaattaatacaggatgctaaaaatcagaagaaaggttcacctttgggggcagtaagtagaagggagcacaagggggaccttgaggtgcaactgatgttctgcctttgggtgccggctacacagagacattcagtttgtaaaaaacatactgagctatacactcaactgtttgtgcagttctctgcatgtatgttagacttcaacaaaaagtgcaaaaaaaaataagggctgaggagagaaactgttgctaggagacaaagaaatgaagattctggctttggttattagcccttagagcttggagaactgtggatacacgctgaaagcccattaaatttttcaaggaatcttaggaccagagaaacaccaaacctggccatcagtggtctctggtactctgctaccaatctccagacctgtgcctgcaagacatggctgagaaaaagctgcaggcctggagaggggaccctgtccatctcagacatggccggggaaaatggtccagggagatctctatacagaccatgcccaccccatacacaggggagactcaaggctgtacccacttggggagggggtgggtgtacttcacgtgggcatgagcgttcccgaggtgcacgtgggtaagaatggactggatggccctcactggtcaatcactgtcctgcaaatcacgttctgcttccctctgtgaatcactgtccagcagaagcacaacacaagccttgggtgtactttacaatttcctcatagccacattaaaaagaatagaaagaaattaaatttaactatatatatatatatatatatatatatttttttttttttttttttttctgagacggagtcttgctctgtcacccaggctggagtgcagtggcgtgatctcagctcactgcaagctccgcctcccgggttcacgccattctcctgcctcagcctcccgagtagctgggactacaggcgcccgtcaccacgcccggctaatttttattgtattttttagtagaaacagagtttcaccatgttagccagaatggtctcgatctcctgacctcgtgatccgcctgccttggcctcccaaagtgctgggattataggtgtgagccaccgcgtccagcctaacaatatattttcttcaacccaatacattaaaaatattatcctttcaatgtgtaaacaacataaaaaatattcagatgttgtacattctttcatgcacctcaagtctttaaagtgcgtgtgtgatgtagtttggatatttgtccccgcccagatttcatgttgagatataatccctgatgctggaggtggggcctggtgggaggagtttggatcatgggggcagatccctcatggcttgatgccgtctttgtcatattgagttcttgcacgatctggtcatttaaaagtgtatggggcaggtgcagtggctcacacctgtaatcccagcactttgggaggccgaggcaggaggatcacttgaggtcaggagttcaagaccagcctggcaaacatggcaaaaccctgtctctactaaaaatacaaaaattagctgggcgtggtggtgggcgcctataatcccagctactcaggaggctgaggcaggagaatctcttgaaccggggaggcggaggttgcagtgagctgagatcttttgagactctgtctcaaaaaaaattgaaaataataataaaagtgtgtggcaggccaggcgtggtggctcacacctgtaatcccagcactttgggaggccgaggcaggtggatcacgaggtcaggagatcgagaccatcctggctaacatggtgaaaccccgtctctactaaaaaatacaaaaaaaaaaaaaaaaaattagccgggcgtggtggcgggcgcctgtagtcccagctacttgggaggctgaggcaggagaatggcgtgaacccgggaggtggagcttgcagtgagccaagatcacaccactgcactccagcctgggtgacagagcgaggctctgtctcaaaaaaaaaaaaaaaaaaaaagtgtgtggcacctctccgacccccgctcctgctctccccatggtatgcggttgctcctgctttgccttcctctgtgaataaaactccctgaggcctccccagaagcagatgccgctatgcttcctgcacagcctgcagaaccaagagtgaattaaacttcttttcttataaattacccagggtcaggtatttctttatagcgacacaagaagggcctaatacagtgggtgttttccacatacagcagcacatcgcaatcagcaccagccacacatcagtgctccggaaccagctggacagcacaactatgggaaggagtacctgctccccactactccacccctaagggctactgtgaatagctttggctgcaattctctctctccctccctctctttctctctccctccctctctctctgtctgtctcacacacacatacacacacacacatacatacacacacacacacacacacacacatgctgggacctagaataagctgttctatccctctagccacagaggtcaagtcaatgagagatctgccaggaatcttgcagaagaaacagacacttttcccattgggctgaaggtgagagaaaggatgtgaggtctggaattgtagcagctgcttgaggccatgaggtagaggctgtctaggaatggagccacagagagaggagaacagagcccaggaagaaaggaaaagcaatgtggttctgtggacatggctggaacctctgcatcaacagatatatcccctactcttggatttttcagtctcatgtgctaaaaaatttgcttgttcactacgcaaatttgggctgcactgatgtgatctgttattaaaatagtcccagataatacacctcattattctaattatctctgctttttttcccttctagcaactttaaagtttcatattgttgttgaattcttcttactgattcaagttactagtatgcttttaataacatgtctgaatatatctaagcctcaaaacactgcatttcttttgaagctacaatttcagttttaagggctcatcctacgaaaataaccagacaagtgtccaaaaatgtgtacacaagaccattcactatagcaaaaaaaaaaaaaaaaaaaaaaaaaaaacccacaaatgcacactgagaaataagtgggtgtccagtcctaaggagatagcttccctctggcacagagggccccccagtgggcagcgttctttgttccctgcgtggacagcaccctggtagggcagggaggccacaggctcactggagcacggtcacagaaggacgtgatgcaaagaaaaagagccggatgtggtggaaggaagggaacatgcagagagttaggcagggcatggggaggcagcatggggcccactctcccatgtcccagcagagaggaggaacgtctaggagggggagcgggggcagagcctgccaacctggactgctgtcagagcaaacctgtgccagagcaaacctggtggacactggtttagaggcattgaacatcccatttcccgggcaactctgactttccgaaggtgtgagtgggacccagaaaacctcacggctgcagttggggggtgagagtctgggaggtaacagctgggcaatgtggaggcgagacaaggggaccaccatgggaaggaggtgaggtggcccccaagggccagatgggggaatgtgtcaaacactcagaaatcctgcagaggaacccaggggaactgagtcagcgagggaaagtccctagaccataccccagcatgggagaacagatgacagcagtaagcaggtggagaaggagtgctgccttgggggtccatggcaccaaaggatgctgtgcccagagtctctgctcctcacccccagtgacatcagacagctacaccatccctgcttccagatgccattctgaagacgagcctgcagggcaggcagaggctgagaaatctgagaggctcagcactacctatacgggcacttctcaattagaagtgtgcataggaatcccatgggaatgccgttaaaatgcagatcctgctacaaaatatctgggggtggggcctgagaccctgcatttctaacagactcccaggagatgcagagactcctaatggatgggccacactcagagtagtaaggccctcagggacctctgtgaatgaaacagaattaaaacaaccctcccgctctcaagtagatgtaagattcatgcagaagacagactgattatacaaaaaaatagtattaataaggaagacagacgtaccctccacatctgagattagtgtgaatactgtactctgcaactccactacacctacttataatctaataaaaattctgaaggaaacatttataaggcataaagattaaaaatattaaattatatgcttaacatagcctggctaagtgcactctgggggttgaaggcaaggataaggccataaggaaaagagcagtgccttgatcttcctctataaatcaagtcacttagtcctagacaccatttgccttgttaggactgcaatggttctctgacttcacgaataagcggatcctgccttctacccccacatactgccaaacatgacgtttttaaggtttatttaattcatacatgttattatttagggcagattttggttcacagcaaaatggagcaaaaaagggcagaaagttgccatatactccccctctccccagaagcacagctttccccatcagagtggtgtatttctttttcttttctttctttctttttttctgagatggagttttgctcttgttgcccaggctggagtacagtggaacagtctcagctcactgcaatctacacattccaggttcaagcaattctcctgcctcagcctcccaagtagctgggattacaggtgcctgcaaccacaggcagctaatttttttttttttttttgtatttttagtagagatgggatttcaccatgttggccaggctggtctcgaactcctgacctcaggtgatctgcctgcttcagcctcccaaagtgctgagattacaggcgtgagccaccatacctggccagtacatttcttacaatcaatgaacctacacactgacacatcattatcacccaagtccatggtatacattagggttcactcttggtgttgtacattctgtgggtttggacaaatgtataacaacgtgtatccaccattgtagtatcttaagagacagtttcactgctctctgtgccccacctattcatctctccctcccccaaacctctggcaaccactgttctttttactgtctccacagtcttgctttatctggaatgtcatatcttgggaatcacagcagtgtgtagcctcttcagactggcttctttcccttagtaatattaatttaaagttccagatcttttcatagcttgatagctcatttctttttagtgcttagaagtattccactgtttggatatctcacagtttatttatcaatttacctacagaaggacatttccactgcttccaagttttggcaattatgaataatgatgctataaatatccaagtgcaggcttttgtagggccataagtttttaattcatttaggtaaataccaaggagtatgactgtaggctcatagggtaagagtatgtttcattttgtaagaagctgctcaactgccttccaaagtggctgtagtgtttagtgttcccaccaacaatgaatgagactccctgttgctccacctccacatcagcatttgatgctatcagtgttttggcttttagccattctaacaggtgtgcagtggtatctcactgttgttttaatttgcattttcctaatgatatatgatgttgaacatcttcatatgcttatttgacaactgtatatcttcagtgagatgtctgttcaggttgtttgcccattttttaatcaggttatttgttttcttattatcaaggtttaagagttatttgtatattttgaataaaagtccttgatcacatataacttctgcaaatattttctcctaggtttgtcttttcattctcttgacactgtctttagcaagacagaagtttctaattttaaggaagtccagcttaccaattttttctttcatgtattgtccctctggtgttgtatctaaaaaatccatcaccaaacctagggtcattaagatttccttctgtgtaatttatgaagagctgtataattttatgttttacacttaggtctatgatctattttaaagtgcatttttgggaagagtttgcgtgttggcctctagctgttccagccccatctgttgaacacactatccttttgcccttgaattgtttttgttccatgtttcagatattagctaactatattgtgtggtctaactagttagaaataaattgtctattatttaatcaagactacactatcctgattaagtaagtgttgaagtcgagtattgttagtcctctaatttggttgatctccttcgctattgtgtcaactattctgaatcttttgcttttccacataaatttcagaatcagtttattcaaatcctcaaaatcacttgctgagatttctgattattacattttttaaataactacaaaatgattgattttattagtttgttggaaactgcctatctggctatagtctacgtttcagctgttataaaatctgcaagtcctcatacaaaaactttcacactatgatgacacctcactgctgacagcctcctctgcagtcctggagctcctgcaggatacacgctgcatgcacaggtagacatgtgcaacccaggagggcagccagggttttcccaggatgtcaaagctcagaaggaaccaaaaattttaaagatttttaaaaatattttaattttttacaatataggttgaaagcaaatagctccttcaagagctagaacaactgaacttcacatctaataacaagaatgttcaattaaaacagaaagctaccctatggcccttccattcataatgcccatccatgagcctcagcatggactacaagtggatttaggggtccctttcaagatcttcaattgttcagagggcactccactgccctagcggaaggaataaatctgtcacaccacccacaacacagctagttctggagggccaggaccatggcccagaagcagtactgcatgaagattaaacttctcttccttttaagtgtcagatcccaaactgtcaacagtgtatacatgcattgtaacaaacacaaacactaccaacagaaaataatcattcacatgccataggtacatgcatgtgtacacacacacacgcacagactctcacacacatacttcatatttgcttgtcttttactgagaaaaaagggattataatatgcaaaaaacagattttttaaagtaatcatgataacagaaacactcagctaagatgctattctattcatttataaacaccttgcttcctaagggcctgccacaccttaacccatagaactcacttgtggaataaattctttactgaatgaaataagaacttaagtcacaaagtatctattgactatgatatggaaaaaagccttttaaaagcacgtattatcatatataaatacagaatatgaactaagggctacagcaggaaaacgttaactggttatgaattagaatttttatttgtctattgcttgcagggttttattgggcacctagcctgtttgaagcatgaaagctttaaccccaagactcaccctgcaagccaaaagcatactttgttggcaacattaaagcatttctggcttctggcctgggacatcagcaaaaaggcagagtaggcagctccaagggtccatcctccacaaaaccattgaaaattcaagcaaaaactgtcagaatcaactttgtcagaataatggaaacagtaaatggttcgcagcaaccaagcaaaaatggaatggagagaaaggtaaaataaaagcaggaggaaggccctgtggtgttttcatctacccaaatccaccctcctctccagctccacagtgcaggacctggcccctgtcttgaagacagcagcagcattcccagtgcaggacctggcccctggttcccgagggtgcagagcagacttgattcacaaagaattgtgtttgctctaacctgtctggaggctgctgaaggactgattcaaggggctcctctctgttctgtgtaactcagaatgcactcagggcagaaaagtggcaggcactcctggaaaacactagaaggcaaatgagcaacctgcagtccctgggacagaagattaccattgaggcacacggtagagtgccaaaaccatgaaaggaaaggctggggacagggtttaagaaattcaggcattcaacacaaggaactcaaacatctcaacagcaaagaacaaataatcccattaaaaagtgggcaaaggatctgaatagacatttttcaaaagaagacatacaaatggccaggagatatatgaaagaatgctcgacatccatcaccaatcatcagggaaatgcaaatcaaaaccacaatgatatataccatcccaacccagttgcaatggctattatcaaaaagacagaacgtaataaatgctggtgaggatggaaagggaactcttatacactgttggtgagaatgtaaattagtatagctgctaaggaaaatcgtatggagatttctcaaaaaagtaaaaacagaactaccatatgatccagcaatcccactgctggctgtttatccaaaggaaaggaaatcagtatgttgaagagatatccatactcccatgttcattacagcactattcacaatatctaagataggaaatcaacctcagtgtccatcaatggataaagaaattgataaaatgataaattgatacattgttaaagaaaatgggagacacacacacacaaacacacaatagagtactattcacactttaaaaagaaggaaatcctgccttttttaataacatggataagcctgaaagacatcacaccaagtgaaataagcaagccagagaatgataaataccatgcggtgtacgtatgatatactatttggccataagatagaatgaaaatggaatactatctggccataaaaaaagaaaaaaaagaatgaaatcctgtccgggcacagtggcgcacgcctgtaatcccagcactttgggaggccgaggtgggcagatcacttgaggtcaggagttgaagaccagcctggccaacatggtgaaaccccatctccactaaagacataaaaattagcctggcgtggtggcgtgcgcctgtaatccagctactcaggaggcagaggcaagagaatcgcttggacctgggaggcagaggttgcagtgagccaagattgtacatctgcgctccagcctgggcggcagagcgagactctgcctcaaaacaaacaaacaaacaaaaagaatgaaatcctgtcatttacggcaacacagatcagcctgaaggatattatgttaagcaaagtaagtcaggcactggaagacaaataccacatgatctcaaccatatgtgatggctgaaaaaaaatgagctcatggatatagaaaattagaattgtgggtgcagagtctgggaagggtaccagtgaggggaggatgatgagaggttggttaatggatacaaagttgcagctagataggaagcatgaattctggtgttctatagcactatagggtgaatatggttaactacaatttattatatattctcaaaaagctagaatagaggattttcaatgttcacaacacaaagaaatgaggtgatggatatgctaattatcctgattcgatcattacacattgtatacacatattgaaatatcactctgtatcccataaatatgtacagttattatttgacaactaaaaataaaagggaaaaagaaattcaagcattccaaagcacctatgcatatgggtgggaatgtagacagccatgtgaatgcccagagcagaacgcatgctcagaagaagcctgagaagaccccagtctttcacctctggatgagctccaggttcagtataaacaagaaatgaaggtcaaggcatagctgtaaaaagccaggctaagtgttaaaggaggactccaccacagagccactccatacagataagcggtcagtctcttctctctctgtttttctctgcctctctctccaaccccctcgctctctctatcatgttttggcatctggtgctcaaggaaatctctttgacagcactagctgaacaaacaactaaacagagacttcagagaccacacacggtaaggaattacagatcttgcaaaactctacagtctatagcaagcaacaacaaaccctgaggtgggggaagaatctgatctccagagttacctctgtttaatatgcaaaatgtccaggcgtttgttcgtttgttttgagacagggtctcactctgtcacccagggtggagtgcagtggctcgatctcagctcactgcaacctccacctcctggattcaactaattatcctgcctcagcctccagagcagctgggattacaggcatgcaccaccacacctggctaatttttctatttttagtagagacgggattttgccatgttggccaggctggtctcaaactcctgacctcaagtgatctgcccaccttaacctcctaaactgctacaattacaagtgtgagccaccatgcctggcatgttcagttttcaacaataacttatgaaccatgtaaagaaacaagaaaatatggctcattcacataagaaattaacaaacattgtccctgaagaaacacacacactggacttactaaagactttaaatcaactgccctaaatatgctaaatgacttaaaggaaagaaaggaaaaggagctaaaggaaatcaggataagaatgtatgaacaaataagtgaattgaaataaagatatagaaattataaaagggagtcaaattctaaggtcaaaaagtacaccaactgaatttttttaaaaatcactagagcatctcagtaacagacttgactaggcagaagaaagaacccgcgaacataaagacagggcaatgaaaattatccagtctgagaggaagaacaaaaatgataaaagattaacaggtatgaaatgccatcaagcataccaataccaagtacataacaggaatcccagaaggagaggtgcgagtgaaaggaacacaaagaatatttggagaaataattgccaaaacttaccatacctgataaaagatacaaatctacacacacaagaagttcagtgagtttcaagtgagatgaatacaaagaaatccacactgagacacattataatcaaacagtcaaaaagccaagggcaaagagaaaaatcttgaaatcagcgagagaggagccactgattcacatacaagggatcctcaatcagattaacagctgacttctcatcagagaccaggggaccagaaggcaatgaaatgacattttaaagtgatgggcaggatgggggtgatgcttccaaccaagcattgtatgatacatcctacaaaaatacccttgaaaaatgaaggagaaatttacacccacatattgaatggctccaattgtataaaatatcagaaacaggtaacaatccacagggacataattcagactgatggcttccaggggctaggagaggggaaatagggagaaacaatttaatgagtatgggatttcctctggagacaatgaaaataattttggacttttatagagggagtggttacacaacggtgtgaatgtactaaacgtcaaagaattattcacacaaaaattattactgttaagttaatttcacctcagtaaagaaaaataaaacatgggaaaaactggcttctgacaaactgatcaaagttctgaatcacaggcagtagcagaagcagcatggattaccctgagatctcttccttccttccttacctgcctggccgagagaaatatggagcgagggtactgatttaagataatatgctaactgggtgcttgtagcaatatcaaaaggtaatgtaatatagactaaaccatatggaaccatgaactgccaaggacatgagttacctgccaaagtaagacgttgcccttgggtgcagacagaaaacatggtggggtgatctttatcaacagtcagcaacaggataaaattccatgtgtaaaggccacctgaactttgattctgtatgtgcgtattttacaagaatgtaagagcagtccaaaaactattttaattgaattcattctatacataggtgcatcccaatgccaattactggcatcaattctaaaccaataaataagaacatatgtattttacgcacaaaatgtcatgtctctctggatatcccatgcacaaccccaacagtacccgtccatcagagcctgcagctctatgaaggagaacttaacagcactctaggtgaacacgcccctgcctgatgccgtccacaaagctaggcacatttgcacgtctgggtaccatcgctcagctacacaaccacaggccatgacggcgcagttcttccaactaggctgtgctgacacaggtctcgagatggctgatgcttttgatgcatcctgaagttttgctacaaagatcaccacaaaaatgttcaagcatcaaaatgttttaattcttctgaaatgaaactgtctctaaatagctcagcaataaaattcaataattctattgggttcaaagcagtttaacaatggaaaatgaattatatagtcaaaggtggtccattctcgctctccagtaaacatttctgtatgtgcggaattggtgggttctcggtctcactgacttcaagaatgaagccgtggacccccggtgaattttacacttcttaaaggccggtgcatctggagtcgttagttccttgtggtgttcggacatgttgggagtttcttccttctctcccaatgggtttatggtctctctggcctcagaagcaaagctgcagaacttcgctgtgagtattacagctcttgaaggtaatacagagcctaagagtgagcagtggcaagatttaccgcaaagagcgaaagaacaaaacctccacaacatggaagagaacccaaacagtttgcggctgctggctccggcagcctgcttttattcccttgtctgaccccacccacattctgctgattggcccattttacagagagctgactggtccattttacagagagctgattggtccgttttacagagagctaattggtctgttttgacagggtgctgattggtgcgtttacaatcgctgacctagacacagagtgctgattggtgtatttacaatcctctagctaggtgtaaaagttctccaagtccccactagattagctagacacagagcactgattggtgcatttacaaaccttgagctagacacagagtgctgactggtgcatatacaatcctccagctagacataaaagttctccaagtccccacctgactcaggagcccagctggcttccgctagtggatcccgtgccagggccgaaggggagctgcctgccagtcccactccaggcgcctgctctcctcagcccttgggggtctatgggactggacgcctatggagcagggggtgatgcccctctgggaggctcaggcaggaggctcgggcagcacgggagcccactgcagggggcagcatggcgggctgcagatccccagccctgacccgtggggaggcggctgaggccccgcgagaattcgagtgtggcacaggcgggccagcagtgctaggagacccagcgccccctccacagctggtggcccaggtactaagcccctcactgcccagggccagtggcaccagttggccactccgagtgtggggccgctgcctgcacccacccagatcttgggctagcccacgagccctgtgcacagccctggttcctgcccgcacccctccctccacacctccccgtaagcagagggagctggctcctgcctcggccagcccagagtggggctcctacagtgcagcagggggctgaagggctcctcaagcgtggccaaagcagacatcgaggcccaggaggtgcagagagtgagcgagcgagcactgctagcacattgtcacctctcatctagacttgttgagtgtgagtacctgccctttctggaacaaaccatcaattcttttgctccctacaattttaagttccaatctggtgagccctagggtccctaggtttcatattgtagaaggctttaaatctaaagagtccttggataaatggaagggcaaagtaaatctcaggaagtttcacacagtagctatctgactgcattcaagaaagaaatctctgtattttccttcaacttctctcacacagcccaaagttgttgggagaaggtaaaggaaaaaacatgaagatttatttcatggagatagccagcataggggaaattatttaccttttcgacttagaacaactagaaaacaagtttccaatcatggtcatctcctgcctcacagtagacattaaagttaagttagagaattcacaaccacacccttctgattgacactatacatatcaatctcgttactcaactgaggggaaaaaactatttccatcagctagaccttttcctgcactccatgaaaagctcaaacactcaggatgtcaaacttaacttttttgcaatcacacagcaaggcccaatctgtcaaagccatacgattcactgcctttatttctactgttggtttgatttttttttttttctagcttgtgggtttcagggcagacaaaggcagctaaaagtctcagggagaaaaagaatctccagtaggctgtaccatagacatccccatttattgcatgtaacttacttcacttctcaaccccacagtttaatcacctgtataaaactggcgcagtaatactcagactgcaaagtcattgtaagaattagcagtagcatgaggaaaacatcagctcatgttaggaatgcactgattattacctggcattatttagattgattaataagttcatatatgcatagtgggaaacaccttggtctaacattctttggttctaattatgattacgatatcatgtgatttccatgtgttagagagcaagtcataattatcaccattgtaaaaggagaagtacattctacatcagattgacaaattgtgttctataaaactctaagaagccaggcagatacctcaagagccatgaggactcaataggaaggttgctaaattctatgagctatcggttatgaccttcaagtgttaaacatattaatatagaggtataacttttcccgataggaaataaaaggcaattactattttaacatgctgccaaacacactgcctattgttaaaataattgttaaaatttttattgaggctgggcacggtggctcatgcctgtaatcccagcactttgggaggccaaagcaggtagatcacctgaggtcaggagttcgagaccagcctggccaacatggtgaaaccccgtctctactaaaaatacaaaaattagccaggcgtggtggcgggcacctgtaatcccagctattcaggaggttgaggcaggagaatcgcttgaaccctggaagcggaggttgcagtgagctgagatcacgccactgcactccagctggggcgacagagtgagactccgtctccaaaaaaaaaaagtttttgttgaaataaattattttaaataacagtgacttcagttaaaatcctaattagtgaacttattagtaattcaataatagtatttccaatgcttccctgacaacccttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgacaactctttttacctcataaagagaagctatgtaaatcctgaggcaaacagcacgcttaatgctgagcatttaaaagcattctcaggcagaaggatcacttgagcccagtaattcaaggctgcagtgagctatgataacaccactgcactccagccagtgtgcagagtaagatcctgtctctaaaaataaataaatagttcagatagaaataaacagaatatagatagatagacagatagagataataaaagcattcctggctaggcatggtggctcaggcctgtaatcccagcactttcggaggctgaggtgggcgaatcacctgaggtcaggagttccaagaccagcctggccaatatggtgaaacctcatctctactaaaaatacaaaaaattagccagggtggtggctcacacccgtaatcccaggtactcgggaggctgaggcaggagagttgcttgaacccaggaggcagaggttgcagagagccaagatcacaccactgtactccagcctggccaatagagtgagactccatctcaaaaaatttaaagaaagcattcccaatgaagacacagcaaaaatgctctccttcactattactattcaatatttaatgggaattcccagccagcacaattaagaaaataagtaacaaggatcgaaaagagacaatattatcattctttactgacagaatgattacatataaaattcaaaaacatatacaaagtatcagacctaatacgagtttggaaagactataggaaaaaaaaaaactttaaaaacgctttccaatatttcaataacaatcaattaaaaaccatttttagaattagcaataaactccaccaggtacctagaaaaaaactaagacacaagaactttatacacataaaattgtgccaaaatacgttaaaatgtattcaactcttccagctttattgtggtataagtgacaaataaaaattgtatatattttaggtgaacaacataagttgatacacatattcactgtaaaatgattaccacaatcaggccaattaacatatccatcacctcacatagttaccatttttatccttgtggtaagaatatttaaaatctactctcttagcaaatttcaagtatacaaaacattattattttagttatagccacattaggtctccaaaactaactcatcgtgtaactgaaagtttgttcgctttgaccaacacctacccatttcccacaggcccagcccctgcaaccatcattctcctctctgtttctatgagccacgtttttagattccacatataagtgagaccatgtggtatttatcattccctggcttgcttatttcacttagtgtaatgtcctccaggcttatccatgttgttcaaaaaggcaggatttcctttctttgaaggctggctaatactcctctgcctgtgtgtttgtgtgcatgtgtgtgtgtgtctggatgtgtgtttgtatgtgtgtcacattttatcagtttatccactgatggacattaggttgttcccattatcttggctattgtgactaatgctgcagtgtacatgggggtgtagatttatctttaaaacactgatttcaattactttggatatatacccagaagtagaattgttggatcatatggttgttctataattttttgaggaacctctatactgtttaccacaatggcagtaccaatttacattcccagcatcaatatataagggttcccttttctccacaacctcaccaactcttgttatctgttggtactttgagaatagccattctaacaggtgggagatcacatctcattgtagttttgatttgtatttccctgatgattgatgatgttgagcactttttcacatacttgttgccatttgtatgtcttctgtgagttgcctttacatttcattgtttcctttgctctaaagaaatattttagtatggtgtagtccaattatttgtttttacttttgttgcttctgtttttggtgtaatattcaaaacatcactgctaagatccatcttattgagctttctatgttttcttctaggagttttgtggcttcaggcctttcctttaaatctttaaacaattttaacttgatttttgtgtacagtgtcagataactctccaattttgtttcctttcatattttttctttttttgcatgaggatatccagttttcctaacaccattaattgaaaacaatgatccttttcccattgtgtattcatggcacctttgtcaaagattagttgaccatatatgcatgggtttatttatgggctttctattctgttccattggtctatgtgtctgtttttatgccagtagcatgtttttttggctactatagctttgtaatataatttaaaatcaggagatgtgatgacttcagttttgttcttcctgttaaaaattgcttgggctattcggggtcttttgtggttccctatgaattttaggattgttttttctatttctgtgaaaaatgccaatgaaattttgatagactgcattgaatctgtagatcactttgggtattatgaatatttttataatattgattattctgatccatgaacatgggatatcttcccatttgtgtatcattccatttcttttatcaatgtttcatagtttttggtgtatagatcttgcatctccttatttaagcttatttatgttattatttttgatgctattgtaaatcagactgatttcttaatttctttttctaatactgtacactaatgtgttattagtgtacagaaacacaactgctttttatatcctgcaactttactaaattcatttatagttctaattagttttggggtggtgtctttaggaatttctattacaagatcacatctcctgcaatcagaaacaatttcctccttcccaatttggatgactaataaaataaataaataaaataaaataaaataataaaattatttttactgcctaattgctttgactaggatttccactactactttaaataaaagtggtgagagtgggcatccttgtcttcttcctgattttagagaaaaagctctcaaccatttatggttgactatgatggtagcttgtgaaatatgacctttattgtgttgaggcatattatttctatacctaaatttgtttagagtttttgtcataaaagattgttgaattttgtcaaatgttggtttaaatatttgagataatcatataatttttgtccttcattctttctgttaatgtgttgtaccacacttattgattatattgaactatctttgtatcccagggataaatcccacttatttgtttaatatgctattgaattcagttttctagtattgtgctaaagatttctacacatatattcatcagggatattggcttgtaattttctttccttgtagaatttttgcctggctttgctatcagggtaatgctagcctcataaaacaagttggaagatgttccttcttgctatggtttgaatatgccctccaaagttaatgtgttagaaacttaatccccaatgcaacagtattaggaagtagggcctaatgggaggtgcttaggtcatgagggttccatccttatcaatgcattaatgctgattataaaagggcttgaagctgtgagttccatctcttgctctctcgcactctttttctcttctgccttctgctatgcaatgacatagcaagaggatcctcaccagatgtgggccctagatcttggacttccccgtctccaaaactgtaagaaattaatttattttctatgtaagttaccaagtctgtggtattttgttacagcaacacaaaatagactaagacattttctcttcaattttttttggaagcgtttgagaagcactggtattaattcttctttaaatgcttggtagaattcatcagtgaagccatcggatcctggacttttctttgatagaaagatttttgttactgattcaaacttcttactcattattagcctgttaagacttctttttcttcacgattaaatccaagacttctttttcttcatgattaagtctttgtaggttgtgtgtttctaggaatttatccattacttctgggctaatttattggcatataagtgtttgtagtactctcttaggatcctttgtaatcctgtggtatcaattgtaatgtcttccctttcatttctgattttattttagtcttcttttttcttaatctaattaacagtatgtcaatttcatttatcttttcaaaaaaccaactcttagttttgctgatcttttctattatttttctaagttctatttcatgtatttgttctctgatctttactatatccttccttctgctaactttagtttgttcttctttttctagtttctcaatatgtaatgataggttgtttatttgagatctttcatttttcttcatgtaggcatttttcactataaactttcctcttaaaactacttttgctgcatcacctatgataagatttggctctgtgtccccatgcaaatcttatctcaaattgtaatccccatgtgttgagggagggaactggtgggaagtgactggatcacagaggtggtttgccccatgcttttctcgtgttagtgactgagttctcatgacagctgatggcttttaagtgtggcacttcctcactctctcctgctgccttatgaagatgtgccttgtttccccttcaccttctgctatgatcgttaagtttcttgaggcctccccagccatgtggaactgtgagtcaattaaacctcttttctttataaattatccagtctcagtatctttataacagtgtgagaatggactgatatacccaaagttttggtacactgtgttttcattttcatttgtctcaagatattttttaattttcctactgatttcttctgctccattggttgggagtatgttgtttgatttccacatatttgtaattttcccaattcccttccattagttatttctagtttcatgatactatgatcagaaagaaatattacataatttgatatataattaaaatataatttcaatctgcttaaatacattaagacttgttttgtggcccaacgtataacctatcctgaagaatgttccatgtatactttagaagaatctgtactctgctgctgttgaatagaatgttctgtatttctgtatatatctgttaggtctacttggtataaagtgtaaaatctaatgtttccttactgattttctctctggatatcctgtctgtagttgaaagttaggtaatgaggtccctcattattactgtattgctgtctatttctcctttcagatctattaatatttgctgtatattatttacgtggtctgatgttgggtacatatatgattattgtgtcctcttaatgaattgatccctttttcattacataatgacctttttgatctcttttaaagttttgtagtcaaactatattttgtctgatataaatatagctacccctgctctcttttggtttccatttgcaagaagtatcttaattccttcacattcggtttatgtatgtctttaaagttgaagtgattttcttacggcagcatatagttgagtcttgtttttaaatctattcagccaatctgtcttttgactggataatttaatgcatttacattcaaggtaattattgataagaactttcaattgtcattttgttaatttgtttctgggtgttttgaggatgccttgatcctttcttcctctcttgctgtcttcctttgtgacttgacaattttctgtagcagtatgctttgattcctttctcttcatcttttctgtatctactatatgtttttgctttgccattaccatgaggcttacataaagcatattatagttataacagtttaagctgataaaaacttgtttgtttgttttgagacagaggcttgctctgttgcccaggctggagtgcagtggcgtgatcataactcactgcagcttctaactccttgagagatgatcctctcacccaagcctcctgggtacctaggactacaggtgcacacactaggctaattttttttttttttttagaaatgaggtctcactatgttgcccaggctgatgtcaaacacctaggctcaagcaatcctcttgctttgtcctctcaaagtgctgagattacaagtgtgagccaccatgcccagtcaaaaacttaactttgataacatacaaaaactctacactactttctgatagtgaagtgtaagtaaattcttcctaattggtaattacatattgtgtaaatgaactaaactctctaagagaaaggcagagattggcagaataaattagaaacttgtggaactgtatgctgtctacaagagactcactttagattaaaagacaaaaacaggttgaaagtaaaaggaaagaaaaggatatttcatgtgaacagaaaccaaaatagagctggagtgtatacactaatatcagatgaaatacactttaagataaaaattgctactaaaaacaaagcagcacaatatacactaataaaaaggtcaagtcattaagaaaatactgcaattataaatataccacacctaccaacagagtcctaaaaatacctgaagcaaaaaattgacagaattgaaatacaaaatagggaattcaacaataatagttggagaattaaatacctcaatttcaataatgaatagaacaaatagaataacagcaaggaaacagaagacttgaacaacactataaaccaatcaacttgacatctatagaacactcaacccaacagcagcagaatacacattcttctcaagcatacatggaacattttcctgatgaaacatatattgggccaaaaaacaagtctctgtaaatctttaaagattcaaataatgcaaaacatgttctctgatcacaaaagaataaattaagaaatcaatcacaaaaggaaaactggaaattcacaaatacatgcaaattaacaacacattccattggccaatgggtcaaagaagaatttacaagagaacttagaaaatactttgagataaaataaaaataaaatacaatatactaaagcttaatctttcatatcagagtttaatccatttgaataaaagcagtgctcagagggaaatttatatctgtaaatgccttcactaataaaataaaaaactctcaaatcaataatctaaccttccaccataagaaacttaaaaaagagcaaattaaatctaaatcaaacacatacaaaaaagagattggagccaaacagagaacagaaaaacaacatagaaaatcaacaaaaccaaagttggttctttgaaaagatcaacaatattgacaaactttagctaggctgagcaaagaaaaaatagaagactccaattactaaaatcaggaatgaaagagagaatatcataattctaagaaaattctatgaaagctggataccatcaaattagataccctagatgaaatggacaaattcttagaaacacacgatctaccaaaattgactcaagaagaaacagacctgtagctaataaagaaatgagtcaacttttctaaaaaaaaatctttcaatgaggaaagcctcgaccagatggtttcattggggtattctacaaaatgtttaaagaaaaattaacaacattatttctcaaactcttacaaagagtagaagagaagggaatacttcgtaattcattctgtggaagtgaaacacatcaaaagtaaaaactacagatcaataaccgttgtgactacagatgcaaacattctcaacaaaacattagcaaatggaatctaacagcatatgaaaggggttattcaccatgaccaagtagagtttatcccagaaatgtgaggttggtccaacatataaaaatttatcaacataataaagcatattagcataaacccacatgatcatctcaatagatgcagaaaaagtatttgacaaattccaacatcttttcatgataaaaattctcaacaaattagaaacagaaaagaaaatttcttaacctgataaagggcatccatgaaaaaccaatagctaacatcatacttaacagggaaagactgaaagctttgctcctaagatcaggaagaagacaaggatgtctacctctcaccacttctattcaacattttactggaggttatagccagggcaaaaaagaatgctgtaggcaagaagatgaaataaaatgcatccatactgaaaaggaagaagtaaaagtatctctgttcacagatgacctaattttatatagagaaaaccctaaataataaacacacatacatattaaagctaataaatttggcaaggtgacacgatataagttcaatgtataaaaatcagttgtatttgtatacacacaatgaaaaattttaaaatgaaatgaaaaagacaattccatcaacaataccagtaaaaagaataaaatattcagaaaaaatctaactaaagaagtgcaagacatatacactgaaaaccataaaacattgctgaagtaaattaaagactgaaataaatgaaaatatatctaatgttaatggacagatcaaagcaattcctatcaaaaatctcatcgagaatttttttttgcaaggatcaacaaactaatcctacaattcatatggaaattcctgaaacccagacaagtcaaaacaatcttgaaaaagaacaaagtgagaggaatcacactttctgatttccaaatttactacaatgctacagtaatcaagacagtgtgatactggtataagacagtcaaatagatcagtgaaacagatctatggccaagtaactttcaacaagagtgccaagaccattcaataaggaaagaataattttctcaagaaatggttctaaaactagatatccacatacaaaggaatgaagttggaccccaccttataccatatacaaaaattaatgcaaaatgaatcaaaggcctaaatgtaagggctataactaaaaatcctagaaaaaaaaagcatagatataaatctgtgcaactttgagttaaggaaaagttttttggaaaggacactgaaagcatgtgtgaccaaagaaaaaatagatgaattgaacctcatcgatatttaaaacttttatgtttcaatcagccctatccacaaaatgaaaagacaacccatagaatgagggaagacatttacaaatcatatgtctgataaaggtctagtaaccagcatatataaaggactcctagcattcaacgacaagaagtcaaataactcaactaggaaaagggctaaggatttgaacaaaaatttctcgtaagaagatatacaaatggccaataaatgcatgaaaagatctttagggaagttcaatatcattggccattagaaaaatacagatcaaaaccacaatgacataccaatttcatacccactaggatggctagaataaagggggaaaaaaaaaccagaaaataagtgttggcaagaatatgaagaaactggaactcatacgttgctgataggaatgtaaaatgttgcagctgctttggaaaacagtctggtagttaaacactgaattaccgtgtgactctgtaattctacccttacatatatacctaacagtattgaaaagatatgttcacacaaaatccagtacactaaatgttcacagcggcaatcataatagtctaaaagtggaaagaaaccaaatgttcatcaattgataaatggttaaacaaaatgtggtatatacatatggaatgtcattttccacaaaaaggaagtgctattgcatgctataacatggatgaaccttgtaaacattatgctaagtaaaagaagccaaatacaaaaggccacatattgtatgattccagttatgtgaaatgtccagaagaggcaaaatcatagaaacagatagtagatttgaggtgccaagggttagaggattggggaattggaggtgactgctaacagttatgagatttctttttggggtgatggaaatgttccggaattacgtcatgatgatttaacataacactgtgactatactaaaaaaacactaacctgtacacttcaaaatggtgacttgcatgttatgtgaataatacctcaataattaaaagaagtaaggataataaaatcatcttaatcagccagctatgctagagcaagtaaagctaaatatctttttaggatctagagaaaataaaattataaaattatcatactaatagacaattaatgaatatgcagcaaaaaactattacaaagatgggtcatgcaattctttaacttgtaaatgttatttttctcaactgtgtggtatatttcatgcatttaaagcatttttaagtttataattcattgtgatttgttttttcattccaaataaatatccactgtcatgactaaatttgtatttacaattttgtattctttctgttaaaagaactgagatgggccctacaaaacttgaatcctccactggagataccttttcacaaccatcacagtagctaaaattaaaaagtctaataatacttggtattggagagaaagtagacgaatgttaactctccttggccctactaggagtacagattgatttaaacaatttgaagagcagtttgacgattatagtgacattaaggtgccccaggaattctacttctagagacaggctctaccaacatgtttctacctatgcacccctgcagcatgttgtaaaggcagaacaccagaaacaggctaaacggtcagcaacaacacaacacagaagattgggatatgttctcagaagggcactctatagaggagttaaatgactttatgcagatcaacccacatggaagtggaaaacaataccaactgtgaaaagcaagtttcagaatgacatcacagttaaaaccatttgtgtgatgttttgaaacatgcacacaagtactacatattgattccagaaacaaagaaatgaagtaaaagagaaattcctctttgtttacagaggaaatagacaggttggaaaaggacacgagagactgtaacttgatctgtgatattttgagacaccatgaagaagaactgaagcgtgtgtttccaagtttaggcatccatgaattctgcctcgtgcttttatacttaggattcttaggctcactctctgaccttttctatttgaagctggattcagactatttacctgagtggaggaaatacttgaatcttaaagatcaaactcaccaacaaagaagtggggaaagcagtcatgagtaattcatgaaatgctaagtaaaataataatgcattcataacatttttcatctatcaaactagaagctctggtgtcttccatgatgatacccagggctggcactgtcatgttaggtcattagaaagccttgaaaacatatttatccctttgcagaagcaggtctgttctcataaggagattcttctgaagttgtgcaaagattttgatacaaggatgtacaatgccaagtcaccttgtagatgacaagagaaaaaggagaaaaaatgtccaacaactgtttgttaaattggaatatcttatacaaaccataaacatagagtggatacttataaagacaataaaaaaggcatggagaatgtttaagtgtttagaaaacatgctccccctgggcagagcccaccccagtgccacaaagccactgtagccagactgcctctctaggttcctcgtctgtgggcaaggcatctcggaaagaaaaacagcagcacccgtcaggggcttatggataaaactcccatctcccttggacagagcacctgggggatgggacagctatgggcgcagcttcagcagacttaaatattcctgcctgctggctctgaagacagcagtggatctctcagcacagtgctcgagctctgctaagggacagattgcctcctctagtgggtccctgaccccagtgcctcctgatggggagacacctcccagcaggggttgacagacacctcacacaggagagctctggctggcatctggcaggtgcccctctgagatgaagcttccagaggaaggagcaggcagcaatctttgctgttcagcagcctccgctggtgatacccaggcaaacagggtctggagtggacctccagcaaactccagaagacctgaagatgaggggcctgatgaccgttagaaggaaaactaacaaacagaaagcaatagcatcgacatcaacaaaaaggatgaccaagcaaaaacaccatccgagggtcaccaacagcaaagaccaaaggtagataaatccatgaagatgcagaaaaaccagagaaaaaaggctgaaaattccaaaaaccagaatgccccttctcctccaaaggatcacaactccttgccaacaagaaaacaaaactggacagagaatgagtttgatgaactgacggaagtaggcttcagaaaatgggtaataacaaactcctcctagctaaggaagcatgttctcatccaatgcaaggacgctaagagccttgaaaaaggttagaggaattgctaaccagaatagccagcttagagaagaacataaatgacctgatggagctgaaaaacacaacacgagaacttcgtgaagcatacacaagtatcagtagcccaatctatcaagcaaaagaaaggataccagagattgaagattaacttaatgaaataaagtgtgaagacaagattagagaaaaaagaatgaaaaggagcaaagcctccaagaaatatgggactatgtgaaaagaccaaacctacgattgattggtgtacctaaaagtgatggggagaatggaaccaagttggaaaacacacttcaggatatcatccaggagaatttcaccaacctagcaagacaagccaacattcaaattcaggaactagagagaacatcacaaagatactcctcgagaagagcaaccccaagacacataatcatcagattcaccaagattgaaatgaaggaaaaaatgttaagggcagccagagagaaaggtcgagttacccacaaagggaagcccatcagactaacagcagatctctctgcagaaaccctacaagccagaagagagtaggggccaatattcaatgttcttaaagaacagaattttcaacccagaatttcatatccagccaaactaagcttcataagtgaagttcaatagaatcctttacagacaagcaaatgctgagggattttgtcaccaccaggcctgccttacaagacctcctgaaggaagcactaaatatggaaaggaaaaaccagtacagccactgcaaaaacaaaccaaaatgtaaagactatcaacactatgaagaaactgcatcaacaatgggcaaaataaccagctaggatcttaatgacaggatcaaattcccacataataatattaaccttaaatgtaaatgggctgaatgcccccaattaaaaggcaaacactggcaaactggataaagagtcaagacccatccatgtgctgtatttaggagacccatctcacatgcaaagacacactaggctcaaaataaagggacggaggaagatttaccaagcaaatggaaagcaaaaaaaaagcaggggttgcaatcctagtctctgataaaacagactttaaaccaacaaaaatcaaaaaagacaaacaagaggattacataatggtaaaagaatcaatgcaacaagaagagctaactatcctaaatatagatgcacacaatacaggagcacccagattcataaagcaagttcttagagacctagaaagaggcttagattcccatgcagtaatagtgggagaatttaacaccccactgttgatattagacagatcaatgagacagaaaattaacaaggatattcaggacttgaactcagctctgcaccaagcagacctaatagacatctacagaactctccaccccaaatcaacagagtatacattcttcccaggactacatagcacttattctaaaattgaccacataattggaagtaaaacactcctcagcaaatgccaaagaacagaaatcataacggtcactcagaccacagtgcaatccaattagaacttaggattaagaaactcactcaaaactgcacaactacatggaaactgaacaacctgctactgaatgaccactgggtaaataacgaaattaaggcagaaataaataaattatttgaaaccaatgagaacaaagacacaacgtaccagaatctctgggacagctaaagtagtgtttagagggaaatttatagcactaaaatgcccacaggagaaagtgggaaagatctaaaatcaacaccctaacatcacaatgaaaagaactagagaagcaagagcaaataaattcaaaagctagcagaagacaagaaataactaagaccaaagcagaactgaaggagatagagacatgaaaaacccttcaaaaaatcagtgaatccaggagcagattttttgaaaagattaataaaataggccgctagccagactaataaagaggaaaagagagaaaactcaaatagacacaataaaaaatgataaaggggagattaccactgaccccacagaaacaaaaactacaatcacagaatactataaacacctctatgcgaataagctagaaaatctagaggaaatggataaattcctggacacatacaccctcccaagactaaaccaggaagaagtcaaatccctgaatagaccaataacaagttctgaaattgaagcagtaattaatagcctaccaaccaaaaaaagcccaggaccagatggatttacagccgaattctaccagaggcacaaagaggagctggtactgttccttctgaaactattccaaacaacagaaaaagagggactcctccctaactcattttatgaggccagcatcatcctgataccaaaacctggcagagacacaacaagaaaagaaaatttcaggccaacatccctgatgaacaccaatgcgaaaatcctcagtaaaatactggcaaaccaaaccagcagcacattaaaaagcttatccaccacaatcaagtcggcttcatccctgggatgcaaggctggttcaatatacacaaatcaataaatgtaatgtatcacaaataaacagaagcaatgacaaaaacgacatgattatctcaatagatgcagaaaaaggtcttcgataaaattcaacaccccttcatgctaaaaactgtcaataaactaggtattgatggaacatatctcaagataataagagctatttatgacaaacccacagccaatatcatactgactgggcaaaagccggaagcattccctttgaaaccagcacaagataaggatgccctctctcaccactcctattcaacagagtactggaagtcctggccagggcaatgaggcaagagaaagaaataaagggtattcaagtaggaaaagaggaagtcaaattatctctctttgcaggtgacatgattgtatatttagaaaacctcatcatctcagcccaaaaactccttaagctgataagtaacttcagcaaagtctcaggatacaaaatcaatatgcaaaaattacatgcattcctatacaccaataatagacaaacagagagccaaatcatgagcaaactcccattcacaattgctacaaagagaataaaatacctaggaatacaacttacaagggatgtgaaggacctcttcaaggagaactacaaaccactgctcaaggaaataagagaggacacaaacaaatagaaaaacattccacattcatggacagggagaatcaatatcatgaaaatggccattttgcccaaagtaatttatagattcaatgctattcccatcaagctaccattgactttcttcacaaaattagaaaaaaattactttaaatttcatatggaaccaaaaaagagcctgtatagccaagactatcccaggcaaaaagaacaaagctggagggcatcacgctacctgacttcaaactatactacaagactacagtaaccaaaacagcatggtactggtaccaaaacagacatacaggccaatggaacagaacagaggcctcagaaatgacaccacacaactacaaccaaatgatctttgacaaacctgacaaaaataagcaatggggaaaggattccatatttagtaaatggtgttgggaaaactggctagcatatgcagaaaactgaaactggaccccttccttacatcttatacaaaaatcaactcaagacggattaaagattttaacgtaagacctaaaaccataaaaaccctagaataaaacctaggcaataccattcagaacacaggcatgagcaaagacttcatgactaaaacaccaaaagcaatggcaacaaaagccaaaattgacaaatggaatctaattaaactaaagagcttctgcacagcaaaagaaactatgatcagagtgaacaggcaacctacaaaatggaggaaaatttttgcaatctattcatctgacaaaggggtaatatccagaatctacaaggaacttaaatttacaacaaaaaacaaacaactccatcaaaaagtgggtgaaggatatgaacagatacttttcaaaagaagacatttatgtagccagcaaacacatgaaaacaaactcattatcactggtcattagagaaatgcaaataagaaccacgatgagatgccatctcatgccagttagaatggcgatcattaaaaagtcaggaaacaaaagatgctggagaggatgtggagcaacaggaacgcttttacaccattggtgggagtataaattagttcctccattgtggaagacagtgtggcgactgctcaaggatctagaactagaaatactatttgaactagcaatcccattactgggtatatacccaaaggattataaatcattctactataaagacacatgcacatgtatgtttattgcagcactattcacaatagcaaagacttggaaccaacccaaatgcccatcaatgttagactggataaaaatgtggcacatatacacctgtaatccagtactttgggaggccgaggcgggcggatcacgaggtcaggagatcgagaccatcctggctaacacgatgaaaccccatctctactaaagataccaaaaaaattagccgggcatggtggctggcacctgtagtcccagctactcaggaggctgaggcaggagaatggcgtgaacccgggaagtggagcttgcagtgagctgagatcatgccgccactacactccagcctcggcgacagagtgagactccatctcaaaaaaaaaaaaaaatgtggcacatatacaccatggaatactatgcagccataaaaaagaatgagttcatgtcctttgcagggacatggatgaagctggaaaccatcgttatcaacaaactaacatgggaagagaaaaccaaacaccacatattctcactcataagtgggaggtgaacaatgagaacatatgggcacagggaggggaatatcacacactggggcctgtcggtgcggtggggggcaaggggagggatagcattaggagaaacaactaatgtagatgacgggttgatgggtgcagcaaaccaccatggcacatatatacctatgtaacaaacctgcaggtctgcacatgtatcccagaacttagagtataattttaaaataaaagaaagaaagaaaaagaagacatgctcccatgtgttaagcgggtttcctgcagaggagggctcatttttacataagattcccaaagcagcctccttatatccagagtgtcagagattttacttttcttcttcttttttcttttcttttttttttttttgagatagagtcttgctctgttgcccagtggcgtgatcttagctcactgcaacctccacctcctgagttcaagtgattcttcctcctcagcctcccaagtaactgggattacaggcgtgtgccaccatgtccagctgatttttttttttattttttgtagttttagtagagttggagaggctggtctcccaactcctggcctcaagtgatctgcctgccttggcctcccaaagtgctgggattacaggcgtgagccaccacacccgactgagagtgtcagagatttgtcaaagggcctgcaagtatcctggcctgaaacctcacaggctgcttctgaatgataaaaactgacctgtcacttctgcaccattggtttctggtcttccatcacttccagcctcgaagggtgctcccacagcttagtacctgcataacaaaccccttaccccagcatatctaggatgccaacaactgtaaggcacaccacaagagaaaatgtatgctgccaataaatgctgacgtgttatctattgtaaagaagcatgcaggccctggcagtgttgaaatgtgaaaatatgcacatccagcaatcaaaacacctcatgcatactacaatattaacagagattgttttagaattatgaaatcagggccggtgctttggctcatctgtattttctaaactttctatggtgaacgatattactgccaatatttgaaaaatggtaaataaacattattttaaacaaaaaaaatgaaatgagccaaccagaactaccatgaacctaatgaaactaaagctttgtggccttccaaaggcccctggaagaagccctagtttgtttatatttgtattttttgttatttgtcataaaacaacccctcaaactacacatgcttcaggccccataaagctatgagctgtcttggattcaacaaatatggagtacctaacaagtccacgtggactgctttaaaagacagacagaaatagaaacatttcagcttaagtgaggatacaagcaagcccagataaccacaccaaggcaacaagaccaataatccctctccctttcctaattatcactcctgctgctatggactgaactgcgtcctcccaaaattcgtatgttgaggcactaaccccaatgggatggtattaggagatggggaggtgatcagggatagatgaaaccatgagtgtggaggccccatgttgggattagtgaccttataagaacaggaagaaacaccagagctttctgtctccaccatgcaaggacacagcaagaaggtggccatctgcaaaccaggatatgagccctcaccaggaactgaatctgcaagcactttgacctgggacttctcagcctccagaactgtgagaaataaatgtctactgtttaagccacccagtttatggtatcccattagagagcagcccgagctgactaaaacacctccatactccatctctagtgattataactggtgatgcacaaatccactggtaaactgtcagatattgaagccaccaccacgctctatagtttggttctgttgaagttttataagtaaataatgaactgccaatgttgtataaatgctatggggaatattcacccaaggattctttcttttctctgaaatctctcatattctttaaaaagtcagcctcttttcatctgcagtgagattttctctctaaatccttctttaaacactctttttgtgtgacgtcttagccttaagtactgagccttaaagaaaagctgttttccactcactgccttgttttacatatgctctccctgagctttcaaaatggcaaaataaagcatcttagggaccacaagggccgcctgctttgaactacccagcagtaaaggggccaagtgacaaagctagtcggtacacccggcccaaagcaccctaaagccaaacacaacacaacactttgtcaaattaattattaggctgcatcaaaatatgaagccactaaaagtggatgtactctatttgaaaaggaattttaaaaccctaaggttccacggaacctagtttgaaaaccattggtcaacattagcaagaagcaaacaaaatgaggaatttttccctctgcaaaaccatgtcccctccaccttctccgtggagggaagacacagtgttgatacacatacctgccatgatacaggggagagtgcatgacacacatttaaaaaggcgtggggtgaacaggcaattctcattttagcaagactgttagaacttcattcagccaatgatgaacatgtgctccactttgaaaacaaaaggcagccttgtctcacccatgactctctgtccctattccacaaggagcattcccacccaaatgcaagctctcagcttcatggacacgctaaggaggctctcaccaggagcacctccgagtccatgtccacatctctgcagtatggccccagccagatctggagcacattcttgtattcaacacatttataaagtgcctcatcaatacctggcgctgttcttgaccatccgtgaacaaaagaaacaacaatctcacccttgcagtgtctacattctagaggggagagacctcctaagtaattaaattgggcacaaaagaatgatgagtgctccgggggaaaaacagagcccagatagggggagcagggagtgctggggcaagtgttttgcttctgtttcggtttttatgtggtaaaaaacatgtaagatttaccatcttagccatttttaagtgtacagtactatagtgttaactacatgtaccctgtttgacaacagatctctagaacttcttcaccttgcaaaactgaaactctatatccaatgaacaactctcctttccccctccctccagcccccggcaaccaccattctgctttctgtctctaggtgcctcgtatgagtggaatcattcagcatttgtctttctgtggctggcttatttcacttagcataatgtcctcaaagttcatccatgttgtagcctgtgtcagaatttccttccttttgaagactgagcaatcttccactgtgtatacagaccacattttatgtatccactcatctactgatggacacttgggtagctcccaccttttggctattgtaaacaaggcttccatgaacataggtgtgcaaacatctgttcgattccctgctttcagtgaagacctagttttaaacagagctgtcagtgtggttccatgcctttcctttcctctgcagccctctgtccaccttctctgtaggggggaaattcccactttagtctatttcctggcactatttcatcagtagctatgcaacccacacctgcattttcagaacaactcccacaaactgcagaggactcaatatcacctattttctaaagatggatttcttcaaagcacagggctgttgggaccagagtgcaataaaagagtgaggaatggagaatgaaaacatgaatcatgaacgtgagcagctggctctgttttcagaggcacttgtcagttcccccaaaagacagcccctcatcatgtccttcaacacggcaggatagacaggacaatgtcacccatgctcccaagggcccccctgtccttactgcctaggaaagaacggccccttgatggaatctctgtctgcatgaaaacctaccacgaacactttcttcaaagttctggaaagaaaagttttgacacctgttaaaggaatttcaagaattcaaaattaagtggggacttcccaaagtctcaaataatcatgacacaacctactcaaccatggaacaaatcctgactgcggagcaggacccccagctagacagtgcagagcagccagagtgggtcagacctgagtcctgacccgaggactgctttctggaggtagatatgagaccccaaatatgaacaagatgcactagggacccaggaaccaggagtgctgatatccaaaggtcggggggatgatggatgtcccaattcgagaagagagacagaacgcacccttcctctgactctctgttaagactggcaacaaatcggatgatgaccacctgcattggtgaggatgatcttctctactccgtctactgattcaaatgctcatctcttccagaaacaccagctatctgggcatctgttagcccagtcacataaagttaccatcacaaaccacaaggaatgaattctgctggcacctgaatgagcaaggaaatggattctccccaagagcctgcagaaaggaacaagaccttgactgtaatccagcgagtcctgtgttggagttctaatctactgaactaaaagaaaataaatgtgttttgctttaagctgttaaatgtgtggtcatttgtaacagcagcagcaggaactaatacagccactttaatgagcagcccaggtggctagtacaactgatggggaatgtatcccctggccatatccccaggtgtgtgcccgagagtatcactgtccaaccaaactctctgcagtggtagaaatgttctatacctatgccgtcaaatatggtagccacttgtgaccattaagcccttgaaatatggctagtgcaactaaggaaatgaatttataatacaggtcatcttaattaccttaaacttgaatagccatgggtgatcagtggctcctacaatgaacagcagagcctcaagcagaggttcttaaatgttgctgcatattaggatttcctggagagatttttttttaatgctgatgcccaagctgcctcccagatcaattaaatcagattgcacttaggggatgggacccaggcattggtatttttaaaagtctccaggggttctaacatgcagccaagtttgagattcagtgacccagggaaacggtcacacagggtacacacagtcagatacatggatggtaactgaacccctgccttggaatgtcaacaaatggcaaacgctaaggtttccattcatgcaatggaatagaatgtccacagcaattaaaataaatgcatggatctatacataccaacaatggtaaatacagaaaacacaaagttgacttaaggagcagaaacactagtaacaatacaatatcatgtctatgaactttgaagtgtacacaacaatactacctgttgactataaacacatatagtaaaaagcataaaaacttggacaagaagaacacacaccaactgcaggctgggggaaacctgctgggaaatgagagcaaaggaggggatgggggggtgcaggtacaaagagcttcacttccatgcagcaatttatttcactttagaagatgtgaagcaattatggtaaagtggtattatttgctgtagctccatgttatgaacacaagtgtgttgtcatattttctctattcttttctgggcgtataacatttttcataataacaaaagagaccaacatatggatctccaggcaggaagagtttatccctgggcgggcagcacagaggagggtggttctctggggtgagttaggctatgtcatattgaggaatttattcctagtaggttttccttcaaatggaaagccaattgtcttccagaatttaaggaaataaaacaattatgagccaaaaaaaaaaaaaaaaaaactactggacaacaaaatctggccaaaggtgagtcaggcaaaataaagaagttagaaatggccttagtaaaggcagcatggcagcagctcaggaggaggagaggcaggttggcagggttctctgagcacttaaacataagactatgaggaaataccacaggaagcgggggagcagcggagagcaaatgctatcaacctcatcccacacatgcaacaatttgcaacaatctagccacgggagggaaatgataatattagtgtgccagacactgccctaagtgctttacattataaattataataactcaactgttagaataattctacaagatactgctattacttctatcttagacgtaacagagggaaactgagtcacagcaagtttggtgattagcctgaggtcaagtggccaagatgggatttgaacccagctgtctgggtcccaaatgttaacccctacattataccgttctttgaaattaggtatgcctgcactaatgtcctctgcgcttctacacttgaacttcccgttgtaaaaaaaaggactctaaccacttaaaaaattctatagccttttctacttgactgtgaagcatattcatattctttttcttgttaaagtaaatttcaaacttaccatttatcctgaaagtaaaatgtataatatataactctttggacacacatcctccctttacatccatgaacagcgtgatgtcgaagtcccgctcaccaatgtctatgaggggttatttgtgaaaggtgacattttatgtcatttttcttcttctgtttttccctggctttactgaggtacacttgacaaataaaaattccatgtatttaaggtctacaaggtgatgtttttgtattcaccttgcaaaataattaccataatcaagctaattaacatgtccattacctcacatagctctgatgttttgtacatggggcgagaaccgcactgctgggtgcggtggttcatgtttgtaattctaacattttgggaggctgaggcaggaggatgggttgaagccaggagtttaagaccagcctgggcaacacagcaagaccctatctaattaggcatagtggcacatgcctgtagcagggagacagaggaaatgggtaacttgagcccaggagttggaggctacagcgagctatgattgctacactccagcctgggtgaaagagtgagacctagtctcaaaacaaaacaaaacaaaacaaaacaaaaaaactactctcttagcatatttcaagtccacaacacagcattctcaactatagtaaccatgccgtacgttagatcttcagaactcattcctcctgcataactgatacttagtatttttattctttctacttttctgtattgctggaatgttttatagcaggtattcataaattttcacaacaaatgttcagttaatgacatttctaaaaaaacaaataaaaaagaaaataccaataaatgcacctcctatagaaacacaaggaaaaggaggcgtgccatggacatgaggagggagaacacacctctacatctgtaggacccaggacagtccttctggacccgcaacccagaggactgcaggcaggcagcacctccctgaatccagggtagacagccgggaagggcaggaggaaggccacaggcatggagccagatgaggtcaacaggaatgccatggagacaacagctataaccacagggggaaacccacgctgaaggaagtaaaaatcagaacctacaccctggaaaaccaaactagtgacacaggggaaagcttcagaaattctcccagaatgtcaaaatgaaaaagaccaccacctgacaaagcctcttatggcaagaacagagaggaaggtcacagatgacaaggacaacagagatcaagggcgtttcaagaggaactgctaactcttttccaaagaaaggtgtgcactactgcgacacaaaagcagacccttgctctatggaagaaaatccctctccaccagtgagtacttcagagactgcctgaaatgctccccaagctgttctcagtaaaagcaccaagtcctcttaccaagtcaggaaaacaagcctgcatatttatttggagcactacatttcttggtattctaaaataatatacacctctttctctctctctctctctctcacacacacacacacacatacacacacagagtagataaaaagtcccctttaagctaaagttgggagctcaagtacaacttcaggattatcaataaatatacagctgaccttggaacagcacaggtttgaactgggcgagtccacttatatgtggatttttttccatcaaagttacactgagtgtgcctgcctctcctgctgcccctcctacttcctctgcctcttcctcctctgccaccccgagatagcaagaccaagccctcctcttccttttctactcagcccactcaatatgaagactacaacaaagatgaagacctttatgatgacccacctccacttataaatagtaaatatattttctcttccttatgattttcctattaacatttcttttctctggcttactttattgcaaaaatacagtatataatgcatgtaacctacataatgtgttaattgaccgtgtttattagtaaggcttccagtcaacagtaggctattagtagttaagtttgggggaagtcaaaagttatacatggatttctgactgtgagggaggttgggtcccatcagggctctgagcccaggctaagccatcatatgccctgtgacctgcagtatacatccagatggcctgaagcaactgaagaaccaccaaagaagtgaaaataggcagttcctgccttaattgatgacattccaccattgtgatttgttcctgccccaccccaactaatcaatcgacctagtgacattcctcccctggacaatgagtctcaaaatctacccaccctgcaccttgtgacccccgcccctgcctgtaagagataaccacctttaactgtaattttccactacctacccaaatcctgtaaaactgccccactcagcccacttgcattcaagtaaaataaacagccttgttgctcacacaaagcctgttggtggactctcttcacatggatgcgcatgacgggtcccctaacccctgcactctttgaagggccaaatgtgcattatgtgacatggataaaaattaatgtttttctaaatggcaaagtctacaacctacaaattgaagaatagttctagcttcatctgaagtgttattgaagaacaaaaataatattctccataaatatagcaggcagatatacatttttaaaagtctcaactaaagctgaccaatgcaaacaattatttatttaggtgatcaaatagcaaactgactgtcagagacccattcaacctgtgatatgtgacctatgaattcactttctaccttcatgcttccaaaattatctagattactcactatcaatatttttcaccaagaaacaatggaatcctgagtctggtcacctgaccctatattaaattgtacccatcaattctacaaaacactgcccatgtttcctataaaaaaaaaaaattagaagaataaaagagtaatccacatacaatgtaaagctaaaaaactgcattggaataaaaaacaaaattgaagtattttatgaaaacctacaagaactaataagtgagtttaggttagcagggctgcagaatacaagagcaatatacaagatgcaactgtatttctatacactagtagtaagtaatcagaaagttaaatttaaaaacaataccatttacaatagcatcaaagtctgtaaaataaataggaagaaatctgacaaaagataagtaactcctgtacactgtaaactacaaactactgtagagaaagattaaagaccaaataattgggaagatataatgtattcatagggcagaggactcaatattattatgacatcaactctccccaagttgatctgtagaagtgcttttcaaccacgggtgattttgtcactccgggagatatttggtaatgtctggaggcactgttggttgtccctacttggtggcagaaggtactgttgccatctaatgagtaaaggatgggatgctgctacccaccccacaatgcagaagacagccccacaacaaagaattatccagcccaaaatgtcaacactcccagtgccgaggtggaaaaatcctgatgtacagagttagtgtaattccaatcaacatcccagcaggctttgttctaaaactgacaaactaattctaaaattcgcacagaaattcaaaggatatagcatagccgcaacaactttgaagaagaggaacaaagagaattaacataacctttcaagaggtttcaagaattaagtcaaagtatgttaacagacaattctccatgaacttctgcatatgtggtttttctaaacaagcagcactgtaaaaataaggatagaggatttgaatgccttgaaagctagaagtagtataacgcccaggagagatttagagacatatctgtcttgcaaccatttgctacctttcagtaaaataaaactagggaactttcctcctctccccagagaggatttgtttagattgcagagtaagagtctctccctctttgtctctggggcagaaaaagggcaaagttattagacaccctatagcaattcaggggcctctcctgaacagcactgcacgcacaggggagtaagtggcactgaccacactgtcccttggggaattgacactagttggcactgtgaatataaaatatttcctctgatccagagacattgttcctcatcagaatatatacatacacttaaacacacacacacacacatttttaaaacacattaattaagacagtgtggtgttggcatcaagacagacaagtagaccaatacagtataatctctactgcagaaatagatccacacatatacagaaaaaaatctttgatagaggtgcaaaagcaattctgcgaggaaaggatagtcttttcaacaaatggtgctggaaaaactggatatccatctggggaaaagatgaaataaacctcaatccatatctcataccacataaaggagttagtttcaaatgaatcacagacataaatgtaaaacatgaaactataaaatctgtaaaggaaagaatggaaacaaatctttataactctggattaggcaaagatttattacatatgacaacaaaattttaaatgtggcatcttcaaaacacactgtaaagggaatgaaaatacaagacacattccaggagaagatatttacaaagcatatagctgatacaggtcttgtacctagaacataaaaagaatcctcaaactttaataaaaatgatgtcaacaaaaatgccagagttgaagaccaatgaaaattctctcttccataaaatcaatgagaaaactggcagaaagtgtcagaatcaactttttcagaaccctaaaaattaaaaacagattgcagcaatctgatgagtgcttcctcaagaaaaatgtctgaatctcggtaagaacaggtgagctttgtggcacattagcttggtgctattcccttcccacctacccgtctcggcaggagccttgcaaaccaatagcccacaatcacagtgcatgtgagaaccctggcaaaacatggctggagctccttcaaattctcattcccagagaactgacatgaaatgacctgtctgatgtttctctagaagaaaccacctagaaggctgtttttatttgacctgactcagaccttgctcagtgtgacatgtctttagcctcggggcatttgctgaaaacagttgaaggtgatcattaaccacaacagctgctagaggtggtggttaacaaaaaggcaaaaagaggctaaccaaaaagcttaaaggaaaaagccatggaatgaaacgtctgtaggtcctttgaaaaactccaataaagtgctgaaaattaaaaggccacatgcacacaggctgtgtacatgccaagcactgtgttcatgctcaggaaaggcctgggaaggccctaagctctcatctccgactgaccttgaggctttgcacaagcaggaagggaagacgaaggtagggctgtcaactgcctgcctggctgagtagtaaagtaacatttgcagatgacttccttagaaaatcttaaggaatccacaaaaatactgttagaggtaataaatgagttcagcaaggtttcagggtacaaaaatcaatacacagaaatctgagattcctgtacatgtgcaataaacaatcaaaaactaaagtgaagaaaacaattccatttataacagcataaaaaatacaatacttaggaataaacttaacaaaagagatataacttgtacactaaaaactagaaaagatcattgaaatgaattgaagaaagcttaaagaaaagacatcccatgcttctgagctggaagacaatattgtttggatggcaatattctccaaaatgttctacaaattcaacacaacccttataaaaatcccagctagatttttttttttttttttttttttttttttgcaaaaatggacaagttgatcctgtaattcatacggaaatgcttggatccagaatagccaaaacaatcttgggaaatcaaagttggaagattcacatttcctgatttcaaaacttactacaaagctactgtaataagcccatacatttatagtcaattgattttcaacaagagtgtcaagtcagtataatgcaaaaggaacagtcttttcaacaaatggtgctgggacaactagatagccacatgtgaaagaataaaattgaacccttgtctcatatcatatacaaaatttaagtcaaaattgatcaaagacctaaatataagaggtaaaactatgaaactcttagaaaaagatatagatgtaaattttcatgatgttggattaggcaatgttttcttagctatgataccagaagaacaagcaaacaaaaaaatagatgggatatcatcaaaattacaaattttgtgcttcaatggacaccatcaagaaagaaagacaatctacaaactggaagaaaaaaattgtaaatcatatgtctgtacaggtctagtatccaaaatacataaataactgttacaactcaataataaaaagacaactcaattggaaaatgagccaaggatttgcatagacatttctccaaaaagagatttgaaggaccaataagcacatgaaaagatgctcaacatctctagtcaggagggaaaagcacatcaaaaccacagcaagaaagcacatcacaatcacaaggatggctgtaataaaaaaaactagaaaatacatgtgttggtgaggatgtgaagtagaacccccacacattgttggtaatgttacgggcaggtctttgttcttagagctcccaagatgtggcagaccactcccaagatggcagcaagccttttgttctctgacctggggttcttggccttatggattccagagttttatagctctattagaagccgtaggtcacggaagagaaccatggaacccagcgactagtgttcagctcgattaggatgaacctgggcactcagccgtgcaggaacaatggcgagcctttagcccagtcggaagcagcaatgggcgcctcgctggatcaggagcacagcagacaccctgccagatctagaggggtgtcagtcagtggcaggtctgcaatggcagccaacagcagtggtggacagcgagcgaaagctcagctcaagccataacaaacatggaccagaagagtgtgcagttgcaagatttaatagagtgaaaatagagctcccatacaagggaggggacccaaagggggttgcccactcccggctcgaatgcctgggtttatatcccgatcattgtccctccccctgtgctctcaggcgatatatgatttcactatttctttacctcttgctttagcctagtttgtattttagtgagccctctttactacctgattggttgggtgtgagctgagttacaagccccgtgtttaaaggcaggtgtgatcacctttcccagctaggcttaggaattcttagtcggcctaggaaatccagctagtcctgtctttcagtaagaatgtaaaatgaagacactttagaaaacaatttggcagttcctcaaatggttaaatccatagttacatatgacccagtaattctattcctaggtacatacccaagaactgaaaacatgtgttcactccaaaacttgtacaggaatgttcacagcagcatcacgcataacaaccaatgtccatcatgcgatgcatggataaacaatggaatatacaactgtttactggaatactattcagccataaaatgaaataaagtattattagatgctcacaaaatagacgaacctcaaaaacattttgctaaatgttaagaaaatagaccactaccaaaattctttcaagaggtaaatgagtaacaaactgtggtgtagccacccactgggatactaccaggcaattaaaggggctaaactaggcacatgaaacaacatggatgaatctcaaaggctttatgctgagtgaaaaaggccagtctcaaaaggttatatgcggtataattccattcacataatattccgcaaaagacaaaactatagtatggagaactggtcagtagttggtggctggcatgggtttgagaggggtatcacaagatgaagccattttacaaggtaatgaaactggtctctaacctgattttggtgatggtaacaggaatggatacatgtattacaattctcagaactgtatacccagaaaacaaaaataaaaacctaaccacaaacagaaagtaaaaacacagaaataaggccctcctttcctgacatgcacattctttagtaactacgaaagtaatttcttcaacttcaaaaagcacaagtttaactgatttatttcaagaatgagctaatcaattctgtatttattaaatgcaaatgtttccaatgggtagatttaatatgctatggcaggagaaaggtacattctataccctgaagtacaagaattgattgtgcaagcttggatgcaaaaagtaaaattaaaattccatgtacgtgatatagtgctacacctggcaaaaagcttttctgtagagtgaactgaaaggcacttgcaaacaactcaatcatctggttaaaaaagaaaagaaaaaataggatcacaactctctcttgttacagggaaagtgtccatcttccaaaaaccaaggctcccctcacgcttctcaaagatggtgtccctcttggacagcctctgactctccacatcattccctctttcctccaacccccactgataaattcccaccttagaggcaagccacagcccacagactgctacttcttaatctccccctgtacagagtattttctttttttcagagacagggtttcattccatcacccaggctagggtgcaatagcgtgatcatagctcactgcagcctcaaactcctgggttcaagcaatcctcccacctcagcctcctgagtaacagactataggcacatgtcaccacacctggctactataaaaaaatttttttttttttaaagatggtgtcttaacgatattgcccaggctggtctcaaactcctgggccatagcaatcctcccgcctcagcctcccaaagtgctgggattacaggtctgagccactgtgcccagcctggaaaggatcatgtttgccccataccttcccatctttccagtcgtgccaacctaacacccccagagaaccatgtctgcctccacactcccactctcccttccatcactcccatctggcctcctcactgattttccacaaaacctgtcctcaaatggtcactaacgatctccatgctgtggaatccggggggcacgtgtttgtccatttgctcagcttctcagttgtcaccaacccatttggccacactttccttctgctgatattttctgctttcaacatccttgaaaccacaccctcctgcttttcccccagatctggccacactttcttggtttcctgtggcagctcagcctgctctcctgagcttctaaatactgaggaaattcctcatggccaggccatgcccccgtttctccacactcttcaatttgttgcctgcctgcatccaatgccatccgtatgcacctgctcgctctgtttcatcggcccaacctttgctgggtttcaggacattttctaattagtctgtgagatctaagtagatgtcccattaaaaagggggttccatgggaaaatacctttgagaaacactgcttcacatgatgccccccagccaccccacgatcagctgatgagtctttaggaaaacaaatctgtctaaaacattcctagaaaaataatcccaacaatcaatagtttgtgtccctgttgtaggctcaggtatttcacaaaatccttctcatcttccccactgaaatttagtctcgtgtgaaatgaaacacagaatttactactttactcctaggtaattcccaagatcacctgcctcacttcctccccagggcacaaaatcagagatgtgccaacagaaggcatccactgcagaccctgtaatcttgccaccaccattcttcatgagccatggagaagcttatagaagctggactcctctccccagaaaaataaacacacacacaacacacaaggatctgtatgtaatctcaaggtctcaccccaggaaattcaccccagggtccatgaattcaaagtaagcccccctcagtaaggatgcttcagcggacccctctgattcacaggggtctccattctcacgggcttgctggtttcgctgctaagattatgacaaactagggctgatgagaccttgcttcactccagcaacacaccagtgcaccataactgaggcctctctgcacacatccgccctgcagacaccgtgcattcatccatttggcaaacactcactgagctcccctaccttccaggtgctgtgctaggtgaaggtgacaaactccatgatccttgccctggggagcagacctcctggtgaacagacgcaaacaataagcacaacaaatgacaggttgtgatggcattataccaaaattcaaggggtcatctgacggggtcagatccttgatattgggtggtccgtagtatcatgtgacagcatctgagattgcattccataaaaatcccatcaagatttgtaaaacctcaaagtccttcaaaataagaagatacagtctcaatgttaaaggctgaccaaaaaaaaaaaaaaataggatgagttggaagagaagctgcatgtccttccaaactaatgaagtgatgctcctcctcttggctccccactcccagtagaaatccagccgctagtacccaagtgagagtgacacattcctgcctagcaagcctacagtacagaccatctggtccactggccttgtgcccacttgaaagataacaagccagtttccaatgataaaggaacccaaaaataaagatgtaaaaacagagcccctgaaatgagtcaaatgatacttcctcaccaaacacatcttctgatagcaaatcaagtccaaaggtctcattacaaagaactgtaattctagatagtaggattagctccaccatgaaatctatatgccaacgctctttcgtaattcacttaaaggcccactcacaggtaattcacttaatttcagatctctgcacttgaaaatcacattttttgtgtttcaaatggaactgtctaaactccatccatcgcagaacagttatatagattatgttcataaaattttgtatatacaaccattaaaaataactgggtaaaactatgttactcaagtgatatgtattgttttatctgcgtaaaactctattcttcttgtaaattctcctttgtcccatgtgattgtacttgaaacttccaattatactctttctagcccctccccagccactgtggctagtccagagataggaccatgacatgaaaccagcctatttgagtcttccctgggattctccaacctgcaaaacaaaagcctcttgcatgtccggtcaaggagctgtgggcacataagctcccaagagctgcaagtggcagagggtccacataaaggtggggttgtgagggcgtggaggggtgtgtgagggtgtggaggggtgtgtgagggtgtggaggggtgtgtggtagctaatccagtaaaggcacaggaaggctacgcctcactcagtttctgagtatcttctctatgaagtcaaaagaagtttgaggatgattggtgccattggtgaggcaggttaagcatggttaggactggctagtttgaagaatccagcagcctctgggctggaggggctgtcatgagttgtctggtacctggctctgaggtgtttagggctggtggaccgtggcctagaaggtgagagccagaagaagtgctggggaactgggctctaggctggctggtttgcattctgaaaggctcactcacaggtgagccattaccacctgcaggaatcagctagcctgggagggacagtccctccagcatcagcaaggccccagatgccagagcacccaaatatacagaataaaagggcacaatgaacacacaccaaaaccttgtctcacagagaatgacacctagagtggctgattgacttgaccaagctcaaatgagctaataaaatttctaccttagggtttacacagcacttacaaactacctcattttagatatagcaaaaactctaaaacatcacaggtttatggccattctgaatctcaggaaaaccgaaggtcagagaagttaagcggtgtttctttagtcatctgactaaagacaaacagagctaaaatgaagctacatcttcttgtctagccttttgcatggattcttcaccacacggcctctgcagacctcaggccccacctaaagctccattctgatggatgaagcccagggcccctcgtgcttataagtcttggttggggtggtctttcccgctcacatctcccatgctcggatgtacggaaggcgcctaggtggggaggggacgctccagaaaatgcaaagctcttccgaacaaggctttagtatccacctgcagctgccttctcaccctagggaactggactgaacaacttagtgctccctgagcctcgcccagagcaatggttctctgggaatctgtgcgggtgctgggttgtcataatggctgtgtagttcctgacctatggggaaaagtggccagggatggtagccatccatctatgcaaggagtgttaacctttacgtgttaatgtaggtgaaacaccaacttataataatcacaacctaaaacttgcttccacttttaacctccaggagttttctcattgtttttatatacactaaggtgcccggcactgcaactaccagatcgatcaagcgaactccaacgtgtctggaactctaccaagagcggttcaccactttggaaaatcatgtccccattgacaaggacactccagtgcaacatcctgtcctgctgtgcggctgccgtcatgtctgtggtgatgggtggaggtgcaagcacccagtcgttccctgtgtctcccagtggtcaacatgcctaagcacagaaacatacattattttcagtgaaaattacatttagggctttgtaatgctttttggaatcgtaagtgagaatacggtgcactttctatgacttccatttggggatatagcaaaaacatcatgacaaagggctgtggatctgacagagttccaaccacaggcccagagcagactctggccagacacctcctgtagcctttcctttgagccctgtccttgatctcgatccagttagcatttcaaggttcaaatgcagacccatcccaaaacggtgccgcacccaagtctgggaccaatgacggagagaagagggaggcacctgcctgcattcttcccctcagtggctctggccacacatggagtcgtgggctcccctgtgcactgttctcagcctcaggtaggctgtgttctaccttccccccagttttcttcttacctacgagggctcttgatttctcctgactttgcaaatcctttatgcgtgacagtctcgccttgagaagacagggaggtaggggacgggaagccagcaattttacccactactgattcattcaagaaacacaaatctgaatgcctactattcattttaccagggctctttgcagacacgccagactttcaaactagccatcatcatttaacatctttcaggatttcacattagaagcttttggtaactgaaagtggactggtgtgggggagggccaggtcccactctgacaagggcctagaagacaggccaactcctgtctgaggtctgaaactgggcagaacatgaagggcagccctggggagggccaaccatggggacggaaggcaaaaggctgtgggaaacccatttttaaattttttaattcatttttaattgacaaataaaaattgtacatatttattgtacaatttgtacaactgcacgtacttcaacatgttgtttgaaatatgtaaacattatggaaagcaaaattgtttctgaggcagggtctcactctgtcacctagactgcagcgcagtggcgcaatctcggctcactgcaacctctgcctcccaggttcaagcgattctcctgcctcagcctggggagaagctgggactaaaggcacccaccaccacgcctggctaatttttgtatttttagtagagatggggtttcactatgttggccaggctggtctcaaacccctgacctcaggtgatccacctgcccctacttcccaaagggctaggattacaggcgtgagccaccgcacccagcttgaaaggctaaactgagctaattagcatatgcattactttgcatccttattttttgtagtaagatcacttaaaatctactcagcaattttcaagaagacaatgctattaactatagtcaccatgttgtacaagagatctctttaacttcctcctcctatcgaactgaaattttgtatacctcagattctaatttttaccctatattacacagagcaattttgaatttatttcgctaaactgtgacctagagaaaatattttattcagaaaacatcactggtaaacaaacagctcaggaagtgatctgtgtttactaaaactttgaaatatattttacacatattctgcattaaaatctgattaaaatgtagttatacaaagagacagtgttttctgatttgtagcattcatggccgagatacactatttaaaaatgcacttgatttaggcatttattcaaaatcataagcataaaacatgatcataccttcctactggcagacacaaaactggtgcatcccacacacttgtttgagtaattacaacaccagctgttctagcacctaccaagagaagctgcaactcagactgactcctggtcactgatgtgccaaacagcatcatcttctaaccaaaaatgaaaatctcactttgataaatgggttgtccaagttaaattagctaaaccaatgcttaagtctaagttccaatttttaaaactttctgtatatgctatactagcaaatgtggatttatctgattttaacacaaaaaggagagactgccaatagaattgatttctgctagattttaaaatctacaaaacctgagatctccccaagaattaaaggcaattctcaggttgaaatatttatgaaacatacaaatttcaatggcatttcacagaaaataaatataaagcattaaatagcaagacaaagattacagccaagactctcaactatccaactgaaactcacttccatatttaccacccaaagacagcagaccctccatgtgctggagcctctacaggaggaaggggaaatggccatgtgctcagtgtgtgttccaatccagggattgtacacaggctactttattcaattttctctgactctggatttcccacaggataggcttcgtagcagcactctacagttggggaaactgaggcctggcaactcccctaaaggctgcccagccaggaagcacccgcccagcaggtctgacgaggcctccattctcttgcagtgcgctatgtctatccactccaaaagccacagcacacacaacttcaactctccagaaaatgtccagtcaccctgtctatatttttcttgtttcataaaaattacgcattttggttggagtagacttatgaccagaaagaggctctctgcaaagcagatgctgcacttgcaatggtgggatgaagggggatggaatgcaatagcttgaaaagtgaccgggacacagcagctggactagactcggggataagaaatacctctctatttttccccaaagttaaatatttctaagcttccacctgttcacctggtgagaaatagcatttcttcatggagtacaagagtcttaagtggtatatgcaacccagaaaatttggcaaacggtccatgatgatcaccattgagctccctgcccataaggtccattgtagaggccctgaccctggaaagtgttctgtctgcagacatctgtggccatcctcaccttggaatttccccttcttagacgagccagtctgacatcagtaaaaaacagaagtcaggcatttctcccctgtagaaagggaacctcccattctggcagaccaagattcaacactctcttggaaaggaagaagggaaataccactcatgcctgcaatgagccaacagcagaccccagtaggcccaaacaatgagaaacaggacagagtttgggtttgctttacatctattccattgtgaaatgccagggccccaggactccccacggctcaggaacgtatggagacgcattaggtggcaatatgtgctgctgcctatagaaacgatatgtgacccacagaaagagtgtcatatgtccaacctaacaccacaccagtgggtcacatctgcaagtgccccttggccaaaaaaaaaaaaaaaaaaaaaaaaaaaaaaagaaggatatgtagccttgctctccttcctaatcaggagctcaccggaacgtgggagccaaccaaaccaaactgtggctccagcttttacaaccctaactactgggaatctattttctcgctggagtgtctgagaggatggagaaatacacactaaaaagggttccgtggagatattggatttagactttataaatgtggctcatgaattccaacacccaaaatggaaaactgggcttccaggatattatactgttttgtacttagctactttatttatacccctcctggttctgaagaatatttaacaggttttatttcaccatgaaaaaaagggttgctttagcaacagggcaaacaagtatacttcttaaatgtctataaatgacccagattagtctccaagtttgtaaaatacttaatctctttcagcaatgaaatgccaagataagagtaaattccaaaaattcttttgagggcatgagggcttacttattgttaagtaggagatgagctaagcctctggtactctcggtccacagaggcaccctataaaaacgtggcaagcccagggcgaggcatcatggaatggaccctgaattctacctcagtggtgccaattcctgagaccttgttaccacaatgtggccaggcacaaagttttcactggccaagacaaaaataagaatagttcccagcacaaaaaaaggcaccaataagtatctgtagactgatggactgataagtgaatgactgatactgtatacttttcaaaagtcaagagataatttattacatgtgaagaacaatccttaaaaataaagctggggccaggcatggtggctcacgcctgtaatcccagcattttgggaggctgatgcaggaagatcacttgagatcaggagtttgagacagcctgggcaacacagggagacctcgtctctataaaaaaaagaacttaaaaactagccgggcatggtggggcaagcctgtagtcctagctgctcaggaggctgaggcagcacaatcgcttgagcccaggagttcaaggctgcagtgggctatgactgtgccgtttgcactccagcctgggcaacagagcaagacatcatctctaaaaaaataataataaaaataaagtaaaaagctaaagttgaacctgagagtgtcccttataacattctcctaataaaatctttttctttgtataataaaatggtgtgataaaagacaatagtttcagtgtgaataaaaactaaacagtaaggccaggcatggtggctcatgcctgtaatcccacaactttgggaggctaaggcagggggactgcttgagtcttgagcccaggagttcaagactagcctggtgagaccctgtctctacaaagaaaaaaaaatttttttaattagccaggtatggtgataagcacctatagtcccagctagtcgggaagctgaagcaggaagatcactcgagcctgggagtgcgggatgcaatgagctgtgattgtgtcactgcactctagcctgggtgataaagcaagaccctgtctcaaaaaacaaactacccaaaaagttagcaactttatgtctgaaccccaaatattcttttttttttttgagacagagtctcactctatcggccaggctggagtgcagtggtgtgatctcggctcaccagaaccccaaatattctcgaactttcattttaactacaaaatctgacagtgtgagaaccactgcttgaagcactggctacaatcccaggaagaagagtggaaatccaagacacaggggctagtcggaaaacattccccaaaggcagggaggcagacccaggcggcagaggagcctgcccaacagccacgttccctcttccctcggacagatccccagctttgttagaggatccttttcccatgtgactcaaggtcaagtgaatctacctcccactctaagaaaaggtcagtattagctaattccccttgccagtgattggttcagggatgatcacatgacttaggtctgaccactgaggggaagtctggtggggggcttctaggaaagatttccttgccactaagaagagacacagggatcagtaacccctcttcttttgtgtacatgtgtcctctgattctggtgcctaaaactacagcagccttctagctggattcaggttaaattaagatactcttaccagcagagcagaaagatggaaaacacatgggtacttgataatgtcaccgaggcactacattaaccaactggaaacctgttatggttgaattctgtcccccataaaagatacatcaaagaattagccaggcatggtgacatacgcctgtaatcccacctactcaggaggctgaggcagaagaatcgcttgaacccgggaggcagaggttgcagtgagctgagatagtgccactgcactccagcctgagcaacagagcctgactctgtctcaaaaaaaaaaaaaaaaaagtcaaagttctaaaccctagtacctcaaaatctcagaatcggagtttatttggaaagaaggtctttgcagatttaaccaaattaagatgaggtcattgggtgggctctaatccaagatgactggtgtccttataaaaaggggaaatttggacacacataccatagaaggatgtggtgaaaacacacaggagagccccaggtgaagacggaggcagagactggactgctgagactgcaaaccaaggaatgcccaaggactgctggccaccaccagaagccaggagaaaggggaggaagggatctatctacctggagtctcagagggagcacagctctgttgatgccttcaggttggacttccagcctccagaactgtgagagaagaaatttctattgttttaagccacctaatctgggcagctctagcaagctaatacaccttctttcttctggacctttttatgtatacgtaacataatatatgtatactatgtaaattaataaattttccttctgcttaagccactttgagtgatgatgtcagtaattgcgattgaaggcaactcgatcaactggtcccaagggaggggactaccaagcagagaaagggtcctaaaggagccaatgcccactagagtccacgcaccgctttaaccagccagcaccaacatccttccttcatcccaaactcacaccgccagacacaaacacaaattgctgctccacacagcatgccgttatccttatatatacaaccaaaagcacacaccacaaattctagaacaagtgcaggacctcaggagaggtccacttcccctttggtttcctcctgattcttcttttagtctaatgtagagattaaactgtaaagctgaggaccagccacgcaccctatatacagtacatgcaaatccaactatttctcctcaaacccttggcctggcccagggccccaccatctctctctggatcattgcattagcctcctaactggaatctccactttgcgaccctggccctccttcaaagcactctacagagctgccaggatgatccggttagaataagttaggtcaggtcactcctctgctcaaaaccctccagtagctcctgtttcattcagagaaaaagccaccgtcctcccagtgactcaggaggcccctactgatggggatccctgtcccatcattgtttcccattgctccccctcttcctcactgcactccgctggcctccttgctgtcctgtgaacaacccaaggcggttcctgccttggcctctgcacttgctctgcccttctccacacttctgcaggtcgctactgaaaaatcacctcattaatgagggcttccctagccatcctttctacaaaggggccttcccaacccctttccactgacccttcacaccccttctcctggatttaacaatacgttttatttatgtggcatgttcattgtccactagaatgcacgctgtaggagggtggggatttttgccaaccttgctacatcccacagcagtgtctgggatagggtctgccacatgcttgaatgagggagagggaggaaagaagaggtgggtgactatgcatgtggttggttaggtcacttagcacggccttgtgttttgtcccagtcatgttcagctgggcagctacaggcctggaggaagcagagagttcaattcagcagggctggagttttgccaacagagtataaggaaggagagaagagccagagagctgaagaggcaaacgatgactgatcataatggctgaactcggaaattattataagttaggtaaagaaggaagtgagggcatgaagagaggacaacatgaaaagataatcaaaggtttatagatcagtgtggggtttaagatcttttgggccgggcgcagtggctcacgcttgtaatcccagcactttgggaggctgaggcgggcagatcacaagatcaggagatcgagaccatcctggctaacacggtgaaaccccgtctctactaaaaatacaaaaaaaaaaaaaaaaaaaaaaggtaggggcgtggtggcgggcgcctgtagtcccagctactcaggaggctgaggcaggagaatggtgtgaacctgggaggcagaacttgcagtgagccgagatcatgccactgcactccagcctgggtgacaaagcgagactctatctcaaaaaaaaaaaatctttctggagtaggtgcacctacattgataatttttgtgtaatctaaaattgtgtttgttcctccttggtctaacaccctcagattccaccagcatatatattagccaagtttgcatccatgtatattagcaaaaattcagttcaagtggcacgtggcatgtaagctttctccctgtggactttataatggcagctgcaccttccctgctggggactgacttcagtctggatatgacaaggggtggtgagggagaaacatcgggagactgccttcccaggtgagatactggggccgggtggaaacgctgcacccgacagaggtcccagcctgcctgggttggcaagcacagttgagagggatcctgagtctcccaatcctctccccaccccccacccccaccagcatccaccagagtgtcagacctcatgcttcctaaatcaacgacagtgttcgggaaccaggcaaggccatgaacacaactgctggtgtgctcagcaaccagaaggatcacactctgaaaccctctgctcctttcttgttgcccccgccttttgtttcagtgcaatcactgcaagttcacgacatgccaggagctgaaagtttcagaatctgggctctgcattctttttctttaagctaatcagcaggagcccctgaatatccaattccccactgcctgccatggacggtgaggagtccaccactcaaccctggctgtactttcactagctctgcccttaaactgggcaaattaccagtcccacatgccctgcccctatttcctggagggtctaccacctgcctccactccttattccaatcctgccttgttctgggttttgacttccaagcaacagaatcaagttggcagagcaaggtggaaaatggcatttacctaaacaatgttggagagggcccagaatcgctaggagggcaaaaggaaaggctgaaggctacagagccaagaacagtgccccacatcctgcccagagcagccaaaatcccctgagtgacaaatgacagatgacggatgacactccaagccaagccctggcgagccctcacaccatgccagggctgcccaggacgcccacctagctgcaaacgtggccaccaacagctctctcactctgtttgcctcactgcctcccaagagacaaagtctaggcagatgtggcccaggcaggccagtggctcccgtgcacccaggatgtatggggatcactcagtttgggtcatatcacagcccattgcctccctgcaccccatactcctgacaccccagcctttctgggacccttatccacagtcttccagtttaaatgaaagaaagtagacctcaaagacaggccaatgtattgaatgtataataatcaagccagggtatccatcaccctagtgtttcccatttctatgtgttaggtacgtttcaactctcttctcgctatgttgaaatgtattatacacactgttgttaactatagccactctactctgctatcaaacattagaacttatttttttctatccaactgtatgattataccccataaatatgtacaaatataatgtatcaaaaagaaagaaagaaagaggccagtggaaggcattcaaaaacaacacacaaacctgacaactctgttttcgcccaccagggctcagtgaaactcttcttaggcatcacacaagagagaaggaaaactggcaagttcacaacataaacacgccgagacaggtagacataccgctaactttatggtgatctggctatctgaatagaaatagaaagagtgctataccatgtcaggagacgaaaacctaacactttgcctgccatctataattgcttgacagcataattgatcatgtaactgacaactgtcccatcatcctattctcaagcactgataaagtgatgtaacactaccaacggcacatgggatcttccctaaacagtgtgatctgcaccaaccagggatcacacagttaataccactggaattttaaaaagctttctctaaacaaaagcatcaaaaagctatcttaaaataaatgaaaagcagacaagttagtcctatagccttgagtatttatcctagatgatgtcctagtggctagtgaactagaaatagactctatctgtggaaatgagggaaatattttttaaaataacaacgcccattagaagaatccagctgccttctcaaaatgacagagccagagcagttctttgtcatcgctatggctcggggcctggggatcacaaacctccaggtattcaccgggtctgcactgaccagaaagcatcactccctccctatgtcaggcatttggacataatgtggatggttaataaaaggcacagcaagctgagaaagactcaccagacccaccttggaggacccaacaactgacccggagcacactgcggaaatttcaactcatctcatctgttcactcgctccttccgtaaatcggtactgagcacctgccgtaggccaagcacggtcctagaaacaggatggacacagctaccaaggcctcagcctcagcctgagggagcccatgttccaggagggaagacagatgagaaacagaatttaatttcagatagtgaggagcatgtaacagaagacaagagcaagcggggaggacacagggcaggaatgcgggctgggagaggggccagccatccagaggagaggcggggagagccttctctgaaagggactgctgggtgagacgtgaagcataagaaggcattactgggacctcggagtcagcttaagggcagaatctcacacccttgtcttagaaaaaaggaatgagaagttttctagacagggaagaaaaggcacccatgcttaaaatgggagggaacaggcagagttcaggtgactgcaagaggccactgtggctgggcacagagagcacacaggagctgcacaagacaggtctgctggtggccacagagccaggacagcgaggtcgtggggaagaaagggaagggctttaagctgctggggctgacacagtcagaactacaacacacacagaaaagcgtaacaggtctttcttcttccaaataagcctatcttttacgcttttctgaattagttggtcctcctgttttggcttgaagtggtagggtttactctattttttggcttgaattggtagggtttattggtttggtttggtttggtttgagagtctcgctcttttgccagactggagggcagtggtgcgatctcggttcactgcaacctctgcctcccaggttcaagcaattctcctgcctcattcagcctccagagtagctgggattacaggcgtgtgccaccatgcccagctaatctttatattttttaagaagggacggggtttcaccatgttggccaggcttgtctcaaactcccgacctcaggtgatccacctgccttggcctccccaagtgctgggattacaggcatgagccagcacacccggctgctttacggagtctcactctgtcacccaggctggagtgcattggcgtgatctcagctcactgcaagctccacttcccgggttcacgccgttctcctgcctcagcttcccgagtagctgggactacaggagcctgcagccatgcccagctaatttgttgtatttttttttttagtagagacggggtttcactgtgttagccaggactgtctcgatctcctgacctcgtgatccgcccacctcggcctcccaaagtgctgggattacaggcgtgagccacggcgcccggccctccttagccatttttaagttacggttctacggcacaacgtacattcacattgttgtgcaaccatcaccaccaaacatgcacagagctctttttatcatgcaaaactgaaactgctcccactgaacactgctcccctgctgtccctggaaaccaccatcctacttcctgcttctatgagtctggctactctgggtacctcatataagtggaatcacacagtatttgtcctttggggactggcttatttcacttagcataatatcttcaaagtctatccatgtcatagtatgtgtcagaatttccttcctttttaagaatgaatagtattccatggtatggagagaccccattttattgatccattcatccaaggatgggttcctgggttgcttccacctcttaactattttggttgatgctgttatgaacatggataaacaagtatctcttcaagtccctgcttttaattctttgggtatatacccagacttgcttttaatgagactctctacatgttaacttcttgcttttaatgagactgtctacatgacatgttagtcacatgtgatttacaacaggaggtaagagcaggctgggtgaatcataatagtgtccattaatgctgcacgtacacagaggactcctatggtgccagtgaacaaaggagcagacacctgctcccaggaccacacaaaactcaccactgcagacatagatgactacctccattctaacacataacataatttggtctcaggtacttagtgaggagagtttccatttttcctccaaagatacctagcagagaaagaatgtcatgtttgatgggagaatttttaaattagcttcagaaaccaattacatacctcaggcttaaaaaaagacagcaaaattggacaggtgcagtggctcacgcctgtaatcccagcattttgggagctgaggtaggtggatcatttgaagtcaggagtcgagaccagcctggccaacatggcaaaaccctgtctttactaaaaatacaaagattggccaggtgtggtggcgggcacctgtggtcctagctattcaggaggctgaggcaggagaatcgcttgaacctgggaggcagaggttgcagtgagccaagattgcgccactgcactccagcctgggcaacagagcaagactctatctcaaaaaaaaaaaaaatcccccaaaaaactttttcaaacccacaatctgactttaaatttcataaagaaggtgatcaacaaagattggtcttggtctattaccaaaatgatgtcaaattttccattctctttctttgttctttacatttccactccgattttatgtaaatgaaattgaacttttactagagctgtttaaacacattctattgaatacaactgtattttatattttcttttatttttatattatataaatttgtatttataaaacagcttttattaaaagtatttttgctctgaataattgtattccatacatgtaaatataaaaaattgctacatggccctttaaggcatttaataattttacaaaatacagtaacactgcagaagaaagacataagaagttttactgttaggaacattctccaagccagaaaaataggcattagagtaaggacatttccacattcaatattaattgatatttggagcagaataattcacagttagtagtcagattgatagagacaggaggtataacagtggttgccagcagctgggggcagacaataggaaaatgttgaaggggtacagagcttcacttttgcaagatgagaagttctggaggtgtatgatgttgatggctgcacagccatgtgaatgtacctactactgaactgtacactttaaaattgttaacatggtaaattttatacatgtattttaccacaattaacatttttttcttaaggttttcaaataaaaaattcggtagttatttgaataactaatgctaggcaggactggtcagcaggaaaaagctgctccaaaggtggctgagggtaaggaaagccttcgtaacccctcaggcaaatcaacaaagagatcttttactacaggaaggtgctacatctgcctcagagcagaagtggtgcagcactgatttaggttctgaatttcttaaggtctaacactgacattcttcacatgctaacagttccgatgttcaggtgcctcacagaagcaatgtcaaaagaaatatgctatctgccaagcaaagaaacaaactgagaaacagctgtgtctgcctgtgcatgcataaacttaaccaggcataaagggttcctagtgacacgtatctgcatggcagtaccacagagtactgccatgtagttgaatttgaattgtcccgtaaatgcctccaaaaagatttcatgatgatatacaactgagactgcacactactgtgtggacagaaggttgccttccatcgggctaagctccacaattaagtaaaaactgccaaatcttttgggcagatcataaaatgttcgaagtcaggacaagctggtgagactgactcacacactgtaaggactatcactgaacatttttctgtcctaagtcccagctgactttccatgacagttgtttaatttccacagatacataatgcaattatggaaaaagtgaaaatccgatatttaccaaagaagaaatgcagacatctggtagtttttaaaatgctttgaaattatgctgtcaatgctaagaggacacaaaaggtcaagaacatgagcatggaatatgaacagtattaaagctgtcaggcaaagctatcaatggccaaaagagataacagaaaacattatcctatgaatgaaaagaaagcttaagagtccagttttgtgatcttgagtaaaacaacagtatgatgtgtgggataaatgtagctgccactgggtagatattttatgaaagctttgtttattatagtatttcttttttctaaaacaatgctgcttagtggagggtaggctttataagagtaggtacatgactagtcttttgctgcagtgatttagtttgtgatgatccacgtcatttttgccacagtgtacaatagctgctgaaggccacccttgtctctcacttttcattattaaaccaaagcaaactcttctgatgaagttagaatacatttttttaagttagtcaaatgtggacactataaatctaacctctagtactatggataggcaatggaaaacatcttgaaatgttaatcctaaataaacactaagcaatgtttaatgtttaagattgatgtcattgactatgcttagctgagaagaaaacatgtgattaaccaagggaaggacttaaaggatatgtaataattctatatcaccactagacatttaaatttcacaaagaggttcaacaacttgaggaagctactgctgcctttgccacagaaccttctatctcaacaatgaaactctatctcattgccctctatctcaacaatgaaacttaggagacttctgatatgacacattgggagatcactttatgttggacactcaaaatagaaagcctgaaatggtaccaaaattgacagctctaatacacaagggaaagccctaccctgtgacactgtaatattaaagcaagcatcttttttaagataaaagtaccacacagtggaaggaaagcaatgaaacatctgcagaccctgagaacaaaagaactccaaaatcgccaacagataatcagtgcaaagtgctggagccagtataaaaatgcagagtccaatttgcaaaacaaaactactgggagtagaaaccaacttgggaagaagataggtaataggggtaaaaaaaaagaaggaaaaggatgatacaagtggcagactagagaagaggagccagatgtcaaaaagtacatggccaaaccaatcgccactttgtgaaaataacgagaatgtgtgctagagctatgaaactagaaatctatcctatatataaacagataaaattggccaggcacggtggctcatgcctgtaatcccagcactttgggaggccgaggcaggcggatcatgaggtcaggagatcgagaccatcctggctaacatggtgaaaccctgtctctactaaaaatacaaacaaattagctgggtgtggtggtgggcacctgtagtcccagctactcgggaggctgaggcagaagaatggcatgaacccgggaggccgaacttgcagtgagccaagatcacgccactgcactccagcctgggtgacagagcgagactccatctcaaaaaaaaaaacaacaacaaaaaaaaaaacggatacaattagaagatgaaaagatagaaaattttaataataaaaaataaagagatatggagcattcaagagaaagggataaagaagacaggtaaagagggctcaacatatgtataaaaggaattctgcaaagaaagaaacagaacaaccactgaaaactacatattgactcaatttttttttttttttgagatggagtctcgctctgtcacccaggctggagtgcagtggcgcaatttcggctcactacacctccgctcccaggttcaagcaattctcctgcctcagcctcccaagtagctgggattataggtgcatgccaccacacctggctaatttttttttttatttttagtagagaccgggtttcaccatattggccaggctggtctcaaactcctgacgttgtgatccacccgcctcagcctctaaaagtgctgggattacaggcgtgagccaccagacctggcccacattgattctatttttaaaaatgagtaaaagacttgaatagacatttctcaaaagaaaatataaaatggtcaacaagcatatgaaaagatgttcaacatcattcatcattagggaaatgcaaatcaaaaccacaacaaggtatcacctcaccctcatcaggatggctatcattaacaacaacaataacaaaacataataacaagtgttggagaggatgtggaaaaattcaaacccttatagactcctggtaggaataaaaaatggtgcagccactgtggaaaacaatttgtctgttcctcaaaaaattaaaattaggattgccatgagatccagcaattccacctctggatatatatcgaaaaaatggaaatcggggtccaagagagatatctgtacacccatgttcatagcagcactattcacaatagccaagaggtggaagcagcccaagtattcactgttagatgaataaataaaatgtggtatagacatacaatggaattcagcctttacaaggaaggagattctgatacatgctaaacatggatgaatcttgatgaggctaagtgaaataaggcagtcacaaaaggacaaatactgtatgattccacttctatgaggtatgtaaaataaccaaattcatagaaacagaaagtagaaggggagttatcaggggctgggttgggggtaaaagtttctcaagatgaaaaagttctgggggttagctgcacaacagtgtgaatatacttaacaatattgaactgtacacttacaatggataagatggggccgggtggctcacatctgtagtcccagtgctttgggaggccaaggtgggcagatatcttgggtccaggattcaagaccagcctggtcaatatggcaaaacaccatctctactaaaaaactacaaaaaattagccaggcattgtggtgcatgcctgtaatcctagctactcagaggctgagacacgagaattgcttaaacttgggagacagaggtgcagtgagctgagatcatgccactgcactccagcctgggcaagagagcgagattctgcctaaaaaaaaaaaaaaagttaagatggtaaactttatgttacgtgtattttaccacaatttttaaaaattgaattaagctgaatatactgaaatatactgaaaaatactgaatatactgaaaaggtacatcacatacctaagaaaaacaatccagagaagccataacaagacatattctagtaaaactattaaagaagaaaggataatgggaccacaaaatcataagagacttccagcactatttgttatgcttcaatcctttagagggaaacaactgtaccatgaagcacataagaaaagagttatatttttcatcataagaggtgcataaatgaggatttgttatattatcctctatactggtctatacacttgtaatatttgatcacacattcccacaaacgattcagggaacctactggctctgttaaattaaactaaatttgggctgaggaggtgcttgtgtaatgaactgcaacttaacttagtatgcaaactaatggaaagcctaactcaggaggatactttgggaacaaattgctgagtctcaggcaatcatagcagctgagctccagttaactgcaggcagcaggacaactgttccaatcctgttcatgtaagacgaacactgagccattaaccatcagctgtctctctacctcacttctgtttctgtacctcacttccctgctatccacaaatgcttttagaccacgttgcagccctggagttctctgaacctgtccctggttctgagggctgcctgattctagaatcacaaataaaaggcgattaaaatctgcaaaactagatttgttatacattttttttttttgagacggagtctcactctgtagcccaggctggagtgcagtggtgtgatatccactcactgcaagctctgcctcccaggttcacaccattctcctgccttagcctcccgagtagctgggactacaggcgcccaccaccacacctggctaatttttttgtatttttagtagagacggggtttcaccgtgttagctaggatggtctcaatctcctgacctcgtgatccgcccgcctcggcctcccaaagtgctgggattacaggcatgagccactgtgcccggcttcattcatcttttagcagtttccataattcaagagttcacagactagtgctgttgttggggcaaaacttgagccaggagctcaatatcacctagtcccaattcttcttcaccttctgctctgcccagttcatccctggactcctcacagaacccctcaggctctcctatgaccatgattaaatgtctatagcagtcccagcctaaatcctcataccagagtaagcaagggcattgcttctagaaactcccattcaggctcctggaactccctctctcaggctgactgaaattggctcctgaaacaatctctgtgtcaagacagtgagattcaatgattcagagtcagagtgagttggggtggagtcaatcctaagaatggaaaagggaaactgaggtgaatgaaggagaaatggattctgtgaggcacccacaacaaggacagcagagaccacagttctggtggctgtttcttaccctccagacactgtccctctgctgagctccttcaaaccctccagacatgatcagactcatctggacttactgtggggacatatctaggccccgactctgtcaaatatgtatagtgacttccatctaaaaggcacaaggttctttacagataggacaaccttgatagcactcatctgagaaagagaacaaattagaaataatcatccttcacttcctaacactcacacaaaaaaaaacaaacctaagggaaagcaagtgcatattaaaacagagttgatcaccaatgagcaagtcctaccaaagatggcagagaagctgaaaaggtcctctaggaactcactcaataaatgctcatttattccatttattgcaaagccaagaattgtaaataatttaactcacttaggaaaggatcttctccattattttatctgaatgttatctgatcttgatgttctgaagtctgacagttaccaaagcgagtaaaaatcctcatgttttccatgctaggaaaatcattaatagtttatccaaactgaaactttcttggcaactgttgcttccttgttcttgccataaattaactgtttttaaaaagctaaaatctaaagaatttccaggaccttaaaaccattagaatacaaagacactctaatttaaataaaattcataaccaaaagttaactcacctaaacacaatgtttccttgtgtcatttatcttctttgaagcccaatcaataacagattcattcattcactcacgcagcaaacatttagtaagtgctctaaatatacctgaagggacctcacacatcatctttcctgagctcttcctttacagattaggagattgaggtcaaagagagcaagtgatctgcccacagtcacacagcaaatatgagaatccatgggtgcaatcagatttcctcacctctggcctgacacgttatccaccctgccatgtttccttggctacagcaggccaatgatgcaatcggcctccagcagagaacactactgtagtaaatatcaatagctgtcaaatttatggccacacaacatggtttgaacacccttcctacaactggaagatctcccatatgagttccttctcctgaaatgtagaggcaaaagctcatccaatcctccctgcagctagagctcaggcatatggcttggctttgccaatcaggggagcagtgtgacgtagtgggcacaagcagggtaggcagcagtggcaaagcttctagtgtttgacctgcagggagctggcacttccatgctgagcgatggtcacagagctgtcttcacttgtcactgcccatcggtgagatttgggcactgatcctggctatatagaattctgtgaaactggctaaaatggactctggggtggggattgcatctaagaaccctgacctctgtgcttcattattacgtgctcaatacatatgcctggagctatatacaaaataaagggagcctctgctcaaaacttcactgtgcatcataagataccagttctcagctatctatctgagtcttaagactttttaaaaactaaatggttcttttctattaaaaaataagacaatgatgggactacttcacttttaacaatatatgctgaattatcaaatgcctatttaaaaaaaaaaaaaagatcaagaaggtggcagagcaaaccccagtattaaaatactccttcaccaaaatccaacagcaaagcaaagctggtcctcgtggctttttggaagcaagaagcaagggagaagcaagtaaacaaaaccctgaaccatttccctaacagctcccatcttaaagaataacagaagggaaagagctgaaggcagcctccagagaataagtagcattttccccaaaaccttcatgtcatctattttttccagagatggaaaaaatgctgtgactccctgctggaagaaaagcaagaaacccttccctgtggttacagatggtaaatgcttaaacgtgacaatgtcaaaggaacagtctcctaaattggacagcatggagtgggaaatggaaagacacataagggccttcctttcctctccccatcttgatgagcagtcctcaagatatggcctaaaattcataaacctagaaacagaggcggcctgagatttaaagtgaaaatgtagccaacaacaaaacaaaaaaactcgggagacagaaggggaaatgtgataattttttcatttttcatagcaagtgaacaatagatataatttaagagttgctaaatcaagaaacagaaggttatacataacaaatatacagagttatatgagtaaccactggaaaaactaaaagtagactctaaaccgtccaaagcaccagaagggaaacagtacacgcacacactcaaataacaaaaaggaaagcagggcaccagagtgtacacctgtagtcccagctattcgggaggccaaggtgggaggatcacttgagcccaggagttcaaggccagcctgggcaacataacaagaccccatctctaaaaataataataataacaaaaaacgaggaaaattggcaacagaaaaaaaccccacaaactagattataaagaattaggacttaaaacatctatgataacaatagatgcagatgagagaaattattattattattggaaaatgatatgttacacgtctacaaaacaagagaatccaatttttaaattattagaaagaattagaatagttagcaagttgactgtttgcagaattttaaagtacctttttcctataaacaagcaaaaccattgagaaaacagctgaaaagaccccactcacagtaactcctgaaaagaacggcacatctgaactagatgtgggcagaacctacatgaagaaaactggaaagttctccaatgaggcaaaaaggagaaattaaaagtagcaccatgtgcttggattggaatgtttcatactgtaaacttggccgggtgtggtggctcacgcctgtaatcccaacactttgggaggccaaggcgggcagatcgtttgaggccaggagttcaagaccagcctagccagcatggcgaaaccccgtctctactaaaaatacaaaaattagccacttatggtggcacatgcctgtaatcccagctgcttgggaggctgaggcatgaaaattgcttgaacccaggaggcagaggttgcagtgagctgagatcgcaccactgtactccagcctgggcaacagagcaagactctgtcaaaaacaaaaacaaaaacaaaaaaacctgtaaagttgttaattctccctaaatcaattcataaatttactgcaaaccaattaaaataccaggaggatttgggaacttactttggaactcagcaaaatgatactaatagtaatctgaaaaaaaatacacgagaattaccaggtgtggctgtttgtattttccacatgcttttctgcagtgtgacccttgtcttcctcccatcaagaggtagggcctatgtcccctccccttaaatgctggcaggtctgtgactgcttcagccaactgagtacagaggaaatggccccatgagacttgtgagcctaggctggaaaaagcaagcagtttccacctagtgttcttgggatactagctctgggggaagcagccatcatgtaggaagtccaactaccctgagaccacagtgctggaggagctacaagtatacacgtggctgaggccccagctgccagcaggccacaactgccagccatgtgagtgggacgtctgggatgtcccaccctgtcgagtcctcagatgagttacaaccccagctgatatccaacacaatcacatgagacctcaagcaagaatcacccagcagagccgttccaaattcctcaccaacaagattataaacaaaataaaacacctgttttaaactgctaagtttgaggataacttgtgatgttacaacagtaactggaattccatttaaaaggaaggaagggggccgtgcacggtggctcatgcctgtgatcccagcactttgggagaccgaggcgggcagatcacaaggtcaggagtttgagaccagcctgatcaacatgttgaaaccccgtctctactaaaaatacaaaagttagctgcgtgtggtggcgcgttgcctgtaatcccaggtactcaggaggctgaggcaagagaattgcttgaacccaggaggcagaaggttgcagtgagccgagatcacaccactgcactccagcctgggcgacagagcgagactccgtctcaaaaaaaaaaaaaaggaaggaaggaagtgaggaaggtaaggaaggaaggaaaggatggagggaggaagggagggagagagggaggaaaggagggaaggaaggaaagaaaggggagggaagggggaaggagagccgaaggggattggccctatcacatttaacaacataatgaatcaaaatccattcataaattcattgaacaaatattgaagatctacaggtccaccacaagctaggcattagagagacactgtgttgtgcaaaatctttgtctttatgggatttagattttagtgaaaaagaaatttcagatagtattaagtgtgctgaaggaaaataaaaatcaggataagagaaagtgctgcttaaaatagagtgctcagagaggcctcttggaggaggtggctgtggcgctgagccagggaagggcccgggtattctcacctactgctgtggggttttgcaaacggttcagcctgtccttggggcaatttgaaaaatctatttccatctaaaaggcatggacctcttgacctagaaacctcttggctaggaaattaccccatgaacattcttacacacgttagcaatacttccaagtatgttatgacaaaaatgagatacacaaaaatgtcagctcaatgggagcttattaaataaattacattatagtcattcaatagagcaccataagactttttaaaaattacatgagctatatccactgacaaacagctacatgagacactgttaggtgacaataagaaaggctggaactgtgtgcacagtatctcctcttctgactcacagagagagaaggaaccggggaagagggaaggatactcatctatgatctggaagaaatccccctttcctcggggaacacctctggggagaggagagagatttgggtttttcatttggtacctctccgtagcacctgaattttctaacaagatgctgtacaacttttacttttgtcctttcaatgcccgctagggttacctggaccatgagtcagtgtttgacagcttctccccaaagaaagaattggggctactagaccggacaaggttggttttctcttttggtactctgtatttccaaaaataactgaatggtatttttttaaataaaataatttgaaagaataaagccctataacaacaaagtattaaactgttaaaatattttcattctattgtaattataagaaagcctgcatggtcccactgcagcagccaccatgacgagcagcactctctgtaaatgcagcccttccacgctgctcagggtgacccaccccagtgagctggctatttgcatattcccagatcccccacctgcgccaggcaggcatatgctagatcagctcagaactagaaaagatgggcaccaggaagaaaggcaccaagccctccctaactcccctctgagagttgcatccttctttcctacctctttcctttttacagagcccactgtgctctgggtcccccatgacctgggggtcagagtcagacacactcctgtgcacaaatggaaccattcgttcttcaccaccacctgtgcccacacccctgtcaaagctcccccgcacccacctctgaatctcccgcatgggtaggacagcttcttcccgaagaaggggaattcctggccaggcacggtgctcacgcttgtaatcccaacactttgaaaggccaaggcaggtgggtcgcttgagcccaggagtttgagaccagtctgggcaacataacgagacctcctctctacaaaaattaaaattaaaaaattagccgggagtggtggcatgccagtagccccagctacttgggagactgaggtgggaggatcgtttgagcccatgaggttgaggctgcagtgagccgtgatcctgccactgcactccagcctgggctgtagagagagaccctgttggaaggatctctccgacagttatctcctggataactgcaatgggtcaagtgacaactttctctagctctcctaagccacagtgcagtacggtttggaaacagcaataagagtcaatcccccttttcacaaatgatcaaatgaggctcagagagattaaagaattaggcagtcattcttcacaaggaaggaagggagggagggaggaaaatttcttgtgaaattcccaaggaacagagaacatttttaaatgtttccttactcattagttaactcagtattttcatgcccaaaaaatgtcaacaaccagttttgccaagaataataaaaacagatactgactctgagcctttcttgcaagatctctcagggtacacacccggctgactcccgcacatttctgtctctcctgccttctcaaatctcgctgtctccatcagtgtctcttcttccatgcaaggctctgtcctctgaagttctctctcccctggcttcagccccatgcaggtgccccccccccgccccacatgtggattcagttccccacctgtggtccccatgattgttctactccaactccggctctcatcacccaccgccagtgtgactggggcacaatgtgactgggtgcaggatggggcagccacctcaggccccagagcgctccatcccatggccaaaggggtggatattccgccctgaaacacctgggagtgcataatgctcaaggtattccttcttcgaagctgataagtttgtctatgagcaaataatccactagttcctctgcaaggggactgcctgacttagaaagaacacagatgtaaaagattagtctttctcaaacactgccggtcatgtgtcagatatctagaacagcccctcaccagcaaacctggctggccccagccctgtctcaggcccttgtgttaatgctgggtctctggcccaggctcccctccctgcctgatgagttcccactgtgctttcaagggctctttcaggtgaagagacttagatcaataccaccttaggtgacccgaactttgactctccctcagggagcagcgacggggttttagtgtcttctctctgacagcccaaagcgcagatgccagctgctccacctcattcccagggacgagctccacagttgaggatcccagggagcagagcaggggttgagatgcaaacaattctgatcacaggcccctctctccaccctccccaaaagtgccacctgctgcatctacataattctgagagcccattcaagagaccgctgctggaaccaagaagctagttatctggatgatgtgggtccccatcggagacacgggaggggagaagtggtgggactgcttcatacccacacccacttcatgtttgccctagcaggcactgtgtagcactcatctggggccaaaaaggaataaatgacaacttgtttacagaaactgtgttgtaaaaatacctagtgggaccttgtttcaccacctggatctttagggaggtgcccgttctccccttcgagctcagcctgcccttaccaagttcctctgtttcccctcactgggaactctcaggaattgtcccccaacattattcccagaaacctgtgccaaccgctcatgcctatcttggagcatcacactatcagatacctggataactgcaatgggtaaagtgacaattttctctagctctcctaaaccacagtgcaatatggtttggaaacagcaataagtcaatcccccttttcacaaatgatcaaatgaggctcagagaggttaaggaattaggcagtcattcttcaatcattctacaaacttttcttcaacacccacctgtgccagcggatacctgcccctcataaaatactcccctccccagagatctgggggtggggtttcttgctcctggaaacaagggaaaaaggagagaaagaggtgtgagggcactcagagaggagcagcctgtcatcatgtgaacactgcccacgctgcctagcaggcctctgaagccaccccacgggagaatggctctgctgtttcccacgcctggggtctccctctcccactccagcatcctagcccaccaggtaggatgagtgatgctacatggacttccaaacatgcttaatctctgcagaccatggcacaggcccgaagctggcccgcagcacccaggctcagtacatgcccgccctcttcacgacctcccagaccagcccggccggtcacccatcttctgcacacatccctccccaacctcccctcaaacccttcacccaggtggggcttcccaggcaatctccaatctacggctgaccctgaaaaacccaggtttgaattgtataggtgcatttatacatggatttttttcagtcaaagttacaccaagtgtgccagcctctcctgactccctctgcagttgaaaatccacctcctccacctcttccttctctgccaccctgacacagcaaaactaagtcctcctcttcctcctcctcctcagcccactcagtgggaagacgacaaagatgaagatctttatgatgatccacctccacttaatgaatagtaaatacattttctcttccctatgattttcttaatgatattttctttcctccagcttactttatggtaagaatacagcatataacgcatatacaaaagatgtattaatcatctatttacatttccagtcaatatgaggctattagtagttacgttttggaggagtcaaaagttacacgtggattttcaactgcagagggagtcagtgcccctaaccgtgtactgttcaagggtcagctgtacaaaatgaggacaagacgtagtacccattccccagggtttactgctaggcttaaataagttgatatgaaacactgttagaatcgcgtctggcaaaaaaagtaagcactcattagttcttgtgatcgatccagttacagtttcacatacagatgactgtacccacccaccagcactcaccagagggggcccttggatctaaacagtgtggaagccacgcctgttcccctcacctcacacaggcctgtgtgcaaggtgactgagcccccctggatttctgactaatcatctttggaccaccagcaggtaaacaactctcccctcctgtgtccccagaatgcctcagcagcattagtttcctattgctgctgtaacaaattgccacaaacctggtgacttatagcaacacacagctatcatcctacattctggaggtcagaggtgcaaatcagtctcactgggctaaattcaaggggtcacaagcctcgatcctcctgggggctccaggagagaatctgcttccctgcctttccgggcttccagaggccacctgccttcattggctcataactctcttcctcacatcattccagtcactgcgttcatcatcccacctcctactactgactcagatcttctgtctccctctcaggaggacccctgtgattacacagggcctgcctacataatccaggatagtctccctctctcaagatccttaaccgaatcacatccgcaaagtccctttttgccatgtgagacacagattcacagcttctagggattaggatgtggacttctctgggggaccacagttccatctaccacattgacctaacccatattcaacctacccagctttgctagctcttagacgttgggttagtcccaatacctggtccacaaaactggaactgaatatgacatttcacatttgcatcataaagattctccggatgctgtgtgaaggggaaattgagaggacaagagcagaagtggagaagccacttacggggctaccagaataatctgggtaagagagacacagcaggcagaagtctgtatttttgaagaagaatcagtaggatgacaagaggctacgttaggaaggaccactggtgtctggttggaggaactgggtgaatggtggttccactccttgaaaacagagcagaagacacttatttggaggggaaatgagcaacttggttggggatatcctgaattttaagtgtctatgacttgtccaagtgcagatgtaaagtcagcaatagggtatgtcaagaggagagaggtaacagcttcaaatgcagagacctgtgtgagtgacagaagtgtccagtggggcagagagagagaagcctgggcccaggaatgtcctcctgctgaccagctgcagtgaagctccgctggccccatctctcagtgtcagccctgcccttgctgtgtccactgccagggtgtcccttgcaggggcactcactgcacagtcatcattcccagggagcatggccacttcaccttgctgctccgccacacctctgttttgggcggccctgaggatgctctgagactgggctacagtctccacaggttccagctatggatgtctgccccacagcctcatctagggaggtctgtttgcccaccattgagggccctgtggcagcacctggctcttccctctctgctatgttcaacatgtcccacagcaacatggaaattagcaaatgtctttattccacacactgtccatgggaaatttcagacccaatcttgtagaccagaggtcaacaaactatgatccctaggccaaatctggcctgctgcttttgcaaacaaagttatactggaacacagttatacccattcatttataaatggtctatggttgcctccacacaatgatggcagggttgagtagttgccacatcactaatcatcagggaaatgcaagtctaaaccacaatgagatatcatctcacacctgttacaatggctattctcacaatgacaaaagacagcaagtgttggcaaagatacggagaaaggggaacaatttctctgctggtgggaaggtaagttagtacagccattacggaaaacagcatgaaagctcctttaaaacttaaaaatagaactatcccatgtagcaattccacctttgggtatatatccaaaggaaatgaaaccagtatgaatgaagaaatatctgcacccccatgttctaaaatgaattcataaatccatacatatatacatacatacataggagagaatggaaaagctcttcctacagtagaataacaattaataaatgtagaaggaatgggccgggtgtggtggctcacgcctgtaatccccgcactttgggaggctgaggcaggccgatcacgaggtcaggagatcgagaccatcttggctaacacggtgaaaccccatctctactaaaaatacaaaagaattagccaggcatggtggcgggtgcctatagtcccagctactcgggaggctgaggcaggagaatggcgtgaacccagcaggcagagcttgcagtgagccgagactacgccactgcgctccagcctgggcaacagagcgagactccatctcaaaattataataataataataataaaataaataaataaataaatgtacaaggaacggaaatataaaattatgacttggcaatcatcgtagaggaggctggtttgggtggcaatcatcaacggatgtgaagttgaaagagagaggtttgaccagaaacaggatattggcataatctgagacttccttacacaaattataattaaaggggaaatggtgaatttaaaatgataacacctggaggacagcaataatgttaggtgatcaaggtgaatatcgccaatggtgagaagggctgacatcaacgcctcctgatgcgatgcactgagaaaagcatggcatcaactttgggattgtcctgccaagaatgcatgagccaagtctgcccatgaggataatcagatggatccaggttcagggtcatcctacagaatgcaaggcctgtgcccttcaaaactgtggaaaacgtgaaacagagaggaaggctgaggagagtgaagacacacaaggaatgctcatgttcctgggtaggaccctgggccagagaggaaaaagaaacactacttggtcaggtgatgaaattggaatggggtctacagattggataacaatgttcttccaatgttgttttcctaatttggagaggtttatgatgagtacataaagagcatccatgagtggtgagaatatacactgagttttttaggggtgaagcaacatcatgtccacagctttctcccaaaacactgagaaaaagactaatgataattgagaatttttttaccttgagaaagacaatgtgcacaagctcaagccatggggtaaatgcaataacatgtttacaattcgggaatttaagagaagagacacaggaattcttggttctgttctgtaacttttctataagttagaaattatttcaaaaaatttccagaaaacaatattaagacagagtttcattgtttattagcatagaatttggctatgagcattccagtgtactatatcttcaaatgactaggactttttacccgatgcccaagggagggttctgtctatgtgtgtgtgttgttgttggttttttttggtgtttttgttttgtatttgtttttgtttttgtttttgagataggatttctcgctgtcacccagactggagtgcagtggtgcaatcgaagctcactgtggcctcaacctcccagactcaggtgatcctcccacctcagcctcccaagtaggtggaactacagctgtgtgccaccatgcccagctaattttttgtattttcagtagaaacagggttttgccacgttgtccaggctggtcttcaactcctggctcatgtgatccacctgcgtcagcctcccaaagtgctgagattacaggtgtgagccaccacgccctgtcaagtttttctccttatctttaaaatccattattttacagggaaacatgtcaatgctgactattctacattgatttttcccagttacacaatgtaacctttcaaatcttattttaggaaggttttcttgcattatagttctaaatatttatgctattctattgctttgtttttctgtccctggacactaattatacatatattgaacctcctttgcctgtgtcctacattcctttaattcactatatcaccttcttttttttattatttttctccttttcaccctctatttttatttctgtgcttcctaagaatatctatttgctcccatgttccttctaattaagtcttcatttttgaaactcatttttccaaattcttttctgacatctctctgttctcctttcataatttcctgtcatctagccatatcttttgtagtttttacaatttctgattcaggatgggagcagtggctcgtgcctataatcccagcactttgggaggccaaggctggtggaccacctgaggtcagcagttgaagatcggcctgctaacatggcaaaaccacgtctctactaaaaatacaaaaattagctgggtgtggtggaaagcacctgtaatcccagctactcaggaggctgaggctgaggcaggagaatcgcttgaacccgggaggctgaggatgtagtgagccaagattgcttcattgcactccagcctgagcaacacagcgagactctgcctcaaaaataaaaataaataaataaataaataagtaaaataaagtttctgattcatactactcttaggaaactttattttcttttagcttatattgaaatattaatttataatttttctggtgtgctctcattttcagtagtaccattatgttcattttcatcatgttttcactgaataaatgttgcatgaggctggatcgtattccttttttgttgtccatgattaaatgaggtggattttcctgatctattaggaggaagttcccaatagatcaggaaagttcctaataaagggatggactaggatacctttcccatttggctctactgatctgtgaaagactcaaaataggaattctccaggtacccacttgtttcccagcatcaagtccagaacctttgtaaagctcagaaagatctcttgcctctagtcctttgctccagctctagaactttgaagtccttcttttccaaggctatatgctctcagcttttgatgttatctttcactgttaaagcagtttttgagatctttttccttgggggtccccttccatatctccaccatctgaacctattttctctcgccatctgtcttctgcttaacttggtgtatgtttccagtaatttctgctcaaggtgaggtgcttagaagggaggacttactgtacgtttctaagattctccaaggcctctgccaccacatcgacgctgattctcccaggtccacacacagttagttgctctcacctgttgccagaagcctgggagcccctttccagttttgccagttgctctcaggtctgcccaccagacttccatcctactttaaagggtgagcagctcatggtagtttttgggttccaccacctgtcaatagtttctttcatttcccatcactcccctgaggccactgcggctcttctccaggtccttctgatgctggtggtttggccaaacccacccagtcctgggaataaaggagtggggagagagtccccaacacttttgttgacatatcctctttgagctttatctatggctgtcttgctgattggtttagcttccaggaagagttcaggggagactgaaaaactactttgccaccatgaatacatccccataaaacatgttctgaagggcataaaacaaggaacaaagaaatgaagagacatactctgtttctgaattggaagatttaatatgataaaactgtcagtactcccaaaattgatgcactatattaaaagttttaaagttttctatctggcaagacatcaaaaattaagcaaaatgagaaaatatttgcaacacataataaagtatccatggaaattcagatccaatgaaatatctttctgcttctatgaaattaataaaaatgctcagccttgctaatatcccacgctgcaagaggacagaaaaaggggcacacactgtaggcttctgtgggtggatgtgcctacattcttttgtgaaaattaatccagaaatagctaacaaaactcccaatttgaatactcatcagctagcaattccactttggggaatctatcctcaaaaaaaaaaaaagcagtggcatctcaggctggataagcagcactgtttgtagacacatagaactggtagagattattcccagcaggagaataactgaataacttgtaataattcatactttggactactccacagccattaaagataatgtgttaaaaaataataataatgagttatggctgggaatattcgttatacattaaatttttaaaagaagttacagagtaatatgggtggtataatgtcatttttgtaaattgtttttaaaaagaaaagaaacattttccggccgggtgcggtggctcacgcctgtaatctcagcactttgggaggctgaggcaggcggatcacgaggtcaggagatagagaccatcctggctaacacggggaaaccccatctctactaaaaatacaaaattagcagggtgtggtggcgggcgcctgtagtcccagctactcgggaggctgaggcaggagaatggcatgaacccgggaggcggagtttgcagtgagccgagatcacgccactgcactccagcctgggcgatagagcaaggctctgtctcaaaaaaaaaaagaaagaaaagaaacattttccatacatatatatacaaattctaatacattttatgattgtaaagggaagcatggaaggattgcattaaacaacactggtaatgttggtggtctatgggtagagaattggggtaggcgaaagctatacattgtttgtgtgtatgtgtgtgtatatatattttttgtttgtttgtttgtttgttttctgagacagagtcttactccatcgcccaggctggagtgcagtggcgcgatctcactcactgcaagctccgcctcctgggttcacgccattctcctgcctcagcctccagagcagctggaactacaggcacctgccaccacgcccagctagttttttgtattgttttttttagtagagacaggattccaccatgttggccaggatggtctcgatctcctgacctcgtgatccacctgcctcggcctcccaaagtgatgggattacaggcgtgacccaccgcacccaacctattttttttgagatggagtttcactcttgtcccccaggctggagtgcagtggagtgatcttggctcactgcaacctccgcctcctgggctcaagcaattctcctgcctcagcctcccaagtacctgggattacaggtgcccaccatcacacctgactattttttgtatttttagtagagacagggtttcgccatgtgggccaggctggtctccaactcctgacttccagtggtccgcccgcctcagtctcccaaagtgttgggattacaggcatgagccaaccatgcccagtcacttttttatcttcagttatttttactttttatatattaatttcagagtatgaaaaaaatccagtggagttgctttttaaaggaaaaatacacacacacacacacacacacacacacacagagtcagcttccaatggctacgtctttaccaacatatgtaactggtaatgtggataactcacaatgtagctgtttgtccctgagttctgggcattaataaaatctccaagaaaaataacaaactactctattaaaggataactattcaagacctccatccagctctcttagtcttctaaactatgaacacagctcattacctctcaaaatgggcaggacatctatccacaagggaactgatccacctgctgactcactggctggcacagcccggcacaggaaaaccacctgcagggggtcctcaaacaatggaaactgcacagctctgtattcatcacagacctccggccaggcctgacacccacccctgtctccaaccttgccgagtcctcccctttcaaccttaaacttcttcaacttggtccagtggaatggctccttaaatttctcttgtatcttcacctttccaggcatgttttatgcttttcctaagaaagagagagcctccttgctaaagtggacccctttaccagcatgctttatttcatccccttctgcctaatcgttagcaggagtttggcctctaaaaagtcagagcaactaagttcaaagctacttcatagctgagtgaccttgggtaagtcactcatccctcttccccttagtttactcagcagaagcaccaagatttcttgaggctttggcttggaacagagtcaggctcagttctgctgtgttccaatggctaaggcaaatcagaggcccagtccaaactcagggagagggaaccacacaaaaccctgagcaccagcaggcagaggccaccagagtaacaggctattacacacacaataagtaagtgctcactaagcatgggctgtctgtcttagctaataattttgtttcttaaatccaggagagttgtttctacaatgggttttcaccatgtgcaaaccacagagagggcctagaaagccatatgttgctaaagagcacataggtctcattttagaagatttagagaaaccagagggcagccctaagccccacagtatggatttctttatgaagccagcccagccatcccagctgccattcttaaatgacgaacaaccttggcaaggcagttgcaccaatctcagagggcaggcatatatatggcaatgggtcagtgttccccactcacaaccatgttaacatgcaaacctgtctcaacacagcaggaaccaatcatcatttctgcaaagtgttgtagacaacagatgaaaaatggtatacactgtaccgtactgaaagaactttcaaggtgcttgcagcaaagtaagtttgaagacagaaaataagcccatgaaaaaacagacaggagggtgggagatggaggactcaggacagaagtcatcttataatctccaaaatgtaagcagagtgtgctgtgttcattgttgatccccagaccctagagtaatgtccatacataggagaactgtgtggaattgctcagaatcataggaagctagaactaacaggttataggtcgggcacagtggctcaagcttgtaatctcagtgctttgggaggctgaggcaggagcatcccttgagataaggagtttgagtttgaatccagcctgggcaacataacgagaccccatctcttaaaaaaaaaatgtttttagtattagccaggcatggtggtacacacctgtagtcctagctacttgcaaggcagaggcaggaggatcgcttcagcccagcagttccaggctgccgtgagctatgatagtgtcactgcactccagcctgggcaaaagagcgagatcctgcctcttaaggcaaaaaaaaaaaaaaaaaaaaaaaaagaataggttagagctgttgaagagaataacactgcaaaagcaaactgaattaactgttttacacatttatttaactctttaaactaaaatgtaggggatgatgtgcatttttcacataaataagcttttctactgtgtccaattaatgttttcccctttaggtttattattaaaaggcagttctctctccacacccttgggaacccaaggctaaaccaggaagggcgggctcagggaggagccaggaagtggagctaattcaccagtctgccacctgtaggctggttccagcagacttaaacctcagtgcccgctagacagacatgaaaacaatgcatattaaataatggtaaaaactgagcaatagatgtgtgaaaactatatagagaggggcatttaaatcatggctcccgtgtgcttgcctccaacctcctctcttttctttgaatactcccagctatgaccacacagtctgttgttcctattcagctctccaaggctcacccttgatctaaaatacgcttcgaaaattaatactcccattaggatgaacaaccacacctgtatcgatcgaggtgttccagaggcaattttgctcagatcttatggtaaaagccatgcaatgaacttaaaaaacaaagaccattatgaaataaacaaataagcaaagctggacgaatttttcaaattttaaaactcaagaacaaatagcaaacattagttttaaaggattggtttggatttctgtagatggaagtaaaacatactgagtttacaagcctatgcgatgtatttcagcacgatccaccaaatgcagttacagatgtcaagagttctcagaacaagtgcctctcttcataaatatctgctctgcatatatatctctcccattcccataacgtccattctttgttaatataggaaaaaaaccgactttcatcaaaatgctacaaaacgccaaaaattaactcttggggacagtcactttaatcgagacgtctttcttctatggagatttgttcaccactggcttctctgatttggtggttaagagtctgaaaatcggtcatccttaaggtctggagctcagaaagcacgccgcccccccttgcctgccccctgccccaggacgccggatgcgggtcgcctgcccagtcccgtcgcccacaaaccacgccgttctgggcggacgcgggaaaccagaagtccccgaagccaagtcagcgagcgaccacaggggccgcccggccgatccccgatatccgggctgacccaaaacccgacgggaggcgcccctcccccgcccccccaccccaccccccacccccaccgcccccggtcagggccgccgcgagggtgagaggcgcgcccacatgctgctccgctccgggttcggctcccacctcctcgcctcggccgcggccgctcggatggcgaggtcgtgtccccggcgcgcgcggtccccggcgctccctccggccgctgcgggctcggaggacggcgggcgcctggctgctgtttcctccaagaaaagtaactccgggaatcagcgcaataggagcgggaacgcgatgctccgagagcggcgagccgggccctggagttattctgctcggagtttcgaactgcgccccgcgctgcagctactcggccccggcgttggccgccggaacttgccgcccgcggtggcgtcccggcggccgcagcgcctagcccccccggcccgcgcagtccccggagcccgtccccgcctggtcgcggacactcaccgagaagcctgcccagaaggggcaggagtggcggacgcgggccgaggtggtgagcgccagcgcggcgaagctgactgccacgatgaggcatccgagcgccatctgcgtggccccgagcgccagcacgatgcgggagcggcccgggcactcgcgcaggcgggacaggctgcggggcagcgcggcgggacgcggcgctcgggggccgccggccggaggcat

SEQ ID NO: 2202 - DNA, 196678 bp, Homo sapiens
acagtctcctgaatatttacgcgttgctgaatctcctgtggacaaaccaccaataggccaggactgtcctgtggacagacggggtgagcctcttcttgtgtctggagattctgagtgagtagaacccgttatgatccccactgcacttaatgtggcattcatgaatgagtctgggctgatgtgctaattgggggccgtaagaagagttatagccacgatggccctcacctttctctaataaaagcttaaacacagctacggtaaatatttttgctttctgctttcacaaacttcacatacgcttacatttattttgaggcgaaaggggaagaacagacatttacaggggaccagttgctaggagaagactgtgcattccctgtaaccctgtcagtctcacctcggagatcctgtccctggagtgccccaggtcccttttcccagctgcactgagtgcctctgtcctcctggtggagctgtgctgctttcttgggcagcctcccttccccatggggtgcacataggctgggggcatcccggtggtcagttcttcccagggacccaggaggaggggctggcagaaagtgggcaggttctttccgctcgacctggcaataacaattcctaaattgctcagcaccccaggctgcttgccttgacccaggtagccagtcccaggcaccaccagtgtgggcagggccctccccaggggcagcagcagggcagcccaagacactggtggccaccacagttagtccccacaaggcgattgtgcaggacatgttctcgagctgcctgcagggtctggttgtgggagcagctcagcccctcctgcagaggtgggagcatcttctacagccagccattgtcccgcaggagctctgtgcccagtggaatatctcagtgcagtgcacaatggggccacagctgtgtcacagccatgctctgtcctttagtgggccgtctgagccacattccacctgcctgttctgacacactgctctccctcgatgaccctgctcccactggcctccccatggtttcgatctgtaacccagaccctgttcccaggagctggctcagcaccatcctgctccacaccctctctcaggagacatcctaacctgcccagcctgtcctgttcctgcctctcaacccagaacactgcaggtccttcaggtattcggtgagaccttagaagcaggcacagcaggatttatcccacatgcaccatgcaccgtgctgaggaagccacggtcactcccctaatggtcactagaggtgagagaactgaggttgttgcccatgtggtagaactggaattcagggcctcagccacacctcagtcaccacaccacgccctgtgcaggacgctggggaaaccaggcagctaggactggcctgtgccttggaatgcttactcagaccacccatccttgtcccctttgcacctcaaaggcttggtctacttttcagacacagtttttatattgtcagcctgatacatatgcatattttaagatgtcaaagagttttataagttttatgaaaaaaatagcagacccctggcctcccagaccatctccccaccgcccctgccctgcccactccccatagattaccacttccagctcttattgcttcttcctctggatttatctccacatttgtaaagaatatgggcacgctgctatttcttagtcttctgttgtggtcaagatggttgaactcgtagatttccctcctgagagctgctccatctaaccctaaccctaactctgatatatagagttatgtcatcatttaggtgaacccttatgcagtgtgtatcagtcaggataggctgcctcatgatgcaggaacaagcatccccagacctgagagagttccgtttctctagcctcctgccctgggggtgggtgctgagtctgggggaggtgtggggtggggggaggggcctcagcgctcagcagacaggtgctcactggtgtcaccatgttccctgccctcttctcatatggaacacgtggtgcccttttgccagggcatccctgctcaggggtcaggatagtcctcctctgagtggctgggagtctgactgctccctgtttagactattgagtagccccctgctttctgcctcactccctttttgtgctggtgtctcagtgcttgggccttttggggttttagaggtgggccgtgaggctgggcatgaaaaggcttctctgcctccaccgcccccccggggctcctcatccctgtgctgcctcagcacttcgtctggcaagatttgcaggtgcagttttcatttctcattctttgttggttttgagtgatttcaagagaagatgcagaaaggctgtgaccccacctctaaaagccagcggtcaacctggccacccttaagcctgttctagtgggccccctgccccgttgccctgctgtgacagtgtcccacgaggacagactcaacacaggacttcagtccttgccttcccgagtgctggcagccctggtgctgttgctttccctctcccctccttgttctcaacctcaggaggaaaatgcccagtttctcatgatgagatatgatgtcatctgtaggttttttttttaaaaaagtgggtaaaattcatataacattagccattaaccagttgaaagtgtgtaattcagtaacatgtagtgcatttgcagtgttgggcacccactatctgtgtctagttccaacaagttttcttcatcccagagaggaactctccattaagcagtcactccccagcctccctaccccagtctctggcaaccccaatctgctttctgtctccatggacttacatattctgaatgtttcccataaattagacatcatataatttgtgaccttttctttctggcttctttggcttagcatgaagtttatgtggatgacccatgttgcaacatgtgtcagaacttcagtcctttctaaggctgaacaatattgcattctgcagatacaccacatttgtttgtgccttcatttgatgggcgtttgggtagtttccaccttttgactgtcaggaataatgcagctgtgagtgtgtgtggatagtgttagattcggtatctgttttcaactcttttgtgtatgtatttaggagtggaattgttgcgttctgtggtgactctgtttcacttttccaggaactgccaaactgttttccaccacagctgcaccgttttacattcccgccagcactgaatgaggattctcattttcccccatcctagccaacacttgttagtttctgttttttgtttctttgtttcatgatggccagtctatgggtgggaagtggggtctgactgtttattggcatttcctgaataggttttttggtagatgttctttatcaagctgaagatggtctctgcctcatttagtgagtggtttttaatcagaaatggttgttggatttttgtcagatgctttttctgcatcaattgatctgatcatatgattttgtctctttagtctgttgatgtggtagattatatccattgatttttctaatgttgaaccaacattgcagccttggaaaaaataccacttggttgtagtgtataattctttttaaacgttgttagatttgatttgctaataatttgttgtggatttttaagttgtttgctcctgagaggcagtggtatgtcattttcttataatttctttggttttgatgttaggataattccagcttcataaagtgaggaagtgtttcttcttttccaatttctggaataggttgtaaagaattggtgtaatttctcccttaaatgtttggtagaattcaccagtgaaatctatcttccttttactgatttttagtttaattctattgtagtctgagaacatatttttatgatttctatttttaaaatacttgttaaggtgtacttcatagctcagaatgtggtctatctttgtgaatgttctgtgcaagcttgagaagaatgtgtattttgctgtagttggatggaatattctataaatgtcaattctgttgagttgatttatgatgctattcaagtgaactgtccttgttgattttctgtctgcttgttctatcaattactgacaggtcttgaagtctccacttataatagtggatttaccaatttctcatttagaattaaaattctctcagattttgccccatatatttcaattatctgttgttaggtgcatagcctttaaggattgtaacatcctcttaaaaattgatttttctctcattatgtaatgtcgcctctttatccctgataattttccttggttggtagtctgctttgtctgaaattaataatggtactccaacttactttgattagagttagcatggtatacctttctctatccctttacttttaacctaccagtgtctctgcatttaaagtagatatcttgtagatagcatagagttgagacttgtgttttttatccactctgaaaatctctgtttcaatgggtgtgttttgatcattcacatttaaatgattattgaggtacttagattaatatcaaactttttagtaactgtcttctgtacttgccagagacttctttttctctctcctctggtttcaatggaccattttatgtgatgccattttatctcctttcatagtgtatcactcatacttctttttaaaagttttacaatatatgtttacaatatgtatttcaaaataatctaagcccaccttcaaataacactatacctcctcccatttagtacaactaccttataacagaatactcccaaatcctccttcctgtcccttgtgacattgctgttaattatttcaattatccatatgtcataatcatacagtatatcgttaccattattgcagtaaataaatttatttttatatcaaataagagtaaggaaaatagaaaattttatttcactgtcatttattcctttttgaatacctcttttttatgtagatccaagttttcaacctatataatttttcttctgtatgaagaaaaatcttttaacgtttatttcagggtatatattgccagtaatgaattcccttggttttgtttgcctgataaactatttctccttcatttttgaaggatactttttctgaacatagaatgctaggttggtggtttcttctttcaaaattttaaggatttcactccactctctctctctctctttttttttttttttttgagacagagtctcgctctgttgcccaggctggagtgcagtggtgctatctcggctcactgcaagctctgcctcccgggttcatgccattctcctgcctcagcctcctgagtagctgagattacaggcgccagccaccatgcctggctaatttttgtatttttagcagagatggggttttaccatgttgtccgtggctggtctcgaactcctgacctcaaatcatctgcctgcctcagcctccccaagtgctgggattacagacgtgagccaccgcacctggcctatccaccctcttcttcctttactggtttctgatgagaagtgggctgtaattcttatctttacccctctatagataaggtgtttccctaccccgctggtcatttgccttagtcattttctctgtctttggttttctgtagttcaaatatggtgtgcctaggtgtagggtattttgctttttgttttttttttgttttgttttgttcttagtatttactctatttggtgttctttgagcctccatggtctgtggcttggatctgtcattaattttgaaaatattttggccatcattacctcaaatgattttcttctccattgtctcttttgttcccttttggtattccagttacacgtgtaacatctttgatgttgttccacagttcttggatactttgttctgttcccctccccaacccattattattatttttttatttttatttttttgtagaggtgggactttgccatgttgcccaggctgatcttcaacttgtgagctcaggtgatccccccgcctcagcctcccaaagtgctgggattacaggcatgagccgctgtgcccggtcttcccaccattctttgtgtgcatgtgtgtttcattttgagaagttcttgttgacctgtcttcaggctgattattttcagccatgttgatgagcccgtcaaaggcattcttcatttctgttaataggttccttttgggctgggcgcggtggctcacacctgtaatcccagcactttgggaggccgaggcgggcggatcacctgaggtcgggtgtttgagaccaatctgaccaacatggagaaacccctgtctctattaaaaatacaaaattagccaggcgtgatggcgggcacctgtagtcccagctactcgagaggctggggcaggagaatgacgtgaacctgggaggcggaacttgcagtgagccgagatcactccactgtactccagcctgggcaacagagcgagactccatctaaaaaaaaaaaaaaaaagaaacatgttgtcctttttgtcttctagcatgccttgtaagttatttgaagctagatatgatgtatagggtgatgggaactgaggtaaacaggcctttaacgtgaggttttctgttaatctggctatgggctacgtgtaatgtttgttgtagctgtgagtgccggcgtattccgatccttgcagtgcccttgtttttgtcctctggctctgggcttccctaaattcccttcctcagacagagtgagtgtcgtgcagctctcccagctttcacctgctgttgtacactggagtcctgttggtgtagttgtagggtgtggggagggccagcggtctatagtcttctgattacatctcagtctttctgtggtcccatttccctgggctgtgactgtcacagatgtttcttcttatatagcttttccagaccccaaacaggaggccagagggggctggactcaggaatgcccttcctccgtggctttgcaacaaggttctggtaaagtctttccctgcggggagcaggcctttgtcctagagaaggctctggatgcatttcaccaggatgacgtttgtcctccctctgccagagtcaccaggagatgtctcttgggttttcatggtgagaacctagtagggatcctggaggaaaagcccatgaaagttttgggcccccctaagactgtggcttctaggagtttctcagtcatgggagtccacccttggcctgcagcaatttgtcagaattacccaaactactgtggtatggccctggaggctctgttccaggtcagtggatctttggatttggctgtgtctctagatttcaggggggcgggttgcaaactcaattcactgatgagtccaaagaaggtcattgattttcagtttgtgcaccattttctagtcatgaggatgggagtgatgacttccaagttctttacgtgttggagcggaaactccaatccttcccctgctttgattttcctgttaccctaaccgggaatcatgtttgttatttgatggtttactcagttgtcatctgtcttcctaattaggacataagctccagggaactggagtgtcagtgttcccttgcgtccttgcacccacaagacagcctggcacattctgaatgaatacaccgaaagggataaataacgaggccaagccacctggctatgggtggctgctaatccgtaggatttctcgtgccttgtggtttcagtgaatttgcgacacacatgagtgatgctgccaatgggaggctcccagatgtcctcaacaaatagaggagtgaccactcagatccaagggtgtagcacttcccgcctatcactgggagctgatgggctgtctttagcatggcactttgtatggtgctggcgcccaggcttccctggggcaacagcgttggcccaggcgacacacaagaagaagggggtttttctgtggtcacttccgcgttgctagttgttttgccctcttactgtggctaaaccttctgtccatacctgtcccccattctcagtatttggcttttcggattgcagtagtgggacttgggtgcacattgcaataaaccaatttgcccccattatccatgtcttgttgatggtcccactgccagcatcagttcttatgaacagatttctaaaccatcaccatctgttctgctcttaatttcaagtgtaaaaagtattactttcctaattccgtcaaggggagggagaatatgtattcctaaagaccacagttcttgtatgaggaagtgtagatctgccacccacctactaaaggaaaggttgcttctgcccatcctcaaagctgttgagcagttatttacctagagggtaaaactggcccattcgcatctctataaaaacaggtaggaaaaggtggaaggagctgagttggggaggtggaaggggggcaaaagctatgtctcccgtccctccctgacagtgcagccccccaaccctccagcccccgccagtataggtgggaatgggctggcagggctgcattgtggtggtccctgctgctgctagggctgtttccagaagaaggcccagtttcaggcttgacttcccctcagaagtcataaggaccataaggtccatctgggtgggcgctgagctctccacgatgggagcaggatagacatgagcatcttcaccctcgtggtccctctgagcctgccctgggggtgagctctttttctgctcaaatgaacattccaggcaggccctggagctttctgtcgttctaaggcaatagaaggttctttggttactttcagtcccaggaacattgttggtcagtcatgaaaaggagtaattatagactctttggagcttctcccacccggctggagcctgacctgtcttggagccggctggggagggagggctgtgtgtctccttctttctttctttgcctctgtttttgctggccagggagtgttccgagggatggagtgtctggggagagggcattctctccacaagtgggctgggtggcacttctggggtccagcagatgtttcacttggacttcctgtctccagtgaccctcgggtaggtttcttagagatgaccctgctgggaacttgcagctcttccctgcgacctgtgggaggccttgctgggctgatgcccttgactgctctccctatcctccaccatgcccctcgggagtgctcctgggctgttccttcaaggcggccccaggctggccccacactggtgggagcagcaggcagctcctccttgggcagctcctcctcttcccctgtgaggcagctctggtcatggcctcctgcctctggattctcaggaaactcgggtgccgcgtccgcagacattggggactcggtacagctatcctaggggtctgctagaagccctgtttgggaatcatggtgaagccacctccccagccccctccatgaggcacagcccttcacggaaagtccctgctcctcttctggtaccccgtaggccagaaaccatgctggggtggggagctgggagcatctgttgatgtgggatgcaggcgtgcttgtcacctctcctggccctcagggcagcaggacagcttacatgaacatctcatcccgctgctggtggcctctggtgagagactactccagtcggtccccctgtagctcctggatcttagcgggggcctgggaatgggaggccacaaggaggttccagagctaactaaagccgctgagactcagagggagtctcacgccactgcctcctgtgcccccatcccctagcaaagtgggactgatgagggatgaccttgcgtccttctcccctgttcactgggacctggtgctgttgccaccgtgggcccaaacatccactgcccttttagcaaggcagcgctgctccatagggtccagccggggaagcatctggctttgcacaggtggaagatcatgactatttccagagtctgttgccaggctccatgtagttcaggagttgtttctccctctgagagtccaaagtggttgttttccggagtttggcagtacctaagggttaattgggatgttattgtctgcatttggcttagagataggaaagttttatgtttattcaaattatcagtaatttaaaattacaattttagtcttaattgtacgtatttggagatcccatttaagtctttggaaataattgcagagtaatattttgggaagttatattacaatgcacagacgttcaagtggagaaaggtccctgcgtgtgagccttggcctggcagaggggcatccaggacaggatctacagcacacagccctcccaactgggtctgggcatggctgcagctgagtctagccctcctttctgtgctgctgcatcccaggggatacggccacacaggccacagttgcctagaccgacctggtgtcaggatcactgtctctgctttggtaagatgtccttgggaggggaagggagccagccaatgagatgaggggtaggagggtgacagggtggagcagaccctcatgctggcagaagagaggttcacattcaccagggagcaggtttttctgaaccctggagagctgaggggggcacctggagcacccctgcagtccacagcatggggtgctggcttctgtactgtagtgcagtgccatgaggtacccatcccttgcagtggggtagggtttaaaacccagaaggcagccctccctggagcacagccccatggtgtttagagaccctctcctctgagcacatgcaggatgtgacaatgcaggtgggcctagtgctgcagtctcagagacacccatgggcttctgccatgctttttatccaccagggcagtaaaagcaacgtccacagtggcttagcctcctgcaaagcctgtggcaggacagccagggttccctgacagtggagatggtggacggccccatagggggttggtcccatctcgccagcagaagtgacctgtgtggccttagtggtcagtgctgcctattgtgatagtggattgtttaaagccaggtcccatcgtggctcctgagggaatgaaaatgaggggttctttgctgtgatctgatgcttgtgttccaccaaatccatattttggaattcttatccccaaagtgatgggacctttgggagggagacattggaattcacattcccaaggagatggggccttatggaggtgtcttaatctgtattctgctgctgaaacagaataccacagattgggtaatttataatgaacagaacattatttggctcagagttctaggggctgggaagtccaaggttgagggttgcatctgctgagggccttcttgctgcgtcctaacatggtggaaggcatcatatagtgagcgagagagggaagggggccaaactcattgttttattaggaacctgctcctcagtcactaacccactctcgcgataatggcattaatacattcatgagggtagagctttcaggacctaatcacctcttaaaggtctcacttctcaacattgttgcatcggggattaggtttccaacacatgaactttgggggggcacattccaactatagcagtgggtgatcaggtcctgatggtgaagccctcataatgggatcaatgccgttttaaaagaggctgcagagagagcctcccgccctccaccatgtgaggacagagtgagaagctgccgtctctgagccatcacgcaggtactcaccaggcacggaatctgctggctctctggtcttggacttcccagcctcctgaactgagacaagccactttctgtcatgtataatctacccagtttatggtattttgtgagagtaccctgaatggaataagactcccttcaaacaaatgtcctgctctttgaaagagagtgtggggctcacagtctgctagtaaagacagttgtaggagcaatggcaagcccacactggctcggattttcagaccttatcattgagttaggagcgaagtcctcgacctgaggttttattggtccaaagtcagggcctgctggagcccgacaggttgcgtgcttggcctgtggagcagttttctccagagcacctctatcccctctgccttgtgccaggcccagcagggactgagggtagaataatgacaggcacagctcctcccctcaaagagtccactatctggggtttgatgctggagcgcaaggaggggctgcccacatgggcggagcagagggcctggggaagttccaggaagaagtgactgtgtgccgaggctgcaggagtagaggcagcccaggagaaaggggggcatgggctggaggtgggggtggttccaggcagagagagcagcttgcacacgggaaaacaaggcatggagtgggcagctccttccgcctggtctctaaacctgtgaagagggggctggggagaagagacgggggtggaggagagcaggactcacaggccagccagccctccacagccttgggaacagagtgaagagcttggactgtgtcctatgtcctggggccggtgccactgcaggctttggagccaggagggactcagtggagcttgctgtgtatgattgtgagtgtggggaatggtttggggtgggaggcaggacaagcagctgtggactcctgtctgcaggtgagtgccagggctcagtgtgggttctgattgggctaagtaggtgcccatctgcctggagtccagctgtccttgtgtggtctgtagaccttgttgtcaaggtctggcagctcaacgctggtctttctgagataatgaaaagggaaaactttagaggcaggacgaagaccttgtagtgaccagtgacatccccacagggtctaggtgtgcgaggtctattggcgcctgtgtgggaaggcgggaaaccaggggcttggggccagctacaaatgccacactgggctctgccttggctctaggtgctttggttgctggatttggtggtggctcagggcagtcacttgtcattctcagtattttatcccctggggcctcctcagagccataggagatggttcacctctgaaggactgccccatgctgtgcttggtaagctcggtcacccagggctgtcacagagatgggctatggcccacatgggctgagcggatttctgccctgccacctacaccttgctgtgattactttggcagtgtttccccgtcaggagagcaggtgggaagggaggcaggtccctgaactgggatagagcccggagacctgggtgtcctctgctctgttgtactgacacgctgcgtgcttatgaaatgagggcaggggttctcagtgctcccatggcatggtgactataatccatgaatgatgcccacacagttcctggcatgctcagtgtagccttgttgttgtaagagaaaaaagcagggattctccacttccccacagagtgaactggaacgaggagagactggtatttctccaacactaggtttctttggatttttatgctggttgatactccctaaatcacaggtcgccttaaagagagcaagagccctgcacggtggcccggacccttggggccccttccatccgatgcacctcgtggcccagtctttacctgctcaccatgcacagcacttcgcatgggtttggaaacgtgtcatctgcatggcaaggatgggaatggggagtgggaacctgcagtttagggtccaggcgggtggattttaatttgcccctgggggattctagggccagcagagctcactgccgctgctgtctgggcctccaggcagtgagctgctgggggagcccctctggaaatggacagtggctgtcagggcgtaggacgctagggggcgaacagaggaagtagaggtatctggggctgaagttcaaggttgcagcatgaagttcagggttgcagcgcccagcctagcagggcagggttcaatctgcaggactggcatgaggaggcagaggagtcagccaagccctcccctcagcctctctccagacactacagatccaaggccaggtctgcatgaggacagccacctggtctcggctgaggttacaggaagggagtcggggcaagggccagtgagtttgttcctaatttgggtcccctaattgtccaagagaagaagaaaaggcctaatttctgtttcgctaagttttagactactttagttcatgttctttaacaataggttattcatgcagagctcatctctattaatcaaaatgtatgattaggcagaaagccctattcccacaccagagtggtgaaatgcagtgcatgtgtgttcagatcaatttttgaagtcttgattttgttttgttacatgtttatttgattgcttgcagaagaatgaagttttttggccctctggaaaatttttctttctcctgagaggttttccaatctagtagaaaatagacgcagagtttggcttgcactgattgcggcattagaagcggccctgtacattttaatgtggaagacgtgatggttttgcgtttgctcctccagttgtgccccatagctgtctttctgccagctctcttgcacatttagttcttgagtgagatgttctaaatagaagccatggtccattcagtccccagcctgctgtccttctgtgacccgccagccagctttgcttagggagctatgagcccctcctactaggctacaaagtcatgggcaggaaaagcatttgtgcacagccaggagcagagcacccaggcccaggtctgtcccggagccatgtggacctggcgaatggctgttcaggtcagaagggggtttggatacaccggttctgtgtttcggaggccagcgtagtccccagtgtatttcgcagaagtgatagcagctttattcccaaggcactagtgcctgcgcgttaggcacgtgctgggtgcctgcttgagtgtctcctttgttcctctctatcactggctgtcccctgcagaggcaagcgaggcagagagttggctggtaacagccagtgtccgcagagccccagggctccctgactgggctgtgccacctggggacaggcagatagaccccaagtaaagttaaagggaagcacagtggggcctgcacaggatgtgagttggaggctctggtgaaactgagacttggtgggggatgggaggcaggggccctgctgggacagacaggagaccaggggccagtggcagaaatggtcctcgatctaccctcatgcagatggtggcctctaccgggagccctgtgtgtctctgagccttagtctccctccctccagtctgcgaaatgggcataatagaaatgatgcctctcactaataaatctgtgcagaaagagaaagcagtttgcaactgcaaagcattattcaggtcttcctggctctacctccaggatcgtatgcctccgctctctcacgagacacaggcctcccatgtgcccggtggtggtctcgaggtcatctgagccatcatccacccctctataccggggacagtgtgctgccaggaggggcaccagaagaggtgtcatacagtggcatgctgagctaggatttgaggcacttcctgcctcttctagttccttgtgggccgggggtgctttgctcagatggtgctggggaggaagggcaatatctaaggatgtattgagagggtcacattcaggtgtgccatcttctgagggacagaaccctgtcacgacagttttgccgtgactgaattcccacattgcagagtgcgcttggggtgtggctctgaacatcgctggcaggtcaggtggagcctcgctgctctggggagctgtgcccaggttccctcggttcctgaagctcagaggttgcaggagaaagggcctcctggtggctgcttactctgccccactgtgaagtgcctggtcactagagttaggcctctctcccactccgggcttcagggattccactgaggatggagggtgttggatttagtttcttttttttttcttttttttcttttgagatggagtctcactctgtcgcccaggctggagtgcagtggcaccatctctgcttactgcaagctccgcctcctgggttcacgccattctcctgcctcagcctcccgagtagctgggactacaggcgcccgccaccacgcccggctaattgttttgtatttttggtagagacggggtttgaccgtgttagccaggatggtctcgatctcctgacctcgtgatccgcccacctcggcctcccaaagtgctgggattacaggcatgagccaccgcgcctggcccccttctggagtatttcgttcattagaagtaagtcagggacttagtgtctttagctccagccagtcctgtggcctctctgccactgtgtgaatgtccccaaccccccacctgataagcaggtgtcctgaggtcatcagggatttggacttagttattaaaaagcaaccagcacccttaggagcctccagagcagagattgccaaactttctcagaccacggtgccctggatctcagcaatttcatggtgtttctagaccaaaacacatagctaacaactctactctttaagtagctaggtccaaaccacatggtatttatgtcccaacaacttggaagccacatgagaaataatactcataaattgaaacaaatgtatttcatcctaaaccacaattacaaacggaagtgtgtctgctgaatgagattggcaccattctcatttcctgtttgatgctgacttttgtgtgggacttgctgtttaaaagtttatttttatttttaatttttatacacatatcatagttatacatattatgggggtacgtgtgatattttttcttgagacagcgtgacagagttttgctctgtagcccaggctggagtgcaggggtgcaatcttggctcactgcaccctccacctccctgttcaagcgattttcatgtctctgcctcttaagtagctgggactacaagaggtacgccacctcgcctggctaatttttgtatttttagtagagatggggtttcaccacattgtccaggctggtctcaaactcctggcctcaagtgatctgcctgcctaggcctcccaaagtgctggaatcacaggcatgagccaccgcacctggcctacatgtggtattttaatataagcatatacattattaattgtggcaaagtacacataacataaaataccatcttaatcattttaagtgtatagttcggtggaattaagtacatcaacattgttttgcagtcatcaccatcagctatctccaaaacgttttcatcttcccaaaacttaaattgtgcgcatgaaacagtacctctcctttcccccttcctccagcccctcccagccaccactctactttccctctgtctgaattcacctctctaggtacctcatgtaagtggaatcgtgcagtatttgttcttttgtgactgtcttatttcacttcgcatggtgtccgtaggggtcctgcacgttgtggcatgcgtcagaattgcttccttttttagtgctgaataacactccattgcgggaatatgccacattttgttgatctgttcttctgctgctggacacgtgggttggttccgccatttggattgtggataatgctgctgtgaacaggggtgtacagatgtctccctgagtcccttctttcagttcttttgggatatacccagaagtggaattactggaccatatggtagctctttttaaaattttttgaagtgccatactattttccacagcagctgcacccatttacatttctattatgccaacagtgtacaagggctccaatttctccacatcctcaccagcacttgtgttttcattttttttgtttttcttttctttcttcttccttttttaaatggtactatcccaacaagcgtgatagcaggaatttgcttttaattacagctacttctggcctcacgagacgtctttcagaggaatgtagtgtgatctcaccttggaaacgagagctgcctcaaggcagtggtgcatgcggtgctgacaggtgccaagggtcactgccttccccatggacatctgggctgtgctgcagtgcccctgtgggtgcagcagggcccctagggtgcctccgtgcagcttgggagccatggaactagacagtgtgcttcagacgagtagataagcacagaaacagagccgtaaggactggggggaacgtccagtccatagttctgtgtggaaccacgatccacggaggcagctgaggggcaagtgtagtgtacgtggctgtgcgctccatctccgtgcttacagccctacaaagtgggaagagaatggaagaaacaggagagaaaaagtcccgtgtggtttcccggaatcctgtgggtagtgagagtctcagcattgttattcctagcatgttttgtgtgtaacgtgagatgaagcaaatgattactgatgtgatcttttaactctgaggaccttgaccaggattttcagtggcgaggagaaaggagatacggaggaaaggtgctgcgggttaagaaagcctcgggaggctgggcgtggtggctcacgcctgtaatcccagcactttgggaggccgaggcaggtggatcatgaggtcaggagatcgagaccatcctggctaacacagtgaaaccccgtctctactaaaaatacaaaaaaaaaaaaaaaaaaaaaaaaaaaaaaatagcggggcgtggtggcaggcacctgtagtcccagctactccgaaggctgagacaggagaatggagaatggcgtgaacccgggtgaacccgggaggtggagcttgcagtgagccgagatcacgccactgcactccagcctgggtgacagagcgagactctgtatcaaaaaaaaagaaaaaaaaaaaagaaaagaaaaagaaaaacaaagcctctggaatccggaactacaaatccataagtagccctagagcgttccctggagaggcctggaatcagtggccaaaccaatcacacggagcacccccagtcccgggtcatgtcttgaaattcagttttctgctgaaagaagctgagactacttggacaaatggttgataccgggttgggggcgggaaatgtacaagttgaacctaaatgctttgtcatagcagataataaaggagccaccctggactgtgaggatgtgattctgctgagagagagcattaaaagaggaaaaaaactattaaagtcaaagtccacgaggatagtgttaaaaggactcgtgagctcacctgatgaggccagagatggacaatttgaacatcagtaagagtaaaaatcacagtaggttgaaatgtatgcagtatgtttaagtccatgagtttttttaacaatactcaggaaataaacctaatccgtcacctttggagaatgctagggaaccaattatatatttttggtaaataagggaaagctctgaaatatatatcctgcttttcttatgcaggccgcactactgggtgagcaggtggcaggttgggaggttccatgtatagaggatggaacctctgtgtctgaagcgtctcagcacatctgaattcacaagctgggcgctggtggccctggggcctgctgacatctcaggaagggaggaagagccacactgcccgggagctggtctgcccctattctaacagggatctcattcgacttccagatccaaccactgatttgcaggaacggaaaggacagaggacgatgtttggctgtgcttcaggcacctggccatcaaaagccaaaccatgggaaatgctgtgtgaccaacgactcttcagttaataacttgggaggcaaaaaaaaaaaaaaaaaaaaaaagaggtggaagcacaaccaacggttaaaggggacataaaaggcacacatagtgtgtgtgtagggacatgtgctacatggagcagggtggggctatgattaccctacaaccaggatgtggtcaggggcacacagggaggctgggtcccgagggctggagtggccggtagggcccctcttcttccctgcctgaggattgtaaaggttgtttcatagccgttttgtttgtttatttatttatttatttatttagagatggagtctcgctctttcgcccaggctggagcgcagtggcgcgatctcagctcaccgcaagctccgcctcccgggttcacaccattctcctgcctcagcctcccgagtagctgggactacaggtgcccgccaccacgcctggctaattttgttttgtatttttagtagagacacggtttgaccgtgttagccaggatggtctcgatctcctgatctcgtgatccgcccgcctcagcctcctaaagtgctgggattacaggcgtgagccactgcgcctggcctcatagccatttattaagctaaatatttacactatgttttctaaaaaagtaaaattattttaacaacataaaagtcaaaggaagaagttcctggaagtggtcttgaaggtgcaagtgggcaattgtgaacagtctgctggtgcaggatgtggcgcttcgtcgtgggagtgctgtctccctccactgtgggccgcgctccttcctgcagcactcgcagctcactgctgccatttcccgtgtaatcctgtcttctgtcttgactcagacccactcgtatctttgttgtctggggtctgcgctttactaggggaccttggagttctgttgttggctgtgacttcattccatgttctttcccataaggaactgtgttgggaatagtttgatgattccatggtcatgccttttggccttttctgtgaggggcgaatggggagcacatggaacttattgctgctgtcttcagtatttcttgggggaggaactcggtgtggttttttccagcctgagcccaccctgaggtcggttgttggacccacctgcctgatgcagactgccagggtcttcctgccagcgcgggatcccccactttccatttcctcttgcaaccatcagacccagggacacatgtgtggctccttctccagtaagcgacctgggaggtatccttaccccaggacccgagtgagcgtctgttggagactcccaggtgtgcaggccagaaggacatgcccagttgtgtggctgcctcttccctgcagggagagagagaaggctggcgtggggcttctccccgggctgggcctgcgttgtccccgaggcccgtggccgctggagcagcccctgagcgactctgctccttcctgggcctcggtttcctcgttctcagggggggcttctgccagactgtctgggagatgttttcagccctctaatttgtgcatgctgtgactcacccaaaattacagagcaaagctaatggaatcaggaatttataaatcccccttccttcctcacgcggttccttgagtttttgaaaactaccattcagaatgagacagtggccttctacctgaggccacagggttgtctgtggcctaactgatttctggccagtcaggctgggtgagcctcaacagcgtgaacatactaaaggcttcttccttgccctgggacaccggttctggccaggctacagggctcacagctcagacctgcctctgcctgggagtgacacggtcccctctgctcacgtgccatggatcagagctgccatgtggcccagcttagggagaccaagaagcatgggagactccccggctatttgacgagcaggacctgtccatgccatctcccatctgtgccctgcatctgcgacttccaaagagcattggcctgcactgtcctatgaaatgctaccacaagccctttctggcaagtgcagttaatcctgttcggtgggttaggaaaccaaggctctgagggaggctttcagtgccacagctgggaggtgagagttgtgagttgcagatgtctcagccatcccgagcgtgaccattctgagtggcgggaagcttttcactcagcactgagtacatgatgcctacagtgttctgggcctcctccatcaggaatcatgggcccttctccccaggacgctcatcgatggccccggctcctccagccctggctcctccagccctggctcctccagccctggcccctccttgggctgtggctgcaccctgggctccacccattccagacccaaaggcccatgggccaaccagacaccgcccctacatggtgtgcccacaggctcttatggatcccagagggccccctttgtcctgcttggggaggctggggtggccgctacacagtgccctgccgtggcccccatgctccccaactccctactgtgtctgctggacgtttgaacagcctcctgccctaaaccttgcatcctgccacctctggcccactctccaccctggcctactcttcaccctggcccactctccactctgcagccaagtgatcttttccagcagcacatgtgactgagtattgctgatggctgcgactgctttcaggatcaaattgtgtctcttccgaaagagacatcagataagagacattggaaaagaacatgaattgcggtcacccagagctctttcgcggtttgggattaagccatgcagaaaggtgtgcaggagcctagatcacctgccaacctgcctcttgccatcctctattttgtacgctcagtcaccccagaaaattgctccggcccttggatttacctccgtgtcactgtccatccggtaccctctgcctgggatgcctcctgggtctccatcacccgcctcactcgtttttcctctgcacatggcatctacttccgcccttccgcaggacaccttcccaggctgggtctggaccaccctgcggactcgctcctcgcaatactggccacatgccctcaagcccatctgtttcttagagtcgatgtcccctaaggtgtgagttcctggtgagcaggagaacctgtgccttttataacctggtgtgctgctcggcgtgccgaaggaaccaaggcgatgttgagaaatgaatggaacagctgtactgtgcagagatacgtgcagagaggggcaggaggaagcctccacttcagacttcagtgtgaaaaagagacactggaaaagaacatgaaatgtggttgcccgatgctcctttgtggtttgggatgaagccctgcagaaaggtccgggcagcactgcagccccgccatgctgcttgccccacgtgggttctggagtctggtggcacctggaagagcaggtggagtggaagctgctagaaggtgggaacctgagggtcctgggctggcagaggccttgcccccgctttgcctagggaggcagtgagcttcctccttcatttgaactttgccctgaagagctgggccttccttgttcatggggagcctgatgcttcttcccagcacaccacagccacacaggaggtgcagcagagcatgcggagatccacctggcaactcacagccagccgcggcgtcactgtcaggactctgtgaaaaacaaggtttctgtttggcgcggggacgaccagagggaaggagactggtagagcctaagtattcagccgaccattaaaaagtgaaagtcagaagcaatgtaagtcaaaactcaggacatctcagggtgaccttggccactcacagttgttcgtgtttgaaatcacattgattctcgcagctgtccaaggcgcaggaaataaccactctgggtgatgtcgttgggatggttttgtcagcactcaggatttgggggtttgttatgaaaatttcacgttacaaaaaagggagaagtgcagttttgtgtgtttagggttattggtggctagacatctgaaaatcaggatccccgctcattgattttttttttttttttgagatggagtcttgctctgttgcccaggctagagtgcagtggccaatcttggttcactgcaacctcggcctcccaagttcaagcgattctcctgcctcagcctcctgagtaactgggattacaggcgcctgccccccgcctggctaatttttgtatttttagtagagacagggttttaacatgttagccaggctggtaactcctgacctcaggtgatcagcctacctcggcctcccaaagtgctgggattacaggcggtgccgctccttacattttgttgctgttcccaggaagattgatggagggaaaacacactctccacagaggagatcctgtgtttacagccgtcttagatagagtcgtgatgaggaggaggactctgggccgacagtgtatgagggttccgcctcataaggctgtttggtgtttgtgcccacactgggtgtgacgggttgaagcagtggataacaagcctattactgttatgcaaatgtgggcggcccagttgcattcttcatgcatgtgtctctccctaatgagtttcaaaatcttaatttagatcttgattttgttgcagataggattccaatttaaagagcgtttgtcattcagagactgtggtagacaggaaaatggtcttcagagatatccacaccctagctgtggcgcctgtaaatctgttactttatgtgacagaaaggactttgcagatctgattaagttatggatcttgagatggagagattattctggattattcaggtgggcccttataatcatggtgacccttataagaaggaagctggaggagttaattgtcagaggagaaggtgctgtgacgatggaagtggagattgaagtgatgcactttgaagatggaggaagcggctgcaagccaaggaatgcaggtggcttctagaagccagaaaaggcaaggaaacagattcttgcctagagcctccgtaaagaaccaggccagtcgacaccatgaccttagcccaaggagacctgcgtgggattcctttctttttattttctttcttttcttttcttttttttgagacaggatcttgctctgtcatccaggctggagtgcagtggcgccatctcagctcactgcaacctccacctcttaggttcaagccattttcgtgcctcaaccacccatgtagctgggatacaggcacatgccaccatgtctggctaatttttgcatttttttgtaaagataaggtcttgctatattgcctaggctgttcttgaactcctgggctcaagggatccacctgcctcagcctcgccaagtgctgggattataggcgtgagccactgcactcagccctctgtgggatttctgaactatagaactgtaagagagcaagttggtgttgtctgaagtcactagatttatggtgacttgtcacagcagccataggaagctaacacagagactcagggaccaagcctttccattgcagcaagattgatcagttgttctctcccatcacggggctctcattttgctcaagtcctatgtcatcgtccctcttttcctggagagcaggagctgacttcagacgccagatcttcttttcctgccacagcgcacttgcagctcttgggaggtgaaggttctgcctgctgctcttctggaatgataaacgctgggcccttagtggaaatgtcaggtgaaatggaaggcagctccttgggtgcagtgacaggacctgcagtgggcctgttggagctggcactgagggctgctccccatccctctgtgggtgtattggctgcatgctgactggccgtcctcgtgggcgtggcctggtgtgtgtgcaggtggacagaggctggagtatccttgagaggctgtgcgttctctcggcttcttttggagccagagccatcagggagccatcacctgtcctggcctgacctgtcctgtcatgagtgctgtgttccttgagctgcctctcaggctaggggatgaggtggctgtgctcaggcctggcttctgcaggcttcttcctatctttggagcggctccaccactggaatctgtgacatgagaggcccgtagcccaggcccatcatctagaatggagaggcagccccacagcctcctgggaaccagagctccttgcctgggtcatcacagaactaagccttaaaatcaggaggcctcagcaaagcgcctctagagactcaaaccaccttgtaaatctcactgggagtgaacgattgactttttactcagtaccaggactacatactacctcatttatgggtttttcctctaaattgctaatgtttgaagtggaaattttcaaaactgactaatgtctctgcttcaagatttgctgtcaggcaacttatttataaataaagcagcttttcaaggagcactaacaaacaatccctcgtgttaggagactcagagccaagtcgtggctctaggttggccttgcagggtgttagggagccagttctccaccccagggccatggacttctgggtccttgcaccatccagagaggtgatgatgtggttattcccatgtatagagtctactgttttcagggggcatttgcatctgtggtttcattagatgttcagagcatccccacaggggttagttcatgtagagaaggaatcagaggctcacagaggttcagggtttgctgggtcaccagctcctaagaggggccctttgggctgaggccacggcgctttctttcttgcaagacagaaattttccttttcctttctttgccataatggccacctccttccaccccatatccttcttccctttggccactggtgagttctgattatttttggaaaaaaaaaaaaattaaaactctgggagcttgagactgaggtaaagtcccctttcgtagagatttttggactgacatgttagctctctgccctgtgtaacttcagagtttggtaggtgatggggacacgcctgttggagagtcctggtgtgtccagttttgtccccgcagcttcactggctgtcagagccacagcctttgcttacggctacgccctggaatatttaacagcaatttcttttcgctttcttctgtcgtgttctgtctgtgtcagtgttttgtggtcttactgtacctgttgttttattataggcagatactgtaaacgctgatacagtctgtgccctgcggttgtggtttttagggccttgcggcggcatctttgctagtgctcactgcaaataggggcaggaagcagttgtttgggaatgagccacatggtggaatatcttgaatgtcccaggccaggcacagagcagctgctcagtaaatgttgctgagtgagaggctggggggttggtgaggataggcaggggtgggcgtccaaggctgcagagttgtaaagcggggggtggggcagccagcaagtccagctcgaggaaacaccacggggttcaggggctctgtgtaagaaatggcagaggtttggcttcgcttttagttgttttgtttcttgttcaagtgaggagaacacaccgagaagggaggagagcaaggctggctgagcgtcatggcagggtggtaaaggaatcaatcacccggacaggttgtccgttcatgtgccgttgtttgcattgctgtgatacagactgctgtgccactgaaaccttccgaaaagcaagccacccagagagtgacttgggcaggtgtgtattcatgtgtgcatcagggagaggaatacttgcaaggagcagagcttccagaagaccaagattcagtggaggcagcaagtcagggccgggcagaagcccctggggtatctgcggaagagcactttccagggtgcatggatggatgcgttaaccagccagttcctacgcatcacggaggagaggtgcctgccctcctgggagccgtgcctattccattgcttctgttgtttttttgagacagggtctcactctgtcacccaggctggagtgcagtggcacgatttcagctcactgcagcctctgcctcccaggctcaagcgatcctcccacctcagcctcccaattagatgggacttcaggtgagcaccaccatgcctggctaatttttaaatgttttgtagaaacggggtctcactgtattgcccagactgttctcgaactcctgggctcaagtgatcctcatgcctccacctcccaaagtgctgggatttcaggcgtgagttaccacacccggcctcttgttgttgttagtaaacttttaattctagaacagctttaaagttataaaaaagttgcaaagactgcagagaattcccatgcttgcttcctccagtcttctctctcgttaacatcttacatcacacggtgcatttggcataactgaggaaccaacgtgggtccattgctatgaactaaactctgcagtttattccaatttccttagtttttgcttaatgttttttttctgtcccaggagcctgtccaggccactacgttacctatagtccttgcgtctccttagcctcctctggtctgtgacagtttttcagctttccttgtttttaatgaccttgatagttttcaagagtacaggtctttgtgaatatccttcgatttgggtttatctgctgttcttctcatggttagactggagttatgggtttgggggaggaaaaccacagaagcgaagcaccattttcaacatacatcaatgttgcatgatatcaatatgactcataactatcgatgttgaccccgatcagctggctgaggtagcatgtgccagttgctcactgtaagattaccccaccttcagcggggtgcggtggctcatgcctgtaatcccagcactttgggaggccgagtgggtggatcatgaggtcaggagatcgagaccatcttggctaacatggtgaaaccccgtctctattaaaaatacaaaaaattagccaggcgtggtggtgggcacctgtagtcccagctacttgggagactgaggcaggagaatggcgtgaacccaggaggcagagcttgcagtgagctgagatcacgccactgcactccaccctaggcgacagagtgagattctgtctcaaaaaaaaaaaaagaaagcaaaaaaagattaccccaccttctttccatagtcctccctggaaggaggtcgatgtgcagagcccatgcttaaggaatgtggagttacactccactccttcatggggggtggggatatctgtataaattatttggaatatttctgtatgggggacttatctattctcccccatttatttattcaaacatttacatcaatatggatttgtggatatataatttataccttgctttataatccagtgctgtgttatttattttattgctcaaactgtcccagctttgactatatgaagctctttcaggtggcatcccatgtcccttagagagatccctacctttttgtttttttgagtacagtcagttggccatatccgtgagttctgcatctgtggattcaaccaaccttagatgggaaatatctgggagaaaaatagatggttgcatctctactgaacagactttttgtcttgtcatcattccttaaacaatacagtataacaacgatttatatagcatttacattgtactaggtattataaataatctagaaaggatttaaaatatattgaagaatgtgcataggttatatgcagattctacaccattttatagaagggacttgagcattgaggattatggtatctacaggggggcctagataaccaatcccttacagatacccaaagaaaactgtacctctttctggcacaagatactcaggctcatcttgaatttttcctacccagtcctggactcagctatttctgcaaggatccctgccttattttattgaagaatggtatctagaaaccaaggtctggagacagggttcttcttgtcaccgaggtacattgcttccaggccctctcagcagacagagctaggaaatatgcatgtatgctaatctgtgtatacatatgtatctcccatagtttttttttatttttttattttttgagacaaagccttgctctgttgccaggctggagtgcagtggcacgatctccactcactgcaacctccgcctcccaaattcaagcaactttcccgcctcagcctccctagtagctgggactacaggcgtgtgccaccacacccagctaatttttgtacttttagtagacagagtttcaccatgttggccaggatggtcttgatctcttgacctcatgatccatccgccttggcctcccaaagtgctgggattacaggcgtgagcccactgcactcagccttttttttttttttttttttttttttaagacagagtctccctctgttgctcaagctggagtgaatggcacaatcttgtctcactgtaatctccacctcatgggttcaagggattctcttgcctcagcctcctgagtagctgggattataggcatgcaccaccacgcctggctaatttttgtgtcccatagcttttttttgaatgcacgaccccatctggcggcgaagccctggacctagccttctgatcactcatgggaaccatgaccacgtgtcacatagtagaaaggaaaacttggacaacttactgtgtagacaggagcagcaacaacaaaaaagacttggaaggcttaaagaatattttccaagtatacacaaatacagagaataataagaggaatgactttgagagcctgaggcaggaggattgcttgagcccaggagttcaagaacagtctgggtagcatagagtgaccttgtctctacaaaaaaattaaaaaaaaaagccaggtgtggtgacgcgcaccagtggtcccacctccgtgggaggcagaggcaagaggatcacttgagcctgggaagttgaggctgcagtgagccatgattataccactgcattccatcctggctaacagaccaagactctgtttaagaaaaaaggagtatctggggtacctgctatccagtttaagacatgtacaaatatgattcagccttccatgagcatgcctccccagccacccctgtgaaacccagtaaattgaatttactgtttgttttttggaggcatgttttatttttacactgcatgtatgcctaaatgatatatcccattgttatgatattttcaaactttgtagaaatgataccttactgtgttcctacaacttgaattttcattaactgagacattttacatgtatttatcttcttagcaatcctgagaaaagcaagagtcactatctccattgtatagatagagaaactgataatgtagagcaatgatgtgatttttgctaatttcaagcagctaatggagatcgactcacatttgtaccttcagagccctagtccatgctctttgtatgacataaatgtcaagattcatcaggaaaaggaagaacaggcgggtcttgttggttactctgtgaccctgttgcttccctgggacctggaagtcctggtgtctcccttagcctggaatcccagtctccatctgggttttgcaggctccaggagttttgatgaaatgaggacccatatggctggttgagactcccaccccctcatcactccctaccagcgtttgtgcagaatcctcctctcctcccgagttggaaataatgtatagttggctcaaaagtcagcccctccttattttagcaccagatgctgcctctcagcttcacgctgccctccagcagcattgcctgtggtccatgggatcttggccttcacactcagcattgaaacagctgccttccgctcccatcataggaaagagaacagaagtctcttgctcccactccccccgccccaccccctgctgctggcctatttctgtgctttgttttgctgtagaacttctggaaagagttgtctgcagtggctttctccatttcctcccttcccgttctctcttatacccgctccagtcggacttttgccccttccacagacacctctcctgacacttttgaccccatcacttagagatcaagatctgtaagactccaagtctccagatccagtggtcagctctcggtcccttcccatgtgactgaccagcagtgtttgccacagtcgtcccctctaggaaacaccttcttcccttggcttgtggggcactctgtgcttgggattttcttcctgcttcactggactttgctcagtccccttactgacccgtgagtgtcagagtgtccctgcggtcagtccatgcccctcttctccgctcggtccacactcccaccatggttgacctcattccgacttgtggcacaaggagctcacatttatcttttagctctgatttctcttctgacctccagactgtacaccctgttgctcacccagcgctttcccttagagttctaattgacgtccccacacaacaggcaccaagctgtccctggccatctcaaccccaatctccacatctcagtaaatggcagctccatgcttccggacacctagaccatagacttggagccaaccttgactcctgtctctcttaaaccccacatggaatctgttccgtaagctgcccatggtcacaccggcaccgctgccgtgcgatgagagcctgtcatctccttgctagattgctgtgccagtttcctgatggttcctgtttccacactgactgcataccttcccacccaagtctgtgtctgctcagcagctggtttattgcatacaaacttaaatgagaatgctcctccgaccagagctctccgttccctggccatcccattaagagtaaatgctggaagcccctcctcaactgactttatttcttaaaactctatcctgcaaaatcctgcctggctaataactttatcaccttcttcgtgttggttccaacgttcccttctgcaggtggcttctgcggactttggtactggcccacatccctgagctggtaaccccccaccatgcacaggcacccccacattaattctgtagcttatttgtttattgttgtctgtgccactccagacaggaagcctgtgggggttgggggcttggtctgccttcttcagccctgggctcacagtcctgacatcttcttgaagacggcgctcacggtcaggctgcagcaaattcacagttgacatctaggagtgagggcctcctgccatgctgcactctggcctctcacctgcctcctgctagtcctgggcacacctggaggacaatcagggaatttctttccccatctgctttggcatcctccaaacctgggaacctttctaacacctgactgcttggtgaccatgtgtgtgctctgtggatttctgtccaggagggtccctcactctggccctcagggccatgtgcatgtggacaccgactggtagggttggtttcctatgcagagagcagggccagaggcatagccggcccacccccagccccattgctcacggttcacccagtcccctggcctttccgacgctgtgcgcatctgtatttgttgcagtgaacagagcctagaattataggactttgtcagacagtttgattttcaaccccgtaaaaaatacattttacttaaccacctaggatacctctacattatagacctcaagcagaagtttcaggagacagtttcttactctcattagaggtgatgcgttttgtgtggtcttcggtttcattgccccataaactcacttggcgatctgcctgtgggtccccagcagtctgtaagccacagctttctcaaccgtacttcctgttctggaggagaaacctgagctgcaaagagctaagggtcttgctaaggtcataccagtgaattcaccaaacagccagtactggaaccctgtcctctgattcccatcctgtggcttttttaggcttgtgtaatcaattttaatgattgtaccattgtagcttatttaaattaccccaggaggaacatcagctctgttcaagaaatgttattgtagttgctcacctgctttgttcagggaaatgcatcttttgtgggatttcttctgagtaattaagagggtctaagaagccagttttatagtcatttatttaactgtagagaacaatgaagttaaacacaaaagctggttccatctgcaggaacatatgagtgatttgcattagaaagggtgttcatcaaagctcctcccaggtgcctagggaggcatggggggccttggtgggttccctgagggtcgggccaaggccttgggccagggagcacagttccattgcactgggtgtgttggggcagaaccttgtgcttggaggtaggtgttgcttctggccctcggttgcttgctcctgcaggcagggccgtggacccgtagctcagcaaccatggaggagctgtgagaaatgcacagtctcaggccccaccctggctctgctgacttggaacctgcatgttaacgagactgggggtttgtatgcacatcacatccggtccagctctggcctgaggactccggtctgtggtttctagtttttatcatccagctggtcatcctcagcagtagagaatgtggttggttaccatgtgcagggcagcctgctatgtgctgtggtaacagaagggtggggcagagccctcctagccctcccagccctctggggcttgctgtctctagggcaggcaggggctggcatatgcagttgtacaccatggtgttttacaaagcacgagtgccatggaccccatgggtgggctggattgagatgcaaggagggaaaacagatggggtggggtcccaagcaggaggaactgcatgaggaaaggcgtggaggctggacagatgcagaggcagtcagggaatagccagtgtcagaatggagcaggcgacagccgggttttggaggctttcagtcccacgtttagatatttggactttatccagtgggtcatggaagctactataaactttttaaaattaaatactattttatttaaaaaattgtgtaaaatacacataacataggattcaccttctggaaccatgtttaagtgtagagctcagtcgcattaagtacatttacacggttgtgcaaccatcaccccatccacctccagagctctcctcaccctgcaaaactgaaactctgtccccattaaacacttaactcccattcctcctcccctcaccccctggcacccaccattgtactttctgtctatgattttgacgacttcaggtgcctcgtatgagagcaattgtataggatttatattttgtgactggcatatttcactctcaacgtcctcacggtgcacacacgtcgtagtgtagcacgtgtcacagtctccttgtctgttaaggtcgaggaatacttccttgtatgaatagaccacattttgttgatcgttcatctggtgaaggatgcttgggttgcttttacctcttggctgttgtgaatcatgctgctgtgaacatgggggtacaatctctttgagctcttgttttctttttctttttttttctttttcttttgagatggagtctcgttctgtcacccaggctggagtgcagtggtgcaatctcagctcactgcaagctccgcctcccgggttcacgccattctcctgcctcagcctcccgagtagctgggactacaggcgcccgccaccgtgcctggctaatttttttaagtatttttagtagagacggggtttcactgtgttagccacgatggtctcaatctcctgacctcgtgatccgcccgcctcggcctcccaaagtgctgggattgattacaggcgtgagctactgcgcccggcctgagctcttgttttcacttccttcgggcatacccccagaagtggagtcattcctagatcatatggtgattctatttttaatgttttaaggatagcattttccaaaggggctgcacaccattttacattcctacccaccgtgtacaagggttccagttttctccacatcctcaccaacacttgttattttctggtttttcaatcgtggccaccctgatgggagtggggtagcagctctctgtggtttggatggcgttttcctgatgcacgatggtgtggagcacctctcctgtgtgggagcactgtggcctggtgagcaggggctctgtggtggggaggcgcgtgccgagggctgtaggagagggcgacgggtggtgctgtgcatcaggttcggggtgatgggaacgctgtctcttgcacctgcacatcaggcctcccccatgctactttggtggcttctgtgggagcacaatatgtccagggtgccatccccaaggcagaagggagcaccatctggtttgatgtgtggcctgtacttcaccaagcccaccacatttggcctatgactgtgtcctgctgcgactgggttgaagtcagaggagccgagacaggcgggggagcatttggaggacgtgtcccttgctgtggtgtctttgcagaagtggccagcacttgcactgcccagtagtattttcgatgctcctgggaacatgagaggattgcactctctgctttctcaaagttagataagaccatgtgccttgcttcagccaatgacatgtaagcagaagtgacttgtgggtagaagctggaagggactttctatgctgtcctttctccagtcacatcggtcctagaagcacatgcctaggaggaggggccataatagcaacgtggctgttatttgctttggactcacagtggactttgagtgagcaagacagaaaccattactgggcccaggccctgtggcgtgggagctgtttgttgtcacagcacagcctagcctgtcctcactgatccaggaggaacctgaaaagtattttaagtgcacagataggtgaagatgaaagtgtagcgttttgggataattctgcatgcttcttagtatctccagcagtttcgagatttggcgaaggggctgaacttttctgtaggtaaatctcttgctgaagagttcattatcagctggtaatggcttcattttgtcagcggcacagagctctggcttgtgcgtgtctgaggcctgtccccactggggcagggaggtaatgagaactcatgaaccctgcatctctgcctggctttaacagcctctgtgttttccagtgcttatcaaatccagagctgtttacatttcaggagacaacttcagactctgtggacctcattatacttccaaagcaggagggtcgttgtttttaagcattattcccaacttttttttttttgactgcagaaatgcctttttaatatcagaaaatttccaagttttccttacttggctatagtcttgtttttagtactgctttggtggttcagtaactattcattaaacaaatctcttcattttaagtttatttcttctatagggctcttctcttctcttctgttctcttctcttctttttgatacagaatctccctctgtcgccaggctggagtgcagtggtgcgaccttggttcactgcaacctccacctcctgggttaaagctattctcctgcctcagtctcccgagtagctgggactgcaggtgcatgccgccatgcccagctaatttttgtatttttagtggagacggggtttcaccatgttggccaggacggtcttgatctcttgacctcatgatccacctgcctcggcctcccaaagtgctgggattacaggcatgagcctccgcattcaaatatatgtaaaaacggagagaattgtgatccctgaaaattcatgtgttgaaatcttcacccccaggacctcagaatgtgactgtatttggagagagggtctttgaagaggtaactgagttaaaatgatatcatcaaggtagcttaatccaatctgactgatgttcttgtaagaagagattcagacacagacaggcacagacggatggccgtgtacatacatggcggaagacagccgtatgtgagccaaggagcgaggcctcctgagaaaccagccctgctgacaccataatctcgacttccagtcgccagaactggaagaaaatacatttctgttggttaagtcccctagcctgtggtactttgtgatagcattcctagaaaactaatacagtgcctgtgtgctattgttcagtgtcagcagttccagtttttaagcaatcttcatggactgctcccgaagttcagggagcatggggcctatagcagagaactaggcagcacctgcccttgtgaaactgacactctacggaaactggaaaaattcatgaggacaagcttcagttaacaacactttgaggctgggtgtgggagcttgagcctgtaatcccagcacttcgggaggccgaggcaggtggatcacttgaacccaggaatttgagagcagcctgggcaacatggtgaaacgccatctctactaaaaatacaaacaattagctgggcctggtggcagttgcctgtggtcccagctacttgggaggctgaggtgggaggattgcttgagcccaggaggcggaggttacagtgagctgagattgcaccactgcacttcagtcagcccaggtgacagagtgagaccttgtttcaaaaaaaaaaaaaaaaaaaagacactttgagactgggcgaagtggctcgtgcctgtaatcccagcagttcaggaagcagaggcaggagtactgcttgaggccaggagttcaaaaccagcctgagcaacacagcaagacccctgtctccacaaaaaatatattaaaattagctgggtgtggtggtggatgcctgtagtcccagctacttagaggctgaggcaggaggattgcctgagcctgagaggttgaggctgcagtaagctatgatcatgccactgtattccagtctgggtgataaagcaagaccttgtctcaaaaaaaaaaaaaagagcactttgaattctcataatcataatcatatgacatctgtctaccttagaaaccctcgctggtgggtggtcacacataatgctggtggtctgcggggggcagatggactctcacaccctcctaggttcccctttaggaactgaggcttcaggtatgggaagggtttgtggaataaatggatgaaaatggaatgagaagctttgcccacgtcagagccaacctatcatgtggaccaggattcagaccacccctgggagaggaaccaggatgcacccatcattctttttttttttttttttgagacggagtgtcacactgtcacccaggctggagtgcagtggtgtgatctcggctcgccgcaacctccgcctcccaggttcaaatgattctcctgcctcagcctcccgagtagctgggattacaggcgtgcaccaccatgcctggctaattttgtatttttagtagagacagggtttctccatgttggtcaggctggtctcgaactcccgacctcaggtgattcacctgcctcagcctcccagagtgctgggattacaggcgtgagccaccgcacctagccgacacccatcattcttacacagtgaagacccagggagatgatgagtcacaccgggaagtgattcatttgcttactgttaagttcatccaggattcctttaaataccaaatccccatatacgcttaaaaatacctagttcactcagaaacagtgtgctgactgacggaagccagacatgaaagactatgtggtgcaattccatgtataggacgtttctagaaagggcctaatgacagagatggaaagcagatgagggcctgcttgggtctggggcgtcagtggggattggctgcaggcagccatgaggagccttcagggtgatgagggttctaaaagtgcgtcgtgtgcctgagccactgcgacattcactagaagtcctccgtgctgacggagggtgaactgtgtggggcccaagttctatctcaggaaagccagggaagccactcagttcagctttgtgaaaatcaagggagtcttcttggaggaagtggactctgagctggatgtgaatgacggagtgtctttggtaaggagagacagctgcaggggactcctggtggaggaacaggatcccgggggagcggccgggcgggtgactgaggcgccaatggaaggagaagcctgtcacaggtgagggcattgaagggaactgcagggacacccagcgcttctcaactctgactgcagatttccagctgccatttctaaaggacaggtgcctgggctccactcctggaggtttggatttaatcagtctcgggtatagatcccggacgttagtatttttaagcatatttttaaatgaagtgatactctaattctatcattttctttttacttctcagcttgttgcttctctaaagagatacctccctttatccattttgtggtcacccagtgggacagttgagagagaaaaggccgggtggcatgtgattcttctacttcatttaccagttttgaagatgatgaatttgtttcccatgaccttccaaaggtggttttttaaaatttattttaatctatcgtcgtgaactcctggggcgtgaacgtgtgtcataggtttcaaaccactgcaatcattatcctcattgaggttcattgtggctggtggtagtgtcttcatattggcctctgagaccttctgacctgattctagttatctttgataatttccttgtctttaaaaaattataattgtatatattttttaataataaagatgggtttcggctgggcgcggtggctcacgcctgtaatcccagcactttgggatgcagaggtgggcagttcacgaggtcaggagattgagaccatcctggccaacatggtgaaaccccatctctactaaaaatacaaaattaactgggcatggtggcgggcgcctgtagtcccagctactcaggaggctgaggcaggggaatcgcttgaacccaggaggcggaggttacagtgagcagagatcgcgccactgcactccagcctggcgacagtgagactccgtctcaaaaaataataataatagtaataataataataaagacagattttgccatgttgcccaggcttgtctcgaactcctgggctcaagccatctgcccacctctgcctcccaaaatgctgggattacagtgtgagccaccatggcccagcctaacttccttgccttttaagagtaaagcagttttatttcccattgctcttccactagctttaagtatgtgttaatttattattttaggttgtcctagaggttatgatctgcagactcattagatgctagtgatgctggtcttctttaaattggtactttaaccgcttcctggacaaggcagggactttgcatacagatatatcagtatggtgtggaagacagctacactcaccattataccacctgcacagatatcagtatgttttgaaagttgcctggagaccttggtggcaatccagggctgaaaactctgggtggggcactaggtgggtggcaggtgcactggggactgaatgggatgctgtggcagagaggaccagacctaaagcctttagtgaagaaggcctggtgtgaattttttagctggttatcaggttcatattttaaagaatatttttctaattacgtttgtttgtttggtctggcctgatgtgggacgtggtattttcagtgtataggtcttcctagagttgggaaggagggatgcccttctgttggagatgtttctgttaactcaggtgctttaggaatggaaaggaaagtcatgcagctcaggcccggcaggggcattgttgaagatcctcagccagtgaggcgccttccctgtgcccagcacattgctgaggaccttgcctgaaagatgtcctttcatcctccccacccacctgaaagatgagaagtggaggactgatgagaaccttccagatgggttctccaagccacacagctaacaggtgccagagtcggaatttgaactcagctgtgacttacttctgttaccagcagaagtgggtgagaaagccggccacagtccactaaacacgggctatgaccaaggtctctttgacaacataatccaacaaataggcttgttttagaatataaatctcaaggaatttggggggagttgatatactcttgttttttactttttattttgaaatatttttagattcacaggaggttgcaaagaaatattcaagaagatcctgaacactcttcacttagccccgcttcaatgttaacattatgcataacgatagtacaatagtcaaaccaggaaactgacagtgatgtagtcaacagaaactagtcagactccagtagttataatgtatgtatgtgtgtgtgtatgtgtgtgattctgtccaattgcatgtgcaacttcatgtaaccaccaccacaatcaagatatttaattgtatcatcagcaaaggactgcctcatgctaccccattgtagccacatgcacagtccctcttccatcattcctaacctatggcaaccactggaggacatttggagtttccagtttggggctgttatgaacccagatctgctatatgaacattcacttacaagtttctatgtgaaaacaagtttttattcctctatgatcaattatctacaattgctggattgcatggtaaattcatttttacttttaaaggagttgccaaactattttccagagtggctgtaccattttatattcccattagcaatgtatggatgattcagtttctccacatccttgccagcatttggtgttatcactgttttttattttagctattctcataggtgtgtagtgatatctagttgtggtttagattgcatttttctgatgcctaataatgttggggatcttttcatatgattatttgccatctgtgtatcttcacgggtgaaatatctgttcatcacttttgctcattttttttttttttttgagacgaagtcttgctcttgtcttccaggctgtagtgcagtggcacgaacttggctcactgcaacctccgcctcctagattcaagtgattctcctgcctcagcctcccgagtagctgggattacaggcgcctgccaccacgcctggctaatttttgtatttttagtagagatggggtttcaccatgttggccaggctggtcttgaactcctgacctcaggtgatcagcccacctcggcctccgaaagtgctgggattacaggcatgagccaccgcacctggcccacttttgctcattttctaattagattttttttttaattgttgagttttaagggctgtttatatattctagatacaagtcctttgttaggtacgtgatttgcaaataatttctcccagagtataatttttttttctgttatcttaacttgacccttgacagaatgaaagtttttaattttgaggaggtcaaagttttatcaaattttttccttttatggatattgtgtttggtgtatgtctaggaactctttgcctaatcattaaggtcccaaagctctttcctttgattttttttttctacatgtcttatagttttatatttaagtccttgattcattttgcgttagtttttgtataaggtatgaaatttatgtcaaatttcttttttctttttttgcctatagatgtgcaaatactccagcgccattaattgaaaaggctgtccctccttcatggaattacttttgctccttgtgacaaatcagttgggcatatttgtagggatcatttttcctgggctctctactccattccatttgatctctgtgtctctccctttgcctatatcacactgtcttgattactatatctctgtaggaagccttaatatcaggcagggtgatttccccaattttattctcctttttcaaagttatttggctattctcaggcttttctctttctaataaattttagaataagtttgtttgcatctacaaaataccttacaaagtttgacaggacttttgttaagcctgtcagtcaatttaggcagaatcgaccttttaactatgttgagcgttccagtccatgagtatgtctcttcagtatttaggtctttgatttccttccttgtcattttgtaatttttattttatatagatcctgtacatattttgttagatatattcataagtatcttcttgttatctttagagcaactttaaatggtgttgcatttaacagtcttgatttccacttctttgttattagtgtatagacatgcaatcagtttttgaatgttgatcttgtaccctgaaaccttactgaactatatgttttcctctcagcactgtctgagctgcatcctaccaacttggtatgtcgtgttgtcattttagtgcagttctatatagtttaaaatttcccttgagatttcccctttgacctatggattagttagaagtgtgttggttaatttccaagtatttggagattttcctgtagtttttttgtcattgatttctagttggagtccattttggtcaacatattctgcatgattttaatttttttgaatttattaaggcttttttttgtgacccaggatatggtctatctgagtgtatgttccatggacaattgaaaagaatgtgtattctgcagtttttgggttgaattttctataaatgtcaatttgatctttttgttggatggtgttgcacacttctgtatctttgctgatcttctgtccagtagttgtgtcagttgctcagagtgggtactgacatccccaaatattattgtgaatttgtcgatttttctcttggcaagatttgtttttgctgtatgtgttttgtggtctggggggtacgcatttagaatttctgtatgttcttggtaggctgggcattttattattatgtaatattattccttgtctttatttagtttctttactctgaagtctgcctggatattaatatagccacttttgctttctcatgattagtgttggcatgacatgtcttttcccatcctttactttcagtctacccatgttgttatgtttgaaatgagtttcttgtaggtagcttgtaggttattttttaaatccattctgccaatgtctgttatttgatgtagttagaccatttatatttaaaatgattattgacttgctagggtttaagtctgcattttatgatttttttccttctctttctcattcctctgtttctttttccttgccttcctatggtgacaaacattttttagagtcccacatttccttatttatactgtgtttgaatgtacggctttggatagtgttctttatgattgctgtaaatattatgtcagcctactggtgtcagagttttaccactttggaccctttaccctcactactttttaaatataattgtcttaagtatttcctccgtatccactgagtaccttatcgtatgacataataacttttgcttcaacttaaagtatgattaaagaacctcatgaggtgaaggacagtctagtcttcttctgttagtctctttttctgtttgaagacatttctttagcccttctttaaaggttggtctgctagtaataaattctttagcttctcttctcctgagaatatcttaatttctccttcatttcttttttttgatagcaaatttattgagtcataattcacataccatgtaactcatacctttaaactgtacaattcagtggtttttagtgtattcacagagttttgaatcataaccacaatctaatgtaataaaattgtaagtctggctttttgcatgtgatagaggggagaaggaaaagcagtctatatcatcttgctctggaactagaagttgatagtcttttcaagtgttttataaatttcaggttcctctctccatccctttatttttatttatttatttattttgagatggagtctcgctctgtcacctaggctggagtgcagtggcacgatcttggcccactgcaagctccgcctcccgggttcacaccattctcctgcctcagcctcccaagtagctgggactacagacacctgccaccacgcccggctaattttttgtatttttagtagagatggggtttcaccgtgttagccaggatggtctcgatctcctaacctcatgatccacccgcctcggcctcccaaagtgctaggattataggtgtgagcctccgcgcccggcccctttctttatttttaaaatgtattttaatttttagttcttaattgtggcaagagatacatacaaatgtatcatcttaagcattgtttaggtgtacaggtcagtgacgttaaggacattgacattgttgtccagctatcaccaccactcatctccagaatgatttcatcttcccaaaatttaacctctgcactcattaagcagtaattgtccattcccctcttttcacaccccctggcaaccaccattctactttctggctgtgaatttgactcttccaggtacctcacgtaagtggaatcctacaatatttttgtgcgtgactgacttctttcccttagcatagtgttctcgcaacgttgtagtaagtgtcagaattcccttgcctgtgaaggctgaataatactccaccgtatgtgtagaccacattttgtttatccattcatccatgatggacacttgggttgtttccacgttttggggactgtgaataatgttgctatgagcatgagtgtgcaaataatctcttggagatagaccctgcttttcattcttttgggtgtatactcagaagtgggattgctgaatgatgtggtaatttatgtttttaattttggggggaactgctatactatctgtccctgtcttttccttacaaacacgtgtggaagactttgaggcatttgacctgtggaacatctcccttcttattttggatgggtgcactcctggtgaagttcagcgtgtccctttgtcctctctctcctgcacattggcagctggatccagtacctttgctggacttggttccgtctctttcgcaggattagaggaagtgctctatgtctgttcacccatctttttgtgagcaggcagctgttgatgctcaatgcccctgttttgggtaaaattgtgtctccccaaaattcatttgttgaagtcttaagctccagcatctcagaacctgcccttatttggagaaatggtctttacagagcttatcaaagcaaaatgaggtcattagggcaggccctaatccagcatgcccagcgtacttccaagaagaggaaatgcggaagcagacacgtgcagagggaggatgggaagatgtggtgactccatataaacataaacacggctgtctcttgcccttcattcttgaacgctttgctggacaggaaatccttgagtgtcttaaataggctactctttttttttctggaggtaatcatggttgtcaaaaagtcttaagggtcagccacagtggctcacccctgtaatgccagcactctcggaagtcaaggcaggaggatcatcggagctcaggagttagagatcagtctgcgcaacatagggagaccctgtctacaaaaaccttacctttcatttctttttctttctttctttctttctttctttctttctttctttctttctttctttcttttttttattttttatttttgagacagtctctctctgccggccaggctggatccagtggcacaatctcggctcactgcaacctccgtctcgcgggctcaagcgattctcctgcctcagcctcacaagtagctgggattacatgcatgcaccaccaagcctggctaatttttgtgtttttagtagagatggggtttcacctataggccaggctggtctcgaactcctgacctcaggtaatctgcccaccttggcctcccaaagtgctgggattacaggtgtgagccactgcaccgggccttaacctttcatttcaaataaaaaggagataacctggaattctgtgtgggctctcagtgtaaagatagaaggacacacagagtgttttgaaacatgcccctccctgatcagcaggtgtcctgctgtgtcacatgtgactgtcagttcccgacccctcggccgagcagaaagggctttggcaaggtgtccggagttggaggtggcctctgggaggtttgctgcccgagggtcctgttgccgccaggactggtgaggagactgaggattgaaggggccaaaagctgacaaaattctgtgcgggggctgagtggcagattcgggtctgaatcatttcctggttcctggaatattcccacttaggtgccgaagccagaattggagggagcgtggcgcctactcatggagcctgccaaggcactgccagctgctcacaggccaggccgggcgggcagagcctcctcgctgcctgctggctttgaaattcatgtttgagacacacattccagccttcactgcttgttcaaggtgatacatgattttcagactggacagcttggcctcttgtctgttcttgtgttttcctttatgtaccaggataatgttaaacccttcccatgatgctgcaaaaaccaaatagtgcagcacacaccccacagcccgaaacaactgcaggtgcgtgtgccagtggttctgaaaggaatacagagacgtgtggtttccgaatccgctgattgttttattatatactgttacagatcatgttattctaaattacaaaataaaacttatgttaatatacatttatacaacgtatatattatacattatatagcatgtagtgatgtatgatgtaatgtatgatatgtactatataataatttataatatattataattattataataaaaatgactggccaggcaccgtggttcatgcttgtcatctcagccctttgggaggccgaggcaggagggttgcttgaggtcaggagtctgagaccagcctggggccacatagtgagaccctgtctttctaaaaaaaaaaaaaaaaatagtaatttgttattattcttcctattactatttttaagggacaattttggaaacatactttactttttctagtgtagcaaagaatttacattttgtcacctgaaagcgtcctggaaaatccatcctagtgtcttgtaattctaacagtcaccaggaaggctactttgagaaaatttcatatggtatgagggaaaacaagaacattctcatttttttttgtcttgctgaattaaaaaaaaaaaataaaagcaacaacaagaaaaaacaaagcccagggctggggttaagtaggtgaaggaggaaagggagtccccacctgccagtctcagtgccgctctttgccatgcacacacccgtatgtgtgcccatgtgtgtgcacacagacaccaccgggtccccttggagttaccaggcaaatgcatgtcatcagctgttgtgccttgatgtctcctaagctacatagaatcccctcagaccacgcctgacacccaggacaccagggcagtaatccgcacgcccatttcactctcaccatgtaaattgcgttttctattttcatttcattttatgtcacttttcttcaacaagtaattattctagggctttataagaacgctgtgctttcttagtctatttataatgagtaagaagttgtttttattctatttcttttctgtctgtgcttgccattttttttaatcacgattggataaggggggatccctgcaagataacagcgcccaccaaattagaatctccctgaaaaacatacagttaatcaggaggaaaatatagttgcccatagtccatgattatagcacaactaggggacaattaatgtagcaaacctctgtttccacccaagaccaggatacagggtttcagggccaggccagagccccgagccatcaggaccgggcacaggagagtgcagcagcggcctggtcccaccctcactcgggagataataagagacatctgaaatgtcactcaggaataaaagagagggtcttggaaagtgcatgggatgggagagtctgctcctgggagatgtttcctggaggtttggtgtgaaagggaagagaagaattagctgaaaataaggaacttagtaaaacaacaaatcatccacaaagaagagctcctctcaggggaggaggaggtggaagaagaggaaaatctctctccttaattaaaaaaactgtactttagagaagtaagagaagagtgcatggctgaaccatgttcctgagcaagccacacagacctctccctccctactgactctactcatcagcttttggggagtctaagtaaattaatataaacccaagcacacctagcgtccatacaatattactgtaagaaaaagaaatagaaaatgtgtagcaaaatgctggacatgaaaacagccaagaagcacaaatgaaatgtaagtaataggcaattgcaaatgtgaaaaaacaccatgagccagctcttcataaaataagactggaaatggataaacaacgggagatatgaaatgagagctaattaaggaaagcaaatgaagaaaagtctaagataatctctgaaattaatagtaaatgataaggttccccaaagggatagtagttacagctgaaagcacagtagggatagaaatgaaagaaatagaaaagatcaaaaccaaagtgtctgttggaaagacatccaatttacctgtaattggtgaccctgaagaactaaaacaaggcaatggaacagaactaaaaatttaaaactgcaagtcaagaaaactttcctaaaataaaattaagacccaaatctacatggaaatatagtccactgccattccgggaatggttgactcaagatttatgctctaggaagactaaattctaaagataaagagaatatcagcagggcctccaggcaaaaggaccaagttatttacaaaggaaatttacagagttgtttacaaagttacaagttatatgcaaagtctggtgtcagacttataacaacaacaaagaaagcaagacagcaatgcacaatacttttaagaaactcaaggaaagaaaacgtgagtgaaggattttatgcccagccaatggttctttaagtgattcagaaacaaaaatattgtgcccaccaggcacacttaaagaatcagctggcattagtgatatgtcagaggctggacggcagaaatggtctgccctggttgcaggcaatgaggagtttcatcatctgtcgataatttaaaaacaataataaaactgactgaaagtccgtctgctttttatgtcactgtgatccaacacttttaaacaatgtcagccaaaaaatactcctcctgaaaaaacctattgttggtctaatttctaagcaatttttcctattacaattgcattttaatgctatgtgtaaacctcaaattagcatatttgcattacttatgctttaataaacattatattctacatggcatttaatttggagaactcccaagtatacgatcagcccctgacatctgcagactgaggcacatgtgtttattttgagaggaagtttgtagcaatccagaatcatgcaaactccattgaggtccggactcctgtgaccctgtgtattcctctgtttggatagcagattaggaataaccagtgatatcacaataggtaaagacaaagaaacagaacttggatttcttcaattctgtcattctatgtgaacactagaggtttttattggtgtgtaaaatttgaagagtaagagcacagatgatgagattggatatttttgtttgattggtgcaacttgtagttgacacatgaaatattttactgaatatgagctgtaccattaggactgaaattcatcttttaaaattgtccatggtttttaaaattacagatccagttaaggaaatagtgattattactggttattatgtgataattactgaaaacactgttgtcacatagaggatgaaggtgttaaaaattagccacattatgtatgccacatagcaggggacaggcttcatccaatgaaaagatgatgtgggaaactttggcgaaggcactgatagtatttttacacttaaacaagtattttaaaatgtttaaaaaaaattgtatatgtatgaccgaaagaaaggtagggataagtatggaggaatggctataaatgttatatattctgacaaaatagaaataatgaataaaaataatagttggagtaggaagagcaaaagaggaacagagaatcagctcattgattgccctgcaggtaggaaagtggtaacattgtttggtatacaagaatgaccactgaaacaaaaatatagaccttaaatacccaaagaaatgcaaaaacaaaacaaaacaacttttaaagaagcaaacaaaccatatagtgaaatacacacggtcaatataacactaaagaatagaactgagaccaaacctagcagccgcatcagtaaattagagtggatttaacccatttattaaaaggcaagactgattttcagattggttcacatagtggcacccaactctatgctgtataaagaagtcatatccaaaacacagtgatccaggaaggctgaaaatgacaggagggtgtatagcaatgaagagagaaaaagagcttgggagttttaatcctgactgcagccaagctagtatcaggccaaaagcattaatggaaacaaagagggccgctgtcaatgctaaaggctgcaatttgcagagaagatacactaggtgtggttatgtctgcttcacataacatcaccagaacctctacgatgcggaaaccacaggggcggtggggagacatgagggacacgcagttccaggacattgtgactgccttgctcagcctgagacatgtgaaggggaccaaaacatacgcctccaaatgtaccagactttgtgctgtgataatagggaatacaactttgtttcgagactacttggaacacttaggaaagttgacatatattagcttacaaagacaacctcaatgagttccgtaacagaaataatacaaacaacattctgtgctcacaatgcaataaaactaaaaattaatcataagattaaaaaccaaaaaggcccttcaatttgaagagttacaagattaaactctattaaataagtttttaggtgaaaggaaatacacaaaccaagtgcataatttttgaatttgacgataattaaaatatatcactctgtggaatacacataaagctgtggttataacctcagaaatgaaaccaaacgaattaatggatttatcatctaactaaaaatgatagataaaaatagccaaataaacttagagtagaatgacaaaaaataagagtaagattggaaattcatgagttttaggaatgagaaaaaaatgaaactgataaatacacaaaatactacatcctagaaaaagaatcaagtggacaaacctctgtctaagctaatcatgaaggggagagagagagaccccaaacaacacagaataagaaatgacattaacagaacagagcatatttaaaaaaatcattaaaagcttactttgtatagtgctttgcaagtaagtgtgaagacctggatagaaagggaacttctttaggaaaatataatttattcagattgaccccagtagacacagaaagttttaaaaaaaaattcctactggaaaaaaattcaaatctatattttcacaggagaattctatcaaatcttcaaagaacagatatctcaatgctacttaaattattctagaacatagaaaaagaaaccttaagattattcaatgagaaaaccacacaccaatctcacttaggaatattgatgtaaaatgcctaagtaaaacagtattagagagaaccctttaaaaatggttttgagacaactggatagccatttggaaaaagataaaattttgtcgatatctttcatcatctacaagcatacatttcaaatgtctctaaataggtagttaccagaaaaactaccacaagaaaacatgggtaaattttaaaataacctgtgggtagggaaaattatgattcaaaatccaaaagcaatgtaaaaaagattgagaaatttggttgcattaggaaaaaaacaaaacaaaactgctttcgcatgatgggggagggacaccataagcaaagtgaaaaagccaggtaataaaccagtagaaaatatttgcatcttatatcacaaagctaattccttcaaaatatagattataacaagataccatttctcatgggccatattggcagagaggaaaaaactcaaaacaaaacaatacaagtttgatggcgccctctattggcgaggctgtggagcagccattcagattgctccacccctggaggaaacaggatgccttgggacttggtgcacctgcatagaccctgactcagccatgcctccttcctgaatttacctggaagacaatactccaaatccaaacatgctcatggcatatggagatcttaaattaataggtcctcttttatgtctttcaataaagtaacagatatgtttctatagaggtcttccatttttacattaaattgattcccaggtatgaaattttggctactgtcccagtggcagccctctggaaatgacctttgttgagtttgtgttttgacctggtatccagcaaccttgcttaacagtctgaagagcagcttggggcttttctctatggacagtatgtctcctgcatgtaatgacagttggctttcattcatccattgcaatcttcatcctttaatttctttttgttttcttacttctgtggttgggagtgacagaacagtgttaagcagaagcagttatactgcaaattcttgtcttattccttcttgtagggccatctctaatggtccaccatgaggtgtggagtttgctgtggacttgtggtagatcctcactttgttaaggaagtctccttctggtcctaatttgctaggagttttttctccctttaattgtgaatgcatgttgaactttatgaaatggtttttgggcatcaattgagatgatctgttaatgtgatgaattatgtgattgcgacaatagcttttctaatattacaccaagttgacatgcctgggataaacctgtatttcatcatgatatgtctcttaaaaattgctgggttcacttggctaatactttatttaggatgttttttcacctgtttataaatgagtttggcctataatttacctttcttattctgcctttcattggttttagtgtggagattatattagacccataacattcagcatctcatccttttctcttttggagagcaattaatataagactgaggtgatatgttcctcaatggtattgttaaaacttacctgtgacaccttctggttccagtgcattactagtggccagatttcaagtgactaattaaatttccttaacatttaaagtctattcacaatgaggaaataaaccttacctcatcagttggcttccttcaacactaccatttttcttctttcttgtgagtatgtgagccttagttcaggctgctataacaaaaatatcatagattagtttagagaacacacattcattcctcacagttctgaaggctgggaagtctaacgtcaaggggctggtgattcctggtgagggccctctgcttggtttgcagatggctgccttcttcctgtgctctcacatcggggagagagagagcatctctctcgtgacttttcttctcattcccattcatgagggcctaatttcttcccaaaggccccacattataatagcatcacattaaggattaggcttcaacctctgaatttgggaggagcacattcagcccttagcagaaccccacccccaagattttcctaagtgaatgaatagtcatcccccagccttgttcctggcctctaacagcattttagaaggaggtttctcatgactggggttggctgagatgggaatttcctgattccattggctgtgattcagccccatgccatcctgccagtaagatgaacacatgagtcatgctcagctgctagggtgcctggtgctgcttccagttcctctgggtgacctctgtccagcacataaacctcctgaagcattccgaatttgcggaaagtgagccaccctcccaatgtgtacatgtctgggcctaccttcctgctctcgtatgtgacaggcacacagcctttccagaaggtacctcattgcctagtacagaaatgctgaggttctcacaggagtgagaaccctactgactggctgttgtgtctctcccatacagtcgggtgtggagcagttggacccacatacctatctgcgcccatcctcagttgaaaggtagtgaacagcttgggctgtggactcaggcaggcctcggttcaaatcccagctctgccactcaggggctgtgtgtgcagataggctgcatctattgtccaaagccaaacatggggaaaaccaaacaatctctcaaaggggtgtggtgagggcttaggcaaaagactggtgtaccgtggctcggatggattagtttccattctccctctctctgtttccagctttcctctcactacaagatgagggccctgtccctcttgggcgtttgccaaaggaaggtctggacacccagcagctcattcatgtcgcttcccagtttgctgttaccatgttgcagtgcagaagccataagccgcatgatccgtgagcctggccctgcaacttggctcctccacacagcagcgtttgccttcattgtcacagatgactatgagaagatgcccttggtcatctttggtctgggctctggagttctgtagagctttgagccgccagagctaagggggtgaggcttgccccaggccggtggcacacccaggactgggcctggatgactttaatggtaggacagaaggaagagaaaggagctccccagagtccagctgctgggctgtgcagcccatttgcagtgtacttccaggagccttgatggtgaatgctgtaaaagggggaatctttcttccccacctttctttaaatcatagagctattgtgatggcttctgagctgcaatagaatcacccatgaggatttttgtttgttgtcttggcatgaagttcctgtcccttcacagtaatccggcaggtgcctcccagggcatggagtcattgtgtcacattcttctccaggactgcaggagggtgggcacagagttccacaacttgaaatgcagcagacagttgaaaggattctgctcacaccaggagttggattgtatttttccaaatgcattaagtattttaagcagcttgagctgcttaatgggcctgaaagcatttgattagtccaaagggctctatgcccggcaggtcaggggacaagaagttcttaaaatcctatgggtctgaccccttctgctctctctggctatctggctacaacgggtccccagggttgcagcaatagctgtgacctgcttatcttcccagaagtgctggaggcaagctgatccctgagcactgtgcctggagcactgcaggtgccctgcagccatctccatccacaccccctgcctggcctgccccgattccaggctgggcctcgggctcccctcccttcttcgtccccctcctcatctatctgtggctctttctctcgggccctaccaccaagccctctccttgccattctcttctgtccctcaagccgtattcctcagcatcacatggtcctcccgggtcccggtccactcctgtcatgtgagaacaaatggtgtctgctggaatttgcttcgggcctctgttgtgttttgagccaatgtgtgtggtcctcctaacgtcatttgattcatccggcaaaaggctctgctgcctgcctgtctggggcagagcttctaagaccctgtcagttttggacaatgaggcttccctgggggtgcagagtggtgaagctgtttggaatccttctcttgaggtggagtccagagtttcttcctgtcagttcctccccatttgtgtcagcagggtgctatgtccagcgcaggtcctcccctggcccctttctggccttgcagagtgcccccggccccgtgtgagcagatggccttctgggcggagcgtgcagtctcttggcagggcagccaagttgggggtgagatggacctagggctctctgaccccgtaggtttggcctaggctgagactctgagcaggtcacttacctctgggtcctcatgctcaggttcaaaatgagacagacagtggagttaagagatgatttttctgatccttctttgggtctttgcatcagttattttaaaaaaagagaaaagcaagccaacacaaccatcctcggctgattggtggagcagggcttacttatgtggctagttaaaagaaaatttatttttgaaagctgcatggagattttccgtaagcacagtaatgtgagccggggtcaaagctgtctttcagagacagggaagtgcagagatgttcaatgtaaattgtgccttttagctaaacacttggtagattcagcactggccgtgtaggtttgtcctgcttgttttgggggaaccagaaaagatctgattgaatttaatctgatttctgctagagtttggtcatgtaagatttgaaaaagtgaaccttcctgagccagagcaatcaggcaacaaagaaataaaaggcatccaaataagaaaagaagccaaactgtctgtcttcactgatgttatgattctatacatagaaaaccctaaagactttgccaaaaggctcctgtaactgataaacaacttcaataaagtttcaagatacaacatcaatgtagaaaagtcagtagcatttctctacaccaataatgttcaagctgagagccaaatcaggaacacaatcccatttacaatcgccacacacaaaaatacttaggactacagcgaaccaaggaggtgaaagaaatcagagatgacacaaacaaatggaaaaacattctatcctcatggattgaaagaatcaatattgttaaaatgaccatactgcccaaagcaattgacagattcagtgctcttcctatcaaactgccaaggccatttttcacagagctagaaaaaactattccaaaattaatatggaaccaaaacagagccagatagccaaagcaatctgagcaaaaagaaaagccagaggcaccaattaccaaacttcaaactatactacgaggctgcagtaaccaaaacagcatgggactgatacagaagcagacacacagagcagtggaaccgagtagagaacccagaaataaagccacacacctacaaccatctgccctttgacaaagctgccaaaaataagccatggggagaggactccctattcagtaaatggtgctgggatagctggctagccttatgcagaagaatgaaactggatccctaccttttaccatgtaaaaaatcaactcagttggattaaagattcaacctatgagaatcctagaagaaaacctagagaaacatcattctggatattggccttgggaaagaatttatgactaagtcctcaaaagcaattgcaacaaaaacaaaaatcaacaagtggaacctaattaactaaagagcttctgcacagcaaaagagtaaacagacaacctacagaatgggagaaaatacaaactatgcatccaacaaaagtctaatatcacaactctacaaggagcttaaacaattgaacaagcaagaaccaaataacctcgttaaaaattgggcaaaggacatgaacagacacttctcaaaagaaaacaggtaagaagccaacaagcatatgaaaaaatgctcaacatcactaatcatcagaagaatgcaaatcagtaccacagtgagataccatctcacatcagtcagaatggctatttttcaaaagcaaaaaaaataacagttgctggcaaggctctgaggaaaagggaactcttacacactattggtaggaatgtaaattattcagccaccttggaaagcagtttggagatttctcaaaggacttaaaacagaactacatttgacccagcaatcccattcctcagtatatttccaaaagaaaataaatcactctaccaaaaagacacatgcacttgtatgttcatcactgtggtattcacaagggcaaagacacataatcagtctaggtgcccatcagcagtggactagataaagaaattatggtacatatacaccatggaatactatggagccataaaaaagaacaaagtcatgtcctttacagcaacatagatgcagctggaggccattatcctaagcaaattaacacagaaacagaaaaccgaataccacatgttctcacttataagtgggagtcaaacattaggtactcataaagatggcaacagtagacaccaaggactactagagggcagagggtgacagcggggcaagggttgaaaactaactgttgggtactgtgcttgttacctggatgacgggattaatcataccccaaagcttagcatcacacaatatacccaggtaacaaacctgcacgtggactccctgaatgtaaaataaaggttgaaattagtcaaaaaataaggaaaagtgggccttccccgccccccacacttataaagagttaaggattttgtgtttattttaagccatgttgaactcagcccaacatattgacacaaggcaggacttagtgcagtgtcactaggctttaattttgttgccctttgggctaataaagtcaggttatctcactgggctgtttccttatccattaagacatttgatgtaactaagtacccatcctatggtgacataaactttttcttatgtcattggaaagtccagaatacctggttgcaggcaaggtttgatctagcagcttgaccttgttagcacaggtccagtttctttccctcagtcctccctggtattttatcagcttcatcctaaggctggttcagggaagatattctgatgatatatatttctgctttggcaatggaggatttatattcgattgtcagaagtcctcatgtcctatttaaagtctagtcattggaaaataggttgataaggatggacctgaagaaaataaagcagcaatttgtcatgacaaagcaagactaggaagaggcattggaccagcatgaccaattcaaggacacgttgatgatgtcttcagcgcaagtgttcttcccaagcttgggggacctggcagggctgcctacagggctggtgtccagcctgctctatagaaggcgaattagagatcgcaataacgggccagcttccatgatgaccccaggttgtagtgatgtctatgtagaaatgaaataaatgcataattaaaaccaaaggtaggcttgcatttgggttgaggtcctggcacctacggaggccacaagtgtgtcagggtggaaggtaacttggtgaaataggaagtcactgcctattgcccactcatgtccccactgatggagttagctgggggatcccctggtgcagaccctggagaggcatcactgtcttccttgttcagtgggcttgggtcacctgcatgaattctgaggttgggaaggtgtaaacatttccctcaacacctgcagcccagccgccgtctccctgggtgcttcagtcagccgtcacgttggggaggcgtcatgtaaggtggtccttgtctgagtagaacctgattttgaaaatgaaattcatttccttgccttcattttccagacgaaaagatatgtatttgtggtgtgtgtgtggcgggagagtaattggctttggttttgacaaggaggacaccagagtcctgttctgatactcagttttgggcccatgcgtgacaattctgtgtttcttttcagcatttgccaatacattattttctagagtctctcccagcatacggaaaaaccccaaattcaaatttgacttttctcttcgaggctggttgtggcatgctgaagctcccaaggcatgtaatgtagtgaacaaggtggcctccaggagcgctgtcggctcatgggccccacccacccacctcgcggtgtaggaggatccaccaagtcactgtcagagtgggttggagagacctggcctggggtcagctctgtgggcagatgggccctttcccccactgggtggagtacgctccttagtagcccaagacagaacattgccttctcccgagaaacccacctctggggaaggttaggccatgggatctgcgggaagggttttaggagtagattaatgggatttgtgatcccaagcacccaggccactctgtggtccccacccctgggcttgagtcctgctgaggtataagtggtgctagaagacctctgccctgccctgccctgccctgccccaggaacctggctttctctgggctaatgagtgtcctctctgaaggtatccagaggccgtgcagacactcacactttggtgtgaggcgtgccctcggttgatcagttacactgctgtggggtgcacaggtggcaaggtgggggattctgggatcggggaggctagtctgggtgtagggtcctgccctggaggggctcacagtggggttgaaagcaagctctcgaggcgttattattcgggactctgagtgccgggccatgctgggggagtgagggcagggggagctgcggaggcagggctctgagggctttagaacaagagccggtgtgtgtttcccactgagtacctgccggcacctcatttatgccacgtagcaaccccatgacataggcttataggggactataattatccccatttcacagctgggagaacctaggcttagtgtcacagaacctaggcttagccactgggtggctgatactgccacccagttctgagccagtatcagcttccagccccctgactcagtctctctgctgtggtttcctctcaagtgccaggatccttcctggtcccgtttccaactcagaccagtggaggggcgcgctgtggttaccactcattagaagagaggcagggtctctctgtctctctctgggtgtcccccactgccatctctgggtgctgggggagctgctgtatatctctctctgtctatccctatctctccctccactgccatctctgggggttgggagagctgctctgtctctctatctctctccccccccaccccactgccatctctggagtttgggggagctgctcgctctctctcccccctcccactgccatctctggaggttgggggagctgctctatctctctctctctctctctctctccccccactgccatctctgggggttggggggagctgctctctctctctctctctctctctccctctctccccctccgccaaccactgccgtctctggaggttgggggagctgcctgggatgcagagcggcttggattggtgctccctctgcctcagtggttgagctgacctctgtccagtctgtacacattggatcctgaggctgagcttgggtggctgtggcaggaaggtttggtgacatcacacccttcaggcttgtgtctgtctgagccaggctctgactggctgggagaagaggaggaggtggggttctgggaggccctgaggctgagcacggctgctgtgctctgtggctgcactgcaggggcacgggctcagcatgttctgggccagggcacacaatgctttcagatcaggctccagcaccccacacgccccttcatgctttgcactttttgtctaccagccagagggcagtgaataatgagaacaaacaacatcgggtccagattttcgtggtcattttcctaacaagccgaggtcagagagcactgaaaggaggcctaagtgcttctgccacctcagctgactgtttttcaaaaaggaaagcatgcgtgggatgtgtgtattaggtgttacggtgatgtctgttgtcagatcatggccagaaaaggggttgtttcaattaaaatggattttggacttcgtttttcttggaatgagtaaattgagggaaatagcacatgttgagattttggatttctgctcttagaaaggatttaaaataagtggtcttcagtagttccacagcggatcttcgagactggtacagatggggtctcctggatgtaacgagttcttgctgctttaactggatccggttgactctgtctgaccagctcagctggttcgttctatgaaacgcacttctgctttctggaatctgaaggaaggagagagatagaagacaaagaaggacagatgtgttggtggccagaccctggcttctgaacagtccttcctgatggcttcaggacctgggaggagcggcggagcaggtggctgccctgggcttgccagacacctccattccagcaagatcctcctgggggatgtggtgccctccctgcctctcaggcacaagcatatgcttgtttggcctaaaaaagtctccttaattaaaattaatatcgtaatgcagtaaatccttctgcctcctcttcccctgcccagttacaattcccggcggctctccagcccatagaggaggcttctcaaagtttcctgcctcctggaggagagaagccattccccgatcacccaaaaggacaaagtatgtgcccactctgcgtccttgcttgtcactgcccaacatctgcaaacattaactaaagtgctgagcccattcaggtgtaggactcactagttggttaatgtgacagacagcgtttcctgtgccagcgctggctggtcacttcctgtcatccagcactcttgagtgttgcagtggatgcctgtttcgtaggaacactcagcctgttccgtaagaaggagcgccacttctcagcctgtacttagcaggtcactactgttggccactctgcttttctttttaaaattttaattattaaaaaaattttttttgagagtttccctctgttgtccaagctgaagtgcagtggtatgatcttggctcactgtcacctctgcctccctagtagctgggattacaggtgtgtgccaccacgcctggctaatttttgtatttttagtagagacggggtttcaccatgttggccaggctggtcttgaactcctgacctcaggtgatctgcctgccttggcctcccagagtgttcggattacaggcatgagctactgctcctggtccccttcttatttttatgttagtctttggaaacaattggcatatattttagtctgtttaggttactgtaacaaaataccataaactaggtggtttacaaacaacagacatttatttctcacagttctggatgtgggaagtctaagatcaaggcgccaacagatttgctgtctggtgagggcttcctggttcatagaaggccatcttctcactacatcctcacttggtggaaggctcaggagagttctctggagtctcttttacaaaggcacaaatcccattaatcacctcccaaaggcccactgtctaatagcatcactttgggcattaggttttaacatgtgaatttggagaagggcaggcacaaacattcagtctgtagcagcatacaaaaatgtaacaagaataatgtgatgaacagctaggtatccacaagctgctaaaggtagagaatactaccatattggttacctatttctgtgtaacatattatgccaacacttagtggtataaaacagtaaacatttattatctcacacatagtctgtgggccaggaatatggaagcagctgagctgggtggttctagtggaggggaaagatgtgagctggggcacctgaaggcttgactggggcaggaggatccacgtccaagatcgacttcacctggctgttggctggcaagagggctcagttctttgccatatagacctttccacagagctgcttgagtgtcctcacaacatggcaggcggattcccccagcctcagtgattcaagagagagtatagagagagtagagaggaagccgctgtgccttttatgacctggtctcattagtcatacactgtcatttctgcttatgtctgttcactagaagcaagtcactaaattcaggccacactcaaagagaaaggaattaggttccactctttgaagggagtgtcaaagaatatgtggagagagatatatatatatatatatatatattcttttttttttttttttgagatggagtctcaccactctgtcacccaggctggagtgcagtgatgtgatctcagctcaccgcaacctccgcctgccaggttcaagtgattcttctgcctcagcctcccaagtagctggaatttacaggcacacaccaccacacctggctaatttgggtatttttaataaggcagggtttcactatgttggccaggctggtctcgaattcctgacctcaagtggtctgcccgcctcagcctcccaaagtgctgggattacaggcatgagccaccatgcccagcctgtggatgtattttaaagcatcataacaccattgcagctagagcccctccccagttgcatcttgtctttcacacagaggtaactactgttgaagtttgatccttgtttatggcctagtacatgtataagtatttctatccctgttagttctgcattttgtctgtaagcgttatgtaaatgatatcaccttgtatttttttctgtagtgtgcctttttttttttttgagatggagtcttgctctgttgcccaggctggagtgcagtggcgtgatctcggctcacggcaagctccacctcctgggttcaagcgattctcctacctcagcttcccgagtagctgggattacaggcgcccgccactgcacacagctaatttttgtatttttggtagagacgaggtttcgccatgttggccaggctggtctcgaactcctggcctcaagtgatccgcctaccttggcctcccaaaatgctaggattgcaggcctgagccaccgcgcccatccagtgtgccttttttgcttaacattatgtttgtgagattcatccatgtgaaaacaggtggctgtatttcatgcattttcactgctgtgtggtattgcattgtacaaacataagactatttgtcgttctccattgatggatgcttagttgggttcctgtgacttgctgctacaaacaaggttgtcttgagtactcaggtatgtgtctctctgtgaacgtgagctggatttgtcagtatatttagcaaggattggaattgctatgggagagagtacagtaatcttcaaacgtactagaaacagctaaattttattccaaagtgtgtgggtgtcctcatgagtggtcccactgacagcgtatgagtttcctcttctcctttttcttgacagcacttggtgttgtcagacattttacatttttgtctaatgcgtgaaagtgctgtctacatgaggtattaatttgcatttccctgcgtgccagtgaggctaacatctttccatgtatctattttcacatatatattttttcatatatttggtattctgtgaatgactggccatatcttttgcacctttttttctgttttcttattgatcaatctgatccgttgttgagtttatgtaccataaatatcttttttcttttcttccttctaacataatgtagaagctaagagtgtggattctggggccacattgccagggttaaatcccagcttcaacacttcctgtgtggccttaggcttagtctgtgtatgcctcagtgtcctcatctgcaaaatgggatgatggctccccacggtgggcctgggaggatgcgcaggttcgtatctgtgaatcagttagtgcctgtcatagtaagcacaagatagactaatgcaacctagtgtgctgggccctgtgtggccacacggggctgtatgcacaggcgtcaccatggccagagctggagctcagatgtgtctgagaagattggcagatgctgcttcactctggctcccggtctcctgggtggccctgcttccatccctgagctgcctgaacggaaaacgaaatcccatccccgctccagggggtgcctgggaattggaaggcatcaggctcctcacagcaaaaatagaagcctcatttgcttaggagagaacaatgacgaggaggcaagccagcagaggcggccttggcgggctgtgtacaccctctgcttgtctccgcactccctggggtcagacgtagacgtggctaagctgcctgcagaccttctcttccccttcatcctggcctgcagtgggcatcagggtccatcctgggacgtgggctgtcttggcaccaagttccagttcttaatacctcagtgtcacactgttccctgatttctcaaagccaggaaggaattgcagaaaacaaggtcagtttagtatcgagaatcactggagagccgtgtcagagccctgctgagaagggcgcggggaactgtgttcctgtctacctgatgctgtgggctgcacaaggacggacttactgaagattacaggccagggggaagagggcacgtttagtgtcaaccctacacagaagaagttagctccgctgggcgcggtgggcactttgggaggctgaggcgggtggatcacctgaggtcaggagttcaagaccagcctggccaacgtggcgaaactgcgtctttactaaaaatacaaaaattaacctgttgtggtggcatatgcctgtaatcccagctactcgggaggctgaggcgggagaattgcttgaacccggggtgggagaggttgcagtgagctgcactccagcctgggcaacggaaactccgtcttaaaaaaaaaaaaaaaaaagaacaagtcagctcagccccactgcaaggagctcctgggtttatttaagtgagcctcagataactttacataaaagcaaatgtgtaaaaagcgataaagtcagatatattgaacatttgtcctgagggcaaatttctgagctctaaaagccagtttggttttagataacatctgtgagtctggaaacaggctgagatactctatatctgcactcccaactctgcctttggctttgtgagccctgtggtctccttgaaagaattggtccccagtgggtgaactaatcacccatgaagagtctcccaattcaaatctggaataaaaagtgaggacatgggggcagaatgttactcatcacatgtggcccgtcagtactagacttcaaggtaagtttccaagaacagagctctgtgaccattttcatgatagcaatttgtacattattactaagtaattttaatgccgtgtttacaggccaccttcccaaacaaaacaattgtttctggaagttagactcttgaagacttaacttttaatccagtttgttctcaaaacatttgcacaaatgagagtcttgaggtttgagctttctattctaaaggctcagcttcttgcccaggagaaaaataatacatgctcgtgtttataaataagagttatggcattggagtcctttacattgcagccagcctagggactcagttattcagaatttaaacattttacttgtaaagagcactttggtatccaccccaagggccctcctctgcctgtctcagcaccatctctgtgtgtcccatcaggaagcaacagacaactccctaagccccacagtaaaaacgtctctcctggtctgggggcgcatccatcccccatgtccccagtcccatcctgggtgttctgggattccagccacagctgtggggacaccgccatctcactgcatccctcttgctcttgcggcagcttggctgagctacagggccgggccgcaggaggcgtccttgtgccggagctcaccttgtgccggagctcaccttgtgccaggtgttgagctctgccagctgcccggccccactgtgaggccgccccttgcaggtgagttcactggcagcccagccagcccacgaaggccatgtgagtgtgaacccccattacaagctttccctcatgagatggcgctgatcagtctgggggatacctgcctttcagtatgggctgcagccattaggctggtaccaggaggagccaggtcgagctggcactggggcgacgctctgtctttgatgcaccctgatgcctcccccatcctgctgaccatggtgctcagcacagaccccttccaacccatcccagggcctctgctcagtgtggccagagcctcctgtcaacaagtatgtcactgccttcgggttattattgttcaccagattccacttgctctacaacccaggcacagtgcaccagagtttcccaaacctgtgtgccgagtgccagccccttagcaagtgcagcgttgcccatttcactctgggaaatgcagccatagctctggggccagctagaggaaggagtgtgattgtgccttcccgggacagcttccaggtctgggagtctgtgatgttgtgagtgttgccttagctttgctaagaaaatgcttagggagatgggttccttcacccattcttccactcatgtgcctttctggctccagggctggtgtcccctgctttggaggggacgctcacatgagctgccctattggggttccgtcaagtttctcttagcctaagcggcttcctgtctcgggctccctccccagccatttgggtcaccttgggtccctgaggatcgcttctggatcttggaccccctcaccaactcctgtgacataataatcaaaggtaatcaggaaatgtatgaatcgtcttctttaaggaatatttagcatttctgctcattccagagtccctggaagcatggcatttcaaaggcttggttagatcacaagtccaatttactgccagaaatttgcacgtagaataatacagagcctatgatggcagttgaagtggtatcctgtgagaaaattaattagtcctgaaactaaatgccgacagcctcagcaaaatattcatgagagaagcaaacctcgtgcgtggtgtttgaagtcaggcagctgaggctgtgtactggacgtgttctctgtggctgagttctgctgtggattctgggctagtctaggcaaggcctgcctctccttctggactggctcccagggctgggggctcaggaaggccctgcaccctggagaagaagggagcccctgagactctttggccttgtatttgtgtgtccctctgggctgcagggctgcagaataaaccagctcccaatcctccaaacaaaaataaagacctgtgaatggctacacttggagagcagagtgttttgatatcatggggagacctgtgtacttaatttacggcctgaagattgagaaggatttaattgttccaaaaatggtgagaaaagagcaggtcccagcctttctgtctgatcacaaacagccgagggggactggggaagtggcctggtcctcactgcccctggaggggcaggaagaggatggagtgatgtgcttggcagatgcaggaatggccaggcagtgggaaaagcctagggtttccaagccatgtctgatcctctgtgttccttctgcctgctgggatggagcccgccccccaaatatgcctggctcacttacgactcagagtcagctgcccccagggacttcccggctctcgtgaccttgctgggcatgactttcaggggagccctctgtccaggagacataggtcactcgaatcacacagccgtgctttagtgaatgctagccaggggccctggagagggcaaggacaggacactcctgcatggaaacgaaaatgaatatttttctctgcagaaaatgaaaagtggtgctgggtccaagtggtaggtgacctggcttttgagcgaaaatgctgctgggaaatgagagaaaagaaacatgaaaagaatgcaaatgagggtggtggacaggggcccagaggcctgattcctccaccctccgcaaaggctgggtgtgtgatgcctataaatagacactcaaaacccgttctaaatggagtgaagacatgggcctgcttcctcttatggaaaggccttacataaggtgcagtgctgctattgctcctgggcggtgtgatgattctgtgcctttgtcggaagtcagtgtgaagcctgtggggcttctgggggatgcacatggatgagctctgggctttctggagactcgcagactctgggaaggaggcggtgggcgatgggcaggtctcctagggctgggaaacagtcctgagacaggctccgggtttcctgaggcgcttctgggccaggagcaagtgggaaaagctggactgcagggcttggtcaagtgacagctgcccagagccggagtttagggtgcctggagaggacaggggctggcaggcctgactttctcactgatccacttggggtcacagagccaacctgtaacagagtgaggaactgaggccgcattgctggactcccagtggaggattcttgctgctggactaacctttagttcatgaactcacccagaaattacttatttttggaggaccgcagatggcgagcttaggagtgaagaagggaatactatttgatgctaatgtgattccaggcaacattctagaggttcccttgcaattcaccttcccagccacctttgaagtagttattggccagttttatacacgatgaaactgacagagatggtgtgaagggattttctgacgttcacacaggaagcaagcagcccatgctgactccactgcggaaagcgtgtgtgtgattgacatgctttttgtgtggtgctcactttgggtgtgataaagaggcctccttgcaaagggccaggatctgtgaagcaccatgttgcttcacagaacaggccgtgaaaagccacagaagcaccatagcctgggaaagaaatggaacaacggtgcaaacagccagtttcccctgagcagaggcaagcaggttacggctctgcagctcccttaacgggtagcttgttcaacatggaaacatctttagcctcctcagagacgttgggtcatctcctttacatggggaccagaagtatcttccctgggccattttgggtggaggaaatttcgtaattataaccctctgctaggggtgtctacctaggaagtgagagcaactggccgctttcttagagaagtgaagacgctgagtagactaaacctttgtgatgaagtcgaagccactgtgttgcctgtgtcctgtttccttccccagtgaatggggctcttccctacgactgcagaccccaggaccagattgcaggtgccctgtccagcagcgcagccattcgtgaagggctcgcagcctggcccggctcaacagctgatgcccccgggaggaggctgtattactatcctttttgaaaggaacacagaaagccctttgtaactttgtctgtagccaacatggagggagaggcagaattcagatgtgatgttgcagacaattgaacacccctcctcctgttccaccccagcttcctgcccgtagccttctaatgcccttgccctgaattcctgatccaacccaagggcctggccttgaaacccccgagcctgctggcagtagcttcctcttcagccttcctgtgcagagcttcctctattcagggaagtctgagacctggtggcctctttctcattcttttcatgaaaccatcttgcccaggagaaggtgggctgagaccctgggcattggaaaggagaggtggtcctccttcctctcttcactttcatcgcagtcctctccccgcccacccccatatgcacaccctccgcagtctgaaagtgtcgtgaagcaccagctctgcaaacccgtggggtcaagctttgttgtgggaaaatacatattcatgagggctttgaggagcctcattaaaatgcagagagtctctcctttcagaatggtacataagccatctctttatttgcccaacacattgttcttaaggcaataattatgcgatgaatggctaaagaaacattttaattatttgtttagggtaatttctgattatctcattagaattataatctgtccacttttacaggtgattcaaagcctcatatttacatttttatacttgaaggagctctatgtgcgcacctgtatcattgctgaagtgaaagtaattttctctgttttcttctgctttattccagaaagatttgatcaccaggagatttttcgggacattaccaaaccactcattttaggtaagaaatacaaggcagcgttgcatggaatgaggttttgcttttgccatgtggggagcggaccgtttcactggagggaaaatgctacattgcaggcagagctggcaactgccgtggctctttgttttctgggatcctgtgtgtgtgagcttggggagtttgaagctggggtttgagtcacagccaaggagtggatggacactggggacgcttctggcacttaccttgcccggaaccgacctgcccaccacccaatgacaacacagcaagacacgcactccccatctgtcctctcctcattatactggtgtttctgtaaaccatggtcctcaccagactcagtcattgatttgtgtaacccctacctaggttcctagttacagcgaaagtagacacatgtatatcggcaataataggtagcactcgaacctttcactctccagtgtgggcagtggctggtctactttgagaagggaccagccattgtgagataccaggaagctgagcagaagaaatctaactttgataaaaagaggcctcctcatcttgccagggatggagcgtggtccatcctccctccctgtgcatggagcagtattgcagccctgaagacactgccccatggtcagcatctggcttgcccttgccctgtaggactggtaggaacagagccctggtgccagccgagtgttccacacaggggagacttgcaagggacaggttctgcactgcagatgaattggctgtcttcttctgtggctggagacacacaaggcagcggctttgtagggaaactggtgtacagggtggggcgtgtttggagaacgaggagcagagggcattgttgctggagttaaagaagcagagccagggatggtcttcatgtcctgatgcccagagcaggcctgagcttctgatggattctgggggttcttatgtattcttgggaaggagcatgtggtaagcttggacagggaggcagttcagagtgttacatgcaaggcagcggtggccttgggaacaccccccctgcctgaccaaggcaaggaacactttgtgtgtcccagtgtggaatctctgtgccagttgtgaggggacggatgaagaccagcaggggtgaggacgggattctggagtgtcaagactcaggttcagaatcacagtttttcttccagggcagcacaaggccacaagtgtggctatttgaagccacccaaaaagccattatttgtaaagcaaggcagctttattgatttcactttctgccctgcatctttcccacattgtggtaaccactcaccatccctgttctgctgatgaggcaggaattcccttgcatccagttggggagcattcttgtcacaaatgtcctggatgaattacacggtggctctccgtggagggagcacattcacaaggcatttaagagatgcaggacaatcagccctcgtccatgaaacagggtgaaacgtagaagagctgcgtgattattaatgggtttggacataagctggagtgtttactgaaatttttctcagttgtcagttttcaaagtttgtgaatgtacttttgtgctctcaacaggccttttctgctctatttaactttctacttagggttgtaaacatacttcagccgtaatgacattagatacatcatccactctcagctctgaaaatgctggagattttgattatcaccagcagtaaggacagcttatgaagggagatgttacttatggagacacagctcatgattccataaaattccagtcttctgggagcccagggttaagcagctgcctcagcccatccaccctctagggactgtccacggtgaaattggcttcttgacgttttccttatggaacctggggtgtcattacattctgttagagtcatagggtggttctatttatgcctgtaaggtataaggtatttttttcttctgagtctagaaaagacctactggaatttttatgtatcctgaaatactattagacgatcaaaatcaattgcaatagagaaggtgctgggctctcttcccaattgctctcacccatctgcagtgtaataggcctatcatgtaagtgaatatactcatcacaattctctgcagcttcccagcagaaaagcatattccttctcagagagaaaggcggcaaggagatggatatttttaaatgccaattatgccagaatgagtctctgtgaggagatctgtaaagagaagaaagggccggggtttatttatttttctgctgcgaatggaatcattctgtagcttcagaatactaatccctgtgatgtgcctgatgtcttttcataggataatttgtgaatgtgcttccacttacaggaaaagtttgaggctcttttcttattcttctttttcttttttttttttttttgagaattaaattctaggcctcactatatcctatgataaccgtcctataggccctcgatctataaaatgtgtgcataatgaaatatataaaatcagcgattatcctgaaggaacacagaaaagattaataagctgtatttaaatcacggcaagtctcagaacatatattaagttagaagacatcacgtcctgaaaatgacgggctgatgtgatactagcatgtacccccgtatggatgcatataaatgctgtgtaaaacctagcccaaagtgttctttaaaacctaagatccaaagaaaggcatggaaattccaagctatgagacatgaagagaaaacacaaagccagagcactaagggaggaggccatgagacccccaagcagtgaggttcctgatggagagccaggatgatgaagactgtgtgacatttgtgcagggagagacacggcaatggctgggacagggtagcaaggctaggagcaagtgctcatatgtataggaagccaggaggtggcagacgtgtgttatggaccaggtgggatgtgatgcaggacagctggttggccacataggaaaagagaaaagataaagtgagatccctacctcacagcacatgtaccagtaaacggccatagaattaaaggcctatgccgggcacggtggttcacacctgtaatcccagcattttgggaggccgaggtgggcagatcacctgaggtcgggagttcgagacgagcctggccaacatggcaaaaccccatctctactaaaaatataaaaaattagctgggtgtggtggcggacatctataatcccagctactcgggaggctgaggcaggagaattgcttgaacctggggggcggaggttgcagtgagcgagatcatgccactgcactccagcctgggtgacagaatgagactccatctcaaaaaaaaagaaaaaaaaaaaggccaaaatgtaaagacaaaaatgttaaaatacatagaagattttttctatctgctcttgaggtgggaaacatacacacatcataaaagaaaagatggattaatcaaacatcagtattagcaacttctttaagagaactacaggctggaataaatattcatgatgaatttactgtgagagatttgtattctgtttgtatcaagaactctttcaaattaattttaaaaagacaatagaattgaaaaatgagcaaatactatgaagaagaaaaaatgaaaatgtcaaatagacaaatgaactctgccttgctcctaatctgggaactgcctgggagaccatgagatgttggcaaattagaaagtctgataatcgaagggttgcccagagtgtgaagcaagggggccttcatgtcctgtttatcaagggcaagttagtaaacccctttagagaacaattaggtgttatctagtaaggttgaaatgtggatcccccatgacccagcaattctgctcatgaaagggattcagtgttgtattagtcagttctctcaaaaacagaaccaataggatcagtttatcttagagtttatgtatcgatcaatcgattgattggtcaattgatataaggtattggcttgcatgatatggcatctgggaagtctcacaatctgccatctgcaagctggagacccagggaagccagtattgtagtgcaaaggcctggaaagcagagaactggtgcagattccagtccaggccgaaaggcctgagaaccagcagcatggagggcagagaagaccaatgtcccagtcaagcagtcaggcagagagtgaattcaaccctcctctgctgttttgttctatgcaggtcctcactggagtggacgatgcccacctacactgaggagggccgtctgctttactcagtctgccaattccaatggtaaccgcttccagaaacacctcacagactatccagaaacagtgtttaaccagacgcatgggcaccttgtggcccagtcaggttgatacataaaattaaccatcacaagtgggtcacaaccagcgttttctaaaaatatgaaccagattagaacagaagatatcagagtttgttctgcatagtgaatgatagtgatcctgagaagggggactttgaggggatgggactgacagcgatggttaagcctgaatggaggtttgctacattgttttctatacttctatgtatttgcaaagttgaggagaaaagaagttgtggtaaacccctggatgtaggcacacggaccccagtgttctgtgctgtgggtccctctgatgcagccgtcttgctcccgtcttgctggttcatcctccaccttggctgactacctggcctcacccttgtacaggtgcttctgtttgtctcttcattgaaatgggtgggatttattgatttatttagagacagggtcttgctctattgcccaggctggagtgcagtggtctgatcatggcgcactgcaaccctgacctccagggctcaatcaaccctccctccttggcctcctgagtagcagggactacaggcatgtgccaccacacccagcttatttttatgtattgtttttatagaggtgggattttgccatgttgaccaggctggtcttgaactccttggcccctagaatgctaggattacaagtgtaagccatcattccctgtgtgaaatgagtaggatttctgaatgagccaggctttgcacattgacctggctctgcctcttgaactgctgccttcacatgggaggctccttctggccctgcctgtgtggctgattcctctctcaggtgcttctctttatcttcacagacgaggctcatgggcttcactttttgggaccttaggtggacatctgagtccacagccctcctgcctggcttctgtctctgtggatttgcaggcctgcttgtcccatatcctccagtgcccagcccagtgcctcatgtacagtggatgctcaagaagtgtgtagtcatcacatagctctagtttcttatttttatttttatttatttattttttttgagacagggtctcactctgtcacccaggctggagtgcagtggcatgatcataactcactgcagccttgaactgggctcaagcaatcttcccacctcagccccctgagtagctaggactacaggtgagtgccaccatgcccagctaattttaaaatcttttgtagagagggcatttcaccatattgttcagactggtctcgaactcctggcctcaagtggtcctcccacgtgggcctcccgcagtgctgggattacaggcatgagccactgcctctagactttagaaatgttcagaagctcaccttcccatctgcaaagtggagactcatgagttgggggcgggtagattgtgagaatgaaccacataatgaagaggggatgtgtagcacatgtgagttttcccatcttgctggtttccttccctggaagaggcaaagagaggacaaggagctggctgttactatttgcttgcagacttggtgtgtgctttcaaattggaagctcctgctctgacacccagttcttttttgttttaagttgtactttagaagagaaaaaaattcatcaacacccttttttttaaaagatggaaaatgggttaagaaagtagcacgaggaactgtgagcccaacataattagtgtgatgaaagagaagttagccatttctgtatgtaacttttgattaatgatattcagctctaattaattatgtccaattctaattaatgacattagtgtgcaagctggcattctcaaactatattctgaggattcccagcggatgttcttgaatataatagtccccggtcacattaggttgggaagtgctgtgtgtactgcccgtcttggacactcccaaagcaccatataaaaggccttcagaagtcctgcaagaaaaggaacaatttaaatttcttttaacctgtcatttcccagacttacttttaccatgtgtgctgctaggcacatacggacatgctaatttaactctcataccacaaggtgtgcttggatgaattgatgagcaatgtacatgtcatggagacgttttctaagtcttccagagtcatagcaggggtctcctgtatcgcagcagagcatactgcaaagaattgcatttccatacagtctagggctgctgtgaactaatctcctttcttgggcaaatcgcttaatctccttcaatcagttcatacatctgcagaggaaagggtgatggcatgccaccctggatggtgggaggactcctagcagtggtggctgttaccatctcataagaaaccctcattacaagaaagtccacgtcatttgccatgtgctggtctcggggggtcagcgagtggggggctgcagggagagaccaccagttacctcctgagcctcacgtgtggggtacactgtgttttgtccgttgttggatttgtattcattgttcatctaaaagtgattatgttgaaaaacagaatggtggcagacaggcatgtttggcatgggttaatgcgaggctggaaagagagcccctgaccttcagttcgagaatcagccactgcaggaaagggtggcgtcttggtggccgcatactgtgaatgtcaagggagacgaagagtgcaccctggggagggcggactcatcagtccagtgggttgtccaggagggagtgagggttgatctttcatctcgaaggatgaatatacatttctgcgagagagggggaagacgggcgttccaggcaaacaagcgtgtatatataactgaagcgtggacagaggaagcagcgtggctggtctgggaatggaattgtttgatctggcttgatggaggagctagggggtgaggtagaagaggtggcagaggccagcttgacctgtgtagatggcttgggagaagccctggcaggtctttgttggagggctgacaggaagggatatgtgctttccatagttgaccttggagggtgcggcatggggtggaggcccgtgcaccagaggctcctcatagagtctctacagagagatgaccaggctagcgttttcatggcatgaaggttgtcttcagaaactcgcttcacaatctacttaagatgagtcaaatctaccctccaaagaacatctgctgctactggagatagcgcttcaaaagctaatgcaggtgctgaatgtttttccaccatgagggttccttctgtgcatcaattagtctagactcttgctgtttgaggaaagaggctcagagtagttaagccactagctccaggtctcatagctggctgataggacatcaacctgcggagtctctatggaggtggaatagtttcagtggtgcactgaaacagtaggggatggataggagaaaggcttggtctattagtcaggttgagccagagaagcagtaagggatggatatgaggagatacattgtgaggaatctgcacacgtggttttgggacctggccaggcaagcctgaagcccgcagggcaggccatggggaagggcaggctggaactcccaggcatggctgcagctgcagtccacaggcagaatttcttcttcctgaaggaagccttggctctacttttaaggtctcctgacaaattgatccagacccagacagattgtctgggatgatctcctttctaaaagtcaactcattatggactttaatgacatggacagaagactttcacagcaacgtctggaagagtggctgattgcctagccaagtcagtacctcaaaaagaccacactcttgataacacgtgggggctccaggaccaaaagctggtgctgcagatgtgtggggtggcagcattgtcacttcctgtctcccactaacctcagggtcacagtgggctggtggctgtagcatgctccacacctgctctcagggatgctggagggagactgaggcccaggcttttgtcttagagacttgggatatgtctaggatcccttctaaaagccaagttctagatagaatctggcctttcagggttggagagaccccatgtggcttctgagcagacttccttcctgatctcagtcttggaagtgaaggtcttacccctggttgcccccttcctgtgacagagggctctttgcctctttgcactccatgccccagagacaatcagtgctggggacaattttgtcagaaatctattcccagccctagcttagcctagtggcactctcagtcctgaaagctagaggccatttccacattggtgtagcaccgtggttctcagactgtgtttgctatcaggatcacctggggaacttggtaaaaatacaaatgcaggtcatattctgcttcctccatcctgggcctctgtgttctttattagccttcttggtggttctgacctacatcaaagttgaggaccactggcataacgcacggctgctcgaactccagtgtgcgccggaatctcctggggatctcatttattttatttttattttttgagacggagaatcactcttgttgcccaggctggagtgcagtggcacgatctctgctcaccgtaccctccgcctcctgggttcaagcaattctcctgcctcagcctcccgagtagctgggattataggcacatgccaccacgcctgactaatttttgtatttttagtagagatggcgtttctccatgttggccaggctggtctcaaactcctgatctcaggtgatccacccgccttgggctctcaaagtgctggggttacaggcgtgagccatcacgcccggccagggaccttgtttaaatgcagattctgattccatggtttttggtggatcctgcgattttgtgtttctaacaaccccccaggtggtgcagttgcttctggtcctcaggccacatcttaaatagcaaaggcgtagataggggccgaaattaagcacttaagaattacccagacttgcatcggaattctgcctctaccacttaactgtctctgtgttaccctgagcagactgcttgatctctctaagccttgatttccttatctggacaatgggaataatgtgcctttttttttgtttttttgaggtagcacctctgtctgttgcctagcgtggagtgcagtgctgcaatctcagctcactgcagcctcaacctcctgggctcaagcggtcctcccaccttggtctcccgagtagctgggacctcaggcacacaccaccacacccagctaatttttaaatttttaattagagacagggtctcattgtgttgcccagactggtcttaaactcctgagctcgggcagtcctccctccttggcctccgaaagtgctgggattacaggcgtgagtcactgctcttgctgctttttaaataaaaactgctggccgggtgcagtggctcacgccagcaaattccagtgctttgggaggccaaggcaggtggatcacttgaggtcaggagttcaagaccatcctggccaacatggtgcaaccccatctctactaaaaatacaaaaattgcctgtcgtggtggcagacccctgtaatcccagctactcaggaggctgaggcaggagaatcacttaaacccaggaggcagaggttgcagtgagccgagatcatgccactgcactccaacctgggcaacagagcgagactctgtctcaaaataaataaataaataaataaataaatattgctttgacagttagaaaagaaagagtttaataccgcaacataataaagaccatacaggcaaagccaccagccaacagcatacccagtggtgaaaaattgcaaaggcttttcctcttaagatcagaaacaagacaaggatgccccctttcaccacttctatttaacatagtactagaaattctagccagaacaatttggcaagaaaaagaaatcagaggcatccaaattggaaaggaagaggtgaaattttctctcttttcacatgtcatggtcttatgcaatatgtagaaggccttaaagacttcacacgaaacacacaaagctgttataactaatacatgaattcagtaaagttgcaggatccaaaatcaacacacaaatatcagttgcatttctatacactaacagtgagcaatctggaaggggagttaagaaaaaaattccattaaccaaggaagcaaaaaaattgtacacagaaaactaccgaacattgctgagagaaattaaagaagacaccagtaaatggaaagacatggaatgtttttagattagaagacaatattgttaagatgtcaatactacctatattagtccattctcatgctgctaatacagacatactcgagactgggtaatttacaaaggaaagaggtttaatggactcacagttccacatggctggggaggcctgacaatcatggttgaagatgaaggaagagcaaagtcatgttttacatggcagcaggcaagagagcttgtgcaggggaactctcatttataaaaccatcagatctcatgagatttattcactaccacaagaacagtgtgggggaaccacccccatgatacagttatcgctacctggccccacccttgacgtgaggattattgcagttgagggcaagatttggcgtgggacatagccaaactatgtcatatccaaagcaatctacagattcattgcaatccctatcaaaatcccaatgatgctttttgtagaaataggaaaattcgtcctaaaattcttgtgcaatctcaagggaccctgaatagtaatagcaatcttaaaaagaaggacaaagttggcgatctcacacttcctaatttcaaaactagctacaaagctgtagtcatcaaaacaatgtagtagttgcataaagacagacatacagacgaaaggaattgagtagacagcccccaagtaaaccctgacatatatgggcaaatgattttttgacaaggatttcaaggtcattcagtggggaaaggatagtttcttcaaatggtgttggaaaaactgaaaacaatataaaaacaacacaagagaatacaaaaatcaactcaaaatagatcaaagacctgaacataagagctgagaccataaaactcagaagaaaacaggtgcacaacttcatgacattggatttggtagtgacttcttggatgtgacaccaaaggcacaggcagcaacaggaaaagataggtaagttggacttcatctaatataaaaacttcctcaaaggacacagtcagcagtgaaaaggcaacccaaggaatggacggaaatctttgtaattcatacatctgataaagggttaatagccagaatgtgtgaagaattcttagaatttaacataaaaagaagccacctgattaacaaacgaacaaagggcttgaataaacatttctccacagaagatagacacatggccagtaaacacagaaaaacatgctcagcatcacaaatcgttagagaattgcaagtcgaaatcacaagataccacctcatatctattaggccggctattacaaaacaaaacaaaacagaaaataagtgtctgtgaggatgtggcagaattggaacccttgtgcactttaggtgggaatgtaaatggtgcagcccgtcggaaaacagtatgacagttcctcaaaaaattgaaaatagaattgccgtggaatctaggcgtggtttcacttctgggcatatgcccaagggaagtaaaagcaggggctcaaggaaatatctgtacattcatgttcatgcagcatgattcacaatagtcaaggggtggaagcaacccaggagtccattggcagatgaatggatcaacaaaatgtggtgtatacatagaatggaatattattttgccttgaaaaggaaggaaattctgacacatgctataacatggatgaaccttgaaccttgaggtcattatgctaaatgaaggaagccagatagaatagcacagatcctgtgtggttccactgacatgaggtactcagaatagtcaaattcatggagacagaaagtagaatggtggttgccaggggctagaaggagagggaagggggttagtgtttaattaggacagaggttcagttttacaaagtgaaaagagttctggagatggatggtcatgatggtagcacagcagtgtgaatgtacttagtgtcactaagctgtattcttaaaaaggcttccaatggtaaatttatgttacgtgtattttaccacaatttttttttcttacaacggaaaggactcaacaccatatctagtaaaacacacactgaatgttgttattgaaagcatagatggcaggatcacttgagtccaggagttcgagaccagcctgggcaacactgggagactcccatctctacatagaattaaaataacagattagctaggtgtcctagctactcaggaggctgaagtgggagggtcctttgagcctggaagttcgaggctgcagtgagctgtgatcatatcactgcattccagcctaggtaacagagcgagatcccatctcagaacaacaacaaaaaacaaataaaaaaataaaagcacagagccagtcacagggacactccatacatatgaattctacccacagtcattcgtgcccctgagtgtctgccttcccaccattctctgggagttggtttccattccctcacctctcctgttctctctgacaaaggtaattgaaactatgtttctgttctttcagtatggccaggtgggaagctgttctctagtgtgagttaaccaggacagagggtgtgtatgtgcaggggagagaagccggcaggctcttcctcccagatgctggactatggaatgtgatactaacatggggatcctccccaagagccttggatcccctagtgcaccaaagtatcctactgagaaggcatcagaaaatctgactcacagaagttagggcagtgtttacagtaccatgacagcaggcagagcttggggttcaaagcagaatctgaggaaagactctaaaaagacgagcccctgcccaagatatggtgccttttctagtctcatagcacattgcaccccctcccctcactgtaacaatccacaccctcagaacgcgcacctggagttgttcatggagactaaagtgggaggaagctttggacagtcacctttttgaagtctgttttgaattgaacagtgtgcaaatgataagccacttattttaaaataagcttcttaattcaagtgtaatataaacagaaaagtacaaaaatcctaagtgtttattaccatgaatattttcaaagtgaacacatccatgaaactaccatccagactaggaaacaaaacatcaccacaacccaagaatctcccctagggtcctctcccagccataacccacccccgaccactaccaccaccacctaaaggtaatcagaatcctagcaccaaatgttatttttgcaaatgtttgaatttttttttaaataaatgaatttctacaatatatactgttttatgtcagcttattttatgcaacattatgtttgtgagagtcactcacaggtggtgtgacagtagttcattgactcactgttacagagcattgtaaaaatacaaataattcatccattctatgtttgatggacatttgcatcttttctagttttgggtcatgattgctgctgggaacactgttacacatttgttgtacacatgattgcatttctattgagggtacatccaggattggaatgggtaggtcacagggtctgggtatgtttctattttagtgaacactgccagtcctttttctgacgtgattgtacccaattacactcccacctgcaaataggagtttcatttgctccacatccttgctcataactggtggtgttagtcattttaatttgatttttagtggatgcatggtgggatcctctggtatgattttcagttcactgaagactgttgaatatctctttcgaatacttgtcttgtgcttttcgaaaccttctcttgaagtttttgtgcaagtttttgctcatttttctgttgcattttctttcttagtgctttgtaggagttctttttttgttttatgagatggagtctcgctctgtcgcccaggcttgagtgcagtggtgcgatctcagctcactgtaagcttcgcctcgtgggttcacgcccttctcctgcctcagcctcccaagtaggtaggactacaggcgcccgccaccagcccggctaattttttgtattttttagtagagacggggtttcaccgtgttagccaggatagtctcgatctcctgacctcgtgatccgcccaactcggcctcccaaagtgctgggattacaggtgcgagccaccacacccggccgggagttctttatatagttagtacctgagacctttgctagatgtacatattacaaatattttctcacactttctcacgttcagtggtatcttttgatgagaaggcccagattatcaatcttttcctttaaggttaatgctttttgtgccctgtttaggaaatctatgcatacctaagaacatgaaaacaacagcatatttattttttccagccattcttgttttctaatatatgattttagggttataaatagcctattaagcctgctttagctgtaatccactatttttaaaaattgtagtaaaaaaacacagcataaaatttaccatcttaaccatttttaagtgtacagttcggtagtgttaagtaaattcataatgttgtgaagcagatctctagaactttttcatcttgcgaatctgaacatctatacccattaaacagcaacttctcattctccttgccccagcctctgggagccaccattctactttccgactactctaggtacctcaagtggaatcctacagtttctgtctttttgtgactggcttattttgcttagtacagtgtcctcaaggttcatctgtgctgggttgtgtgataagattttctccctttttaaggctgaataatattatgtggtatgaatagaccacattttgtttatccatcatccatcgatagacattgggttgcttttattccttggccatgatgaatagtgctgctgtgaacatggctggctgtccagcaccatttttggatacgttgtatttttattattaattagttcaaaatctgttcactttttaaaatttctcctttgaaatgtgggttattttaaagtagttgatttccaaatgcctccatattttctggttatatttttgttatttatttctagcttgcttaccccgtagtcaggaacagattatttacaatgttaacattttgaaatttgtttacactggctttagacttgtccaccatatgattaattttgacagactatcccatgtgcccttgtgtgtagttcctcagttcagtactttcgatatattcatgaggaaaaatgggtaattgtggtgttcaaatcttatatttccattcttatttttacttctttgttatatcatttactgaaagaagtgtgttaaattatccagctgctcataatgtctgtgtctaatagacataaatttcataatgtctaatactttagatttgtcttattatagtcctgtcaattctccctttataaattttgagtgcatttaactagatacatataaatttagaatttattcctagtaggttgccctttttaattatgaattctttcttttccataagaatgctgcttttcgtaaaatctagtttgtctaattaccaatataggtatataaactttcttttttaacttactgctttagaatagttttagattcacagagatgttgcgaagatagtagagagttcccatacatcctgtacctacttttccctgttgttaacatctcacattagtatggtacatttgttacaattaatgaaccagtgccaatgcattattattaactgaagtccatacttcattcacattttcttagtttttatcaaatgtccttttgctgttccaggattctattaggagactgctttgagttcagttattatgtcgctttaggttcttttagactgtgacagttcctctgactttccttgtttctgatgaccttgacaattttgaagagtagtggtcaggtattctatagaatatctttaaatttgagtgtgcttggcatttttctcatggttcaataggggctatgggctttggggcagaagatcccatctgaaaaagtgccattcttatcctatcaaatcagggctacataatttatcactgctgatgttaccctcaatcgtctgagtgttatgcaccatctccatgagggaacagtatctacacaaattatttgcaattctgcacagggagattggtctgttctcactcatttattttctcattcatttatttatatttgtatggactcatggatattcattgtatactttgggctataaaccagtattgcattattaattttgttgttcagatagttccagcttttgccctttcctaagatagtggactcacccctctgtgtttcaactctaccaatttggaccctcaagttcttgttgccttattagccataaattgcaatttcttatttccccagtcctctgagactactgaaagttctgcttaggcctattgcctcttaaccactactttcttcctgtgtgtgtttttaaccttttggcttccatcactcacaaatccccaaatgccttgacgagaaaagcagcacagaatgctgagcttatttctgggtaattatctacttgtcatgatctcagcccctcaagtcctagctgccttggactctctgatgcttccacagagatcatttaaaaaaatttcgtcaagagtttctagttgttcttggtgagaggattagtctgacacaagctagtgcatcatagcaggcggtggaattcttcagacataatatttttttttacttcttctactatgtcatagttgatggtgcctcatggtattttaatatctgatgctttgcacccatacagcaactatcctgagtaacgaagatgttatgtcatataggaaaatgagtcattcttttttttttttttttttttttttgagacagagtcttgctctttcgcccaggccggactgcagtggcatgatctcggcttgctgcgagctccgcctcacgggttcacgccattctcctgcctcagcctcccaagtagctgggactacaggcgcccgccaccgcgcctggccaattttttgtattttttaagtagagacggggtttcaccgtgttagccaagatggtcttgatgtcctgacctcgtgatccacccacctcggcctcccaaagtgctgggattacaggcgtgagccaccgcccccggccgaaaatgagtcattctttgcatttcattcatttatgcccttagtcacaagggctttagcaaagaattggcttccaccctctctttaaggtaaggaaataaataatgaccttggaagacagtattcatcataaaagcgcttgatgaaaggagcaattggagtgaactatgtaaaacaggcttttcagtctaatgggacagtgtaattactggtgcagatttctagttaggccttaaagaaattaagcctccctatatggttaataatggacttgtgtaagaagattgcttcagagatgaagtttgtgattcacattagcatatttggcagtgaaagcgttacctttctcaatcaagcaggatatgtaagatctttgtgtatgcttttgctaaactttactgctgccatccctgaacttgacttgatatttttacatccccttcaagtctgcatcccagttttgtgtcatctacagttctgaagagctgccttgtgctttatcatcatccagggttgaaaagagccagatcattggagaatccccacagactgacagttttccctgaatcgatgcctgcttattgtgctcatgcaggtagctcctattccatctcacttcgctgcatgcagctcacatatttcagatgatccacaagaacattgggaaggacctgccaaaatcctgccttgctaaagtccaggtatactctcttccagatctcccttaactgcctttgcagattctatatcggagaaagaagtgaggctaatttcacaaacttattcttaccgaattcatttatagctctaataattaccacttttcttagatgtgatcccaaaacaatcctttaataaatgcattttagaactgcactgtccatagtggcagctacttgccatttaaatttaatttaaatgaattaaaatgaagcagacaaaaaatgcagtttctctattggactaaccatgtttcaagtgttcaatacctgccatattgggcagtgcagatagaacacttctatcattgcagaaatttctgttgaacagagctgttctaaaaccttgttttagaatcagatctgagctcacccgtctgcagattactcagtcatcatttgactgtttttttttttttttttttaaagagacagggtctcactttgttatccaggctggagtgcagtggtgccatcatagctcactgcagccttggactcctgagctcaagtgatcctcctgcctgtctcctgagtagctgggcctacaggtacatggcaccaggcctggacattatttaagtctttaagaaacatctacatgtgttttttcctgtcacctctctttttctccatttccttcaaaatcaccttgaaggcgactccatttctgtattgcccaaatcagtctacagtgtaggtgttggatgtggactttttttttggtttctaatgaggttgtgttgcagatgagctgaagccacctttgatattctaggatttgtgcctgaagaatagcgctttctgtcttgctgatgtttatatgactgctatgattgtcaagggaaataaggagaaatgaatgggatccacgttgcttggcccagcatacctgtttctgagtgctgttggagctgagaggcatgctcttggagaatcagccatcaagctgtcttttccagagtggatgttgtccagggcagttgcagagtgagcacactgtcaatgagtgcctggggtccttcatttatttctttacagcatctgtagtagaataaaattccagtgttaagagacaaaaaaaatgtgcccagctctcctggggttgacagtctcagttggtaaatcccatcccaagggggcagctcctctcctgtctgtggtttgcctgctgtcccccaggagccacactcaccagtttggtcagctggcagatgataagagggagagaatcttttagaaaacagatcctggagatcattgttagtggagaacttattatcaagtcaggaagaagaaaaatcattgttagttgagtgaatacattttaaaaaatgataaagtgttcgtcaggcacttgggatttcttgctcatatgctaataggatttttgaaaatccactcactgtttggaaacttgcttgctcagtgacaactgcatccaaatagcagatcatgagccaggtttgtggggggacaagagtgaagggagttcggaggaagtcgctctgggccaggaggcagggaccctggccaccagccatgtgacccggggcagatccttgcagtgctgggccttggttttggccactgccccctggccccccacttcccagaattattgtgaggaactgtgcgtgtatgtgcaggaactgggttaacatatctacttatggttggccgggcgcggtggctcacgcttgtaatcccagcactttgggaggccaaggcgggcggatcacaaggtcaagagatcgagaccatcctggccaacatggtgaaaccctgtctctactacaaacacaaaaattagctgggcattgtggcgcatgcctgtgatcccagctacttgggaggctgagacaggagaatcacatgaaccagggagtcgaaggttgcagtgagctgatatggcgccactgcactccagcctggagacagagtgagactcagtctcaaaaaacaaacaaacaagcagacaaacaaacatatctacctctggtcaacacagaaacaaggtaagcttttgttatcccctttgatagacaaagcaacagagcttaatgagcatgcatgtcacaaggaagcacaaattcacgcttattatttttatgggaagacccctcacttcctggtcctgatgttctctgtgggacctttggtgagtcagggaaggcctcacagtatggagacaacagtcccagcctctgacttgcaggagtgtggggactaagtgacactggaagtgtgctgcacacgtgcaggcctggattattaggagggaaggttagaaatcaagagccaggggaaaactgggaatagctggctggcttttcagaagggagtcattattttgtgcaccttgcaactcaggcagtgagcctggcggggaaagagaaatggctgctctttttttctgtccatgtgtcaccccctgtcagtgtgttactgggtgcaggtgtctcctctgatggtgtctgggcttttctttcccctcccttccttctttgcctgcttctcctttgctcctctgtctccgtttctctctccctgcattttgtctctttctattccttctttcttccttttttatcttcagattttaacctgttcctttcatcaaatgatgcttattaaatacatttggtgatttatatttttgtttctaagaaagctgatcaaaataactgtgtaagttcagtccgtgaaaagacaataatgatgacaggcaggcagcgctttggaggaaggagggttgggtcccgggtacccctgattcggtgggtgtttgtgcatagagtggtacctgcctgcttgaggataggaggctttgcagcttgaggtccttgctccctggtgtggggcatctgaagggctgtggtgggaagagggtcagaaccaaggccagatgcacccggagcttgctgcacgcacttctgggaggtttcctcttattttctctattttaatttctccattttctcttttctctctttcctctctttctggaattcccatctatctgatttttgacctattcattctatctttgaagtctctcttttctttcatatttttccatcttcttttctttctttctttttttttttttttttttttgagatggaatctctctctgttgcccactgcaacctccacctcctaggttcaagcaattctcctgcctcagcgtccagagtagctgggattacaggagcccgccactgcgcccggctaatttttgtgtttttagtagagacagcaatttcaccatgttggccaggctggtcttgaactcctgacctcaagtgatccgtccaccctggcctcccaaagtgctgggattacaggcatgcgccaatgtgcccggcaccatcttcttttctttccgttctgttttctgggatagttcaacgactttaaatacccatattgaaatgtttatgcttgctcttactttggctctctgagggctctttctattctttcgtcatttcttattttgtagcactgtatctttgtgtttctgcggcaatatcttcttctatttatttaaaggtattaatttgttattttgtttcttttttgacaattacttctgtttccttcactatcttttttcctttgctgtccttgtacttgcttgcctggattttcttcttcctgtttgagaccttcctcccagatctgtgagccgtggttgttaattcgcattgagaagtgaagcactgaaaattgactggagtgtctgcaacgtggctgcacattagcatcacctggaagcattaaaaactacctctcccgggggacagtctcagggccattggatgaagatctgttagattggggtctgcatattgataggttgataaataaagatattgatagagatcggtaggtagaaatacagattttccctcctcagcaattctaatgtgcaagcagggctgagcgttgtatagtcttgggtgacagtgccgggcctctggagagttggtataattaccgtgcagcgaaaccactctgcgttttactgtgccgggtgcctggaagactttgattgcatccatatgattctttttctgtacctctggcaaattgcagattgggaggaattatatatccctacagagacttcagtgaatgaagtttcagggacctatgagcaagaaggatgaactggcttcccggggaggggccagcagtccttctgccagacaagtcatcagggctgggacaggaagcatgggaagggcagctgtgcagagcaggatccaggaggggccacctggtggcaggtgtggccactgagcagcccctggctagggatggagctggagctgccagggaagctttgaggccaggtaacttggctcttgggctctcatgaagccaactgttcctctcccaagctctgagaaaacagtggagtcctggagtgacaggatatggtagctccataaggaggaggaacctgtagttggaggggcaacaccaggaggccagtgagcgatactctgtacctgagagaggtggccggaacctgggcccccacttgctgccagtgaccttgcacctgccacaccttctcttggagttttggcttctttaactgggacatgaggatcctgaccatctctgccaagcaggagaggaaatgggctgatgtgtgttgtgaggcagtagagactggggcataggaagcaaattgactctcagagtttatggtataaccttctcccacgctgtagggatcaggtttgcccctaaacctgcagactggctaaggccagggctggaaagggaaaaaagtaagcagaggacaggtcatgctgcaggccggcccctcacccctggtgacttgtgctcttggagtgagggcccaggagggggttgcctgcctatgcgtgtctctccctttccccctcctgttctgtggggctgggcctcacacggccattcttcgaaggaggaaggtggccttttgcattccctgttggtgtgttacttattgtcacttatttttgattaaggatattatatttagggagaaattatttgcattttctttgtaaatcatctgaagaattgtgcaacacaggagtgcattcgggaagaaaattcagacatcagagataaagcagagttctcccttggctgcatctacaaccttcctctccctagagaaccactctgtggttagtgtgttttccttcattatcttatataagcatttatgcatgtgtagatgtagatggctgtgttttgtttttatgcacatagaaggtatctgtgcattgttctgctgccggagttgttcagaacatggtattgtggagaaccacatgactgtacacacaggtctatcttagagacctgcctcatttgctttaactgctgcagaggcttccagggaccgtgtgtacagtactagatactgtttaatgaacactttcctactgatgaacatttaggttgtttcctaatgtttgctgtcacaaacagtgatgctggtgggttaatgcttctctaggggagagagcaagaagcagaagtgctggctgtcatctgcattctgcagtttaccagatactgtcaggttcccttcccaaatggctacagagtggtttggtccctgcagtgtcatcagttcccgacattataactttgcagatgtgatagggagaaaatctccattttattttttcatttcctggattatttgtgaagtcaagtatatttgcctgtgtttactggcacatgtattttctctttggtcaatttcccttttgtaatttttgctcagtttcccatggggttattcgtctttttcttattgatatctaggaaggtcacacgttcatgtgagtgtttgggtgtgtgggtatacaagcaaaaaaaggtttaatacatcctggatgctcattctttgatacatttacttcgactattttcttccagtctgttgtcttctgttttaggtgttttttttttttctcatccaggtttaaacattgtttattgttgtagctaaataattcactttatttagggattataagaaaatgtagaaagtaaatttgcattcttttcctttttcttagtattatgaaacttatttcttttttaaaaaaccagtctgttgaggtaagattgccatataaaagctgtacacattttttttttccagtgacttttttaaaaaatatatttaaaaacaaaaccggccgggtgctgtggctcacgcccgtaatcccagcactttgagaggccgagaggggtggatcacctgaggtcaggagtttgagaccagcctgaccaacatggtgaaacccggtctctactaaaaatacaaaaaaaaattagctgggtgtggtggcatgtacctgtaatcccagctactcgggaggctggggcaggagaattgcttgaacccgggaggcagaggttgcaatgagctgagatcatgccattgcactccagcctgggcaacaagagtgagactccatctcaaaaaacaaaagacaaaacgacctcctcccaaataacccccaaacaaacaaaaaaccagattaaataaaatttacagtgaatatacccagcaaacatttgtatgtgcaattcaatactgtgtctgttactgcggcacgaacctcagacaatatataagcgttctggggggtcgggagagtcccaagttttaactctgtggggtctaggaagacaagatggggaagtgagagaatggggaaatccgttttgtttatcttaattctttccatataaatatattcataaagaccaaaaaggaaaggaagcttgggatgttaaggtaataggagaataggagagtgtgggactttcccaattctgactgaccaaaaaatatgaaaggaattaattttatggtgggagaagagatttaaaaaataaaaaaaagaggatgggggccaggcacagtggctcatgcctgtaatcccagcactttgggaagccaaggcgggcggatcacctgaggtcaggagttgagaccagcctggccaacatggtgaaaccccgtctctactaaaaatacaaaaattagctgggcatggtggcgcgcgcctgtagtgccagctactcgggaggctgaggcaggagaatcacttgaacccaggagccacaggttgcagtgagccaagatcatgccactgcactccaaaaagctgtacatatttaatgtacaactttgtgagtttagagcgaagccaacccccatgaaaccattgccacagcgtgtgccgtaaacagatccatcacctgctcacgtttcctcctgcctactttattacgatgatgatgatttgtgatgagaaactcaacagaagatccaccttctcagcagatttttaactgtacaatacagtgttgttagctgtaggcactgtgctttatagtaaatctccagaacttactcagctcggacagctgataccgtgtaccctcggcccagcatctttccacttcccctacccccagctcctggaaacccccattctactctctgcttctatgagttgactttttaagattctgaatataagtgagatcatgcggtatttatctttctgtgcctggcctatttcacttaatgtcctccagtttcatccgtgtggctgtacatggcaggatttccttctttttaaaagccgaataacactccattgtaagtgtataccatgttttctttatctgttcatccctcaaaggacatttagattattcacatatcttgggtattgtgaataatgccgcagtgagcgtgggagtgcagacttctctctgaaataccgatttcagttcctttggatgtatgcccagcagtaggattgctggatcattcggaagttctatttttaattttttgaggaacctccatactattttccataatagtgataccaatttgtattcctatcaacagtgcacaaggattttcttttctgcacattctcaccaacgcttcttatctttcatccttttgatactagccattcttacaggtaatagtgtgttttgcatttccccgattggtcttttccttgatgattttttattgtcttatttaagaagggcttccttatactgagtatctaacattttagagtcacctattttacaataagtctttagtccccttgaaatttatttttgtgaatagcgtaactcagggatatatatatagcttttaaaaaatgagttgcaaagtttataacccattccccccaccagctgatttgacatgttacctttatcatatggtaaatcattatagatgatgagttgttctggactgtcttctgctggtctatttgtatactctcgtggaataaaaaattctatggttttatatccttcattgttcttctagagtgtttctgcaattgtttcctctgccatctgaattttattattctcattggaggttcttttggaattgcactgactttctaagttgatttggaccaaattaaaatacttaaaattgaaatatttactatattaaaatgcagtattatttgtttttatctgggaatgtagtgtatttttttcttgaaagttttgtacacttttgttatgttctttccctatatgctttatagttttgttgctattgtgtatgaaatattttttattattacattttctatttggttgttgctggtgcttaggagagccattgatttatgtgttaaactcatacctggccaccttgctaaacctttttcttagtcctaataattcgtccgttgattctcttggttttctataaagacaggaatattgtctgaaaaaaatgcctccttcttcccctcttccttctcaaactgtacacctcttgagatgtctctttgtgtttgtacttctaggtagggtaaccagccccagactgaaaggtgacagtgatagcagccttcctaatcttgtccctaaatttacaggggatacttttatggcgtcactataaaatgagatgttttgctgcacttggctgataaatatcctttatcaagttaagggagtttgcttcttggtctaccttttaaggtttattttaaatcaggaatgggttgtcgaatttgatggccattatacctttttccttttttttttttttttttttttttttttttttgagacagagtcttgctctgttgcctaggctggagtgtagtggcgcgatcttggctcactgcaacctctgtctccgaggttcaagcgattctcctgcctcagcctcccgagtaactgtgaatacaggcgtccgcccccatgcttgactaatttttgtatttttagtagagatggagttttgccatgttggccaggctggtcttgaactcctgacctcaagtgatccacctgcctcagcctcccaaagtgctgggattataggcatgagccaccacacttggccccattttatacctttttcatggaagtaaacattttctaattcacaataaaagagaaaaaagtataataaacacaacatatccattgccatatttgcttagatttgttgttagcattttattatatttgctacttctttcctttttgtcgattttttttttttttttgagatacagtctcgctctgttgcccaggctggagtacagtggcatgatctcggctcactgcaacctccacctcccaagttcaagcgattcttctgcctcagcctcctgagtagctgggattacaggtgcatgccaccatgcctggctaatttttgtatttttagtagagacggggtttcaccatgttagccaggctggtctcgaactgctgacctcaagtgacccacccacctcagcctcccaaagtgctagaattataggcacaagccactgtgcccggccttttttgctgaagttttaaaagttgtagccatcattatttggccatataagttcagcgtgcactttaaaaataagcacatcttcctacatttccacgagaccattatcatagtaacagcattcacagtaattcattgataacatttaatacccagtctatggtaaacactctccagttgttaccagaatgtcctctacagctggtttctttaccagggcctggtcactgcggagacagcactgtgggccctgatgtctccactccttctctaactggaatgcaccctcttcctttttgttccattacacctctctattgcagagactcacgtggaccagctgtcctgcatcaaatcccatcttcagcgttcgtctgattgctttctgggctagcatttaacttttctctctagctcttgcgcttcttgtaaatgggaatttcagtccaaaggcttgtgtgtttttgctgtgaaacaacagcagaatctcataggacgagaatttttcttcctgtttgtaggcagggtcagcaaaagggcaggtttgttcaggttgcaggtctgctggggtagctctgcctgacatgtttattctgagacccaaactagagggtaggggctgcatggggctcgtgttgcccatggtgagtcagaggaacacaggaggagcggatggaagcaggagatggcctgaggtatagccttggggcttgcaggtggacggttcccattccactgtcgagtatcaatggagtgggcagtgtgcttgtcccatggaggaggaaggggtatttgctgaatgattaaatccaacccaccaaagcatgtttagattcagactaaaagttcttggcaagaatacttcataagcggtggtgtatgcattctattgcagcatgtcacaattcacatgtaatacgtggttgtctcattagcaactgatctgactagttaccatttattaataagatgctgtgctgaacttctgttaacctcaaaaggggaaagcaccaggttcaaggctgaagaagagacccagagccaggaaacaagaattgggattttttttttttttttttttgagatggaatcttgttctgtcgcccaggctggcatgcagtggcgccatcttagctcactgcagtctccgccacctgggttcaagcaattttcctgtctcagcctcctgagcagctgggactacaggcacgtgccaccctgcccagctaatttttttgtaatttttagtagagacaggttttcaccgtgttagccaggatggtctcgattcgatctcttgaccttgtgatccgcctgcctcggcctcccagagtgctgggattacaggcgtgaggcactgcgcctggccaagacttgggattttattaggggcctgcatacaggggagacggatggtggtggattggaccagagaaccgccttatgtacagagatggtccagtgatgggctgggcgtggtggctcacgcctataatcccagcaatttgcgaggccgaggcgggcagatcacctgaggtcaggagttcgaggccaggctggccaccgtggtgaaaccccatctctgcaaaaatacaaaaattagccaggcgtggtggtgggtgcctgtaatcccagctactcgggaggctgaggcaggagaattgcttgaacccgggaggcagaggttgcagtgagccaagatcgtgccactgcactccagcctgggcgacagagcaagactccgactcaaaaaaaaaaaaaaagaaaagaaatggcccagagatggcgggctggataacatatcggccttcctgcagtcttgtggcagtgggctgggcaggaaagctgcaacttcttgccaactttatgcagtttatttagcatttctacttaacaccctcctcttaatgacccctacccagcaaccttcatttaccccaaaactcagggcctcaatgccctgtatggcccgtgttccataggatgttccaggggctcaaatgttcctcatagacaaggaacgaatctctgggttggccacacctgattccccagctcagagcacacactcaggtgcatctgccatacagggtccttctgagggtaggttcaagttatcgctgtcaggtgcatttaccctacagctggtgacagcttgagtcttcttttataaagtttcttatgcttgagactgacaagaaatctgtggctagttctttggcaccatgtatatgaacggccagttaaccctctgttatccattggtgatcctggcctgaatcagttaattcattagttgttgcaaattggtggtttcacaattctctcatactgttttcatttattagctgttattcttctgtaaagaagagattttccttatcacctggagctgttagaccaccctgaaatacagtatcgttagaacaggccgggcatggtggctcacgcctgtaatcccagcactttgggaggctgaggtgagcggatcacgaggtcaggagatcaagaccatcctatctaacaaggtgaaaccccgtctctactgaaaatacagaaaaaaaaaaaattagctgggcatggtgttgggcgcccatactcccagctactcatgaggctgaggcaggagaatggtgtgaagccaggaggcggagcttgcagtgagccgagatcctgccactgcactccagcctgggcgacagagcaagactctgtctcaaaaaaacaagaacaaaaaaaaccaaatccttatttctcttcaattgttaattttcagaataagaagttggcaatagccaattttaatggtatgatacattctcagggtgtgccatcttcccctttatgatataaaccatttttggtcatgacgtgttagtttttaatgctaatagtgaacctatttgttaaagtttgaggtaagatctttgcctctctcatgttggagactagtttgtgcttatcctttcataaaataaattgcttcagctttccatctcttttttgagatgtgacatcatggtaatctattccttgaaaatgtaataaaacgtgtttgtcaattcatctcggtctggcctttattaggttaccttgttattttaaaatatcttctatagctattcagtttttctacttattgagccaattgtggtaatttatattttcttagaaaatcttacatttcattcagttagatttgcaaattcattggcataaagttctgaaaagtattctcataattttataaatttttctgcatctgtaattatgggcttttcagttctaatgtttgtgttttctttctttttcttgatttgtcttatgatatgtattctttttatactgggccaactttcaattaattactgtcttaattttttttagtcttttatcttttttttctttttttttctttttgaggcagtcttgctctgttgcccaggctggagtgcagtggtgtgatctcagctcactgcagcctccgcctcccgggttcccgcattctcctgcctcagcccaccgagtagctgggactacaggcgcctgccaccacgcctggctaattttttgtatttttcgtagagatggggtttcaccgtgttagccaggatggtctcgatctcctgacctcatgatccgcccaccttgaagcctcccaaagtgctgggattacaggcgtgagccaccgtgcccggcctagtcttatatttttctaattccttcattttgattttcacttttatttcttagacttattttatacattaacactcttttcgtttttttttttaatttaatttttaagttttggggtacatgtgcaggatgtgcagcaggtttgttaggccggtaaacgtgtgccatggtggtttgctgcacctatcaacccatcaccgaggtattaagccccacatgcataagctgtttttcctaatgttctccctcccccgatcccacccctgacaggccccagtgtttgttgttcccctccctgtgtccatgttttctcagtgttcagctcccacttataagtgagaacatgtgatgtttggttttctgttcctttgtcagtttgctgaggataatggcttccagttccatccatgtttctgcaaaggatatgatgtcattcctttgtatggctgcatagtattccatggtatgtatatatgtaccacagtttctttatccagtctttcattgatgggcatttgggttgattccatgtctttgctattgtgaatagtgctgcagtgaacataggggtgcatgtatctttgtaacagaatgatttattttcctttgagcctataaaccagtaatgggatcactgggtcaaatggtatttctggttatagatctttgaggagtcaccacactgtcttccacagtggttgaactaacttgcattcccaccaacagtatacaagcattcctatttccccgaaacctcgccagcatttgttgtttcttgactttttaataatcaccatcctgactggcatgaggtggtatctcattgtggttttgatttgcatttctctaatgatcagtgatgttgagctttttttcatatgtttgatggccacataaatctcttcttttgagaagtgtctgttcatgttctttgcctgctttttaatggggttgtttgggttttttttcttgtaaatttaagttccttgtagattcttgatactagacctttgccaggtggctagattgcaaaaattttctcccactctgtgggttgcctgtttgctgtgatgatagtttcttttgctgtgcagaagctctttagtttaattagttcccatttgtcaatttttgcttttgatgcagttgcttttggcgatttcataatgaaatctttgctggtgcctatgtcctgaatggtattgtctagattttcttctagggtttttatagttttgggttttacatttaagtctttaatccatcttgagttaatttttgtatgaggtgtaaggaaggggtccagtttcaattttttgcatatagctagccacttcttccagcaccacttacaaacagggaatcctttccccattgcttgtttttgtcaggtctgttgaagatcagatgacattaacccacttttctaccaaaaaaaaaaaacccctctgtagtaaatgtgtatatttcctaatgagtactaatttggccatatcccctagttgtgatatctaattttttgttcatgtctaaaaatacatcatttacattttgaatgctttctaagcctcagttatttaatgtttaagaatttcccaggcatgtcatattttgttttgtttttgttctttaactatctttgtagcagtctgggtccactcaggagatgggaaccccagggggagcatcatatttaatagaattattaggtatgatgagagagtagctgttaagaggtggaagttctgtgtggtatcgtgggggtggagggagggggacctaagcaggggcagacctgggaaagccccagggaaggaccagcttgttagggaaggtgtggttcagcagtggagagcagggacagccgctggttcaggcagtccagcactggtctagagatgctgttggtcacaataggccaccctctggagtacaggctggggagcagtggcttgaggctgggcctgcggtgtgagttcgggcaccagcacgtccagaggtgccggacatgcagaaggaacgattgctcaacgcaggactctccagaccacgcgggctacatggggtttgtcgagggagtccagaggtggctggccatgtggagctctgggttcgaggcccaacaggtgtggccccaacaaggctgcagggttgcagaagaactaggtgcctctgtggcctgagccgggaactgcgggaaccgttttcctccagcaatgttgctccatcaccctctgcccagaaagcttaatgtgctcactctaaaggagaaacatgaccgggcccggtggctcacgcctgtaatcccagcactttggaaggcagaggcaggcggatcacgaaatcgggggatagagatcatcctggctaacatggtgaaaccccgtctctactaaaaatacttaaaaaaattagccgggcgtgatggcgggtgcctatagtcccagctactcgggaggctgaggcaggagaatggcgtgaacccgggaggcggagcttgcagtgagccgagatggccccactgcactctagcctgggccacagagccagactccgtctcaaaaaaataaaaataaataaataataataataataataaaataaaggagaaacgcttaagggaattctgtttattcagagaacatattgaggggtacattcagaattgggaggcaatgaattgataactgacacaacctttttgtcattcctttctaattgtcccattgtagtcagtgggtgtagccagtacagattctttgtagaatgtcacatttcttttgtggcctaatgctacataggcagttttggttaaacccatgtgagtatgtgtgtgtgtgtgtgtgtgtgtgtgtgtgtgtgtaaaacctccgccttctctatttgttaggtacggggttctaaataaatcttattgttatttaaatttttatatcccatctcatttttgtctggttaatttgattttaatctctcaatatgaatgtggctattaatttcaccttttatcattatttgcttggtttatattttgaagctatgttgtgaagtttataaaggtacatgatgctcttggtggattatttttgttattaatgggaatttttccttttatgcctttgcatactttgttgtttacattcattttgtctgattaatattgccatatgagccttctttttattagcacttgtctggtgtatcttttcctatacttttatttttagcagtcttcgtgccatttttttcaggtgtcatcagaagagactaagcaactcatggcttaattttctaaaataatctgaaaatctatgtttttcaacagatggactaaaagagagtataaagagcactgcattcatttgctcaggctgcggtaacaaaacacagacttggtgtcggaatccatagaaatgtattgcctcacagttctggaggctgggagtccaagatcaaggtgtcagcagggctggcctcctcgggccgtctctccttggccttgatgcccctgcatgtgttcttccttctgtgcctgttgtgtgcccctggggtctctctgtgtaccccaatttatcttttttttttgagatggagttttgctcttgttgcccaggctggagtgcagtggcgcaatcttggcccactgcaacctctgcctccccggttcaagtgattctctgccttagcctctggcaaaatgcccttttcaatcctccctgccattggctacttttaggatcctgctgattggtgcatgttacagattgctgattggtgtgttttacagagtgctgattggtgcattttacaatcctcttgctagctacagagtgctgattggtgcttttttacagagtgctaattggtgcattttacaatccacttgctagctacagagcgctgatgcattttacaatcctcttgtaagacagaaaagttctccaagtccccactcaacccaggaagttcagctggcttcacctctcacaaccaccccaagaaagttgagggtgaagtgcaggccatgcacaggatgctgtcttgatactgagaaaaggaaggtggtgttaaccacagaatttcatggccaggggtgagagttaatgtagcagaggggctctccttggaagggctgtctagaagaagagtgtgtaactctgggcaggataggaagaggtgacacctccatgagaaaagggactttgtcttttttgcccctgtctccccagcctgtggctggtgtgtgtcaaagaggcagagtcattcctgtgtagtcatgatggttagttttgtgtgttaactttgcccagctctggtgcccagttgatttgctcaaacaccagtctggatgttgctgggaaggtaatttttgggtaagatgaacatagtagaccttgagtaaagcagactgtccttcatatttggatgggcctaattcgatcagttgaaggccttaagaccaaaggctgaggttccccgaaggggaaggtcggcccccagacccccttgtgactcaagactggaatgtcaactcctcctggagttcccagcctgccggcctgccctgcagatttcagatttgccagcctctgcagtcatgtgagccaattccttgaaataaatctctttttatatatcctgttggttctctttctctgaaaattcctaatactgtagttttttcatctggtgatctatttggctatctcactaacttctgagttgggacagcctcagagtcagaagtcatgtgtctcctggaccctccatccccaaagcacagccccatgccaaaatatgcctttatgttagtagcactgcccagccctgttcagttttctgagatccagttcctacaagactgtggcactcagtacttttcatctcattgggttctgtgcctctggggctgttgcctctgagaccagatcccggatcctttctttgtgggctgctccacccctgctgtggaaatcacacagaaggcggacagtacatgtggacaggtcagacagacacactgattggccagctgcagcatggggagcatggactctgcccacagctgtggcgagatggctctgtggtgagatctgggctttcttgtgtgctgaggaatgggagcgtttgccatccttatccaagctgcatcactcagggctggcccctctgaggttgcactgtgggccccaccccagcctctgaacgagaattggcataccagccagatgcctaggtgatctgtgcatgtgctgcaggtggagaaggtctgcactagacatctccagaaggacgatctgggatcagggttagacaaggcccacgtctgctgcccagccctctcctctttgatgtcctttctgcacctgacacctcttcttgacattccctttccttggtttatgtggtaagacctctctgtccacaacaggaatggtcttacccatcttcttctcctaccatgtattaatagttccctgtgccttaaacccctgattcaaaacctgcttcctcaactctccaaagtcagccaagcgagaggttatgggcacagtcttccacaagactgccctcacttctgacaccagccccaaattcaggggtcctcaggcccatccttacttcttaccagctggtcaggggttcccatgaccagtcttaaattagataatttgctagaatgactcacagaactcagaacaccattatacttaacaatgacagtttcattatagcaaaaatttacaacccagaaccagacaaaagaaggaacacctggctgggcgcggtggctcacgcctgtaattccagcactttggaaggccgaggcagctggatcacgaggtcaggagatcgagaccatcctggctaataacggtgaaaccccgtctctactaaaaatatttttaaaaaattagccgagcgtggtggcgggcgcctgtagtcccagctactcgggaagctgaggcaggagaatggcgttaacccaggaggtggagcttgcagtgagctgagatggcaccactgcactccagcctgggcgacagagtgagactccatctcaaaaaaaaaaaaaaaaaaaaaaaaagaagaagggacacctagggtgaagtctgggaggcttccagatgcaaagctttggcgtcctcagagatgcattatcctcccagcatccaagtgtgacagtaatcaaagagtattgccaaaaaaggaacctcacctgagcttcaatgtctagagtttttatttgggattctttatgtaggtatgatgcatgatgaattgaatcagtgaattgattaaattgttggccatgtggttgagctcaatatctagccttcccagaagtcaggctggtagcccgtgtctcctgtctcaaagccccaaccctctagtagctagttggcctctctggcatcaccaacctccatcctgagtcatctcttttgcataaactttggaacgcaccacgaataacaaggacactcctatcacttggagattccaaggatgtagaggctccctccaaggtaccagaaggccagccaagttctttattacacaccaactgattgccatgacttagtggttaataaagagtggggcttggggttcctttagatttcaggcctgacacaaccccttggatatagactacatgaaatgaaagtgttaggaagggtgtatgcatgctatttgtttactttgaagagtgacacttggaaccaatgtcagttttacaggctgccctgacttgctggggcacagactgtgaagtgcatattcagaatgaatgaagtgttaccctacagcagtggctctcagacttgcaggcatcagaatcccctggagatcttttaacatgcagacttcagggtcctgcccctgagttttcattggtctgggggagggcccaagagtttctgtgtttgtggagttcccaggtgacactgatgctgctggcccagggaccacacttcaagaagccctggaatagactctgtggtgggtgtttgaactttggattcttggccataggtttttacattacaatgacagaatgggaagtttggcaggaataaagatgacttccacccacaggctcccggggaggtccttcttccctgggccctggcctggtgtctctgtctagcagctagctagcattcaggtcccaggtctcacattttggctggactttaatggcaattgatgggcaagtgcaggctgttcttgcaggggagggagtgctgcctctgcttgggctgctaggcttggggcctggtcacctggggccactgcccttccttcagtcttgccagacaggcagaggagtaagggcttgctaccggggcagagaacatcgaatgattgcaatcgtggggtcattaggattaattagtaaatagccatcagatcttaaaaaatagattcaggaacagcctgggagggcatttgggtgtggtttcccagtttgaggggaaagcatgaatcgactactatctcaggtagggctctggtgctgggaccctgctcaggccagttaagtgacagtggatgtggcctggaaatcctgtttctctcatgttcagtgagggtggaattaggggtgtgtgtggggaccttgggggcgccatgtgatgattaactgtagtctgtctcagttgtggaagctgctaatgtgtttttctgggacatcatcatgggatttttattattgatttcagcagggagactgctggctcattatgtgacaagaaatcgatgtggtgttccacgttcgaagcaggggttctccgtgacgtgcgggccctggaccagcagcctcagcatcccctgggcatgtgtgagcagtgcacactcccagcctccccctgacctgctgagccagaagctctagggctgggagccagaagccccgcaggtggctctgctgcatgggaaggaactgttgggatgcaaagcaggccagagaggacaggagcagacaaagatctgaagctgaatatggacccctcagggtgccagctgtcaccccggagcgcccccctacctggggaagctttggcaaccttcctggttgcaagccaaggcccagggactccaccgctggtgacccccttacctggccctggctgtgccctttggctcagggctgggcccgggaggctggagaggtgccagggttcattgccagaggctgccttgcccctcccttgtgtccttgtaggcagagccctcacccccctatgctttcccgccacccaccagccacacctccttgcccaggcctcagtgcctgacagatggcctgaatacatatatatatattttttgtcttaaaaaactattttttttaacatatctacagactctccccttaccaggtatttcttggggaagaaaatgttgcttagtagacaaatgtccccaggtctccttcagggaggatgagcatcacctgcattgaggaaggggtgcttcagcagagatgctcacttcaaagcgagcctcactagtagccacagggtgcacagctaggatgggaggcagtgctgctgagccaaggggtggtgggagcagctctggagaaacctggtcgggtggtgggtgaagctgcctccaccccagcaagcgatatggggcctccccactggactggggaactgtgtatgagggtttggggtgcagagacctcaggtggccttcaaaggaggggtggccagaggcccagcaggtgactcccacacctcttttacatcatctcctgctgaacaccccagagttccctgcttcttacagtggtaacatttgtttaggagttgtgcagtaagtagaccaggcatggtggttcatgcctgaaatcccaacattttgggaggctgaggcaggcagattgcttgagtccaagactttgagaccagcccgggcaacatggtgagaccctgtttctataaaaaatacaaaaattagccaggcaaggtggtgtgtacctgtcatctcagctattttggaggctaaggtaggaggattgcttgaacctgggaggtggaggttgcagtgagctgagatcacaccagtccactccagcctggataacagagagagaccctgtctccaaaaaaaaaaagagaaagttttgcataaataaagttaaattatttaaaataaaattatttaaaataaaagttaaattgtttaaaataagctaggagaaacttgctacttaaagacatcttttgggagaatttttattcagaagataatcatttatcaaagtgattgagtaacctgtaatttatccagtggagtttaatttaagcatttgaatttcatgtttacccttttagcagctatcattgaacccgtcttggtagctccaaagcacacttaaatatgagatgcagcccctgcctccattggcttatggactgggtgggtgtgtagccaccgtgtacagaaagttaaagatggttctagggaccaggcaaacagcctggggtgagttaccagaaggatgatgtgaatcatcgtgtgagattacaggttgcccatcaccatggccagtgcctctgagggtttgttgggattagaggggcagcttccaggcctttcaggagaggagggtctttacatgtcttttgtgggtgaggacctgaggcaagcagagagagacagccagagttacgtggggctggaagaaatcaggccagagtgactgggacccttgactctccttgttagagggtgtgtttgtccattttgtcctcttataacgtagtaccacagactgggtaatttataaagaaaagaagtttattggctcaaagttctggaggttgggaagtccaagagcatggtgccagcatctggtgagggcctttgtgctgcctcataacatggtggaaggcatcacatggcaaagagacagagagacaagataggggctaaacttaacctcttatgaggagccctctccctgggtaatggcattaatccattcctgacggcagagtcctcatggcctaatcacctcttcagcatactgtctcttaatactgttataatggcaatcaaatttccacatgagtattggcagggacttctgaaccatagcagagggactgccttccccatggatcctggtgtcctgcaccctgggcccagtccactctctggctggcacctctggttttgccccccaggactctgtaagctctagccaaggcagctggtgctgtgcttgccagctctgtgctttgacaacaacttctgccttccccacactgtctgaactccagggtctcctcttcgttttggtgttgggggactctggctcaccacagagctcctctccaggcacgtccctccacagcacctgggaaatccccttttctggctccaagtgacctatcttccgagggctacttgggaattcacagaacctcagctatggagaagctcagaggattgggggattgaaaccgtaggtcatccttgaatggttagcttttgaaaataattgtgcatttttccgtggtatgggttggtttcctgtcctgtctccacagtgctgaaccaaatcagcaacgctgcactttgcaactctgacagttgagcttcctggtcctgcgattagagccctcaagatagtactgaagcattaggtgaacggtggggacagaagcccagactctgtctggagtaggggccctggagggacacacacccacttcctatttggctctgtcctatatgcaggcattttttttttttttttttttttttctgagacgaagtctcactctgttgcccaagctggagtgcagtgaggccatcttggctcgctgcaacctccacctcctgggttcaaatgattctcttgcctcagcctcccgagtagctgggattacaggtgtgcgccaccacacctggctgatttttgtatgtttagtagagacaggatttcactatgttggccaggctggtctcaaactcctgacctcatgatctgcccgccttggcctcccaaagtgctgggattacaggtgtgagccactacgcctggcgcatgcattttttagaaggaccttgagatgatttactattgttgatcaaggaagaagatgaagcggggagatatgctgccttgaaagtgtcctttgagcatgcagccttatttcagctgtatgtcagggtgtgtgtgtgtgtgtgtgtgtgtgtgtgtgtgtgtgtgtgtgtgtgtgtgtgtgtgtatcagggttgctgctgaggagttgcattgcttccctaaggcccaccagggagattcctgtgagggggtcagacagggcctttgaagttttatgtgttattaaagaaggtcgtatcttattaccacaaagacctgggatatctgcagcagggagtggtagaggagaggctgtcaggccagcccttaacagcgtaactctctcattccttcctcagttcctccttatcctcctggcatccagctccccatcagaaactgtgaatcctaagatatgatgggaccatggacccttcacatttttgtcatattcattatagtggttctcagccttggctgcatgtcagccacccagagtgtccaaattctcctcacccagaaattctgacctcatggagctggggcaggatccaggaattgatattttttaaacctcctcaggttgattctagcatccaaccggggtttaggcccgaggaccacagcctgccagttttcgtgtggcgtgacctttcctgccgatgataatgctgatgatgtcaagcctagctgaacgctgatgggcagtgtctgattaatcgaatgaagtaaaaataaacaggttttaacttaatgtacctccccaaatctgtaaagagatccatggatgacatcagtgctgtccaggatggagtaagcccactatcgtccattccactcacggattagaactcaaaactctgaacagaatgaaaagcaaccccatcgggaagggggttggagcttgaatgcgcagcacattagaatagagtttctgtggttgggtttttttccctcctttgatctgagtgctgactgatttgggaaatagcacagtgggcagaggcagcaaaactctgtgagaaacccatctttgtggccagagggttgaaaagaggaacgctgcaagctgaagattaggagggatcactgttttgttttgtcttttcctctctcctggccctgccagacccagagcagtagcacctactaccctgagagaaaatccaactctctggttggaggaaccggttgttgcataaaggtggtgggaagaatccccatttttttctctttctcattctgctttgccctcagcaggggctgcagttgcaagaaactgtgaaagagtgtgatgtgttaggctaaaactctgggagagccccaactttatgggcagaggaaccaggaaaaggtgcatctggtagtagcggaatatggaagaaatcttggagaggggaaatctggaaaagagggtttatttatgtttctgaaccaactccatgtatgggatatacccagagaaccatagcaaaggctttggatttaagctgcaatagaaaccgtggcccgggtcccagacttaatccctgaatagctcgtgcttgaagccaactcacagagcacagcaaagggttttgaaaccgcactgacgttaactccatcccctaacgaaggggaaccagagcttgtgttctcaacctgagtggatttatcgtctgatgaagcagacacatgaaaatcaacattctctacattctcaacattctctctcattcaacatttttaatcagggttaaaatgtacatattaaagcgatctgggatgcaatctacaattatttgggatacaaagaagcaaaaaaatctgactaattcttcagtcaatcaattaaaaatattttttaaatgacccagttctcaagggaaaaggcaattaacaaatgtcaaccctgagatgacatagatgttgaaattatcaaagactttaaagtgactgttataaccatgttccatgaggtaaaagatggacagttctgaaattaacagaaacatagaaattcgcagcagggcaatatgaaaaaaaaaagaaaaaaataggaattttagaatgaagtaaaaatattactggatgagttcaaaagcaaatgtatatgacagaagaaagaatctaagttagctctaagtagatcaatagaaattatcctgaataaaagaaaaatgagtttaagaaatgagtaggccaggtgtgatggctcatgcctgtagtctcagcactttgggaggccaaggtgggaggatcattgagccaggagtttaagatcggcatgggcaatatggtaagacctcttctctactaaataaataagtaaataaataaaattttgctgagcctggtggcacacacctgtagtgccatctactcagaaggctgaggcaggaggatcacttgatccccagaggttgaggctgcagtgagccatatttgtgccactttactccagcctgggtgacagagcaagaccctgtctcagaaaaaaaaaaaaaaaagcaattattaaaaaaaggtatcatttacaatagcatccccccaaaaaagaaagaactacatataaataagaaaatatacaagatccgtatgctggagactaaagaatactgatgagagaaatcaaagacccaactcatggaaagatatatttatattttggaagattcagtatagttgtgaattctccccaaatcgacctatagattcattgcaatcccaatcaaatttccagcaggatttaaaaaactagatattgataatgggattctaaaatttatatagaaaaataagggatcaatagtggaaacaatggttagatccctggtgaaaaaatattcctgattacatgcgggagaatttcccagaagatgaaaaacaagggaactctgaactttgaataaagggcacatgatccttatggactttcttagttctctagggctgctgtaagaagtccacagactgggtggcataaacaacagaagcttactgtctcagttctggaggctggaagtcccagattgaggtgtcctcaggactggtgcctcatgagggctgtgagggaaagtctgtcccatgcgtctccgtttgcttgtggtggtttgctggcgatctttgatgttccctagtttagagccctgccttcatcctgtttgtgtgactgtctccacaattcccctctttagaggacaccagtcctattgggttagggcctacgcaaattactgtatgtcaactaattatatctgcagtaatccccttcctctctctctctcgctgtctcttcttttctttctttcctcactgtgttgccaggctggagtgcagtggcccgatctcagctcactgcaacctctgcctcccgagtttaagagagtctcctgcctcagcctcctgagtagctgggactacaagtgcatgccaccacgtgtatttttagtagagacagggtttcactgtgttagccaggatggtctcagtctcctgaccttgtgatccgcccgcctcggcctcccaaagtgctgggattacaggagtgagccaccacacccagctgcagtgatcctatttctaaacaaagtatattctgaggtacaggggatgagaacttaaacatatgaattttgaggggacataattcagccataacacggatgtggcttattttaaatctacacagtactgtatgcacttggaaatgactagaaaaatgtgaaaatcacagggcaacaagcagaagcagacttttccccctcgagtcttgtggccgcttctctgggggtgacagatttctttgtctctgaggatggatctggtagagggtgtatttagcagtgtacttctttgcacggggtcctggcagctgcagaagctgcgcccctttctccagcatgttaagaaaaaggtcagtgctggtaacgttctgtgttcagttgccctcttatctggaccctcgcttttcccctaaaggcatccaggagcaaacatgacatgcagaggtagactttgccaaggcaccgctatttccagaagttcttgtgggagagagttgacttcttactgttagacgtaacccaggaagaacagcaaataccggccaggccagaagtgcacacagttactctgttcctgttacggcattaatgctgctttcaggcgtggactacattgtgagatattgaaaatgccatttcctggagactagtattgatgatgaaggtctgacagcaattttaatgatgtttaaagggcagatcatcgccctttgcgtatttcgagatgaggatgcagtggggcagatgtctcagcatattgaatgcccagaaggaagaagttaggcccaacattaaccccaagcctcttccaagggctgctgagacttaacacccttcccaccgcagaaatgtcacctgacaggtatggctgcccaaggcttcctgggcttttttatgcttgtcttttttatgttatttgtctgtagaagtactatagccaggaatgactagaggaaggaaataggtaccattgtcccatcactcgaaggcagcccttgctaacgtcttaatgcatttcttcacagttgattctgtgtttatttgttgtgaataaatcataacaatacatattacatgctaagccttttgtaaatatttcagatgccacaaaattgtcttgtggaagtgctaacactgatttatctaggatcctgttattgaaggtttagtgtgtgctcaatatttttgtccatttcactgccgttttccaaagagaacacatccctttgtgaccctaagctaggttagagagccttgcttgacagtgttggatatcagtattgtttttggaagattaatttattagtgtcctttcagagcttgcggttgcctgtgatcttgaagtgaaatacttattcggtgacttttgtctggaatgcttgggctgattatacaagcattctccaggactgttcaaacccacatcatgtatagtgtatagtgaaagcaactaaattatatttgaaaggaacaaaataatattatctttacaacatgtgagaccaaatgggggacaagattggtgtcaggaacaatttggctgagtctgtttctcatttgtatgatacgttttcacccagcctgtattgtggtcactgaatagctatttttcatctggtctgctatattactagctcttctaagcaccagctaatgctattttcccgtgcaaaagaaaaacatggtttagaataaggacactggagctctttattgttgacaatgagcctttatttctcacatctaattagaatgtttcaggaggcgagtggtgagcacggtgtcgggggccgcattagctattgatttatgtgctgttatagaattaattgagtctggacatggagactcattttcttggacatgtagcaggtaatcatgcttctcctgtacatttgaattgctttccagatggtgtgttgtacaggatttatctttaatatgattgactagaagcaaaggacctgagtgtgtttgcatacatgctctgcaatgcaaagcccccagcccccactgtagagatggttaactctctcctggccacaccccccctgggctcatatggggacctgggccttggattgacactgtatgcagcaaagacagcgtcaaagggtcctggataaaggctctgggaggggagaaaaggcctatagtatattctgagggaaacagaataaacagcattacttattatgcaaaaccaggacataatgtgggttcagcaggggaatagttagtgtcttagtcagctcaggctgctatatcaaaaaacaccatagacttggtggctccaacagcagacatttatttctcacagctctggaggctgggaagtctgtgatcaaggtatgggcagattcagtgtctgctgaggtctgtctgctttctggttcataggtggccatcttctttctgtgtccacacatggtgaaaggggcaaggcagctctctggggtctttttcttctttcttttttccttccttccttcctctctccctccctccctccttctctctctctctctctctctctctctctctctcgtctcgcactgtcacctgggctggagtgcaatggcgtgatctcggctcactgcaacctccgcctcccaggttcgagtgattctctttgcctcagcctcccaagtagctgggattacaggtgcacgccaccatgcctggctaattttttttttttttttttgtatttttagtagagatgggatttcacaatgttggccaggctggtctcaaactcaagaccatgtgatctgccagcctcggcctcccaaagtgttgggattacaggcatgagccaccacgcccggcctggggtctctttcataagggcacagtcccactcatgagctccaccctcatgacctcatcactccccaaagaccccacctcctaatgccatcacactgggggtcaggatttctacatgtgaattttgggggcgatgcaaacattcagtctgtagtggtcagatgatatctattcagctgggaaataggatgtagccattaaaatgatacctatggagagcttgtgttgcttaccgcatgttaaaagagaacaacatggatttgtgtttacagtaaggtctcggctatgcaaaagagatgcacagataaaagactggaaagaaagaaaccaccaaacaaacactggctttctatgggtggaacaactgtgagtgggcatccattcctctctatatttcctattaagaacacagagcaaaacagattgtagtccttgttgctgggaagtaatgtgccctcagaaacagtcaccctctgagtacagaagtctgcccacatcagtttcacaaatgatgtgctagatgattagtcatatctccggctctctcctgccctcctacagggcagctgtccccatataacagttgtatccctagaaggagtatgcagttaaagtaattggagattctttgaccagacgttttgagagtctggcagcccggaaaggtgggatttggcagctatgtgggaccttccttcaggcactaaagggcttcctgaaaaagttgcttacacattgaggtgtgttaaatggaattctttatcataaggctgcaaactgcttctgtgcaaaaggcaatgtgttagttccttgcaggaatatgcttttagtgaactcaatgagataccagaaatccagtaggagaacactttctttgaaagaaccacttgtttctacctacgtttttgcccacctttccttctcacctccccttggccacaccccacttttgtgtcttgggaattatctgctgtgctctgaatagccccgtcctgccaggccacccacctttgcccttgtttgaagaagctggggacagttgtccttgctctccaccccctggagtaggggaagaaggcttggaatgtggtgggcctaggcttcttggtgagggccttgtatttgttgacaaggaggtcagatccattccctgggccgtcatcagagacctgcaagcatctacttagggcagagttttcaagtgcagtctttggacctccaacatgagaaccacctgcagctctagacctggcctttggcccacaaccttggaatcttgggccatgaacctgcacactctccaggtgggccttgtgcccaccaaagtgagcgaatcactgcattggaggagtgactcttggcttttcacaaggacctctccctgctttcctcagtccctccaagatgcacccatatcccactgcagggatgcaatttgcatacatagccagggacagtgtcatctggccacagccactcccagccacctgtgtcagcagagttccccgttcccatctaagacattcacctcatcaggcatctctcctggaccatttcattgacattttccttaactccctttatgtagtgtttatggagttcaggcctgcactggttgctctcttctttaactcgcttcaagccctgcaggcacatactgtcattttcagtttcctaaggaggggaaggccatctctccattaaatatcttgccccaggcctcacagtaaacagaggtctgaattgaaacaaggaccttcagtcttcatctttaacaggcgggctctttgtcttataccaaaagtgccccagtaggttccgtgtaattctgtggagtctttgaagacgtggctgccttctgggtagctgctgtgggtcccttaccctttgcactcatgggaaagagagctggatcagaatgtctgtggtgtcaaactcaggaaaagagctgccattagccagcgctagcattgtagtcatggtgaaaaacgggatcattaccagtccacagccaagccatattgcagcctgaggcaacaggaaaaatcaggaataccaatcctatcttcatttacaattttgatattttgttcatcatggatttattttgccttagttttgatttctaaagcattgcattaaaatattatttatttttgattgcttaggtttttggggcctccctgatctccccctggttcagccatcgtaaagtgaaagcattttcattgcaatgaggaataagtcaagggtgcctgttagtgccattgttaactcctcagggaagtgcagggcagggtagttagacaagatgaccacatgccggaaaggggaagcaaaatggtgacttctgaaagtgacatcatttacctagaaaaacattatcaactaaaaactattaggatttaaaaatagcttagtaaaatctatttttacaaaatcaatatcattttttttctgtatgccaacaataaccaggtaaatatataaggaagagatctattcgcaacagccacagaaatattatatttaagaaaaaacttaatatgagatgtctacagctataaagaaaattacaaagccgttgagagacatttaagacttcaataaataggaagatttttttgggtgaaattgggtaaaaagactcagtattgtaagtatgaataatttctgaggccggggcacggtggctcactcttgtaatcccagcactttgggaaaccgaggtggctgatcacttgaggcaggagttggacaccaacccggccaacatggcaaaacttcatctctacaaaaaatacaaaaattagccggagggtgatgacacatgcctgtaatcccagccactcaggaggctgaggcacaagaatcactttaacccaggaggcagagactgccgtgagctgggatcgtgctactgcactttagcctgggcgacagagcgagaccttgtctcaaaagaaaaaaaaattccctaaagtaatttataacttaaagttactccagccaaaatttcagtggaatattggggatacttggaaccactaactcttaagttcttttgggagaataaatgtgaaaatagcaggggaagatgacaaaatgagaataatgagagagaacttgccttatgtcgtattaaaatatgctctaaattcataataatgaaaatggcatggtactgttgctgggcagatagaaatgatgtagactagaaagtccagggacagatctaagtttatgtaagaatttagtgtatgatggctgggcggggtggctcacacctgtaatcccagcactttgggaggctgaggcaggtgaatcatgaggtcaagagatcgagaccatcctggccaacatggtgaaaccacatctctactaaaaaaaaaatacaaaaattagctgggcgtggtggtgcgcacctacctgtagtcctagctactcgggaggctgaggcaggagaatcacttgaacctgggaggtggaggtttcagtgagccgagatcacaccactgcactccggcctggcaacagagcaagactcagtctcaaaaaaaaaaaaaaagaatttagtgtatgacacgcagggtgaccagccatcccagttcctgtggaactgagggtttcctgggacatgagactttgagtgttaaagttgagatggttggtcactgtaaaacatgagaaacagaatagtctatttagtaaagggtattgggttacctgagtaaagctgtggtgcccacactttgctgtatattggaatcacctgggaaacttttatgaatactgatgcctagttcctatctgagacattctaggttcattggtatgtggtgtgacctgggcatcagggttttcaatgggtaacaaaacttgaaaatcactggggtaaccatcgtggagaacatgaagctgctccctaccttgtgtgtttacactttctgatgggttaaatatttcagtgtcaaaaataaaggattctagacagtgactggatttgcttgctccaagggaagaggtttgacccctcccatgaaaagtctggaacttctggagctagggacaggtgcagcacacagactcagggagtttcaggggagcaccttattcctgtgcctctaggaagggtggacattttccctggaagcaagcagatctggctgaggacagcctatctctgtcatacctaaaaaatacaggcacctcttcacatctcaacagtgaagtcccagatgaccaccctgactgcctccagctcaccataaaatcctctcccactgtatcttacactgcccagccatccaccagtcgctgaaagacatgcactggtgtctcaggggccctttgttgccagcaagagcaaagacaggtcacatgctatatcttgctgaaaagtgagttagtgttttggaaggtcaaatggaggaactaatttataccacacagaaaaaaatgtgaaatgggtgctatgagtgtaaagttcagtgatttggagggcaaattccagagatattccagaaagagaaaaaggccattagggagagaaataaaaaagaaatagcaagaatcttcctgtaactaaagtaagatgtgggacttgattcggaaagggctcaccaaatgaatctcacataaaattaatgagaccctcataaaattaaaaaagacccttatctagacatagtttgctggaatttctgaactctaagagtggagaggaaattgtatcagcttccagacggaaggaatagatttttgtaccaaggtaaaaagaatctgaatagtattaaaatgcacatctgcgagactgtaagctagaagatagtggaacagtgttagcaaattattgtgaaaaggatgcaatacaataatcttatacctagcaaaggtatcattctatgtgagatcagagccattttatagatacaaaagagttacctcctaagtaaacaaaatgactctaacaattatttttacaaaataaaaatgaaatcccactaaatagttcaagagaaagaaatgcaaaaagtataggaagcagtggtaagttatgaattgagtaattatagtccaaattatattgttgtcgtagtgttatacatctggaataaatttttctgaaatcatctgaaggcttggagagctaataggaaacaccagtggaaaataaactcctggttctattgtagttctcctacaatgtcctcagtgttttcatttttgaaaacttgaataacattttaataggatctggactgttccatgttactgtaatgtgtattttagtccttatgtcctatattggcctagagaatattttatttagtgttggtatacatatttatatgtgcatattacagattttatccccccgaatgacagagattttgaagttaagatagcaagagtactgtgtactttagtttgttctcttaacaaggatgtgcataccttcaacgtgcacagcttgatgtcagagcctggcgagaaacagggatgctgtagagatggcaccgctatgcaaggaatgggagctgtgtgctcatgtgccagtgatgtaccatctgccctttgccgtcctgacgtcaagacatggacgtctggttgcatgttagcagctgcattcagcacatgcttctgagagaccgttttgaggaatgtagttactggagattgtgtctgagagttgtggttgctaagtccctgacatcactcctgcagcctctctcttgtggctggctgtcctctgtgaagataagaaatctggtgacaagttatatgtggtctttgaggcagctcagtgttcttgatgtgtcctctgacacatctgggttgcagatgtcttagtgagtgctggccccttgttctcttctagggaacagctctttcgaattgtcctgccagtttcagggtttgcgaatggggtgacgggccctgcagggtccatctcagtgacaattttcctggtgtgggacatctttgctgtctgtgggccactctagggggagtgctgtgaattgctccgcataccagtgatgctcctgaaacacggccatggacaagcctgtgcaggtggcggagtaaacattgcttctttagatgtcaagtgtccttggagtgaattcacacgttggaagcatgtggctccatcagtaattgtgcccacactctgagtgtctggactggatgaaataattatctccttcttcgttcttttgggaatattcatactgctgtaaccgtgaccatctggtacactcagtctcataacaagatgtgttttgggcaccactacaaacaaggtgctgtgtttggagctctggggggatacacaatatggaaggccttgagtttgtggcctaaactaaagagacaagaggggaagaggaggtacaggaaggcaagatgagagcccgggcagtgactgctgagggtcactgatagctcctctttcatcttcacttcctgctcccatctgagcccagatccctttgcttctgccacctaaggtcctcactgagccacttctccactgtcctctctactgttttagtttaagctctccttttttttctttttaaaaattgcagtaaaatagacataaaaaatttagcattttaagcattttcaagtgtgcaagctcttaactggactactggaatatgtttttttaaataattgaactatcatgcaagcaaaaaggcatgtgtaatgtaagagtacagtttaaagaatatgacaaacatttggggaagcaattagctgaagaagtagaacgttgctgggcgtggcggctcacccctgtaatcccagcacttttagaggccgaggtgggcggatcacgaggtcaggagatcgtgaccatcctagctaacacggtgaaaccccgtctctactaaaaatacgaaaaattagctcggcatggtgggggacacctgtagtcccagctactcgggaggctgaggcaggagaatggtgtgaacccaggaggtggaacttgcagtgagctgagatggtgccactgcactccatcctgggcgacagagcgagactccatctcaaaaaaaaaaaaaagaagtagaacgttaagcaaacttttggacgtcctctgtgccactttcctgatgctagccccttgctttcccccagaagagagaatagccttttcactggtctccctgcctctagcctctagcctctgtccccacgccaggcccagagagacagggctaaaagaaaaaatgttgaaaatggctcagtgactgtgcacatgtcttagtctgttttctgttgctataacagaatacctaagactggttgattataaagaatggagatttgtttctcacagttctggaggctgggaagtccaaggtcaaggtgccagcatctggtaagggccttcttgctatgtcatcccaaggcagaggtgagaaggtgagggagaatgagaaagagagcaagagagagccaaactcacttttataacaaacccactctcacaataaagaacttcctcccaagataaagacattaatccattcatgagagcacagccctcatgacctaatcacctttcaaaggtcccacctctcaacactgttgcattagggattaagtctccaacgcatgaactttgggggacatattaaggccatagccgtgtggtttgggggataaagtgcagagtcctgggcactgggtccaggccctctcccagtttggcctgccaggtctctgcagctgccctgtcaccccacgatacctgcaggctgcggctgcaccctttgtcctcttctccccatggccgagcagtgctgtcccctctgctgagccctccagcctgccacgctggggacttgtgtagagcttttctgcacattgctcagcctggatggtccctgcgcatccagttcctcggtgaacattgttcagtttgagggggaagaggagggagaggatgggataagcctgaaggggaaggtacccaagatagtctttgaggggtcatggatttagattgggaagagttattgtccctcctcattggtcctcattatgtcttcttaatgaaagctgctcattttcttcgtgagagcaaacaacctgatcttctgaccatttgtcttggtcacctgggctacccaaactgagtgagaagtcaggaatgagccggtaggttcctggggagaggcgtgtgtcctcgtgagttgccggtgcctcccttgactgcttttcccggagctctgtgtgccctcgttctccttggtgtggatgcgtgttgttctgatgatgagttagcgggggtggggatggcgcactgtttgaacagatgtgccctcacatggctgcgggaggacgtggtgggaggtgctgtggtgaagtggccccacacatggctgggctttgtggggttttgactctgtccttcccaatgttcctccccacagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtaggaccctggctgtcctggggaagggagcagaggggcccgagagcaagggacctcagggtacaggccttgcagatgctgaagcgaggcggtggggggtgctgggtgcctcacagttctaatggtggctgagctcttcattggtccagttgggagacatgttgcgtggatgctccggccactcttaagctcaccgctcagactcaggactaaagccggttgagggctgagtggcaactcgtgtctcgcagaagacacccctcctcccaccctagaagagaggttcgatttcttgcccactgccctggtctgctcatggtggggcagtatgtgtgggagagcccctcaatcctcaggggtgtactcagaccagcagggcagtggcaaagacgtgggggtgctggtgctcacccactgctgcggccagtgttgggtggcctggtggctggggtcggggccagagtgcatttcacaatggacgggtctctgaaagcccgggggccttggcctgatgggcaatcagctgtgaatacctatttggaaaaggattttttgaaggtttgacaaaacctcggggaagaaacgcatgctaatgagggcagtggatgtcagcataactgtattttaattatagcaaagtcagcgtgcattctaataaacacatttgaaaagccaccttccaaaaaaagcctcactgtgagtatataaagaagatgtgattattggacttgtgtgaaggaacttctatttggccaattatgtggacttctgtcatatttttttacagccttaactgttaaatatttttttccgagaagagttcatgaatttgagtgtgtgtgtgtgtgtgtgtgtgtgtgtgtgtgtgtgtgtgtgtactgagagcttgggtttggaatggaaatcattggattttcagcacttatattttaattgactcctggattttcagcacttgtattttaatgtcttgtattctctctaaagaacgttaagtgtcagttgacttcactttgggggtgttcctgtcattcacagcaattccgtgtttacagggggctgtgggatgcataggagctcccatggtactagtgggtgttgggagagttcacccctaaggccaggaggctctggaccctgggtctgggctttaggccaaagcaaagtgtttctttggtctttagcagggcctgggcttgtcccacaacagtggtgaaggcacctcagggattgacgtgggctgtgcagagcgtgtgacatgctgcgtcttattgtgacaaatggcatcgctagccaagttcttgtcaaagaagattatctttagagcgtggtggggagtaagcaagacctgatattttctggttttgtgcttcatgctaaccagatggtaatttgggtaaaaacacagagatcttgcgattggagagctgggaggtaaatgagtgggaatgaatggatggatgggtgatagtagctgtttaaaagggcaggtggaggtaggggaagtccccagccattgtggaggatcaagaggatgtctgttcttcccagaagaggcattgaatgaaaaagtatgtcacttctccccctaaggagaatgtgtccttgaaggacatgctcttgtctgagacactggaaaagttcatttaaactggttaatgattgtatagcttttgttttgttttgtttttccctccctccctcctttctgtcctttcctcctttcctcccttcctcccttcctccctccctccctccctccctccctccctccctccttctctccctccctccctccctcctctctctctctctctctctctctctctttctttctttctttcctatcagttcacaaattaattctgtcaaggggaacacctgctagttccagagttccaggctgacaagtaccctggtgccaggggccctgactactctttctgaagactctaccaggcccgctgcacgtgggcagggtctccacattcttagatttgagtaccccattccagatgaggacctctttgaaacctgaccagaaagagccgtagaattcatcttgaaagcaagattttttatgaaggatgtgcactgggagatttggtgctgccttgcttgaaataacaacctgctttcctaagaacaatccccttcctcccctgggggacagccaggccgtgccaggagccaacaaaggcctggcctcaagcaggtgcacagggtgccatgtgtcccatgctcacctctctgatcccagtgctgtccacatagtgtagtgatccctatggttgaggctgcagtaaaaaaaaaatctgaagggagaaatgggcaatattggtcacttagatgctgtagactcctgtttttaaccctaacccagcagcattggcattactggggagccccgcccccacattgctgaatctgaaatctgcatttcaacaagatgccacattccagctgtgatgctgtaggagactcacttggaggaaattgtgtagcaaccctcccctctcttctactcattttacagcttgaaaaagtgtgtcctggatattttgaagaggactgaatagcatttagtcattgcacgaatggcaatagtaaaatagagttagaaaaaatgggaagatgaaaaatgtattctccatggtccctactaccctaacggatgagctatttcatcagtgtgccttttcagaccatagcattgagcataaatgatgtacgtagctgtcatcataacccagatgtatttttgtcatacagtttttaaaatctgatgtatgataaatgtttctccatgtcaccatataattttcatgattatttgtagtgacctttccatgatccatttgggcgatgatgtgctgtataacatatttctctgtacacactctaccattgagcatgcagattgtgagtggcattttctcttaggtgtaaggctgccacagacatctttgtacaaaccatgttttccttctttggtttattacctgaggataaatccccatgccgtacatcaacgttgaccatttcccctcgatgaccttgcctaattgtttcccttcttctgtggatgttggatgcatgccctttatcttttggggtttggatgcatttccatctcatagaagcactctctacactgtaggtgtgacttcctgttgcgtatgtcctcatctttagtacattttcttttgaattttggttatattattttcaccatctctgcagcatttttaagatgttaatgactcatctgtgacccctccacctcctttcggtacagagggatttaattggatgtttccttcttccctgtctgggtagatgtattcacagaggacattgctttggtctggtcgatacgaaaaatgagttgccggctgggtgcagtggctcacacttgtaatcccagcactttgggaggccaaggtgggcaaatcacctgaggtcaggagttcgagaccagcctgaccaacatggtgaaaccctgtctctgctaaaaatataaaaattagatgggcatggtagtgtgcaccagtaatcccagctactcaggaggctgaggcaggagaatcgcttgagcctgggaggcagaagctgcagtgagccgagatagcaccactgcactccaacgttggcaacaaagtgagactcccacctccaaaaaaaaaagaaaagaaaaatgagttgtgcctgtactaagaagtaggttgtgtggcctttggagccctcctgagctgtaggatgccatgcattttgaaaaggctccagtttgcagggagccctcccacctgtgccactctgctgagaccaagaggtctgcccgggggctgggatatgagaggcacaaaggtgatagagtttctaaaattgtaggaagacaggttggggaacagagatctacacttgaattattttagtaaaataaaaaaaggttatttcaaagcactgcaagtttactgaggaaaatttggaaaatacaggcaaaaaaatcttttgccatgtggcattgtagaattccactgtagagttttcaaatcaaagagacaaacctaggtcaggatttcccaaaacacgctcttagaggtgttgtgtaaacaaagtaccatttgatccttactattcatggatttgatatttgcaactttgttaacttgctaaaattgatttgtaaccctgaaatcaatactcgtagcactttcccagtcatttgtggaggtacagagaggggaagaatttgagtcacccaactctcacgttcccagctgaggttgaacaaggctttgccttcttgtttcagctctcatactgtaaacagctgttcttttcacaatctatttaatgttctttgcatttttgttgatatgtgtgtgtgtgtgtgtgtgttggtgataaaatggccctcaagtgtggtgctgaagcctagtgatcctaagcacagaatggctgccatgtgccttacatgtgctagagaagcttccttcagggctgagcgacagtgctgactcgtctatgctgccactctgggaggtgctaaagtaaacttctgtagcgtatgatgaagttaaggaaaaggtggaggaatggctaaatttgcagattcatgggacaataactgattaaaaaacacatagtggacaggtagaaaacccaagaactttactgtcttgtgatctagggtcagggaaatgttaaactcttctcagctagtgttttatgttaaagaaatattgcatataattaattatttataagaaatctatattaaacaaggtgcgtataaacagaaacacacataaaacaaggttctgtgttgattcattgacaaaaatgtgtcccgaggctcataggaacctaaccctgtatcgcccctaggagcaatgtattcagtattcatcaactcagtgctcagggcagctttacagaacataactatgtgaatgagaattggttgtatttggttggcaaatgactttgggaaactttgctgcaaagtttttcccttcttgggggtttactgatttctcacacacaagtagcataaagtcccacgttcgctatagcggagacaccagccagcctggccagtgcttcccaaacatggtgtatcagcaagcccttttccctccatgcagggtctgtgggagaatacagacccaagctttacaccctggggagtaaaggacccgtacacatgaactcccaaggcctctccctgtatgcttcagttccaagatgattcagcaaccccaaatggtgatgatggaaaggttgtcattgtgttatcatcaggacccttggcttctgcagatttaacctttcttattttgtggtttgtgtaaagtccgtgggtgccggtggaggtggcagcagtgttggcggtgactgccagcaccatgttaggggtgttaggaatatgatcgcagtaaatcctagagcaacccagagagagggagctagggttagtcccgtgttgcagatggcacagttaagtagctcacctgtgaatagactgtggactgtgttatgccaaaacccgtgcctctgaacagtgcataacacagcccttgaagaacctgagaagagaaagcgtccagttctgttcagtccgcgtttgagcctgcctgctggagggtgagtcagtgtgggggaactgtgcagtgttcctcctggagagtgatggtctcttctcctctgttgtctgtttccttgctgttgaaaggcttggcgtgccctgttgttctcagtgagtgggatacggtgccagtgaggtgaccagtagatacggaagcctccggtctgtaaaatgtccccatctcagtgctaacgtgtcctaagttcaccagggctcaggccacagatcaaacaagtcaagtaaagattgttcatgtggcatttttcttaatttttttgagctttgttgacataacgtattgattttttttttcatgcagtgattaaggaatacatgagttgggtccagcaaggctcgtattgtgtgacctgatggaattagtattactacacctacccatgtggccctctactatcaggcagtgaagcgtgagtggagggaggaccccagctgggcactggtacctggctcagtctcacagctccagggatgagcctgtggacctggcacgtccttggtgccttcccttgaagagagtagtttgctcatcagtgctttccctggggcaactcacccacactcctggggggcaccataagagcgtttgtccagcaccaaagatcctagttctgtgggtctgtggggtggccctggatggcatgttctctggatgcctctgggtggcctgtggaacataaagggtttggcgagggctggacggattgttttggagccccatcccacctgttaccttgtgacgtctatcaggagatacactgaaaaggtcagccctgcctgaaattctccctgtagagacttactcctttggaccttggagatttctggagctgcaggcattccttgtccaggacctccatggctaccgagttgaggtatttgatttactcagcaagtgtagaatagctccacaccttggaatggcaaaccaaatatgcgttttgattatttggggttttcatgatttctgtttatccctgacccagctggtgctttctagaaagagccttctgccaatagaaaaaagaagaaaaatcaatacatggtagccaacttaatacaagttaaagggaagcatggtcgagggccccgaggccacatcgaatgcagaattgtgcatcattgctcattgtagagatgctttggccgtgacttggcattcagtagaggcttgctttttgaagaaccttctgagagtgtgataggagtctggtgccaagggagagaaggtgctaaaagcacaggtaactgggtgtgtcccccaggtgggaggcagtggtaccgtgtgtgttctgagccacggcctcacacacatgccccgctgggcagcatatgaagtgagtgtcagtatctgctttacagaagaggactgagacaagagtggcatggggttgttggcacccaggcgccccccctccatcagcgtgtggtggggcagcaggtgtgcagatggggtggtcctgcacagaggggctttggggcttgcactgcgcccaggagggagtggtctggggtttgtctaaacctggcccacagtaggatggaacttgggaaagagcctgtaggtggtgctgagggcagggggttatggggggcattggggcatggtctgcctgggaaggggaaggtcctctccagcccccaggcctcagtggagtagtcggctccctcctttctgcagccatgcctcagattctagtgtcccttgccccgcccacccatggcgtcaggcctagcactcctgctctgcatacggggaggctgcacgggagggttcttggggtgctcctgtgtcccctgtcgtctgtactgaaccccttcccgtgcagctctgctcccagcactgtgacagggtggacaccgcacctcctgctactgattcccaggattgccttgaaaaataaaatcctacgggtgtgcattgacgtttcaatcctggctggctccgcatgagcttctgaacttgatgttcagaagctcagggcccatttgctgagtcagcacagctgccttctttgatttgtatgaagccttttgatgttttgatgacatgtcaccatgggtggctgttattttcagggagcagtttatctatcaggatctgggattgcttcgggtacttttaaaatctaggtaaagccggggtttctaaaacattgttctaaaacattgtcagggcagagcatgtaaagctctcccactaccactaatagtgatctaaaaagtgcctctcccctcaaacacaccctagtcctcggggagaaagcagagtgcggtggttaggaatgctggagccacagtcaggaagccggcatcccacccggctgcagcagcttggggcccgggaacattctggatgggccacctgtgccagcagccccccatctcgtggggctgtggggaggggagttgatctgggtcagtgtctgtatgggtggggaggggagttgatctggtcagtgtctgtatgggtggggaggggagttgatctgggtcagtgtctgtatgggtggggaggggagttgatctggtcagtgtctgtatgggtggggaggggagttgatctggtcagtgtctgtatgggtggtgcggggagttgatctcggtcagtgtctgtatgggtggggaggggagttgatctggtcagtgtctgtatgggtggtgcggggagttgatctggtcagtgtctgtatgggtggggaggggagttgatctgggtcagtgtctgtatgggtagggagggaagttgatctggtcagtgtctgtatgggtggggaggggagttgatctggtcagtgtctgtatgggtgatgcggggagttgatctggtcagtgtctgtatgggtggtgcagggagttgatctggtcagtgtctgtatgggtggtgcggggagttgatctggtcagtgtctgtatgggtggggaggggagttgatctggtcagtgtctgtatgggtggggaggggagttgatctgggtcagtgtctgtatgggttgggagggaagttgatctggtcagtgtctgtatgggtggtgcggggagttgatctggtcagtgtctgtatgggtggggaggggagttgatctggtcagtgtctgtatgggtggtgcggggagttgatctggtcagtgtctgtatgggtggggaggggagttgatctgggtcagtgtctgtatggatggtgcggggcatggagtgcttgtgcagatgatgatgatgatgatgagttttcagtccatgggaagctcatcgggtctgggggaggtgggtgggcaagtccctgcacccagtttgggtacaggccatgctgggcaggggtgaggacactagtggacctgtcctcgggagtgacacaaaggaggtggtgagccctgcttgtgagataggatgagaggaggaccaggactggtcagggccacactggagctgctgggggtgaggtcgggtaagggcctcccaaggtgcccccacgctgtcccctctgcagggccctcctgaatgtggcttgtgccctgctggagaagttctcacatgcctctttctactccagagtcactgatttgggagatggggcaacagctgcacagccccaagggctgccctgattttctcacaccgaatatctaataggaagttagctgagaagcccacacacctcttcttccaggtaggcaagctgggcctgggactacctgtctctcaccgactccaaatgatagccaagcctctcttaaccttgggcaccttttttccagtttccaccccgaattcacactcttcaaagccagctcctcctgctgggctgctcctgatgtggggggccggccctccctgcaaatctctggcatggcccttgcaaattggcacctgccacgtggttggcactgggactgcaaaggtgaaagtggcattatcctgcatttgaaactcattctagagggagacggatacatgagactctccccgcccccatccaggtgtggccaggctccagacgagttccaggcaggcttccaggacaggctccagagttagggacaggcggagaggctctgtgactttgagaggggctttgggaagtcagccgacaaggtggggatgaacatagaggtgtgtgggtgtcctcagcatggaaggggctggaatcgtgatgtggctttgagcctgaaacaagacaaagggaaggcgagggacatgggttgggggatggtgatgagagagagacagagggttccactgggggcatggaggggagccaggagagaactggggagctgaggggagggacattaggaaggccagatgtagcagggcagttaggagatatcttactggggaagaaagcacccgttggcggtggccacctgttggcggggtcccctgagcctgagcagctctggtggattgggaaggcagaggcatgggaatggtagatggacagtgtctatagagacttgcacggagggcccaaggaggtgccagcaagccgaggtgctcatagtgtgtgtgtgtgtgtgtgtgtgcacgcacgcttgtatgtgagatattgacttgcattgtactcatctgccggtggggtgtctagggcagattgtggggagtgagagcattgggtatgggacccaggctgtccacgtgcgtctgcttcttgaggccccgtacctcccgttcttgggcctccgtgacacctggcatcatgcctctcttgcaccagaggcttgagagacacccagttggcaaaatcagttagtctgtgacattccctaggaagtgcagggctcggtgcaagaagttatagaagtatctgtttaggaagaaagatcgcatggctgaacacgctgagatgcgtaatgtcacccatggtgtgcttgcccaagatgtgatagcgtggtgatggcagacatgggagttttaccccaaagcattcagatcacaaccagtgccagtcagttactatgaagacatgtgactatggtaatagggggctgacctattagaataactcctaatcctatgtcagataataccatgggcagctcaagaaaactacgcacaactcagacatgtggagaaaggagatgtggaatggaatggagccctctgggctgatagaggcctccaggacttgccacacccacgtctgcccccaattccccagtcagccttcacagaagagaagttggtctctctccagctgagaccaagccaagacccaaagtgctggagctgaaggaagtttgggctaggctcacagaagctattgtcccctcctccagtgtcaacagctacccatggtccaggcctccatctggtcctggtccttttaagagacactgggtgctgactcacttctgggtctgtcccacgggtggcctgcctggtctgctgtgggtgcagccagactgtgcaggttcgggagcccgaggtggacttcaggtagggagacgctgctccccaagagctgctcgggtgtgacgtcagggtggaggctgttgctgtgtgtggcggcatcagtcatttaccctctttctcattagcccctgtccttcggcccatgtgcttgcaggtggcctctgattctgcttctggagactgtctgccccctctgattcattcattgcggccccagttatgtgaaagatagcatgttcattattcattcattgggccccacttttagatatacttgtgttcatcttcgagagagggaggtcatccagccattccccagtcctcaaaacccactccacaggcaaagcagtggtgggtcagggctcctcttgctgcattgcggccttgtatttgctcttctgagccacaagcatagcgagaaagtacaaaagaaaaggatttcaatggtattcaccctgaaaaaggaagaaaattgtgacacaggctgcaatatggacaaaccttgaagacgtcctgctaagtgcaatgagccagtcacaaaaggacaagtactgtgtgattctacttctgaggcacccacagtagtcagagtcatagaaacaggaagtagagtggcggtggtcaggggctggagagagcagggagtggggagctggtgtttaatgggtgcagaggttcagttgtgaagatggaagcattctggaggtcatcggtggtgatggtcgctcaacagtgtgaatgtacttaatgccactgaattgtacacttaaaaatggttaagatggtaaattgtatgttatgtatacttaccacaataaaataaataaagaaaagaagaggtttttcagtgaataactggtttgaaccaatttggatcctctaaaaccaagttgagccagtctgaacccatgtagccattatcacaccgtgttaggctattcttgcactgctttaaagaaatacctggggctgggtaatttataagaaaagaggtttaattggctgacagttctgcaggctgtagaggaagcataatactaacatctgcttctggggaggcctcaggaagccttcaatggtgacagaaggcagagtgggagccagcacttcacatggtgagaatgggagcaagagagagagtgggggttggagggggaagcgccacacacttttaaacaaccagttctcttgtgcactcaaagtaaaacctcacttactaccaaggggatggcccacatcattcatgaaagattcaccccatgatccagacacctcctaccaggccccacttccagcattggggattgcatttcagtatgagatttgggcagggacaaatatccaaactatatcacccacaaagaagcaaaaacattttgggccaaatcaaaactatttagatgtagccacagtggggatgaactgtgattatacccattcaggcctgtggacctgtggacctggcgtgtgtggtcgtgaggcggtgggtcggcacatccctgggaggtttcaggaggacattcaagaccaaaatgagccatgagtaaataacacaaccacatcctgagtgggagtaggggagcctccccttctctcctaggtcttgtatgggtcatgatcccgccttggcaggagtggaaggaacagatcccacaggctgtggcttatggtaaagtgattgtggtcatgccttgtgagtgtcattaaaataaacatatatcgttaaatccaccatcaaataacagctatttctgccatcctctcgccttttccacaagtttaaatatcccagatattctactgtgtatattcctaaaagcagacaggtagatttagtaaagttaactggatcattggtaccttctttatagatcatctggtgaaacttgtttttcaaattatgagttgtagggctttgttttaatgtctgtagccttaggcagttccattgagactaagtttttttcttattaagactaatcttattgactggaactgtggactcctcgtattaggagaacagagatgtggcctacataaattagtggaagttaaatactgtagaaaatgctctctggaaaccaaagtctaacatcgacttactactggtcattcaatttccttttggcttgggcaccatcgttacattcatttttcagatgtcaagctagttttctcagaatgtgtgcagggctcgaggccaagtgtggaggccacaggggaggtcacaggtcaagccttctgggagaactgcaagcttgagcctctgataaagtcacgcgattgaattttagccccagtaggttgctgtcgttaaactgtgcacacagggcttcttgcttttaagttagcaggatggaaaaattgcggatgtttgcagcaaatgtgtagaaccagtggcagaagcagccatgctggcccctaagcaatggtattagaaagggttgatgaagattttctcatttgagagttgaacaaaaccaaatggaattctccctagttccgcagcactggtgggtgactctccctgggccggtctcagccctgcagaaaggggcactgtctgcttagcttggtcagcgcagggtctactgcagcagagtgccaggtggatcacagccctcttgtgggggaaggatgggcggagctcccaccttccccacaaatggacacagaatggcacctggtatgtgaggcaggtgcaggtgaccaggagaaggggctgtcagtggttgatggacagctgcctctgctgcctggatgacccaccccctcccctggaccatctcccactttgcctgggtgtcagtcactggagggttagctcagtacaagctggcggatgacctccgtagagcttaggtgaaggggctctcacagggcagtatgtttgagacccttagagggctctctttactcttgcttctcctattatttttaaactgtagtaatacacacgtaacataaagtttaccattttaaagtgtacaattcagtggcatttatcacaatgttgtgcaaccacctctgctctttagttccagaacattttcgctgcccccagaggagaccctgtatttattaagcagtcactccccattcttccctccgcccccagcccccacagtgaaaaatctgttttctctcactttggatttgtctattccggatattccataaagataggatcagacaatatgtgccctttagtgtctggcttatttcatcatcatgttttcagggttcatccctgttgtagtgtgtgtcagtactttgttcatttttgtggctgaatgatattccactgaatggctattttacattttattaatccactcatccactgatggacatttgagttgtttctaccgcatgattaatgtgaatagtgccactgtgaccatatgtgtacaagcttttgtgtagacacttgctttcagctcttttgggtgtatcactaggagtggaattcctgggtcatgtggttattcagtgtttaccgtttttaggaaccacagatgttttccacagtgacagaacattttacattttcaccagcaatgcatgagggttctgattactttcaaaggaaaaaaattaagcagccctgtcaccttgatggtttggtctctggcctcaccgcttcagctcctctggcctgatctcccagggcctgcttttgttcatgtgtgtgtctgtttataccctggctcatcctgtggagggtctgaggctggcaggatcactgggttctgtctccacattggaaggtgagctgtcctaggtcagggtctttgttgcatgcatcgtcctgtccttagcaagagctaccctgtgccatatgggacatacaacaggcacctgttcaggcctggccatgtgggcccacctttggatggtacttgacaaagcctcaaaatgcagtgacaagtttagataaatatgattctgttctgaaatgctgcactggacacagccatccactgcctgccctttacagggctctgtgaagagacagtgaacaatgaagtggaggacgtgtgcaggtggccccagtggtcggtgatggaggagagatttcagcagaccaagcacggagaataaagccaggccagagtgtgctatcagcctgtctgccccctagagctgatggactcagcaaataacagtatagggtacccagttacattcgaatttagacgggtataggattttggtttttcaagatgaaaaaacttatagtggtgagggttgtacaacattatgaatttaataacactgaactgtacactcaaaaatggttaagatagtatattttattgtatgtgtattttaccataataagcaattgaaaaaataagttgtatttcaggtagatagcgaataattttttagtataaatatgttccatgagatgtctggataccgggatgcaggagggactccccttcctcctcccattcacaggcctgcctagagatttgtaagtacagactgactggctgtttttcccagtgtgtcttgtcgtgatacttttaagccacagatccgctttgaaaagatatgatctcccccaggggagtaactattataagaacaaatactctatccaagcttccattctcctcaagataaacatcacaggagtgacctgaattgtaaagaggagtggaaggaaaagaacaataccgtaatgttttctgagccacgcagatgtcaggggacggatccaagggcgtctgaaagaagacgtccacgctgctgagtgagaccttcctctgtgctgctgagtgagaccttccatctgaccagggggtcatgctctcactgctcctgcttggagttctggtgctgtagcgggtctcggccgccccttctgagctgggtggaggaagaagtccctgttgaaatatcagatgagtagggatgatcgcctcttttgaaaacaggagccgtgaagggattcccagagaagattgtcatctaacggagtcattcgtccgcccaggacttctctgtcacagggttacgtttgggagaattttcacaggccactggggatggctgtggctagcctggctttccactgatgccctctatccctaacctcagctcctgacatggctgtcattccagagagtgcttggaagcatcctgactatgttgacgatggcctgagcggagtgagtgtgcactagtttggtgttgtttcatccaaagcaatgtgattatattgctgtactttcagtttcatcaagcaggcaaaatgagaattgacactttttaaaatccaagctttagtttcaccacctggagccaaggtgtttattagaaagatttattggcattagtgtatttttattacaagcatttatctctgtgctgaacagttgcccctgagtcccgtgtgctgtgaagagtctgtgccacaccacacattaattttctgtcctcagagctccggggacacacgctgattctcatgctgtgcctgccgccttctccgagtgatggctgatgtgggtttcaggccccactacagttactcagcgacagatgggaccccgtgtcctctgttggctgtagggagttgaggcgaccctggctggcatcttgttttgaggggtggctggctgctgtactttggggagggcataacaggatttaaatagtatctttatctaggatgcctggagccccaaatccatgtgggcctcccactgtgtgaatttcagatgctgccagccccccaaccccgccacccctgagatggaaattagagcaccagatgggctctcccaaggagaagcatcacaagcccaccctcctgcctctttggaaagtaaccctggctgtttattgtgagatgtggttgtcatggtgacaagtggacacccgcttgggagggagatagaggaaacgctgttatggaggaaaggtcacccctagagacaaccttgtgttgcccgtggacaccccatactatggcctccgtactggggagtcccatgggtagggcatgggggtgcagccatcagtctgtgtccccagccaagccttgagccctggcttgaagttgcatgaaggtacagtggctggcccagccctaacccgtggtggatgcagcccctgttgtgtcccccaacccctgacttatctggccgcctgatgagagtctgtcgccctacatctgtggcgctccctctgcctgacaaattaaatcccgcccagcttgcaggagggatgttgttaacctgatttcatttgctggtgggctggttgatttctttggggtttttttggagatgaccagcacctgtccagcaactagtaaggcagggaaggcctccaggaacccaagtccatgcagaagggcactgtgttggggaactttcagacaagtgggtaaaataccgacgtgtgctatgtgcaccttgaaatagcaaagtgtcctcaacagagctctctgggggatgtcccaaataaggtttactttaggagaatgtgagcggcatctgaggcgagattctcttgttgcatcctttggaagcttttgcttggtgttccttggccatagcaggaagatcagtgccagggatgggtgaggggaagaaaccttgcaggagcggtacctgggccagtctcagccctgcagaaaggggcgctgtctgctccacttggtcagtgcagggtctactgcaacagagtctcgggtggtcacagccctcttgtagggggaaggatgggttttgctcctgggatgctaggcttcgaaaagcagggcagtgtgccagcagtcccagacaaaccagagccgggcctttggtcatgccaggacagcagggtgtggtctggctaggcctgtgagcccctgtggggctcaggggtaggggcagcaggactgggggaggcagggaccaaccagacttcagaactgctgggtcccagctgcacccctgcaccacctcagctctaggaagggcagccccatgtagctttcttgagatgtagcagcagtgctctcccttctccctcgccatccttaaagcccggtgcccgctcccctgcatcccccactcccattgcctctgaaatccggtggtgtctgtgatcctggaggggaggcttagccagcaatcattccaactacctggggcacggcatatctgcccccatcagtgctgggagggtgggcccagatcctttaatttttctcaaaaccccagagaggcagagttccatcaaagagcaagacactgatagactaggacaggggatagggctggcagccatgcctcgtggcatcacctgactccgagagaagccagcccaacacttggggtctcagttttctcacctgtcaagcagggggaagaatattcattgtgtacacaagaggcttttgtaaaccctaaggtgctaggtaaattaggtaaatgtaactttttttttgagactgaatctcactgtgttgcccaggctggagtgcaatggcgccatctcagctcactgcaacctccgcctctcaggctcaagtgattctcctgcctcagcctcccgtgtagctgggattacaggcatccaccaccatgcccggctaattttttgtatttttagtagagacagggtttcaccatgttggccaggctagtctcaaactcctgacctcaactgatctgtctgccttggcctcccaaagtactgggattacaggcgtgagccactgtgcccagctggtaaatgtaacttttatcatcagtgtcttccttgccatcatcatattgttatttctcgataatttatttccagaaagttctggaactggacttaccatgcaggctccggaacctcctctgggaggtggacagggatttaagggctatggatctggcttctgtcttctggatgatataaggaactaaatagagaaaatatacctaaccttaaattttattaattgaagtagaagcagttgtagtttggtgtcttctttaagagaagacttatgacatgtacttggggcattttctatgttgtagtaacagattggctaatttgcatttattctcatccaagaatttaggttttttaaaaatatggcttttaactttttgggcactcttggtgggaacgtaaatagtactactgctgtggaaaacagtatggaaggtccttaaaaactgaaaaatagagttatcctatgatccagtgatttcacctccaggtatgtacgtaaaggaagtggaagtgaagactcaagagatatttgcacacccacgttcatagcagcaccattcacaatagctaagaattggaagcaacccaagtgtccatcaatagatgactggataaacaagaggtggcatgtacacacagtagaatgtgattcagcccttaaaggaaggaaattctgccatgtgcttcaatgtggacgacccttcaggacattttgctgagtgcaataagccagttccaaaagggcacatactgactgcttaatcactccacttacatgaggggcatagagctgcccaattcacagaaacagaaagtagaatggtggttggcaggggctcaggttggggttggggttgggcatattgaggagtttgtttaatgggtacagagttttagttttgggaagaggaagacattctgaaggtggatggtgaccatggttgtacgacagtgtgaatgtacttagtgccactgaactgtacacttaaaaatggtcaaatggtgaactttatgttatgtgcattttactgcaatcaaaagataacaaatttcaaaatgatttaaaataacttttttagaagtatgaaaatagaatattaagtgcatagcagtttaagtataattaaatagacgtctgcacacacacctatacacatacagacatacacatgcattttacaaaattgtatcacattgcatattcaggttttgcatcttgcatttctctaacatataaaatcacgatctttaacttccccgtttccaggtttgcaatggtctggagcagccaaggaagcagcagcgctctgatctcaatggacctgttgacaataacaacattccagaggtaatttttttcaaggatgagagttctgggctggaacactcatctaatgatggagtggcccaccgagttgtggtctgctcactttgtccatgatgttctcatcccacccggtgcctgggggagagggagtccaggtcaggccaagttggtgtcaccatatggtgaggaggtgagggcacactggcctgggaggagggaggagagggcctccctgatgttaggaccatgccatggagtgctcttgtgttgcagatggtgtgtgtgtgggggtgggggaccattggtactacttaattttataaaaagccattctattcattgtctgataaccatgttctaaactagggtttctcaacaatgacaccattaacattgaggcctaggtaatactttgttttggggactgtcctgtgtattgtagttgagcagcatccgtggcctcaacccactagatccttgtacctaccccatccccatccctgatttgtggtaaccaaaaatgtctccagacattgcctaatgatgtccctttgggaacaaaaatcatcccagttgagaaccactgttctaaatcaacaacaggttttaacaaacaatttcctataagctaacagtgctatgatggaagttatttcccctttctggtaacatagtttagatgagattatttaactttgatgaaataacgatggccaccgatggagtggtatccagtctcctttatcttgcttttaaagatgggcctggatggctctcatgccccctggttggagcgtcattgtgttggatggtccctaggctcccttctagtcaagatatgctagtctgagggcccctaagttttagatgatgggcttttgggccactccccaacatcatgttgcctgcagcagactggtttcctgtatggagctgacatcttcagaacaccatcactcatggggggtttgcttttctcattatggctcatatcacagccctgcttagccttcaccttgtgggctacctacttaacaattgttatgtgttttatttttccatatttcctaacagacaaagaaggtggcatcatttccaagttttgtggctggtaagtgactttgaattttatttctcaaggggcagttgcattttacatcaaaataaatggtgcttttagtttgggcattcacctgcaaagcttgtttacaaagcgtgcctacctaccagcaaggtgcttggccattgtctgtttgaacactgtgtagccccacttagtggggaggggaggtccagctgatctgcccgctttgatgcaaggaacagtagacgatctcctttaattataccctcactaattgcatcacagacgacactgatgactgaatagattgagatgtgtctttataagcagctggttatagctaacacttctgatcagggtggatataatgcattcaaattcaggctttttttttttttttagatcctttgtttttctttaccgttccaccctttttgaggaggttaatagtgcatttcaacattcagtaaagaatgaaactggtcgatatgttctgtgtcactcttggggatggggagcacacttgcctggctttgacggagctgagcatctggagaccttgcagggcccctgtaggagatccactgggtttgcttctagtgctccaacctcagagtaaagagcttgttcggcaggatttctgtctttgccaggaggatgtttcctgcccctgctaatgtgttataataaacaatgtgaatttcattaattctttcaataagctggtaattaattcttataaatatttatgggagcaaggtaaattagttttcagaaataaatgactttcagcccttcccatgctgcttttctttttttagcaaacaactaaagcctggggaactgaagcccccaaattcgcctttagagaactagtttgaaccaggctaatccagttccaattggttgaaactggattaactggctcaaatcaattttgactgttataactggcttaatgctgctcagattgggtgagaatctgttttaaaccatcagaattaatatcatgcaattgagatagacttggttccattttgaccaattcagataggctaaaatgggttttgcccagcagtttacatgtggttttaggtacattttatctggttcaaattggttttcttcaggccacagcaggttatgatgattcctggaagagaccacactccccacattcccgcttgtagtgtttgattgggttcctggtttataggagctggcacctcgtgagcagggcgaatgcagtacgtcactgtgccattttccttggcaggcagaagccagggtggggttgccagtcacactgctccagtgaggcagggtctcctggatccaagaagctcacttgtcagtgtatcatagtgtcatctggacagaactctcacactaggaggtgatttagacattaaattccccgacccttgaaccaatctcatatctgcagggagtgggatcgtgagggatcgggaagcagtgtcagtgcctggggtacctcggactctagctcctggcatcccagaagacttggttccctgcaccactcagactgttccaaagcaaatccaaacaaggccggtggcttaaaacaattcagacaggctaaaactgctgtgaccagctagaaccaatgtggaaaacctgaatttatagtttcttctgtaggagagaagccctttgattgttatgaaaacatagaaaactgaagcaaaacaacatcctttactattacagcatttatatgcagcgaggccttcatggaccaaaatcttactcagcaacaggaagagatcatcataatggtgatgccaaaccctagaatataatggatatgggaaaagtttctccaaattaaacaccgttatcagtttgaatgcctttgggtacaagtatcaaaatccccacctaacgttacacaaataggtgtgtgtcttacataaagaagtccagggttggacgtggtggctcacgcctgtaatcccagcactttgggaggccgaggcgggtggatcatgaggtcagcagatcaagaccatcctggccaacatggtgaaaccccgtctgtactaaaatacaaaaaattagccaggcgtgatgctgagcacctatagtcatgctatttgggaggctgaggcaggggaatcgcttgaacccaggaggcggagattgcaatgagccaagatcacaccagtatacgccagcctggcaacagagcgaaactccgtatcaaaaaaaatataaaaaaaatattaaaaagtctagaggtggccaggcacggtggctcatgcctgtaatcccagcactttgggaggccaaggtgggtggatcacaaggtcaggagttcaagaccagcttgaccaatatggtgaaaccctgtctctactaaaaatacaaaaattagccaggcatggtggcgtgtgcctgtagtcccagctacttgggaggctgaggcaggagaatcacttgaacccgggaggcggagcttgcagtgagtcaagatcatgccactgtactccagcctgggcggcagagcaagactccatctcaaaaaaaaaaaaaacaaaacaaaaaacaaaaaaaaaaagtccagaggcaagaggccgccggttcgatggctctgtgatgtcaggattggcgctgttgtgtctcttggcctcctcttcaggcttgtcacctcatcgtcacacagtgtgtgggcagccccagccattgcttctcgttctaggcaggaagaaaaaaggagaagggctgaagtccacaccagctggacgtcctccccttgacattaggaaagcaaaggttttctgtggattaagaggtgatgacttctctgcatgagaatcggaccctctgttacctttcatagtgtgctccctgggtaacctgaaaggcagcgtgtcagctgtgtctccaggcaacattgcttatggtgagatgctctttttgataaactgtatctagatgggaaaattctaatgcttgcggggcagggcatccagggctttgagcttctcacagtggtgactttcgtgactggcatgtctcttgaaggtgaccctggaagctatgccccacccatggggtgattgtgagagatactggctgctgggagcatgaggctcttagaccagatgggttccacatgcccttcttggtgggagttttgtacccttgcagctgacccatccagggagttctgtaccattgcagctgacccatccaggggcccatgagactagctgtgtgggtgcagtgtggactcccatcagagagtccaggaggcaaactggcgtctgtcttgttcccttggagtagacggccccatgtctagctgagccttaggacactgcatgcttctgaatatctagttgaaccttacttagaagacccagaagcctcttcgacacactgcttatttctttgtggccagagctgtgtcacatgaccagcctctcagatgttagtgttggccagacaatcaaaccctgggctttttatgaaggcagggcaggtctggaatcagccctgggtgcctgccgccacttcccatcccactgcgggcccttccagcctcctggcgtgtccagtgctgaggctgagtatgtgagttcctgggaagcccctgtgtaagggaggagcagctcctccaccctatttgtgtctgagaagttgccctgaagggaaatgttcctggagtattcatgagtatttggtctcagcttatgccttatttcatatcagataattgttgataataatgaaaaaaataatagtaacaatgcacatgataccgtctgaaccctcgttggggcctggtgtccactccctgtgccatgcagcatctctctatttcatgtcgcctggtcaaccaccacgtgaggagtaagtactttcccccgtctgataggttagaaaactgatgcacagtgaggctaaagtcacttgtgtgcagtcccatggctgtgcgggggacagagcctggacttggacccatgtcttggtgcttgacacataaactcgtagccgaggtcattcctccctacccagcatgccttcatataccaggaataggtaagacctgtcaggtgctttctttgagccaggcccagatctaagtgttttaagtatatcaacttaacaatcactatatccacagctcagggagagtgaatcccgggccgaaggtcaccaggtagcaagtggcagagttaggattcgaaccagtctggaatctgagctcatcaccacactgcactgcctggcgaccctcacgcagtgggtgaggaagaaccttcacttagagaagacctaccatgcaggtgccagagagttcagtggaggggagcgttccagatgccagagctcctggccttgtcaggcgcaggatcacagccttctctcagcagaggcattgtgaggaagggcctgccacaatcactgtctgtggaaagttctcggggtctagcgaccctctcagactgggaaggttaacgctgcagagaaaacctccttatgaaagtgcggattgcacagaggatgcactgcctgtcctgcggggaggaatccgaaagcagccaccctcaagatgtcccctcctacaggacgtggtgtctggcagcagcttgagcccaagctgcttagagggtcactgcctctggatgagtatatgtgaatgaccagcttttctatacaggtaaacacgtgctcattaaaaccaaaaggctgatgttagtcccaagcaatggggcctaacagtggcagcttcagtacaaaataacaaagactggtaaatcttactctgctttttgtactttgttctcctcatccaaagctcatacaggatgttttgaaacccaccaccccaccagcagcttgaggcttatgccaaaatgctgccaggccttagggtcctggggtcctttacagcctgtctatagctcatcaacttgcccagctccgtgtggatcatgtggaaggcatggagattacatgccccagacctggagctgagctcacctatcaccccttccttctctcaggggtcctcacagtggtaaagctgctttgttggtttcatacagtgggcacatgggatctgagacttagtttgctcttaaaataggcagttggggtgaacctgttcagataagactcttaaagtgaagacatctcccacctcctcctctttggtgtatttgggtgggggatggacgggaggaaggtcaccctgtgggaccagaggggatgtggcgcattccaaagaggagttatggaaacccagatgactttcctttttctacaaacaagatcatgtttctcctgtactacatgcagtcagcaggaatagggattcgtcgttttaaaatctgaacttttattcactaagtagaagttgttaaagatttctcagaatagtgcttgtatcagaccaagagctgcaagagttaaaaatgagaaatccccacagtacctcttgttctgcctatacatcccagatccctagtccttctgtatagtggaagccacttacatttcttgtgaatttctccaggaatttctcagctcatccataggcccttttccttaaatagacattgcactggccacatggctctgtacttagctttttcctttcttgctagatcttggaaacagcaataggtccacctgattatttaagcggcagcacaggatcggttgagtggatgtgggatggggtattaaccagcccccttggactgattgttgggagatttccagtcagtgcagcagtgaacagccttgtggctacgcctttgtgtttgggtgtgggttcttttatggaggcggttcctggctatggcaggggtacaggccaggagcacagcaactctgatagacacgggcagaatgccttcccaaggggggacagcgtacgctgctgttggtcatgtatgagagttggttacgtatgaggttcccacactgttaccaacactgcatgaccggctgtttgatataagctccaggccgatgggtgcaaagaggtgtcttgttgatttcacgtgtctttcataataagtgaagccaaacactatttcgtatgttcataggtggtttttcttttcagtgcactgccagtttgtttcctgtgctcattcctctgttagattttcacccccagctttattggcgtataactgacaaataaaagttttgtatattaagtcatacaatgtaatgtattgatataagtttacatggtgaaatgactaccacagccaagcgcattaacatagccatcacttcacatagctacctttttgtgtgtgtggtgagaacacttcagatcgattgtcttagcagattactagtatacaatacaggattattaactacagacatttactcatctcataactaaaggtttgtaccatttgaccaatatctccccatttcccccacccctcagcccctggcaattgggaatttgggtgtttcttattgatttgtattattctttacatataaaggaaatgaaccctttggtttgtactgtaaaagtttaccccagcttaccattcttttcttcttcttctttttttggtatgctttttactttgctaaacatgtcatttagtcaaatatatcagtctttttcctttgagcttactgagtttttgaggttagtgtgaccatcacactcctaagattatttttgaaaataaagttgttggccaggcacagtggctcatgcctgtaatcccagcactttgggaggccaaggtgggcaggtcacctgaggtcaggagttcaagaccaggttgggcaacatggtgaaactccgtctctactaacagtacaaaaaataaactgagcgcagcagcacgtgcctgtaatcccagctactagagaggctggggcaggagaattgcttgaatctgggagttagaggttgcagtgagccgagatcgtgccacagtgctccagcctgggcaacagagtgagacaccgtctcaaaaaaaaaaattaattgattaattagttaaataaaaagctgtcttccaggactttggtattattttaaattatttaaataattgatttatctggaatttatcttggtgtatttatacaggaaaagttacattttaggcattttgtcccaatagctagccagttatgccagaactatccaaggaatctttcccttgcaagtttgaaatgctgcctttaccgtacccaaatcgtcatgtgggtctcggtctgtttctggatctgttacagggacggtccattcaggttccagatccaggctgctttatttactggggatttatggtgcattttattacctggtagggctactttcagaccttgccaccatcattccatttcagatttttttcctaggtatttttgcacttttatttttccatagtaactttaaaactagcttgtctggttattcactgcaaactcttttgtttgttttgttttgttttgagacagagtctcactctgtcgcccaggctggagtgcaatggcgcaatcttggctcactgcaaccttcgccttctgggttcaagcgattctcctgtctcatcctcccgagtagctggaattacaggggtgcaccaccatggccggctaatttttgtatttttagtagagatggggttttgccatgttggtcaagctggtcttgaactcctgacctcaggtaacccatccacctcagcctcccaaagtgctgggattacaggcatgagccaccgcgcccgggccactacaaactcttactggtatttttattaggcatgcttaaagtctgtccatttaggggaaaaaatgtcagctttacaacatagtctttctagccaacaaaggatttatctgtccacttgttcaagctcatttatcttcatcggtaaagttttttcataaaaattcaacacatatcttgtttgtctgtttcttgttgttttatcccttttattgtttttgtaaatgctgactttcattatttttcaacatgttgctgtttgtaggtacaaagaaagctatcgatttttatatattaaatttgaaaccattgccttagtgaattctcttattttttaaaaatagatttttagttgttttcttgagtttttcctggcatgcaatcataccatctgcaaacaagaatgatttttgctgcttcctttcttgttttctattacttcttcttgcttaatcagattgggtagaacagaaggaacaattttacataatagtagaatatggcttcctaaaaataacacctttttgaaagatctatgcttttaattttgtcataaaaacttcaagcatatgaaaaaatagcttcagtatttacccattcatggctagtggtatttaatctacaccctgaccctttcccagattattctaaagcaaatctcagatcttacatcatagcctctttaaatatttcatattgtatctctaaaatataggagttctgtttttaaaaataatttcaatgctgttatcacaactaaagttaatatttgtttatgccattaaatatttgtttttgtttgcattttcccagtttacagggcgctgtttgaatggggatccaaacaaaacccgtctattgagattggtcaatgcatttcataattcttttatgtctcttttaggttgtccatccgtctcttttttctgtcttacaaatttttgttggtgttattgtggaagaatctgtcatttatcctgtagattttcctgcagtgtggattttgctgattgcatcttcatggtgttgtttaatgtgttcctctattctctgtgtcctgtaaaatagtggttgtttttagacatagaggcttgatcagattcagtttgattgggcaaaaactttcgtacatatttttgtgttgttctattgaggcacataatatctggtcatctcttttttggtgatattagcaaccattaatgatcattgtctagatctagtaattgattagaagttgccaaatggtggtgttctaatttcatcatttcttcttcattagttagctggaattcttctatgtagagaaactttccctcaagtatttggttaccctgaatattgttcatataagaaaagcagattaaatgcttgatttcttctcttttttgaaaaatttaaaaattaatgagttggctgggcgcagtggctcatgcctgtaatcccagcactttgggaggctaagacgggtggatcacaaggtcaggagatcaagaccatcctggctaacacagtgaaaccccgtctctactaaaaatacaaaaaattagccaggcgtggtggcgggcgcctatagtcccagctactcaggaggctgagacaggagaatggcgtgaacccgggaggcggagcttgcagtgagccgagattgcaccactgcactccagcctgggcgacagagtaagactccatctcaaaaaaaaaaaaaaaaaaaaaattaatgagtttccccgacagcctttaaaagataaccggtgaggttgtgtatgttgttgttagcacagttgatgtgttttgtgtgtgttaccatgattattggtgctcaagttttctatggccaataagagcttctttaggttgttttctgagtcccgtcaatgtgaacccagtagtctttgattgtttcctttctttctggtatattccaggatcatcttaaatatttcttgccccaggtctggaaccagttggttctttctccatggagccctgtgaaataacatttagagactgtaatctgggtagtgtggttgctcgttgttgtagatttggtgagagtgtatatgtctatgtggaaggcgcctcctaaatggcccccaaggacccctgcctcttggtattcatggctgtgagtccttccctccccctgtgtgggggatggacttactgagctgcttctattgaatagaatatggtagaagagatgggatatggcttccaagatcaggttacaaagagatgtggcttctgtctcagcttgtcctttcttgttctctcttacttgttccctctgaaggaaccaagctagcctggtgtggttggcagttgccccatccagaggcccacgtggcacaggactgatgtttctggccagcggcctggtgagagaacttggaagtggatgctcccctcttcaggcattcagatggctgcagcatcactgagtaccttgctgcctgtgacagacgagaggtcctgagccaaagtcacccagctaagccacacccagattcccgatccacagaaactctcagataatccacggttgttgttttgagccactaaattcccgagtaatttgttatgcagccaacaataactaatacacaacatattttttaagatcaaataacgtcatgattcctaatgatactttgtcaggtttataggttctaacatttgtagtttctttttcctgtgccccaaattcctgttctcaaggacaccagcataattttgcattggttttattccattaagcttacagcagtctcagaataacaataccaaacactgccaaggacacatgattgtagatacagattatgatttatttgcatttacttttgtgtttagaatacatcccacaagggatgtacagtcagacaactgtgttttaaaatattttggaatagatcacaactggatacacttttagattcattggtttcatttttctcttagttatttggactttgctttttccatttaattttgttttataattatataaaataattacatggtatgaaattcaaataaacaacacaggatgtatgcaaagaggtcagtttcttcccctatttatccccccacctcccaatttcttcccttccactataggtaaccattttgagcattttacatatttttattgtaagcatgtcttcccctttcttaggtaaatggtagtggattagactcccatatctccatcttgccttcttcacttcacactaaaccctggcggtgatgccacagctctgtgctgttcacaggagcatggagaggatgttctgcagaactccactgtgtggatagatgtctcctgttcaggagtgtttgggtggtttccaggtttttgctattacaaatagtgctgctgcagtgaaccgcctatgcatatgctttttcccatttttgccatttttttttaaaaaaaattatttattatgctttttctgggaagtcattctccccactgcaagggttaggatctgtcttgggcaactctgtgcgttttcttgagcttggctttgaccttccttccctgactctctgttgtggcttctcttcctcccagcatccagtgacttaatcttgctcattgggtgtctaaagttcaacactgtggaacccccaaatcccttttatcagtgacaaagcctgtgctgcaggcccaggtgtggccactccctggtgaatgtcccataggtgtgattttcagatggtgtcttctctttcgtatcagccatattatagggtcaccttcagtgggggcatctcaaggcacaggccctggcagtactggagagtcgggcctggaggccacgccttagctctgcagcagaaggtctcacttgagacgccagttacacgactctgatactcacccactcctgcctcctttccccactccagacctagggggcacttcagggggcaggctctcctgctgatctggtggctcgcctcctcccagtcctgtcctgccccattagagctgcagcccctcctcccagttgaggccaggtcccgtctgcactttggaacctcacacgatctgatgtcgtttgtctcctgtcccttttgctcgcccctccactggcttttgaccacgtctgtcccaccctgcatctatccacaccaccccgctctacctgccccttttctttcacagccggaatctgggagtggcagcctcattgtctgcacctcccctgcacctctcagccccctctctggctcctgccccggttcctctgaaacagctctttgaggtcacgactgacttccttgacactgtgcccaatacacgaggtctccttgtagttggcctcctgctagcatgggtgtagatgggcaggcctccctttctaagccccttcttttcttggtacttagcagagcagagtcctggggcttcatcctgcccccttgcccatgaccttccttgcagactcatccatgcctgcagcttcacttggcacctgcagatggttcattcccaaatctgtttttctaaccgggactcccgagtccagccgcctactgagcatccaggctcctgccactaaacttgcctggaatccccaacccaagctcagtcctcttccaggcaccctttctcagtgaggggcaggtctgtccatcgagctctgcaaccattgtctagcgtcctcatcttctctcagactccagtccacctttccgtcctgttgatggacccctaaatccccatctgttgctgtctctccatttccgttgtcaccctgtccgtaccatcatcaccactcatgtgctgggatggctacagtagcctctcagctgctctcccttcttcctctctgctgcctgcccctctgccagagttcatttctaatgaaggagtggttgggccacttccctgatggataccctggagtgacagtccttatggcctgtcacccgtggccccagggtcctcacatctggccagcgcttcctccccaccctcgacttgtctcagctgctggcccatgccctaggcctcggcagtccagacatcctatagatcttctaaggtgtcattgtctctgcaccctagggcctttgcacctgctcccgcctcagcctgggaggctttctcctccttttgccttatggcttgttgattccttctcctcctccagacctcagcttaaacagcagccacccccaaattcctcaccagagcagcctccctgtcccttccttcccagggccatagcctcccttttgagcattcaccatggcccatcctgatgcatttgttctgtggctgtgggactgatgtcagcctcactgtgtagcctgtgagctccatgtttctgtcttaacaccggtctttatacagtgggttcagaaatgctgagcacctgaactcatgacagtgaacttgggcaaagccacgtgacccacttagatggtccttatttgtaaaattgggaccctgagattgcttcatggcgtggttgaggactgggtggaactgtaccattgttgcacagaggtctggtgtgttgggcatgagggctgcactccaagactccgtgcctttgcagagagcagcgggccttgtggatgcacccccacactcccacatacacctgtgctccagctccacccagccacctcctcccagacccccaggatatacagggacaggtcttggagctaatgagaccccctggggccacactggcaccttagaagcctctgtccaccacccatgttcaggataattttcttcaaaggtggcaggagtggagaccctcaggcttgaagctgtgggactcccctccccttccctctccagagggcctagggttttcctaagcggtgtttcaaacagaggcttcctctggcaggggagaacctggagcgccttattcttctccagactgtgcagatacactgtgcatatgcctatgtgagtaagatatacggtgtgaaaaggataaatcactctctggggagacaagatctttaaacctgtatcttgattatcttgtcattttgtctccctctggtggtctcagcttagggtcagtgcaagacttgagcaaaataacagcaatttctacccaaacatgtagggctagctgctttcattttctaacgaagctgttagatttgggttctgcgtttcctgcggaagttgagagctgtgcccatgaatctgatatactccccacaccatgccgcccccactggactcttctctgggtctgggttctcctcccgtggtgcgtgtgagtgggaggcaggatgctggggccaccttggactcgattgtttctcgctgaacaaaagagcaaggcaggcatggaaggcccccaggcagaggtgggtggtggctggagttgcagcaaggcccttgagtgcttcactggcctcatcccggaagcaggcatccgtgggtgccagtggtgaccccctgcctgggatggggcatccttcacacacagcagtctgtgcccagatgggccccagagctactgacgctcacttcagggggagacgaggccagtctttcccaaatctactcaaggacatgggtcaacatggaaatgtgaacctcagaagggtctggtgcactgaccagggccaccctgggggctggcgagggagaagccaaggggcagtgcctagaaaggtaggagtcagattccaaagggagggctggcctcccagcctccccagggcctggggctgacagggtgccaggcagcccctgccacagaggggacataaggacactcgcccaaggccctgctcacctgctggggctgtgaggctggggtacctggggcgcctggaagaaccagagctttcctgcagaacaaagtgacgccatctagtggtcaatgagagccactgcattgggccccactgggtgactggggcttcactggggggtgcctgttgagccatgctcactggggacggcaaggtggtgtgaggtagtagaaacaggcctacctcaggcgctgggagccttcccagccccacagccagatgccataaaaggcagcacagggcatgtctggcgagcctgtggcagccagggctgtcatacacgctctccaagccccccagctaggcagatgtgcacacttcactctgaagaagcgccagggtatggtgggggtactgcattgggatagatgggtcctgttccctctgtggggctgcctctgattctcctggtgacaggagaatcccggtgtaccctctgagagacaggtggacaggggttcctcccctggtgccacccctgaatcccgcagtcccccacattggtgcctgcagccctgcccagctgggagaaggtttatcggctccagggcaaggggtgaatggaggatatttaaaagccgtgggaggaccccattgataggactcagttagatgcacaggggagggatgggggtccctgtggggagagacggctgggagcacaggtgatcctctgaccccaggggcacgcagacccactactgcccaggaaagcaggaaggagggccaagtgggctgagcaccaacgcgaagctccccacttggtctgtctgagcaggtgagggaggggcagccaggagtttgaggcagtggaggggtctggaataactcttgcatggaggaagagtctgagtttcccagagagatagatgagagttgtgaggttgtttggggggcatttggggtcaagaatttataatacatttatcatggcactcatttgccctcttgggcagctttttccagcctcaggtccagagaaaacaggttggagatttgctgaactcctgtgggcagatacacaggactggggtcagggaactgaggatactgggcggatgttattgaagtggtggatggcagcgcccaagctgggccagttgatgattttagcaacagaatgggttagaggtgagaccagggatcagctggctgagggagggaagaggtcaggaggttgctggcgcgagggctggggaagtgcaggatggctgggcccgtgatgctggagggactcagggaggggccagctggagcaggaggggagccaggaagccagggccaaaatccccagtggaaggggctctggccaggaggtgggcagtcgggagggataaagcaggtgacatggccaacatgggtctgagaggacagccaagccacggtctaggatagctcagaggtcggctgactgcagccccaatcgcaaatcctcctggccccctgattttgcatataaagtttccttggcacacagccacacctcctgttttacatactgtctacggctacctttacgcctcaggtacaacggtgaatagttgcaacagagaccacaaagcctaaaacacgtaccatctccccctttacaggaaaggtttgcccacccctagctggagccttattgtctggcataggagccactcaagattggtttgtgggcaacatggacaggacttgggggttggttggatatgactctaacatgtggctctttatatttcaattaattaaaattacatacaagaaatgggtccagtccctcagctgcaggagcctcagtgccagtgctcaaagccacatgtgggtagcggatcctgtattggacactgcagagatagaaccttccattgtggctggcaggaagtttgttgggtcacgatggtctaggggcagcagatggaacaagcatgatgttgccaagcctgggcctgcggtgtgatgggtgtgaggagctacacgggtgtcctgagaggctacagacaggcaggagcccctcaggacagatgcacaaggacaggccaaggagaagcccagggcacagtttcaggtcaccagcatgagttccggggctgtggggaaggcatggaaagtgctgttgtgtttgggatgtgacgccttctggatttgcagcctgtgattgtcatcttgagtgacagtcaactggaatgctggcattgtcctcctgacactgtttgtgcagagttttctggcccaagtgttgatttcgcgcagttacttgcagcacggggtagtgagggaagcagaccggccgcccgtggctggctgcagatggcaatggttgggcccttctagtttgccccgcatcctggctgccgtgttccttgtgctatggccaggcatgcaagttctttgttcaggggacttctcctctaggaagactctgactctgtgccctccttcagttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaaggtagaggtgcttcgagggcccctcgcggatgcccgcacactttggggggcactagcaggagggaatatggcggggcgtaggccctcttccagctcggactgcacagccctcagcacagggggcaggagcggcccaggtgccaacgaggctgagggaggcttgcgccttggctgggagaaagctggctgggcagaggcaaccagctccttaacaagaggcccacggaatcccagaaatacgacctttaaagatcatcgttccaaagcattctagtcatcaaacaatcccaaatcccagttcaacagtatgtgtatttttagtgccattcagagtgcttcaagaaagggtgaaaaataaatcacgttttatttaaattcaggacctcaagaaaaactttgacctgcttgtagctctaagtgctcattggattgtctggttttgaacatcgggtgaggccgggcaaggggaagatgaggccacgtcagcaaaattaaatggggtcggcggggaggggatgcagccatctgaggtctcagctctctgagcaagacaggatctgcagaggcccgccagcccaggggtgagaaatggcagcaacctcctccccagccctcaccatacacaacctcctctaacagaagcagagaagcaccatgaggccatccggggtgggcaggagaaagccaggtaacccagggcagtgctgagccctgctggccagtgcctctcagcagaggcccggccctcccatcccagacccttgccttgctccgctgcctggagctcagctccccttcctgccggctgatggcatctttcctgtcctccatagatggggtggttggcagtcatttctagcgctccagggacacctgtgtgggcttctcttggtcagtgtgtgtgcttgaagtgggcaatggctgtccacccgtccctgctgggctttgctaggcaccagacctgagagtgggggcatcaaccaccaaagtgacataacctcacgcaccttccttctctctgtgccaacttgtttttcttttctcttccatgctgtcagaggatgcaaaaggctgctaagatcaagaaaaaagcggtgtgtagggccttgaggccctgggacagtgttgtttgcttgtgtttccgtggcttgtcctgggcagtgggggctggggggttcccctggggatctaaataatgttgcaaagcagcttttcctcttcccttggtaggtgaatcttagatgtttgtaaatgaaactacagacacttcatttttttaaccacccatttatggaaggatttattaattcttctttcttagcatctcctgtgtactgtatggataatgctgtgatgttcctgttttacgtggacattttaaattgatatgacatttagttgatatgacaacgtggtgggtgtagggtctgggcctcctgtgcagtattactgaattgttctgatagttaaagattccttaagcttaatttactaagtcaggagggtgagtagctcagtttgcccgtgtggtgctttctttattggaaatgagtttttgggctgggtgctgtggctcacacatgtaatcccagcactttgggagacagaggcaggaggatcatttgagcctaggagtttgagattggcctgggcaacacaatgagaaccctgtctccacaactttttttttttttttaattagctggtcatgatggcacatgcctgaagtcccagctgcctgggaggctgaagtgggaggagcacttgagcctgggagtttgaggctgcagtgatctgtgtttgcaccactgcactccagcctgggcgacagagtgagaccctatctcttaaagaaaaaaaaaagaaacaaaaaaagaaaataagtgttgaaacactggcagacttttaaaaatgggttgacactgaggccgggcgccgtggctcacgcctgtaatcccagcactttgggaggccgaggcgggcggatcacctgaggtcgggagttcgagattagcctgaccaacatggagaaaccccgtctctactaaaaatacaaaaaattagccaggcatggtggtacatgcctgtaattccagatactcgggaggctgaggcaggagaatcacttgaactcgggaggcaagaggtcgcagtgagccgagatcatgccattgcactccagcctgggcaacacgagcgaaactccatctcaaaagaaaaaaaaaaaggattgacatcgagtcatttgtttgtcacctggtcatttagtaaatgctagagcttttccaatcctcctcatacagaaaatatcaaaatagttggtgtcacaaggcctggggcaaaccccggggtccttggcactggcttattgcccactgttttcttctgtttaaacagcaggagatttagttccccctccctgctttgaagtaatgccattttctggcgctttggccagaagacccatgtggggactccctcttctggagtgagactttggtccacctaggatgtctgccttttgcccagcagcgtctcctttgattctgctcaggagcaggagaggaaggatcatgctcatgctcctcttcccgggctgatttcctccaggcaaggcagaatgtgccacacattgcagacttgcagttggggtgtgcttttctcaaaagagaggggccctcgcttgcagcctcctagtccagctggagcagggagtccctacggactgcagctggcttctgggacctgcaggtccagcaatcctacagagtcgctgccgcctttagaggggttggtacaggcagacccagctcaaaaaggcctctgcggccagtcaggtggccgcctgattacatttaattacggtttgttcttcctttttggaaagtgggatgctcagtgtcattgctgaaggtccctttcctggcccggccacagccatggggatgactgcaggtcatgccccccatccacagacatgccgaggcccaccctgtggcctgttctctggtgtctgtaggatccgtactgtcgacaccctcccttcttctgccaaggaggatgatgggtgtcctctccctgccctgttactgatgggttttccactggaggctgggtggcttcaggctgcccctcttctcccatccagggatcccagcctcaggtttcctccacaattgtcactaatgccaaggtccacctgcaacttttctcacttctggcttgacctactttttagcaagaggattttgagccacaacccatgaatataacctttaaatgcatgctgatgctgaatataacccaattttaaaaaacagaaaaagttcctccgcggctgcggattgtcagctgcactgctttcaactcctttctctttctaatgagttaaaagcaaagaaagcccaaaagaccctttcccttgaaaattgagctaaaatacacatttattattacaataccgggcctctctaaaactcaaaattcttgaggaattgtcagcagggagatttcttatttcagattttctagtgaataattaaatcatagtttttgctgtttcgaaatggaaaatagaccaccctgggctccccagtgaccacggagaattattcacctcggtgggcaaaccaatagaacttgaaattcattgccaccgtgcagtggtaattaggattcttacaaatgtaaaaaccaattaaaggctatcctagtttggggcagactctgaagagttcactcagctcagaagagcccatgaaactcgtctcacaaccatatgccagacatactacagtggctacaggtgacgaattaggccatttgtgtggcacctctcttggcttctctctgtcgctgtgaggacagcacttaggccagccccagggctcagtcccccaaggacgctgtgggatggacatggtggtgactgattaaatcagaaggaaaggctgacattttcattcagcttctctgacaatgtcttccccatttcttaaggatacttagaatcccaaatccaggaaacgtaacctgagtctataaattccacaggggtcagccagagggccttgcttgccactggcaggaggggctgtggcgacagacccaggcgtcccgccccatctcggtcaagctcccgggggctggccctcctccctcccaggtgcctcttacagactgcctcgagaactcacacttagctagatgatgcggccggtggcgtgcaggtagatttctgatggccagtagcatttccttctacgtggactctgggtaattgttaaaattgccgagccttccttcgagttattactttttacattgacggataaaattgtatgtatttgttatgtacaacataatattttggagcatatacacattgtgaaatgactatatctagctaattaacgtgcattacatcacctagttttaatttttgtaatgagaacacttcattcactatcttagcaatttttaagaatatgaaatattattaacggtagtcaccatgatgcacaatagatctcttgaactcatttctcctgtctagcaggagctttgtgtccgtggaccaatacttcccccttcactcctttgccccagcccctgataaccaccattcagctctctacttctgtgagatcgacatttgtagcttccacctgagtgagatggtgcagtatttatctttctgtgcctggctgatttcacttcacagcatgtcctctagggtcatccatgtgttggaaatgacatggctttttctttgtgaaggctgagtaggcctccagtgtgtctgcgcgccacatttctttatccattcatcgtgaatggacttcgggttgatcccatgtcttggctgttgtggatagtgctgccgtgagcatgggagtgcaggtgtctcctagacacgctgatttcacttcctttggaaatatgcccagcagtgggattgctggatcacatggtggttgtagtttgaatttttggaggaaccgccattctattctccacagtggctgcactgattcacaccctcccacagtgtaccagggttcccttttctccaccccacgccagtgcttcttatcttttatctttttgacgagagccattctgacagatatgaaatgatatattgttgtggttttaatttggatttatctggtgattagggatgttgagcattttgtcataatgctatttgcatgtcctctattccgagttggtttttggactttaacaatatccactgtccttcttagaattctgagggggatgcccagacgctgacggaagtggacctcttcatttccacccagaggatcaaggttttaaatgcagacacgcaggtaagcgtttaagacagttgttcaaaatcaggtaaactcctaagttcgactccttcttgtcccatggtataggccctcgttctcagcagcttctctcctgtgctctctgcgcccatcaacccaaggcccatagcccgggctgcgggaggagcaaggagcgcacagcaggtagcagtcgtgctggcgtcaccccagggctctgcgggcgggaggtaggtgggaagacctgctgggctacctgggccctcccctgcttccccactcccgggtagcctgacctctggggacagaggaggcagcagcccccactatgtggctcacactgcagcccaccactcccaacccagtgccgtgccctgaccatcctccaggccctcacataccctgatacgggcacaggggcgcccttcctcatcccatgtctgtcctgtgtccaggcttgcaccttgtcccactgatctttgtgtcctgcacccccctaccctggaaccagccccctcctggagcctggcacttggtgaaaactcagggagacaggtgccagggctcaggcactgggcttgcgacgcttcacagactttgacttcattttctgatcttttgtgggcaaaccatctggactagatccccccaccaaccctccgagccccatgcctcatcacccacctgtgctgggtgtccccaagaccaccacaggctgggtggtttggaggactgacaggactcagtgagctcacagctgagatttatttcagcagatggctccagagcagaatcagcaaagcggatgcaggcttccagagccctccccgcagtcacacaggacacactgaactccctggcaaggggctgtgacaacagagaagttgtgtctaccagggaagctcatagacactcagcccaaggtgtttactgggagttggtcataggcaccctctgcctggcagctaccaaaattccagactcccagaggcaaaagaggtgtccagcctagaccacgttgtttgcacaaacggtttaggcaaaaggaaccatggttgtcagttcgggtgctgggtaccctcctgagatccacgttcccagatgccagagagggccagccttgcaggcgggcctttctgggtacagctgctaggcctgccccagtacctcttcttgccagtgtacatggagggtgccacacctggggtgggaggatgggcttggggattgaagctgagccccatcctcatgagctgtatagccttaaacaagttcctgaacatctctgaacctcctaatacccacagccccagctgaaagagtaactcttccgctggatcctgtgaaggagagatgagaaatctcctaggctggcccagttcagggttcactccactggccccttctcccttcctttcctttcccttctggatctttggattctggacagggcatgcaaattaaagctgttggggcagaggagctggagaggagggaacaggtgagagactgggaaggccaaagtagccattcagagcaggagagcagatgcggccatgttggtaggcagcctctgtgaggaggaggagggatctgccattgataggagctggggaaggaacatgtttctgacacctggggattgattcaggcatttatgacagtgacagaaatcaggagatgctgaagagccactccaactgtttcctttcagtgtccctccctggaaggtgactcttgtggttatgaaacagcctcatggctttggccagaaaaaaagtcagcagctgagacaaaggtgaagcagcatgcactgcaaagtggattctgtgaggaagaaatgaggtccagaggttgcagaaacactcgagtttcttttgtgaacagaggacaaaagcataaaagaccagttgattagtttttttgagctttgtgtgcagtcttgttaggtaggggttgtgggcaagatgctggctggagattcctgtccaaggacaaaaaaccatcaagagtcatgggcctgccagaggccgagggaattgaagtcaggtgggctaccttggtgtcttttgacccaggcccaggctgtttgggctccctgggaagagctcattgaatgacaaacattggccttgatgctttcctcttctgcacagcaggaaggccaggccaggccactcttgggcccataggagagcacctcgttcagaagggacccttctccagagccactggtggcctctcatccgggaatgtatgggtttcactatatggcaagcccctgctccagcagagacagcccgagagctcacctgacatcacgcctccctgggttctgcacagtccattttggaagctgggactgagatgagggcagagtgactttgactgtaaatcattaccctaaaacgctctgttaattagggccgtggttctcaaccagtgtgatttttgtccctcaggggacatttagcaatggctggaaataattttcattctcacacttgggaagagggaggtgctactggcatctcctggggagaggcttggaatgctcctaacaccttgcagtgcacatgacagccctccacaataaagaatgatccggccccaaatgtcaggagaatcagggttgcgaaacccgaataattggagtgccttttttttttttttcctttctttttttttgagacggagttttgctcttgttgcccaggctggagtgcagtggcgcaatctcggctcgatgcaacctctgccttcacagttcaagcgattctcctgcctcagcctcctgagtatctgggattacaggcacctgccaccacgcccaactatttattttatatttttagtagagatggggtttcaccatgtttgccaggctggtcttgaactcctgacctcaggtgatctgcctgcctcggcctcccaaagtgctaggattacaggcttgagccaccatgcccagccctggagtacttttcaatggattgtcccagtagtgttccctgacgtggcactgtctccctcccgacaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgtaagtaagcccttgccagggcactcccctcccaaagttcacagcccagggcggctccaggatccaggcgctgtggaaaccaccctcaggtggaaagcctccatgctgttactgatgtttccagtggatcagtgatcttttgcatactctttgggtttgcaaagatagtgaatacagttttattctacttcttgaaataggttcttcaggagctgtttataaattgagttgtggttaaatatatgagggagctatttgaagaaatccctttacaaaacattttctctactaaaaatgaagttaatctttgcataacttttgttattaaaatgcaaattttcgcatggccctggcatgctgtataaagaaagcacatctgcacatgaggcttagttctgcctttgcgtgtggtcttcagaggaagtaaaaagtgattctgaagtataagataccaaagactcaggaaaagatcacaagccctttggctccctccttggctggagaagagtgttgtttttagcctggagggggacagaggggctgaggaaggagcagcagggccaagaggggagctcagagaggaactgtccttcctggaggctgatcttactcacagaccagcagggggcgctgctggtgagccagttttgtggctgttgccagagtgaaattttaaaatatgatctatggctgggcacggtagttcatgcctgtaatcccaacacttttgggaggctgaggtgcgtggatcacctgaggtcaggagttcaaaaccagcctggccaacattgcgaaaccctagtctctactaaagatacaaaaaaattagccaagcttggtggtgcgtgcctgtaatcccagctacgtgggaggctgaggcaggagaattgcttgaacctgggaggcggagattgcagtgagctgagatcgtgccattgcactccagcctgggtgacaagagtgaaactccgtctcaaaaaaaaaaaaaaatctatccttcaggggcagttggccagggcgttctttttcacataaggacttgaggctgtctcagggacctgggcaatagggaagggtccccatattgtcatgatcctgacatacagcatggaaactgaagacagggttcaaacctttggctggcgcagtcatcttcttcctaagaacttgggtccacttgaagtgcttcggcgcaatggcagatttacaggagggagagagcatttcaacagcgcactcacacattccttccaccgctacacggagacccttcgaaacctggatgggtatttctgtgtgactgagggccgaggatgtgtgagagacctggcttggggatgggccacaggtactggcggaatgaggccaggagcaggcccggtggcgaagggtggcagtcagctggtgagagtttccaaggggcactgagagcccccaggtgcagccgatgcggagggttaaagccagggtatgccgtattgggtagatgaggccgcagggtggtcctgccagcaacagcagcctcctcttccccacctctccagcgcctgcaggctctgcccacagcccacttgcaggaggccgcttgagccctgaggtggggcctgggctgggctcctggactcacagcagtgaacgcccacaggcttggctgcgagttggggccggcagggcgaccccttctctgaagcgccagccgcagagagagccccctgaaccccacacctcccaggaggcagccggtacccggcgtggagtgacggggaggcggcggctggcggcacaccagcggcccagatgacaccggaaggaggcgcagccccgcggagccggctccccgggcttggagcttccgcgggggcggaggatgtcgtccaaggggaggaagaatggcggtggcccgagggagcccaagtggagtccgagggccgtgggtggtggagccgggcctccggggctccagggctctcaggccgtccttcccagccaggtggcctcgtcaggcggagacagaagcagaggcctgggggccgccctccgctcttcccaaaggcccgaccctctcctgcgcgggcgctgcccccggccctcctgccgagccccatcagctcgccaactccgcaggccagcccggcggcgccatctggcggtccccgggcgtcgcgcctccagctgggtctgtgcgcgcggcagagatgctgggcgtgggaaccggcaagtcctggaaacggcttagggcccgtcagggagggcagttccacgcctgctggagggcaggccgcctgctgcgcgcttctaatccggcccagcttgtctttcccaatgcatacattcatctgctgctcttacatcctgccacgtggagagtgggaagggaattgaggccaaagcccttgttttcacctgttttgggatcctgttgagtaggagtttgctgggggcgcccgtgcaggacccccttgagggcagttggggaggcacgtgaggagcaggacagcgcataaggagggctcacacagcccagagcctggcgggaggccccgctgtgggctgaggcgtcaccaaggccgccaagagccccgccgcgctcccagggctgcacagctgccagcctgcttggcgagctccgggagctcagtacagccctcacctcccactgtctcctgtctgcgcaccagcaggcggccggccaggccctgagtgctgtttcagtgtccaggcctttgccatgtcagagtcggtgatgtccactgaagcagctcagcggaagtagaaagaagtgacgtgcttcatggggcctgtgtggagtcccaggtctcatgtcttgcaggcctggcctggcacagccacacatccctagaagagcagccaggcacaccctctgcctccagtgggcactgggttctgttgctaccgataaatacatgcggggtagacaactagcagcacgatgctcccggaaaacacactgaaagtccattttcggcatcagatgagtggaaaggaaatacagatggggtcaggtgcagtggctcacacctgcaatgccaacagtttgggaggccaaggcaggaggatcacttatgtccaggagtttgagaccagcctgggcaatatggcaagacccctatctctacaagaaaactttttttaattagctggatgtggttgtgctcacctacattcccactccagtctgggcaacagagccagacctcatctcgaaagaaaaaaaaagcaacaaaaatatgacatgtagtaaataattcattgttgtcccagactttctttgaaacagctttgacctggagcatctgggccgtgccacagcttaggcagggacagtcaggagtagaccctttggggttcagggcaacactggggttcgctcacggtggagtgctggtgggagacagccttcatcagatgagggagggcccccagtttctttcttgttcttctaagcccgagcaagggctcccttgaaggcttatgggtgcatcctgcacccagccctgccgcagccccctgctgaggaggctgcggggagcctgtgccacgtgcctgtctccagctggcctgccctctgcacaggcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggaggtaagccacacccaccagcctcagggaggccacatttgccagcttctgctccctgagctcctgcagagcgagccttcccggggtcctcacgcacacccttgccttcctatcagactccagtggggcccggaatgtgcacctcgctcctgccttccagctgagcacttgggtgtgaaatgaggtgtttgtaacaaagaagctgattacagtcagctttaatgacctcgaaaatgcgccttttaatgctgctattatcatcaaccagcactcagcacccaggagatatttctgaaaagcatgtggcatctctaaagggagcctgggggctctggcagaggaggctggaagccaccagtagcagaggccttagctggtcccagtggcttcccccaggggactttggaaagttcttatgggcagaggagcaaattccctggggatggcccatacctggactgtttgttaaatggctgaatgattgtgtctgctgtggatgagtggatggtctctgctgcttgttgaatgggtgaatgcatgatcctggtttcttgctgaagacattccaggcagtttctgagacagtgacctttgagaggaaataaaagtagaaggacttttccaacaagagtgaaggccgggggcaggatatgggtatgggagcctgagaacattcctctggcctctgtgggtgtggaaggagcaggaaccaggacactggagccctgcttggggtgggaaggtcagtgttgggcacgggtggggttggggtcaatgccaggcacgggtggggatagggggtctgtgcttccaggttcccaggattgctgggtggaccccaggaaggtgtgggagccagactggggtgaggctgggggtgggtgggcagggctcccagcccaagacctctcctggctgagatgagccagccttggatcccagggcagggcgggatgtgccaggacagggtcagcctcatcctcctgtgggtccttggcagaggcctcggtccttgccgccagcccctctcacactgctgatccctttgcagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaaggtaggcaccctgggatcctccgcccaggggtcacctcaaccctgcctcacttcatccccactttgctgcaatccccacttcactgcaatccccacttcacccatggggaaactgaggcccagggagacccacccggtgactggtcgatgatggtatcagaatttgaactcaagaccattccccatgtctgaatcagaggtggacccgggctggcctggggtgggaagggaggggttgtctgagccctgtaccgagccatgtggccctgggcaagggcccaagaaccagtgagtatagggtgaccagcttatcctgctttgcctgggactttgccaggttagcactgaaagtccggcttctgggaaaccccctcagtgctggtgggctggggaggtggggcaccctgcatgggttgggttctgggacgcaggttcccttaagtaaggaggccaccctgaccgtcagactcgtgagcttgcagctttgggaggtgctgcctgtcgctgtgaggggtcaggcagaagggtcaccggcagctagggtgggggccttcacactggccgcctgcgaaggaatgggttctgcctgctgctggcggctcttgtgacccagctgtggcctggcccccagccctctgtggcatgttcctccccaccctgctgtggtcttggtgctggaggaagcgccttcctcctctttgttcggcatgagagatgaagggcattccccaggccagagcatcccatagactggctctcggagctggcccggcagagcgtctgcccgatgggcagccacacagagagacatgggagaggcctccaccagtggcaccagagggctcagcagttgaggccccccctcccagggctgcagctcccaggtggaggcttgggttcctccctgtgcctcctcacccccaccggaccccggcggcctggcgcacccgctgacaattgcgtcctcactcacagagatttgctgtgtggtcactccctgccctgcaggaggtccgtccttggagggcattgggttttgaggaaggtgtctccacatccttccgtaggaagctgtcccgaattcggcatgatgatggccccctcgacaccctgagggtgacctggtgccaggtgcgttggttctgcccagtggcactcagaacctgggctcgctcctgcagtggctaatcttccccagggcagaggcaccctgcgcatggtgggacagagggcgcagtgctgccctggaaacctggtagctctggtaagggccagggcgaggcttgtccccgctgcacagaggggctaccgaggctgagaggggactgcctgcctctcccattgtgtgttctcactgcccccggcctccaccaccctgccagcctcgctcatcctgggtcaggcttgatgtctaaggcccagcctgtgactcctgtccccgtgctctgcagggcctgaagaaccagacacaggtgaagctcaacattgtcagctgtcccccggtcaccacggtccttatcaagcggccagacctcaagtaccagctgggcttcagcgtgcagaatggaattgtgagttccccctcctgctctgggccaccaccaccactgcagggcccagggagggggagcagctcccgtccaatggggcaggctatgtctggcagcctggtaggacctggcctgtggttgcagctgcccacagccaggccacctggggcaggaactttccatggctctctgggaggtcctggctagaaggggagggccagggcatggccgtggattgggcccctccagcctttcccaggctcccttgtccccatggtggttgtcccctgctttggagggagggcagcagacttcaccagccactgtagcttggacacaaccaattgtggcatcacttactgtgctcaacaaacagacgttcactcattcattcattcatgtactcatcattcgcttgttcactcagccattcagcagacatttgtgaagtacctgctctgtgttaggctttgtaccaggcaatgggaaggcaggagtgctgcctggaggaggtgatgctgggcttgagtgagtgtggttctggccaaaaacctgtaccagttccccaggccagagttctttagcccagagtttccaccctctcactgacctgcatttgactggcctgaattcttttttcctttgtttttcctcctgcaaaagacccagagggcagagatgtggccactaagtggagtaaagaagaaaagggctggcaatacccaaattgtttaaaccagccctgagtatgaaggagcccaggaggagagacactgcgggctggagtgggagttttgtggaggtgatggggagggtgtgtgcccacccacagtcaggaaagacagtgggagaacattctagaaggactaccaaatcttctccattgttttctggtgaagcagcatggagggttacacccaccgtcagggtggagtcccagggcttgggtttagggtccatctctgaccctgctgtgtcagagcaaatttgctgctataaaaaagagtctgcaaatctccatatactgagagcttattgcttattcatgctgcagtttaatttgcagtgggggcggtgggggtgagcttcactccacaaagccactcaggggcccaggctctgccctcagctgggctttggcagcccccactgggtgctctgtgtctcgctggcactgcaggaagagaggcagctcagaagaccttgtgaaggttttcagggccagggcagaagtggcccttgtcatttctgcccacagcccactggccagatagctcagccacggacccatggggaggctgggaagtgggggccagctggtgcccagaacgaagagggacaggggcatcgccagcgtcagccataccttccctgctgtgtgaccctcaacaagtcactgaacgctcactggattcccctcaaaaggtgcttgtgaagatcagctgagaaaatccataaagtaccccaagctatccaaggtgggcccgctggtcctcgtctctgccaaggaggaggccccgtggcccctggacctggcacaggtgccaggacgagttgtctgcaccccacttgggacttcaggacagtgcgcctgccgcaggagctcgccagctggtggtctggcctggtccggctctgcctgactgctctgcacacatgtgacctgggcacaagcagttgccccagctaatttgggggctctgcagaaaatcagctggagccctgtctgcagctgctgtgcgcactttgtggatgggcatggctgggccccagggaggagggctgggacatccttctgggctactgcacccccgaccatcaccaggccctgcctgtgtgcctcccaccccagcactggggacagtggaggaagctggggactgacagccctgcagccctcatgaggagccgtgctgtgcagagcctggggtgctgtatggtgtcccctgggctgcccctgcctggctaaacctggtgaccacactgcctttgcctcctgagtggcactggggagctgcttgtcctgttcctgcacccccttgcccagcctaggaggcaggtgggcctgggttggtggccagtgctgctcactgacagccctgtcgctgtgagccctgcaggagaggctggctttccccaccatggggtggcctgggggctacctactcgtagggcctgtgaatatagccctgcccgggatgagtttgatgccccctcagtctgctggtcttccccaaactataaccccatgaggagcacaggaactggagaagctggggcacacagaggtttagtgacttgccccaggtcacacagccatgtggagcactggtggggagagggggagaagagatgaggaagggaaggactccggtttgtgttttgtgggggctaacatgaatgggaaaggaggggacagcctggagcagcccagccaagcccaggtgcagggttctgtgcctttcttcccagagagctggagagtgcaatgggcaggtgtgaagtcaaggcggagggcagcagacggggaccagggctcgctccagctgccttctggggcaggtgcagaggggtctggagtagctcccaaagatggggcaaggtgggtccgagtggccaggaagctgagggtggtggtgcggaagggggtttctcagaagatcagggggtgcagggttgagggcagcagcagacttgcggggcctgcagtgaggaaggagtcatgtgcaattctgaagacaacatctccggggtggcaatacgaaagagagggtgccacccacggctcggtgtctctgccctgggtctagggtctgagttccggagtgatggagggggccaagcgtctgtgaaacttggggggtggtctgggtcacgactggggacgaggagggtctggaggtcccagccctgcttgtggatgcgctgttgttccaccctctggctctgcctccctgtctgtgaaatggggtcccacttccttgaggcctcagtgctcaggatgcaggggagatgctggcagccgaggagaggggcaaatgctggctgtcaggggctttctccaggatacaggacagctcaccctgagagtgccagggagggttagatgaagcaaatgaataggcatggttatgatccatctccccagtgatccagaaaatggcatgcaggcggccatatggatcagtcaccatctctgagtggctcggctgcctggcggtaaacaccgggcccttcaggcccccaggtgcggaccacaccctctgcacctgctccatgagtgcccgtggtcatggtgggggttgagggtaggggtctggctgtccccatttggccctctgtgcacctagacacagaggctgtcacagtggctgccacttgtgcccctgcaggccagggctcatccaccccagggccatgtccaggcatctgcctggctgaggtgcactggggctccactgcccagccgggacctccagggagcaatgagcctgggataacattcaggagacccgagggtgctggctactctggtccaagcccctcgtccctcacagcgtgctcaggataggacccgcagtcccaagggccctggcctctactttcaggagcctggaaccccgggctcctgctgtccccggccctgcagcagtggggcgcttcccttggtgtcacctctctgggcacccccatccccaccatgcccagtgaagctctcacctgtgtcctcccgtccttgccaggcccttcgcctgaagtcctagctccagctggcctggggcagccactcggcaccttgtatcccgggagctggtgggcagggactggggttcccctcagcctccatgtgcctggccacctggggagcatatgcaggcgctggaggatgcctggctaggagtctatcagctcctgtcccgacctgcagcggttctccctgatgaccacagaaacattccctgtggcaggtggcaatgcttagcacccagagcgagcagtcagatgagatatgggccagctgcagaaatctgggtgctggtgtgtaggagacggggaggccccctcacagttgtctgtgtctgcatgtgtgtgtacacgcatgtgtgtttgggacaggtgagtctgtgcttctcccatcccaggccactcgcctcctcccagggctcagcacagtctcctttctccaggataagagggccctggggtggcgaaggagctgccttgcggtatggaatctgcctctctccacccccttctcttctagtcctaattctccttggacatccatttttccggtttttgttttcatttaaaaaataactgtggtaaaatatatctgtaacttaaaatcgagcatcatagccattttgaagtgcagagttctgtggcagtcagtccatctgcatgtcaggcagccatggccactgcgctctcctgcacgtcttcctcctccccaacaggaactttgtccccactaagcaccaccgcccatttctccttcccagcccctggcggccccccacttctactttgtctctgtgattctgactaccccaggtacctcatatcagtggcatcacacagtgtttgttcgtgtgcctggcctgtttcatgcagcatagtgtccccgaggtctgtccgtgttgtagcacacttcagactctccctcctctccagggctgagtactgtttccctgcaggcctagagcacattctgtttctccgctagtccgtgctgtcaccctcggctgttgtgaacactgctgctgtgaacacgggtgtgcacggcgcctgttttccattctgtccagtctcgtggtcacaggcgctcccaggccctcctgtccatctgtttggcgtcacttttaggctggaatggaagcccccaccgctgcactccagcctgggtgacagaatgagaccctgtctccaacaaaaccagaaccagtatatttggcacaaaatgcccttacgtcacttggcgggggggggatgtaggaataaagtgactcttccctgtcgatgtagaccatttgggcatccggcaaacagagccttcccttgacagaacagatgccccacctttctggtggccaggggacaggctgcctctcctttcccgcccgcccatcagctaagtgcctgtcttccaggatggtaaccaggctgtgccgtaggaggccaggtggcagtggccttgggctgtgtcaccagtctctagcctgaccacaaagggagcggccctgggggaggtgcagctgggggacaggttccaccgtgggagtcagaaaacttggtggttccccacacaccatggcattaactctcttgttttaaagaaacatactgcatatcataaggatctctgtctgtgagtcagcgaattgcacgtgcacgtattcatcatgtggcgcttttccctctgcatgtcccatctttggggacgtggtggagcgcctgtcgggtgtggcgggaacacgtgtgctgacctggccatgtctgcttagatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagaggtaaggagggactttgagtgtgcctctgcatgccggttcccacgtgctcccgcctgccctccatgagcctcccccgctccagaggacacagggcatctgaaggtcagccaggctgtgtctcccatcggggctgctgtgacaagggtgaatggagcggcaggtgatgcggagccatcccggtctggctctaactgagcaaccgggagggcacaggctgctgggggtgctccctggacactacttttgggactggacctgtatgtccagttcagaagctctgcagggcacacagctctggccaccctggcaggcttgcctctctgcccttgctggccatcccctcccacagccaggctgcttgccctgtcccacttcactggctgaaccccccacagtccagttctttctggcatcgcttccacggcagtgtgaggatggtgtgggggaggtgcaggttttcctccagagctcacaaggaggcaggatcattgggaggggggatggtgctggggaggtggcacatacaccgggggaggcctggccagtgcgcagcgggtgtgcgtgtgtgtgtgtgtgtagtgtgagcgagtgtgggtgtgtgcatgtggatgtgtgagagcatgggtgtgtgtgggatgtgatgtatgagtgtgggtaagtgtgggtaggtgtgggaaatgagtgtgtgcgtgcacgtgggtgtataggggtgcatgagtggatgggtgtgggtgtgtggctgtgtgaatgtacctgagtgtgcgtgtggaggagtgtgtgtgtgtgggtgagtgtatgcggatgtacgtgtgtgtgtgagagcatggggtgtgtaggagtgcgagtgtgggtgtgtgcaggggtgtgtggctgtgggtgtgtgtgagcatggggtgtcaagcatgagtgtgtatgtgtgcacggctgtggctgtgggtctgtgagtgggtgtgaggcatggggtgtgaggagagtgtgagtgggtgtgtctgtgtgtgtgtaggggtgtgtgaaggggtgttcagcacaaaggggctgcaggctctctgggaagcgtggtggccgcacgaggcgggaggctgagagctgaggagcccggcctacagaggggcccgctggggaccgggcagggaatttgggtctggggacagcagcagcaggccgggccgtctgtggtgctccccctggtggctctgtgaggctgagtgcgtggcgaccatccttgcagcctgtgggtgggcgggtgggtggaggggtctctagttcctgttcttcggatgaggtctccaggagccacatcgggacactggtattttgtgcactgcagggtcggctgggagctgggaggcctgttttccctggactggtgggggcaggggtctggctcaggaggaggaggggccaggcggacaccagcctccctttgatggcttcaaagaaaggaaaagccagtgttcccaagtagatgctttgaagcggccgcccccacggccagcagccccacacctgtgaggaaatccacccgtggaggagcgggcgggagaacggggaagaggcaggaggcggccggggcgttggaatcctttcagccctgccgaggttatggtgcctgtttccagcagctctgagcccacgcggaacatgagtcgctgataaacaaggcttgcagttgcgaggggcctcggggtgggtttctggttgaggaacgccggggaatggctgatggaggaagcccctgccgggagcaggagcagcggaaacctacatcggccacacagatcccggcgggggagggagggcaacgctcagaagcagagctgcgcgatgtgcctttctgggctgctcagcccagggcccgagacctgcttgcctgaggaggggcagatgcacggcggctgcaccccgtggggaggccagcatgcctgcggcagctgaccctggcagtgcgagggccccccatccggaggccgcagcctagcacagtcccgggcaggacaggggagagcgtcgtgctcaggagaggagaagtgggcagtagagctccctttccgttcttgaagcagacgtttagagtctgctccttcccagtgtccgcaaagaaggattacaaggcgcgccacccacacggttggtctccctggggcggtctgaggccttgcttgtatacccagctcctttggagtcagggctcgaggccaggccccaaagggtcatttgctcaccgatccccaaaggctaagaacttgaggtgccctgggccccagcgagcctgttcccagcccccagcacactttcctggcccgtgtgtgttttgtaagaaggggtgtaggccgggcgcggtggctcaggcctgtaatcccagcactttgggaggccgaggcgggcgtatcacgaggtcgggagattgagaccatcctggctaacacggtgaaaccccgtctctgctaaaaaatacaaaaaaattcgctgggtgtggtggcgggcacctgtaatcccagctactgaggaggctgaggcaggagaatgacatgaacccggggggcagagcttgcagtgagccgagattgcaccactgcactccagcctgggcgacagagcaagactccgtctcaaaaaaaaaaaaaaaagaaggggtgcgtgtgtcttcccccattgagctcctcctcagtgaagcagagtgcatccctcgcagtttctgccgaggcctggccacccccagccagccccagtggatgggcaaactgttgtcaccactagaagtccaatttctcacccctcgggtgtcagctggactggaagcaaaactagcactcaactgtattgactcctctggagccaggggtggggacctggagtctcagtctgctgcatctggaaggcatcataagtgtccccaggcctgggcaggctggccttcctccttcactctaggagatgggcatttgaagcagaactctggggggtttgcctctgtcctttgctttcacctgattgtgggaggggaggtgggagggcagcggctcagcctcctgtttctgtccgcagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgaa

SEQ ID NO: 2203 - DNA, 196678 bp, Homo sapiens; identical to SEQ ID NO: 2202

SEQ ID NO: 2204 - DNA, 57004 bp, Homo sapiens
tgcaactgccatggatgtttacaggaacccagccagagtttgcctccctgcacttcatcccagagcgcacctgcttcctccacttcaccttcggagaggacacttcaaactgcggacacacgcaaaagcaactcccagctctgtttgatgtgagttgagccttcaggccagctgggtttagcccgaggctggtcttagatgcagcgactgtttcagggagtgactcagaataaaaagaagctgaggaagctgttggggggctgaggatgagattctcgcttcttcatttcaggttactcgttcctcagcaagttggcaaaacagatatcatgctggtgagtgccacgttactcccctggctgcaaatgcttttctgaaagtatgagtgtcgtgcctacttaattctgataaacctgtttaagcaatacttaggaggctgacttctttggattaaaaaaatgtatgcaactccaaaaaaaaaaaaaaaaaaaagaaattcaacatttaaaagtttcatttctagggcagtcttccggtttggactacaaaattattttgcttgtttttgtaggggatcgttttgtgttgttttgtgtctttctccacatgatgcttagctctttccccacgtcccagattaaagtctgtatttttgtaattgtgggcacacaatcatatctcttttaatctttgcaacgatgttgaacttctgtagacagaaggatagagaaaacagcttgaaggcagtcagtgtgtttttccatgaagggaaaaaaataaataaaaaaattaaaatgggtgcttttttaagagagattgtcctatactttttcattctgtttttcatcacgtagtttgtatcatagcaagttcattgtcattccagagttcagctttgcccttgtactcagttgtgcttttttcccattggtttttgaggttttgctaaactgttgaatatttaatgtggggacaggaatggactcagaagaaatgttttttattttgattcttactagtcttgtaggcaaaccttccattactttttatgcaaataggatctagttgaatattgtatatcgagtaaatatgcgtctctctctgctcttttcgttgatatttacataacattaaaaagattatactttatcagagattcaagctttttcttatgaatgaagccctataaataagaatattttgttacagggattttgttcttttgaaatttataacaataaagctaaaagttctctaagctgttttatattttttcttatttttcaaagtgtgaaatttttctatcatctgaaaataaattttatgtaactatagtcttagaaatttaatacatttgaattgtatatttagcctctttaatatttccaatgaatacacttcttaaaagtttaattaggaatacagttcttagtttttgagctttctctttgttgactaaattgaaatgttaataaatcatttataaatgacttttccttctctctcttttcctctcctaatttatgctcaaggccaggtgattttatagacctttattctgtgtagtttatattacaaaataatatgttacatcttgatttagaatttacattatagtatccaaaatgtttttgtcaaatgtgtgcttttatcctcagattccggcgcccctgtgactcagagtcacttctttttaggtatggagagtattaacggggaggagaaatgattcgtttgagatttagttatctatataaaatacgaattgtcaggatatttgaaccaaactgggtcatacaatttctgtggctattttgaatagccttacaatgaattaagcttactaaattccttgtacttttcatttaatagctagatgttattgttttaatttgaataatattaagtgagccatattaccaattaacctgaatataaacacttgcttgtttttaatctgagtagtttatgtcttaaagtatggaatggaactagtggtcaatttttattaatctaagtgtctcccatacttctttaagcttttggaaagtttgggaagttgtgattttgcaatgaataatctctccccttggtttcataggcaattgaaaagctgcaggcgggtgctcttgcaactgacgcagtcactgcagcactggtggaacttgaggtatttcttttctctgttttattgaaaatacttgtgagtttatctttattgttcttaaatgacatgaaactgttgagttagtcaaccataaattatatgaccagtgttgcccaccaatattagcacagttatgaagaagcctatgatattgttgttttcattggtgacttttctgagtaatatgaaagttggttaaattccttccttttcttgatttttttttttttgtgagattcatgaatacaaaagttagtgactggatactgaagtttctcattttcagtaggaaaatccttgaagttaacccccaaaaagtgatgtatgttctgttgtttaaaaataaattccaactgtctagaagtgcctaaagtagaaggggaagattcttcacgaacctaacagttagatatataccctgaaattgtgtgctgtgaagtgtgccttgtcccagtgttatggttaggtttgtccccagtttactgtggacatcgaataattgagtggggaggctctcacgtttgccataattttttatactctagagtgaggtcctctcagttctcttgatttggacccttgatgaatttgtgcaggggatattgaggtcttcagaagattgacttgctgctcgaacttggagaagatagatttgtatctatcagttgagaggattatcgtgaaaaatatttttctggttgagaatactccttagggaatcaagtaagacatgatgacgaaacaatgatgagtttgagggaggagatgatagttaaaggcgacatttccaggttgactgggttgtggcccttgtattcaggcgctcataccagggcacgcaccctttcatgcctttccttgtgaaaattgcccaggtgtttaccaaaagtcctagccgtgttttctgtatattctcatgcttaattgtggacctgagcttttgatcatgctttgtagattttaatttctcttggtaatgtcagattggtcctaatgtagtcaaggaaggtgaaagaatatggtgagcacctagttctattgaatcttacatggggatgtgtgatgccctcctaatatgactgatacatttcatgccagctctaccagtcattagccatgtgtccatgggtgtggcacagtctgtccttgactcagtttccctatttatgaggataataattcccacttcacagagttgtgaagattaactgagttcatatatgactaatacaggacagtctcttagaacagtgtgtggtacgtagtaagcacccataactgttagcaattattacagttatgaggtgctttggaagtggtatgtatgagatgaatatttatggtaactattaatgacaagttttacagcatcaaagaaagtttaattatatgttgaggatcagaggagaaaaatgacataagaaagaagatagatgtatttaccaccaaatgttacctttactcaaaacagacacacaaagagggcttcatctaacttaactaattcaattgttagttggaaattacttgcatggaatcagcataggtttgggaaagaaggttattgagtagctggagaatatactagaatggcaaccatgaatgcaaaactgaataaaattaagtttctctttttatcttagaataactttaattttcctaagtcatacttatatatcatgtttaatatttcattctattttcccctagtgttgaatctgacttttaagggatttacttatttatacttaaaaatgataagaatacattttgaaataatgagtttctcctgagtaagtggacttatagttttggataacttgtgtttttttaagagtgtggatatgaatttaaaggaaaaaaatttcttgttctattatttttgattggaataagtcataaggataatggtagcatagaattcttccccaagtgactttagagcatcccacacctcaacttttagttattttattttatatatatatatatttttgagatggattctcactctgtagcccaagctggagtgcagtggtgcgatcttggctcactgcaacctctgcctcccaggctgaagtgattcttgtgcctcagcttcccatgtagctgggactacaggcatgcaccaccacacccagctaatttttgtatttttttttttttttagtagagatggggtttcaccatgttgaccagggtggtcttgaactcctgagctcaggtgatccacctacctcggcctcccaaagtgctgcgattacaggtgagagccactgtgcctggcctcaacttttgattattaaatttgtggaagaatttcaattatctttaacaattaacttttctatggactctttgattgaaatacatgttaatagtttaaggttaagcttacactaacaggaagaattttcctaaatcttaagaattatgttggaaatcatgcttatactgccccctgcagtttctctcaccttgaataattgtgattcattaccttaaaacaggataggttttcagatggacttcagttggggaagtattgtaatagcttgggtcaatggaaagacgtaagaagattggattctaatatttttgtacttagaaaaatataagtagcagtattgagtcctttcagaatactgaaaagtgctgagaaaaattctggagagccttattaataatgcattatgtttaatttgagaataaatacttatcttagttttggtcagtctattcagttaagtcatgtctggattattgaacagatgcaaacagtcattgttctcttctctttagactttgggatatactttttgatttaaaaaatgatgttcttgccactgagcttaaggaaacaatacataaacatatttttaaaacttgcccgttatattattacttaggcagatattaaaattgatatgaattccttaaatactaattgtggattgaaatgactgaaatgttttaatggtctttattgcctagaaagagtatctggctgtatattttaaaaatgtgataatttgtattttcccaaatagtgaaaagtatactgatcttaactccatgcagtgaaggaggaagagacaaggcaaaagaaatatgtgtgtgtgtgtgtgtgtgtgtgtgtagtagtgtgttccacacacactaaagggaattatgcagacatatcattttttagcttttcttagagactgataattttgtgtcgttttatttttctttaccaccgctacagacaagtgatgtcatcttaagactgtcacttctggacaacagaatgaggtgttttcttcatttaagtaaaggaggagcaggtgcaaaagttcctatctattaaattgaccaccttctccctttagagttttgggagggaaggtggctgcttctgtatgagaggttttctgcagtgtggaaatgcaaatgatattactccaaagtatattttgtttatcttcaaaatgtagggaaggaaatggaaaggtcagtttatagatcatattttaatgatttattggtaagttgattcattcctgttgtttcgtatagcttttttgagattatcttaataactgatgagaaagtgaattctgttcactggatggtacaactctggtttcactcacagcagagaagattaatattgtgaaagaatttggtcttcatatttgggactatacatttggatgccagttgcttttttggctgcttttgaaatagttttggatcaagtagtgacagtggatttaagattccagaccataattttgcatatttcaaatggtaaaacttctaatgtgaatttcttttttgagaaaagtggatatagaactgggtgagtcatgatgctaccattttcttaggattgtttctaaaatagaaagtgtttcatggattctgatagaaaatgaactatctataaaatactgcctgaagctccttttgcacaatggtgtttttcttaaaaagtacaaagacctggtttaaaaaagtctaatgagtaataataggtgcaatatgaatgacagacttttggaaggtaatttataatcttttgtgagaaaactgatgaatttcgcagaggttttgaagatcttgttgtaacctttgagaaattttggttaattcattctgaaaactgattattttggtaggtagaataccgtgtattaagaatagtgataggggctgggcacagtggctcacgcctgtaatcccagcactttgggaggccgaagcggacgcatcacgaggtcaggagatcaagaccagcctggccaatatggtgaaaccccatctctaataaaaatacaaaaattagctgggcatggtggcgcgttcctgtaatcccagctagttgagaggctgaggcagaagaattgcttgaactgggacccaggaggcagaggttgcagtgagctgagactgcactgagactgcaccactgcactccagcttgggctacggactgagactccgtctaaaagaaaaaaaaaaaaaagaatagtgataggaatagcttttacgttttatgtagtaaaaggcaaattatacaggttcctttgttaaaaatcttttgttgaacttctgttattaaaaatggactgtgaagttttttattcacttaattcatgctttaaagctccctatggtcaggggagatgctaattcatggttaaaactcgtttcttgtccaaatgctttagcgtttatagggcagattatattgggccaagtttttagtcattctgttaaaaacagttcgtcgtctttggatctctgtgtaatacaaatattgcttgcttgtaaactctagggaagtcctttaagaataacttgttcagatgactgatattttggtatgtaagagaaagaaagtaggtattttcattatatatttatattatatataatactgttatacatttgtctgtatctttgttgttgttgagacagattcttgctctgtcgcccaggctggagtgcagtggtatgatctcggctcactgcaatctctacctcccaggttcaaacgattttcatgcctcagcctcctgagtagttgggactacaggtgtgcgccaccacacctggctaattttttttgtgtttttagtagagacggggttttgccacgttgcccaggctggcctcaagctcctggcctcaagtgatccatctgccttggcctcccaaagtgctggggtgacaggtgtgagccaccgtgcccagccaggtctgcatttctttaaggcagggatctccagaatgggaatgttggtcacacttgagtagttcattgtgagtggaccccagcgcaggcctcttgcgcagctgcaggaataggccatattctctcccctgggctttatacttccggctggaattgtctgtgtgcctcagggggatagaagaaacttctacggcctgccagtccttgaaatgcctagtggtcatggagatggtgtggcttcctgatggcatatgggcatacctaggatggaaggggacattgggaagagctgatacatttcccttttccctcaccaaacttataacaagttttcttgtgagcagatgcttaaccacaccctgctccctaccctacttcagtcatttggtttttattgcaaaaaaggaggggcatctactttaaggtcatttctgtgatttgggaagtttaaaattatttaaataaacgagcatctcatttcctgtacgtttttatttttgtagaaattatattttcataagcagagtggtcccttgctctttccccagcaccccctgccccccagtagagctgaccacactggaacgacagcttgatgcatttagctcacatttacgtaagtgctcattaactataatgtggctggtgagtctaattttagacctaccacccttgaaaatctcatttttcttttccattgataatatcttttattctctgtaaggggagtgggatgtgtttctatgtatgtgaagtagaatatttaccttttttcttttgtagtacttacaatgttttcattgcatgaaattggagttttgaccttaggtgctcttttttcctttttttttttcttaacttggtattattgatgatttcaaagatcctattttgcctgtctgtttagcagtattcccagtggtgcttcagtatttctgtgtattccagctgtttatggagtctttatgtttctctgcattttttattttttgaggtgtacacacacagttacgcttcatggagttgcatccagccaagtatccatgttcttcttgtgaagaggcagagaaaatcacctctcccaagaatttccaccttctgaacaagggaaatgtatccttaagagctgtatgcagatgggaggcaacttgtttgcttgttctgctgctagagcattggtttaattagaagacaggctgtgggtggccatgtgcagacaaagaagcaccagacagagcccgtttagcctgggtcagtaagagtaagttacactctttttaaaacacttttttgagtactgatgctgattcttgccttcagtactaaggggcaacttgtaacttactgtttgtgtttacacatagatacatctgttctttttctgagaccctagaaatgacacatgctctctagcacaaagtacctgcgcaatggaaaagcagtgatttcttccccaaccaccctttttttttttaagaataaaaagaaaatggaatcaatgattacattctagattaattttacactgtagcaaacccggtgttagcgtttgaccaagtcaaaacacttaagtatagagcttgtcatgcttttactttgtagtaatgggaacatgagaaacgattttagccttttccagccatttcttgataaggtatgtgggtctcatcagatacattcatccaggccgaacctagtagaagagagggtccaagatcagacctagcagttcctgaggagcatggaactctatatgtgtgcccttgtttttctctgggagttgttactctcaaaaatatacttcattttggaattcagttttgagctacctaaagccacatatggtagtgtggtggagttagtggaaatcctgtgtttttgactatgtgaaagcaatttagacttttggatttttgagtgtacaatgtcttctagtcctatattaatagggatattacacaaaagggatttaattagattcattggtcctaggatttatagtgttgtgatttttgaatctgtgtgtgtgtgtgtgtgtatttgtgtttgtttggatctgtatcatttgtggcatcaggtttataccttagcatctactgttttggtttgttttgctcttggtaatgaaggaagtaggctaaaaagatttttctatgtttggaaaatcacaggctggtatgatggtgtttaatttcaaagactaccttttgattttaagtttttttccatctctcaaacccacccctttattcagaatctggaaaagaatgaggaagaaacttaagttacataatttttaagattctcggcctggcacggtggctcacacctgtaatcccagcactttgggaggctgagacgggcagatcatgaggtcaggagatcgagaccatcctggctaacacggtgaaaccccgtctctactaaaaatacaaaaaattagccaggtgtggtggtgggtgcctgtagtcccagctacttgggaggctgaggcaggagaatggcatgaacccaggaagtggagcttgcagtgagccgagatcgcgccactgcattccagcctgggcgacagagcaagactccgtctcaaaacaaaacaaacaaaaaaccagattctcatcaagattctaaatcttgctcttctctctttctttctctttcatgtgttcattacctaagtgttagaataatgaaggattgtacctcactatagaaatcagcttaaagttgaatcttagacataccaattgacaaaagttctttggccattcccattgccaggcagtttttactggcagtcattctcactcagggtccagcctcctgcatggtgtacacatttcctgacagctcatgacacgcatgtactgtaacacaggacatcaacactataacacattcatagtggggaatttatttatgtttagtttttctggagtatgtgcaaatgtaagcatattttctagtgggttggaagtctttttattaaaaaaaccttagtagaggacttaaaagttactagtatccctctttcctctccagttctgaccatgtcatttgataaaaggatggtttaaattattataattccatggtctgttaggttcttcttgagtgatatttccatattattgtcaatatggttaaaaggtataattatttaggttgaagggaagtataagtagatgtatacagcagatggtagcctctagctgagatcccaaggagaatatcctgttactgggaaagggtgattatgtgtttatttagcaaacacaaagtgtttaccatgtgccaggtactctttaagcactttacaaatattggctcattagttttcacaagtgccctgagatgggtactgttgttagccctgtttgatgaggatactgatgcacagagtggttaagtaatttcctcaaggtcacatagctaggaagtgttggagccagaaatggaatcctgctgccgtgacccactcagtcaattttttttttttttttgagaccgagtcttgctctattgcccaggctgcagtgcagtggtgcaatctcggctcactgcaacctccgcctcctgggttcagacgattcttctgtctcagcctccccagtagctgggactacaggctcctaccattacactggctaatttttgtatttttagtagagatggggtttctccaagttggccagactggtcttgaactcatgacctcaggtgaggcacctgcctcagcctcccaaagtgctgggattacaggccttagccactgctcccggcccctcattcagtttaatcaacaaatgaacagcgtcactaaagatccctcaaactcagtgatgaacacatctgaaaaagttaaagaaaattaagttcaaagaagaaacttttcattgtcaccattgtcggtgaatgtagtgatctaaaaattctctttatcattgtgctttaaatagtgatttagttttgatctttaaatgtcaatagactattgatattttgatctttaaatatcaaatatgtatggactatgtgaatattgaaaagaaaatatgaacagtcacttttacagttcgggtttttgtcttaaaattttgttgtaatttctcttcctaatcttagatctgtttgaggagatggtgcctgtgtcagtgtggcagtctttggctgcctgtgatcagaggaaagccgatttgttaacagatcaattgctcagatgagagaagccaccactttggcaaatgggtaggtagagcttaattttagagcctaaagttttccgtttggttgttctttagtttgtgaacattttagtttctgagcttagagctaaatgtcaagagtatataaaatagaaaatgtagacacacacaactatttttggtggacactgtatttgtgaagctctagcaaatatagttggaagaaattatagaaacaaggtgaggatgtttgactaaaaatttgtattttaagagatatttatttgggggaaatgagaagtagaaatgaactcagatacatggtacgtttagtgttctgaaccaatttttgtttctgatggattggatactaagaaaataattcattggtttaaaaaatttttaggtatattttgcacacacaaaatacacctattctaagtacacagttcaattattattatatgtatatatatgtttatgtgtgtgtatatatatatttttttgtttgttttgttttgttttttgggacagggtcttattgtcaccaggctggagtgcagtggtgtaaacattaaacatggctcactgcaatctcaaccttctgggctcaggtgatcctcctgcctcagcctcctgtgtagctgaggccacaggtgcaagccaccgcacctggctaattttttcatttttttatagagacgagatctcgctttgttgcccaggctggtcttgaactcctgggctcctggtcttgaactcctgggctcaagtgatcctcttgccttgacctcccaaagtgctgggattacaggcatgagccaccatgcctggctatttagttagttttgataaatgtatgtacccatgtaaccggcactatgattaagatagagaacattactgttaccctaaaaaaattctctcatgcccctttcccagtccttcttctcctggcccctggccactattgatctgctccctgtcttaagtttagttttactttttatacaatttaaaatacatgtaatcattctagcatatacatatacagtacttacagtatgtacagtatatacttagaatgtgttttgctttttttcacttagttactgtttttgagattcatctatattatgtgtatcagtttgagtcttttctgtggctgagcagtattccattttatggttatggagtagtattccattttatggttatagagcagtttgttaactctttcacctgttaatggacatttcagtttctatgaacattcgtgtataaagcttcatgtggacatattttagttctcttgggtaaatacttaggagtggaattgttaggttgtgtggttagcatatttaattttacatgaaattgccaggttgttttccaaagtggttgttccattttatatcctatctgcactgtttgagaaatacagttgttctgcatcctcaccaatacttggtaccgtcagtctttttagttttagctgctttcgtgtgtgtgtagcagaatctcactgtgatttaatttgcattctcctaattactaatgatactgaacagcttttcatgtgcttactagccattcatatcttttctgtaaagtgtctattgaaatctttttctcagtttttaaaactgagttttcttaatatttaaagagttctttacctattttggaggcaagtcctttgtcagatacatacgattgagaatatagttgaccctgaacaacataggggttatgggtgctgacccccctgcacagccaaatctgcatataacttctgagtccccaaaacttaactactaatagcctgctgttgaccagaagccttactgataacataaacagtcaattaacacatattttgtatatgtattgtatagtatattcttataataaataagctagagaaaaaatgctattaagaaaatcataaggaagagaaaatatatttactatgattaaatggaagtggatcatcataaaggtcttcgtccttgtctatttcatgtttgagtaggctgaagaagaggaggaaggagggttggtcttgctgtcttagaggtggcaaaggtgaaagaggtgaaagtccacatatacatggactcacgtagttcaaatctgtgttgttcaggggccagctgtatttctctcgtggttggcttgccttttcatgtttttagttttgattaatgcatggattttaccatcatttttcttgaacaagaaaggaatgtaagtttactctagcatatgataaacaggcagtctgagattttacagagcttcttttctgaggagttcattgtattccatcatttcatttgccttttttctttacatagtaggtagggatatgtacctcccttccccatcatgtaaatgaaataactgaggaatcgttagtgtgctacaaaaccgagagcagatgaagattctgtaatgaagacttagatcatctatcttctgttgacattttgcctagatgatgtgaaattataattattgattctgttgaaagagagcaaaaaagaaaaaaatacctattttgtgtattgtttctgactcgttagagatgctgtaacaatcaaaagtataaaagactgcttttttaggatagaatttttgacttttaattacttagactgaaacaagtttgaactgtaagccaacgatacctaatatattttaatgcggtcataatttttcggcttttttttttttgtttttccagactgagtcttactctgtcgcccaggctggagtgcagtggtgagatctcagctcactgcaaccttcgtctcctggcttcaggtgattcttgtgcctcagcctcccaagtagctgggattataggtgctcaccactacgcctgactaatttttgtatttttagtagagatggggtttcaccgtgttggccaggctggccttgaattcctgacctcaggtgatccgcctgccttggcctcccaagtgctgggattacaggtgtgagccactgcaccagcctattttttggcttttaattctgaattgtgaacttaattttttaatgattttggtttaattgtatcaatcactgatttttttgtttttctgttaatctttgctttgtttttcattgatagggcttatccagtttttctgggtgctaactccattgctgttgatttggttatagaagattaaattaaataaagtaaatattgatgagttaaattgttttagacttcaatataacatagtatctcattttttcagagtgctagcttcccttaatcttccagcagcaattgaagatgtgtctggagacactgtacctcagtctatattgactaaatcaagatctgtgattgaacagggaggcatccagactgttgatcagttgactaaagaactgcctgaattactgcaatgaaatagagaaatcctagatgaggtatgttttataagatttgcttttcaagtataaacactgtgatcccttgatgtccagcagggattgggactggagacttcctcatgctagtgctcacagtgtagttagtattcatcactttggtgaatttactgtggcccagagccgcctctttagcataagagtaattctggttgagtgagaatgggtttcattcttatcttaagggtaagtaagtacacattaatgaaactcaaatgaccactgtgtaaaactagtatactatgagaaatcaactatcatatgaaccgttcagtctttgtaattattgatttattttatacatagcgtgtagcaagatttttctttttaatttaatttgtcttaacctggaaggttaaaccctttaatttatccctaatttcttgaaatatattaagtatatttattttatattatttatcttataattccaatgtctgtggtttctgtgggtttgattctatgatttgtaatttttgctgattcttgcttatggtggcttgttttctcttgtgttcagtttttttgttactgttttttaaaactttaaaaaatagtttcagatttacagagactttgcaaatttagtgtggaaagttcctgtatatttttcacctagcttccctgaaagttaaaatcttacgcggtcgtggcacattgttaaaactaggaaattgacattggtacagtattattactcagattttaccagttattccaccaacgttcctccttctgttccaagatccagtacagaatactgaattgcatttagtgttcagtgagttttgattgtgcattcatatttcctgtaatttatttgtgggaattcattgagatctgggtttaaggtgaattctagaaagaatttgtgtttgcttctgccataaaaaggcattatatacctggcacctcctcaaacttaagaggctttttcctttcttttataatcttttaattatagtagtaatttatcttaggactttgtgtcacacaaatagtgtggtttctagtcccaaattcaggcttttgatcaggaatctcagataatacttctttttttttttcttttttctttagagccaaggtccagacaggcatgttttcttctgtagggccgttttctgttttaaaaattcatccactgagaatcatctatttggaagtataccagtttgagtgtggagagtgcttttgatctgacctctcaccttttattgtccctacctatgtttcttgttgacttttcatgttctaaattcacaatgcaagtcaatggtgaactacacagctggtgaactatggatggtgggctagtgctggcttgtggcctacttttgtgtggttcactagttaaggataatttttatcttttttagagcattgtcaaaaaagaagaattctatgtgccatagactgtggcccacaaagcctaaaatatttactctgtggtgtttgacagaagtttgctattctttgtcctaagctatcagggattgtcatgtattgttggtgctagcactgtgtctactggtagattagtattttcttgtgtttctggccccctactatcctgtcatcttatctacacattaaaaggcatttaaaaatatattaaacataattttctgttcgttgtattggaatgaaattctaaatcttttattttttaatgtaattgatcagtttttcccctttgtttatggcttctatttatctattttaatcttaaaactttctttaaattgatacatggatgtaaatagtctcatgtattcttcctttttttttttactgagaaaggtgatagctaattcagccttaaatttataagactttttgttaaatgcattataacttagatgtctgcaagaaaaaagtcgatttatattctaacctagtattcccatctcaccaaattctcccttatattgtgtatgaacatttaataattgcattaaattttttaatccagaaatgacatttcagggttctttttgcttccttttaaagtcattaaggtttttggatgaagaagaagcaaccgataatgatttatgagcaaaatttaaggaacgctggcaaaggacatcatccaatgaactgtataagcctttaaaagcaggtaaaaatgtgtataaatgaccttcatttgaataaattcccaatttggacccacatttttacttgattaaattaggctcagttgtaaattcgtttttaccgaaattgtttttcctcagttttagtataaagattaaaaaagttcacaaaagtaatctgccaattgtcagaagtacagattcttaagaacagtataaagggaaaagttaaaatggtcctccaactttcattttctgttccaagctctgtgcatattttattttatttattttttttttgagacaaggtctcgctctgtcacttaggctggagtgcagtggcaggatcacagctcgctgcagccccaacctccagggctcagtcaatgcttctacctcagcctcctgagtagctgacaccgtagacatgtgctaccacgcctggctaatttttgtattttttgcagagacgaggttttaccgtgttgccctggctcgtcttgaactcctgggctcaagtgatccacctgcctccacttcccaaagtgatgagattacaggcttgaatcaccatgcctggcccctgcgcatattttaaaaacataaatgagagcatattatatttatggctttgtaatttttttttcatttagtagtgaatcctgggtggtaaaacgaaaatgagctttaagttattttgaggccaaatttatgcttcttaagactttgattatgaagattttgtgcttgctgagataaatgctgtcttcatggtggctggagattagttttatttatctttgtaaaaagtttgtatattattgagatttttctaaaaatctttttttttttaagtcacattgctcttttgagagaggaatacttttaaaataaatggaccaatttttggagagaatgatttcttcctacattcatgagttgtaggaaaagattaatattaattagcttttatttggcagatagtaaccaccaaatgtattttaaggtatagctatgcttttgattttataagtgattttgtcatctttccaaaaacgagaacgcaaagactgttaggagctgtttttatgattaagtgaattggggtctagagaaggggaagataagtaaagttggagactagaactcaacatataaccaggccatacacgttgctgttagaatcacttctgtgctctgcaaacctattttctcccagagggaaccagcttcagaacagttttagataaagctgtgcaagcagatggacacgtgaaagaatgttacccgtctcatcgtgaccccatcgtgcttttgtgtaagccagagcctgagctgaatgctgccatcccttctgctaatccagcaaagaccatgcagggcagtgaggtgagaagggcactttgatgtgggttgtcatctgcttaagaaaaccacattcaagccattttatataatgcactgccaattccttattgtcatctttaaaaaaatgcagaaataaattggggttgttatatttaaagtagtatatagactgtgtaataggaaattatactaatattaactatcctgtaatagtcacttccatttattgaatgcccttttttgaactaaattttagatacttcataggtcaacagtatttaatttgggttttataaaagagagaagcttggaagtatagaaatttcctgaaatgaaaggactgggtatggccagatacacaaattctttatttcttccattgttctctactcccttccaccttgtttccccgggactacctttgaaaggaagattggcaaggtgtgcgtgttaataaatggatagctccgtcatggtgtttctactgatgacaggaaagagaaaattgaatagtagggcatctgatttggaaagtcctaagagaaagtgcaactataatttaatggcctatcatggggaggtagggtaagttagtaggaaaagatagaggtcccaaatctctgcacaggaaaacaagccaaagggcaagaaatactgctgaaaacttcttgaaaaaagtgaatttcctgggatagtaagttctgaaaagtatgagttttgtttcttatttgtctttccacagatgcattttatatgtttcatatatgtattccaagacctactggatatctgctctgtgtaaggcactatggtaggtacattggaaaattaacatacaaattatacacaggctttaccctcaatttatgatccattgtggaatattagtcatgtacaaggatgactgtaatatagggaagaagtttaaaaatgtcacagggaaagtatagaagtatgttatgaggatttagatgaagtacttaaatttcagtaatttggagtagttctcttcagaggcttcttaagagattggcacattatgaggacagagtggataggcagaaaaagtaaacgtgtaggatcggagaagggctgagtagtggctgtgtctagagagttatccgaggcacagaggatctgcaaacacagcttttactcctgatttctcatgacagaaggtttacagacatgttgagaatggctggaatctgcttgtttatttatttattcaccaagtgtttgaaggcctgctattccagagcagtgctgagcaccttggtccctaacataaagagacaaaaaactgctctgggttacctttagtgtagggtaaatgcacaggtaccgggcacctctcaaagggaagagaaggctacgtagttgaatgtgcattgaacctgaatctaacgggggaacccagtggaacagggaatgtgagttgttgctttgaggacatagcggagaaaagggaggtggtcagaagattaacttgtgagcaacaaagaacccgaagaagaaactgtagacccttggaagagcaatacattctggtaccttttttattttagaaaaagatctctgtttagtactctctttgtattctttttggtgtcttgtacgtgactcagaattatgtggcttttgccctttgattcttctgctttcagtagaaaagtaaaaatggtttgtgctaagcaaaatctgcattagtatgcactgatttgttgatattttattcagttgtatcagttttattaatccttacttgtgttacacaggagaaaggaacttttatagtcaatatgaagtaattttttggaagctagagttcttgatggggtaaccacaaaatttcagtactctctatatattcgtttgtcgtgtgccttaatcaaataaggcaagcatcaggtttatcagagctatttcagatggttgtcataatagttgatgacgcattttagccagaatttttatgataaaaactcagttttttgattgctgattagagtgatgcaatgtatatgttttattaaaaagtccaagtttgatggtagggctgttttttcttttattgtgaagtagcctactttctagttacttattttcagtctctttgggcatctggttttagatattgagatactctgaaaaattttgcagactagtggtcatttgtatttcaagatttttgtattaaatacctaggatcactgcttgtgattggttgcctatgatctactgtggcctgaagtctggtctgtggttggctggccaagccttggccctaatgtatatggggctgagtctagccaggggaaggaacatctatttttttgcacaaggatgatgttcaattttactcaaagtgttacatctgctggaagtaacggagggggtacctttaaaaaaaaaaaaaaaccctttatctccttagaggtagagcataaagagaactgtttaaaactgtgtgccctcccagaggagtgccttttttggattcacagactagtggaggatctgcaaacacagcttttactcctgatttctcatgacagaaagtttatagacatgttgagaatggctggaatctgtttatttatttactcaccaagtgttttttgaaggcctgctattccagaactgtgctgagtaccttggtccctaacatagagagacaaaaaactcctctaggttacctttagtgtagggtaaatgtatcaagtttctgctttcgttggtgtagacatagttgcttatttgccttttctgaaaataaaatgacaaggttataaaagtaaaatagaagatttcattgagggcatttctttctttctttttttttttggccgtggggggacggagtcttgctctgtcacccaggctggagtgcagtggtgcaatcttggctcactgcaacctctgcctcctgggttcaagcaattctcctgcctcagcctcccgagtagctgggactgtaggcatgcgctactatgcccagctaattttcgtatatttagtagagacagggtttcaccatgttggccagggtggtctcgatctcttgacctcgtgatccacttgccttggcctcccaaagtgctgggattacaggcatgagccaccgcgcccggcccattgagggcatttcttacggcttatattgtacttggtgctgttaaatgccacagagggttttaaatctaaaactcgggtcaggaacctgtggcttgtgggccgaatcctctgcctcttctctttgtatggcctgggagctaaaaatgagttttacattttttaaatataaaactctactttctacttcattttttaaatggctaaaaaaaagtcaaacgaatgttttaatatgtgggcattatataaaattcagatttcagtgttaatacatttttgttgaaacatagctgcgctcattcatttacacattgtctttcatactacaaagcagagttaaagagttggaacagagactgtggcctactgaggcaaaaatattttctgtttggtcctttaccaaaaaagtttgtaagttcctgatctgaaagacaaagtattgacagcctaggtgatgccgttcctgccattctgtttgacctcatctcctgttctgccttttgtttactatgcttcagccagagtggcctttttttctttcctttgatcctgccaagcttgtgcctgccacaggactgttatatttgcgtttccttctgtgcagggctttcttcccatttccatggctattacctctttttcattagtctcagatgtcacctcttctccatctttgtcattgtctacccacattattctatttttgtgtatttgtttaatcctcccctttccatatttatttaatcctctctggtccccaaatgaaggaaaagactgtttttgttagtagtcgtgtccatggcatctagaatggtcccaaaacaaaaagcatttgtttgaatggtcatcgctggcagccttaacttaataaagggatacatttaattgcagttgaaaggtagctggagctgtgtataagaaataaatatgctaggattctaattatttatatactttgataacatgttaaacctcaaatttgaatttagaagaaaatttaggcagtggttttcttattatcgtggtcattcatttgtggaagcagtttaattcattttctacttcatttactctgttaaaatgaggcgagtgtcatataatctgaaatatgttaaactagtgcactgcatatgaatttttttaaaagatgttcgtaatataagggatctctatctttgtgtggtagtccacaagtttgttcataaattcgttgtttgaaatggcatttttttccccagaaagttagaattattgcatttttgaatatcacaggatttgttaactatttggccctctgtatcagtctggttagaaagcttctgtatcagtctggttggataccatggaagttgcggtaagcttttcttcctaatctaggtaatatgactgaatacttaccctttgttagaagttatgttgagcactttatatagattatctcagtcttcacaacagtcctgaaataggtactattatgcccattttgcagctgcgaaaattgagttttctaagtagtaacctgtccttgattgcacagtcactaagcccattatggtctctaagggagtatagtcagagttgaagtgtttttaattttctatgtaattacgttttttttgtgtaattacgtttcactttgatagaccattagttcatttgtttccatattcaagttttgacttaatcttgttttctgagtgtgtaaaaaatgttcatgattcaaaaggtacatgcagagtaagcctcattccttttccttctacttctttcctgtatacttcctgtaagtaatcatatccgttagtttctggtttgtccttactgattttctttttggaagaacaacaacaaacaaaaaacccaacctcccccaaaattatgcatacatatgtatacatatgtacatattatgtatgtgtatatttattttctgattttccttctgtcttactcaaaatgcagcacactatatatgcttttgtaccctttttttctcatttaataatatgtcctggaagtcacttggaaggaaacttttattcacatcgtctgatatcaagttctactaggtctttaaacagactttgtcatatccacccacgtatgattctttctcctcctccttccttttagagtttctgtggtttgatgctttctagactctaggaatcatatttctttccctttccacagccttctcccctgtaccctcttctttctctccctccctctctccttcccttcccccttccttcctctcttgtccccctcccccttctcttcctttcctttccttccattttaaaattaggatgtttagaagatatagatgtaaatgaggccaaaaaggaaattcgcctacatttagcagaaacctcgagtctctggtcttcacaaagggatgttactttggacgttcctatcaaggagttaactaagactgtggaagaaagagtagggtaggaatttttagaaacaggcagttggtagggggatcatgggaactggacttgctgctggtaatgagaaagacaggggtggagacagggctcatgatgtcctcttcttccctttgtctttccccctgttttctttctatgagcatcattggggcaagcagaatagggagattgggttgatgttcttggtggtcctagcaaagtatgaagagatgagtgaaaggggcagcttgaaagtgctcattagaaggcacttgaacactatgaatataaaggggtatttatgaatcaggtgggtataagtcagagagtgtcttgactgaatacaagagataaatctctgttttgtttttgtattttgttttgagacagggtttctctctgtcacccaggctggagtgcagtggcatgatcatggctcactgcagccttgaccccctgggctgaagcaatcctcctgcctcagcctctggagtagctgtgactgcaggtacacaccattgcacccaactaatttttttttaatgtagaaatgggggtctcactttgttgcctaggctggtctcgaactcctaggctcaggtgatcctcctaaagtgctgggattgcaggtatgaacctctacatctggcctaaaactcttaatgctatgaagagaggcacaagaaccctctttccttttcctctcccggtgtataaaataaatgtggtatatacctttatatctgtgtctttctctatttctttctccatctaccatgcttgcttcataactatctctatttctatcttcacctctatttctctatatctctgtctgtcagtctctctaggcaaaataggatatctacttacgtagcaaaatcataccttcccctgcttcacagccatgattgggagggagtagagtgtagagtggctaagagattggttttggaactagtcagacttaggtctcaaatttcacctctgccccttagtaactgtataaccatgtcacttaatttttttgagactcgttatccctatctttggaagagaggtcataaatatatataccccatggggtattgtaaggaatacataaaattatatttctgaagtgtttagcatggtgcctaacacataggagttcagtaaattgtagctgttggctactgttattaatgctgcttttgttttaatatgagtcaactgaaggtacagtgtctatctacataaacctgatgttcaatttatatttggctctctgagaactcatctctctctcagcccaaatgaacctttatatattatttccttcttgaaattggctttttttttcagttaaactaaagtgtcttttttattgtttaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggcatgataaatgaagaagctctttctgttactgaactagatcgagtctatggaggtcttacaactaaagtccaagaatctctaaagaaacaggagggacttcttaaaaatattcaggtgaaatttatgtatttaataacatctatgttttaaaaattacagaaaagatatgtctggactaaacctatattcaattagaaaaatgacattggagaatatctgtagttgagagtagaacttaatacatatatattttgtaaaattaaacttggcatatcagttttatttgtgtctatgaaaccaagtcactccttgtttttttttttttttttttttttttgagatggagtctcgttctgtcgcccaggctggagtgcagtggtgcgatcttggctcactgcaagctccgcctcccgggttcacaccattctcccgcctcagccgcccgagtagctgggactacaggcgcccgccaccacgccctgctaattttttgtatttttagtagagacgggatttcaccgtgttagccaggatggtctccatctcctgacctcctgatcctccctccttggcctcccaaagtgctgggattacagacgtgagccaccacgcccggcagaaacaaagtcatttctatggctaaaatgttgcatattacttaggagtgcttgatacttctgatatttttcatggtttcaagtttttaatagctttgttttttttttccatacgggaggaaaatcgaaattagttggaattactgatacctttaattatacggctaacatacatacagacttcagtcattttttaaaaaaataatgcaaactaaatatgttgagaagtttgaagttagttttcgtgtttacagataggtagtttggactaacaaagacttgaaagtttgcccttttcatagttaatgtgcaaaattaaacatatatttctactcctaaacattgtatctatatatgatataaaatattccaaaaggtaaaataattttcatgttatattttttgcaagtgttatatactaatagaaatctgtgatcattattggttgttttgacttctattggatttttgaaatttttacttaagaaagatttaaagcataatgaggcttcaaaagagtatactaggtatttctagtaattttgcatatgtatttaattacatatgattttcataattggaaaagatcaataaaaatgttatgagccatattttataagtaaatgtaaatacataaatctttcttttaacaaggtctcacatcaggaattttcgaaaatgaagcaatctaataatgaagctaacttaagagaagaagttttgaagaatttagctactgcatgtgacaactttgttgaacttgtagctaattcgaaggaaggcacaaaggtatgaagtacatgcaaaaggaaccatagctagcaagtacagatgtgaacgtataggttggaagttaaatggtatttccagttgaaccaaattactctttgcctggaatgttagctttaatgccattgcctctgcgaagtttgttacaggagggagaaagcttaatgaaggtggcaacatttcatgggaaccttgaagaatgaattgcatatttcaactggcagaaaaggggtacaaatattccaggtagcaggaattagcagagatgtcaatgacacctttttaagggataggaagttgattaatttgatgaattttgaggggacaggagtagtcaaagctgatttgtgatggaaaagctgggcgggcatgacttttatattctgtgtggtggtttgctgaggacagacttgtggcctgcccaagtgtcagaaggcttgctgaatatgtaagtactttcttgccttgtcctttaaaaagtttagggaattcacttatatttgtttttaccaatttgtttttgagggaacagtgatttttaagttttctcagatgcataattccttttggtacttaacttcataataatcactgaataaagttaccttgatataaatacagtagctaaaatgtaaaaccctctgaagagagggtgaaaatactgcaaagccttccaaatagagaggatggtaaaatgccattttaacttggtttaaaatgctttgtttaaataggtaagctgagaaaaccctccagagagcctttagaaattcttttaagggtttctgaagtatgcttgcatttctttttttttttttttttatactttaagttttagggtacatgtgcacaacgtgcaggtttgttacatatgtatacatgtgccatgttggtgtgctgcacccattaactcgtcatttagcattaggtatatctcctaatgctatccctcccccctccccccatcccacaacagtccccggtgtgtgatgttccctttcctgtgtccatgtattctcattgttcaattcccacctatgagtgagaacgtgcagtgtttggttttttgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatatgagtgcatgtgtctttatagcagcatgatttataatcctttgggtatatacccagtaatgggatggctgggtcaaatggtatttctagttctagatccctgaggaatcaccacaccgacttccacaatggttgaactagtttacagtcccaccaacagtgtaaaagtgttcctatttctccacatcctctccagcacttgttgtttcctgactttttaatgatcgccgttctaactggtgtgagatggtatctcactgtggttttgatttgcatttctttgatggccagtgatgatgagcattttttcatgtgtttttggctgcataaatgtcttcttttgagaagtgtctgttcatatcctttgcccactttttgatggggagtatgcttgcatttctgtagtgaatttgaaaacctaatccttccacttaaataggtttcatgttattaaacaattgacttttctctaggaattaggaagattttcatgatcatgaaacttttaacttgttacatttttgatgataatgttctataaaaatgattttattatttttattttctttaggagtcttagatcatatttaatattaagttgttgggcctagtaaattgtatggatgtatctcatgcagatctcagttcttcggctttaactgtcattgacaaattagctttagatcacattactctctggattaaaaaattgttcttgttcattacttgtatttgttctttgcttatagttttacaatgagttgactgaaatcctggtcaggttccagaacaaatgcagcgatatagttttggcatggaagacagaaagagatgaactcttaaagtaagtctgttttgtgtatcaaattgtacttaagaattttcttttaaaaaatcatgtggagacttttggtgtgaacttggtagtatgagagcagtttccctccttttctcatggaagaaggaactagatagagtattttacaaagcaacaagtaaacagctgcacagtctgggaatgaaaggatgaaaagaagcagaaactctagatgcaggaagtacagtgaggtcacagaaatgataaaacagttcaggtggcagatctcaggaagtgccagtaaatacaagcaatttattttgaagtggcaaataggttccttacataaaactagagctatagaacatggaggagacgccgtgaatagctcagagaataccagcaaaatcactttcagaggaggctgctgagaaagcagggccagttaacatacgactcatttcctgctgagtaatcaacacggagtagcacagcgctgataaaaggtgaaaaacattaacaaaatttaataaaacttcatagatgaagaatatttaccaaaataatattgtcacagaataggtgaaaattatgagcaaacgtctgaccatgaactaaacaaaaagaacaacaacaacaaatgtaagaaggcagtcattctaaggccggggtccccagtcctggggccatggactggtactggttcgtggcctgttaggaactgggctgcacagcaggaggtgggtggcagacaggccggcggctgggcgagtattactgcctgagccccacctcctgtcaggtcagcctcagcattagattctcataggagcgcaaaccctattgtgaactgcccgtgtaagggatctaggttgtgcgttgcttaggagactctgactaatgcctgatgatctgaggtggaacagtttcatcctgaaatcatcttccgctcccctgtggaaaaattgtcttgcatgagaccggtccctgatgccataaaggtttggggactgctcctctaaggaacacttggagcagaaattccagaactgcaggaatatggtaagaaaacaggaagtggtaagatgtgaggtgtcagaattcaggaaagaagtagaagggaagaatcaaaccacgacatgggaaagagcacaaagggcgagtaaacactgaagaacacacaggaacacagagtagaaatgaggaaattaaaatgaaaccaaagtcaagaaagaatgagaaaggattagagagaagatgggcacagaagatctaatatgggcaaaactgaatttctctcaaagaagaaaaaccagacagaacagttatttaactttctgtaaacagagcacttatttcatgatactcaagaacattttcttaaaacaagtgaaggttgttgaaagaggatatcacatggtaggggaaattgatcaagaactgtcagcatcaaggcatataaattattggccttaaaaggtaatggcagaatcctttaggcagtcaggcaaaacaatcaaaccagtatataaaaaggtgaaaaaaattaggctggcagctctgtatgccagaagagagtggagtgattgctgtaatctcaaggatagtaaatatgagctaaagattttatatcatatagtaaatacatgctaaagattttatatccaaactgtccttcgggtgcataaaaagccatatattcattagtaataaatataaagagctgaaagagtcttataccgatgaccctttcagccaactagatctttattcatctctctgttcatgttcatgttcattcacctctctgctcatgttcatgagagaagttattttcttctacctctaagaaagagcaggtgagttgtttttagaatatttctactaaacctataaaaagcaaataattagaatgttttaaaaatggttctaaatgttttaaaaaaggtgacttttttttagatagagttttgctctgtcgcccaggctggagtgcaatgatgcaatcttcgctcactgcaacctccgcctcccgggttcaagcaattcttctgcctcagcttcccaagtagctggcattacaggtgtgcaccaccacgcctggctaatttttgtatttttagtagagacagggttttgccatgttggccaggctggtctcgaactcctgacctcaggtgattggaattacaggtgtgagccacccccccagcctaaaaaaagatgagtattctccatattagtcttaaagataaaaaaaacctaacaaagattaatacaaaacagtctacagaccagtttcagttatgaatatggatgcaaaagtcctaaataaagtatttgccagtaatagtcaccaggacgttaaaaaataattattgaccaaggggaggggggcatttattccagtattcagtattcagtgttttcatgtcaaaggaaagattacaggcttgtcttaatagatgaggcagaagcatttaagaaaatgagtgttctgatactcagtaaaataagaatagatagaagatagatgcttccgtaacatgaaaaaatatatatgtatgtgtgtgtatatatttctgcccaaaactcagtacagtgattaatggagaagcactataaacagttccctctgaagtcaagaacagacaacaaatgtcactgtcagcactatttttaaatactatactgcagtaccagccaagacaatcacgtgagagagaaatttaaaaattggaaaggaagaagtaaaactagcactatttacagacattatgattgtacaactacttgaaaacccaagagaaccccaaaactctgcaaataataaaataattattactgaagttgttgatcataaaaataatttgtagaaatcagtggctttcatgtaaataaacctatagaggataagatgaagagacccacttacggtagcaacaaaaaggataaaatataaaatataagtttgtcatatatgagacctgtgtgaagaaaaaactatttcaaggacacaaaagaaggcttgagcaagttaaaaagcatgttcttggataggatgactcaacttcatcaagatgtcaactctcagttaacttatgtatcaactgggcgtgatggcatgcacttctagtcccatctacttgggagattgaagtgggaggatggtttgagccctggaattctaggttgtagtgcgctatgattgtacctataaatagccacggtactccagtctgggcagcagtgagaccctatctctaataacaaacataaataaagaaataaacatatacggccgggcgcagtggctcacgcctgtaatcccagcactttgggaggccgaggcaggcggatcacgaggtcaggagatcgagaccatcctggctaacacggtgaaaccccgtctctactaaaaataaaaaaaattagccgggcgtggtggtgggcgcctgtagttccagctactcgggaggctgagacaggagaatggtgtgaacccgggaggcagagcttgcagtgagccgagatcgtgccactgtactccggcctgggcgacacagtgagactccgtctcaaaaaaaataaataaataaaaagaaataaacatatgcattcaacatgcttttgattaaaaaaaaatcagcttttcatttggaattagacaagttgatcctaaagttcaagtagaaaaagaaacaaggtcagccaggaaaacaataaaaagagtagtgaagggatactagttctaccagataataaggtatataataccatctttaattaaaacacagtggtactggtacatgattagacaaagacagaatagaaaatagaaatagattcaaatacatgtgtgaatttagtgtaaaagatcttcaaccaaccagaagaggttgtagtcaactgcccagccatttagaaaataaaagttatctttataccagagtaagttctgagtggaccaaacttgaaatttgtaaatgaaatataaagtataaaatagaatggaggagaattccttaataaagctgggatgggcaggatctaataactcctacttaaaatccagaagccattaaaaaaaagaaaagaataagtttctcatagaaatatgataaacagagtcaggatatgacaaattggggatccaatatttgaaacttattcacaggcaaaaggctaatttactttatttagaaaagaactcctagaaatgaacaagaagaaaacccaatagacaactgaggaaaagacgcaaatagaattttgcagacaaggaaatacaaatagctcttaaataaatgaaaaaaaatgaataccctcattcattataaaatacaaatcaaaattagtctgaagtaatatttttcagattggcaagaatctgaaagtttgtttaaagcctgttctgggtcttccacattcattattctctacggtcaatcacattccaaggattgttgcctccaatgcatgcctttttctcaattttattttctcccatcagagtcatgcacagattagctcccaagtgagctattataatggcctcctagcatctaaactctccttttttccaattgatagttctgccagagttgtcttcttaaagcagaggttagaccgcatttctcttaagtaaattccaatgacaccaaaacagtgattcttaataagaattacaagtagggaaatacagatgggagagtttgcttagtaaataagttcataaaatctaggttaaacaaagttaaatggggtttgctttttgctgttgctttgttaatgtgcatttgaaatttctaaagtggcattacatatccataatttcccttatctatttgacaaaggaatctggtttgtttagaagcattttttcagaactgtgataggtcaacctttcagaaattcctcattatcaacagtcaaatccagatgtattttctttggctctcacaacaggcttagaggaatttctagtctgttctcctgatgtttcattatgtgcatcttttgcttaggcctgttaaacctactcaatgtgtgtatcttctactccatgtctttattcctactgttgtcttaacaggaaatccttgcaacccaattcatagtttttgttctttggaaaaatccaaatcatgtatcatgaatacatattttttctctattgggatttgcctgtttttatgtatcacagccagaagtaatcactgcatagtgtatttctgtagaaagatagaagagttctattttaacacaatatttcctatatacccagcaaaggtctaggtatttatacatactattgtatttattcatctcatcaatgcaatgaagaaatattaataaatccattatatatgctaaaaggtagcgacacatatatgctacatgtgcaggttttctcaggtattattagctagggaagctgtgttgtaacaatcttcaaaaacttctttctattgtttacatgctattccacatcattttgttttcatttcttttgtagtatctaatgtattctactaaaaaaaaaagtagagtagttggaaaacttgtgaaaaaaacatatgtattacatatataccattcttcatgattctcaaaattttcatcattattaatgttttgtgtatatatatatatatattgtgtgtgtatgtatgcatgttagatatataatttaaaagaaaacaataagttggtggcttatggcaaattgttccttaagtcctgcatttgaaacatagacactgagtgaatcagcacatttgatcatcttttaactacaatagatgattatacattaaaaatacattaaccatccaaatacatcttttttcttatttatgtatgtatgtatgtatgtatgtatgtatgtatttttatttttttgagatggagtctctttctgtcgcccaggctgaagtgcagtggcgcaatctcagctcactgcaagctccacctcccaggttcccgccattctcctgcctcagcctcccgaatagctgggactacaagcgcccgccaccacgcctagctaatttttttgtacttttagtagagatgggttttcaccacgttagccaggatggtctcgatctcctgacctcgtgatccgcctgccttggccttccaaagtgctgggattacaggcctgagcctcggcgcccggcccaaatgcatctttaggaaaattatatttaagctcttcatggagacattaaaaaaccaagctgcattaataataaataattatatcattcattagtaaggagtaaatagctgttttctatttgagaagtattaattggattgtccatctgtatgcaggaacatctgttttctgacatgctttaatcaccatttgttttgtacttgtaccataattacacttgtttgtaatattgaaccgagacaatgattaaaatcaacttatgaatacgattcttttatgcttttgtatttcattagaaaatgtgtaattctggtatgacatttataagtatatataaaagaaagtatttgattaacaaaatgcctcaacagattatgtcagtaaaatgagtgttatatcatgcagtctatgttactattttggcatttttaaggaaagtttattgcttcacggaagcttttttttaactgaccatctatgaattttctgtattctttatttcattgtgatcacatggtcatagaagagacatttttagatcatcagaagttgacagttttcagtgtagtgtatgtgcttagtataagatggaattaagtttgttgtatgggtgattgatgaatttttactgaatcatggataactgctgttctattaatgacatttcatcaattaactcttttggatatggtttatcacaaaatgttgctgatttaatgtttgtggattaactgaggtgaaagtgatacctggtagaagtttcattaatacaaattttcctctcttaggagtaggatggattatattatttgtcgaaatgcctttgcatgtaagttcttaactgtcagctttcttgtcctgtgaatcatatcttttctgtatttgctgaaatagagacttaacattgttaaatgatttttccatgtcatggaaaatgtatgcctctaaatctgcgttccttcctacaaattacaagttcaaaatgactttttttaagaaacaaaaaaaaaagatggatttctcgtattttgtggcaggataagctccctgtagcctatcttaaatgttgattacgactaaaactatgaaaagtacaataagcaactaactgaggaatctgaaaagtaaataaaagtagaattatgagtgataggcaaaatctggagaagcaccctgcagtagtgtgagcttccattgttgtatttctttcaatcaaaaccaaaacaaacaaacaaaacaaataaaaaccagaaaagaaccaccaccaacaagaaaacactcaaggaaaatagatattgtgatagaaacagcagaaatgtcgagaaacaaaaccagaaggttagaattattagagaaaataatataaaaagtaattttaaatatctaaacaaaattttaaaaaggaatttaaaaaaataagcaaggagaagacaataaaaataggttgataattcatttgttagcatttgtctgtttggtatttgttgaccattttatttttaaaaaatttggctatatttgcttttggtgtatttcttgtatatgtattgtaaaatttagtatttattattattaaatattttatattgttaaatgataatttatttttattgataagaaagatgtagttttctggttgttatttttgtaattttacctgcatttatatttttctccatttatttagataatacctaatggttccccacaatgagtggcaattaaattagactctgtgctattttcactttctcaacttctcctgaactatttgatttttgtggcaggatatttcttaatatttgcctttgtgccacttaatgttttcatactattatgggcaaattttgagatttaaaatgaacccattactctcagctattatagacgaggcaatcagggagctaattcctactttcccctttcttttactctctcctcctggttgttacagttgaatcatttgtacattatcagaatcatcagtaaaatatctttttacatcttctacaccatgtatcccttaaatctatatatgacgcattgaatgcttacctcttgccttactggtagtattttacctactcagaactaggttgattgaactttgtcctgtggtaactctcttaataagaactttctgtaaagtgttccctgaattatgggtgcttataactgtacactttatagctgatagatatcttgcaaggataaggataaccatttgcttctcccttctcttctttctcaatatttccccccattttctggtgttaacttttgctgtggaaaactctgatgccaaaatgattttctttttctctaagttgacaatttttgcttaagccctcacataatgctttcttaatctttaaagtcctagtcccatacacagatatatcttggtgttgaacattctaataacatacataagcatatactacacagtaatgtaaatatatgtgcttatgatgatctatcttgtcttaatataggcaataacttttttctaattctatcctatgttttacagtttttggatttttggacggggagaggacttactacatattcttctctcacaccctttacgacccttacattatttggggttcagtctcccttgttctctttacaatttagtttttttttttttttctacaatgattttgtttttaaatcctatttctttcatggattctgccagttgctattgcactttctggctatctcttccccattctcttgcatttcacttcatggtctctttatgttttattacacccttaaaatttatgttggaatgtataaatgttcattccttttttcatctgttttgtagcaacatgtttctagttattacaagagttgatatattccttttttatctttattcttaagagtatttttatgtgaatgctgagaaaattcctttagtatttctcatatgtgaaagttgaatttcctacaggacaaaggaaaggggttgtagaatgtgccccagcctgctagctcaagggccctctcatcatttgctacagtgacagactgttgcctcattttggggacattatggagtcaccgctcgttctccataagagcataaatgattaccaggtagttgttactgtcttctctccttgatactcatacataactcatagcacatatggaagcaaccttctaaatacccatgttttatctttaaaatgttctttgtgtgtagctgcccatttgttttgtgctaactgactgaccctattaccttcagttgtaacaacccatttaaggtagaaacgaaggacactcatctccatgtgttttcagaatttaaatgaaaaaataaaaagaggctgatgtcacttcccagtttaacgcaggggttttatttatttatgtacactcaatcaaactatgactattacaaatggttttaccgctacaataaagatagttaattcataactcaataaaaatgaagagtgaaagattaaaaaaggaaagcaacaattctaaactataaaatctacttcagaaagctacatacagcaaagctcaataaataaattatgaaaaaaagaataatatgggataagttttatggtttaggagataccttcctataagccaaaaacctaaaaaaaaatgctaaaggtatagcttgctatagtacgtggtaggagaaattaacatgtataaaatcaataacactcacattatgtgatagtctacagccaaagaataatagaaagcaagtgaaatgcttagcatagctatttagtctactaaattaggtttgtgaaaatgggaatgccaaatgccttaaggcttatggcaggtgcaaaagcaaaacatcagaggtcaacctaaggatatttttaatataaaattaatgtacctgcattgtaagcattattttttttgtatggtagaaaggaaaaaattcttgtattattctactataaatgtgtattctttgctctactaaatttgcatgtcatcgtcagcctttcactttgtcttcagctaacaagaacctcttgggttcatcctttggagaacctgatatggaaaatggactgaactaggagaagagcctttgtttagaccacatgctgaggtctagtggcttcaattaaaaatatataaatgtggccgggcacagtggctcacgcctgtaactccagcactttgggattctgaggcgggcagatcacgaggtcaggagttcaagaccagcctgaccaacgtgatgaaatcccgtctctactaaaaatacaaaaattagctaggcatggtggcacgtgcctgtaatcccagctactcaggaggctgacgcaggagaatcgcttgaatcctggaggcggaagctgtagtgagccaagatcatgccattgcactctagcctgggacgacagagcgagactccgtctcaaaaaaaaaaaaaaattatgtatatatatatatgcttaatctctaagctttggaaggaacagcctatctacagaaaaatttaaaacttggtcatgacaggtacagagttgggccccattaattttgttgacattgaggtcagcagattctgtaaattttcactatacctctcatatgatctgccgccacaccattcatactcttaactttatttctcctcacaccagtaaattactaaaactgccaagtttttttttcacaaattaatatctttagcattctcctccttcagcctgcaatgaaattatctactcccctccctcctccttcctccttgactcccgctaatgcacatttgtgtttggtttccacaccaaatgagctaccttcaataagcatcccacaactccacagggaacttttgtttctctaccttctgtgctgtcaaagcgcttggctcagaatgagagatctgtctgcatttcagatctacaaattactcattgtgtgaccttggacatatccctaatatttttgagcctcagtttctcaaaaattagaataaagataccaaactcctggggttttgtgagagtaaaatgagacgatgtgtgtaagagactcagtgcagtgtcagtatctaccatgtgctatgcactctgcgttttctttttcttttttttttttttgagacggagtctcgctctgtcacccaggctggagtgcagtggcgtgatctcggctcattgcaacctctgcctcttgggttcaagagattctcctgtctcagcctgcgagtagctgggactacaggcccatgccaccacgcctggctaatttttgtatttttagtaaagacagcgtttcaccatactggtcaggctggtcttgaactcctgacctcaggtgatgcacccacctcggcatccgaaagtgctgggattacaggtgtgagccaccatgcccgggccaacccatagccttttggtcttctctcagccaaggcatccagtgaaaatgcaatttatttttcagattcctctggagaattaaaaagtctcttttgcggctggacacagcaactcacacctgtaatcccagcactttgggaggctgaggcaggcagatcacaaggtcaagagatcgagaccatcctggccatggccaacatggtgaaaccctgtctctactaaaaatacaaaaattagctgggtgtggtggcacaggcctattgtcccagctacatgggaggctgaggcaggagaattgcttgaacccaggaggcggaggttgcagtgggccaagattgagccactgcacttgctctggtgaaagagcaagactccgtctcaaaaaaaaaaaaaaaaaaaaaaaaaaagtctcttttgcatcaaattgccatactctctgctcttggtcctcttttccatgtactcattcttcaagcatttattttctcattgcctgatccagatcattgcaatgaccaaaaaattttcgaatgctatgatttttgtgatattcttttagcaagttaatcacgatgttgcattcttgagtgtgcaagtgtggaggtaagtcaggatgcatctttaagacaaaaagatgggtcacggcagtgccacaccactcacggccacaccaggagagctgaaggggcagtcaccaacgaagatgcctgacccagaagctggctgccagggagccaagagccaggtcactccacaggtggccaatgcccgggggtggccctccaccgccgaagctgctgctgctgctgctgctgctgcttattattattttgagacggagtctggctctgcctcccaggctggagtgcggtagcacgatctcggctcactgcaacctccgcctctggggttcaagcgattctcctgcctcagcctcccgagtagctgggaccacaggcacgtgccacctcacctggctaattttattttttgaatagacagggtcttgttatgttgcccaggctggtcttgaactcccgggctcaagcgatcctcccacttcagcctcccaaagtgccaagactacaggtgtgagccaccacacctggccaagttctacttttctaatatttaaaatatgaaataggccgggcacggtggctcacacctgtaatcccagaactttgggaggctgaggcgggcagatcaccagaggtcaggagttcgtgaccagcctggccaacatgatgaaaccccgtcactactgaaagtacaaaaattagccgggtgtggtgacagatgcctgtaatcccagctactcggaaggctgaggcacctaaacccgggaggtggaggttgtagtgagccgataccatgccactgcactccagtctcggcgacgcaatgagactctgtctcaaaaaaaaaaatagatgatgtcagtgatttctattacatgagatctggaagcactctgtacctgattgctccacgtttagtggtgctaagttcaaataattcaggtggtgagaaactgacttccgtaggagtgcgggtgtgcgtgcgtgccgcggaaatcccgccttctggcgcctgcggttgccccctggcctcagccggtaggctcccaagtaggaagataaaccgcattgcacgaagcgggagagtccagaggagcggcgaagcgctcctcttccccattggctgcgcccacggagccgccttgcgattggccctaagcgcgggtggctggggttgcgagaggcatcaggatccctggcggcgcctgagccagcggctgctaggaggctgtgtccgcaagccagcggggcgaggcgcctgggccctgcgcgtcaggtcccggcctggggcaccggggctgccagcgtcggaggaggtgcgggcgcggggttggcgggcggccgaacgggggcctgcgcggaccgcccgcggctcagcctccggtctctctccgtctctaagtggtggtggctgtgggtttttctgcaggtgatccttttgagtaatttgtttcacgcaggcgccctgctgtagggtaaagcggcagattcatgctgctgtcatttgtcgttcaaactgtgggcttcttggccaggcgcggtggctcaagcctgtaatcccagcactttgggaggccgaggcgggcggatcacgaggccaggagatcgagatcatcctggctaacacggcgaaacgctgtctctactaaaaatacaaaaaattagttgggcgtggtggtgggcgcctgcagtcccagctactcgggaggctgaggcaggacaatggtgtgaacccgggaggtggtgcttgcagtgagctgagattccgccactgcactcaagcctgggtgacagagggagactccatctcaaaacaaaacaaaaaacgatgggctttctgtcgtgtgtgtgtaccttttggatttgagggcagggggatgacattgtgatctggcctcctgagaaaccaggcacaccctgcctaccttggaaggcggctttcccttccccacctccctctccctccatctgttccctctttccctctctccacttcactcccgtcccccagctcttctctcccatctttttgttctctgtctcttttttttttcctgcattaaacctttcgggagtgtctttgtaaaatattaagaagcgttaggtcttcaacatgtgtgtttacttgcaggcctgagacctgggaggaagctggagaaaagatgccctctgaatctttgtgtttggctgcccaggctcgccttgacaccgaatggttgaaaacagatatacaggtggggtttgacatgtctctttcttggtgtatttctgcttccatgtttaaatttctcgtgtaaggcttttttttagggtatgtaaggggaagtcagttgtatcttgctatattagaggagcaggtttgtttcctgtaacttaaaatgtaacagtctttatggctgtttttgtagatcgtgcgcggctgccttttaattagtttcttgcaagtgcaggaaatgagatttattaatagggaaaatttttttcttaattattattactggttgagaaatctgctacactcctaaccatatcatggtgactgttgtttgttactgatagtttttgagctgttgagttaactgtcgaggggaaaattggagaagtaagttgcagtaattatggctgctagaaactcactccttttatgaggtcttgtgtttgtgtttctggagagaaaagagttagttcagttgagctgtttgttttgtatttgtaaccaatacaaggactaaggacaattgtgttgaaactgaggtcataatgttgggatcttaagggccgaaggttccaaacaaatggtatgtatagagttctctctgacttgaaattttccctttctggacctccggatgctgaggctgggagtgtccatatgacagtgccttccatgacaggagtcagcaacctttttttttttttttttttaacacgtatcagtaattcattctgtatattttgaaaagttttaacctcttcttcctagccctccagtatttgttaataaattaaaacgtttcccaaagtgttttttgtgaaacaataattctaaaagatgctctaagaaaagctaagtacatggaaaaatccaaagtgtatattttatttattacatttcatgaatttttgtttctgttttttcctcttgagagggagtcttgctctgtctctcaggctggagtgcagtggcatgatcttggctcactgcaacctccgcctcctgggttcaagcagttctctgccttagcctccagagtagttaggattacaggtgccctccaccacggccagctaatttttgtatttttagtagagacagagtttcaccatagtggccagactggtcttgaactcctgacctcatgatccaccctcggcctcccaaagtgctgggattacaggtgtgagccactgtgcctggaccacatttgatgactttttttgtcctttgttcttttaaaaatcatggttagaaagcagagcataattgttctttatgtagaatccaactgattggggtttttagggagatgttttgacattcagtaaatgtttttgttttccattattaagactatgaattttttattttactttctgagacagggtcttgctctgttgcccaggctggagtgcagtggcgtgatcttggctcactgcaacctctgcctcctgggttcaagcagttctcctgcctcagcctcctgagtagctagcattagaggtgcccgccaccactaccctccgcctttcaggttcaagcgatcctctgcctcagcctcctgagtagctgggattacaggtgcacgccagcatgcccggcaaatttttgaatttttagtagagacgaggtttcaccatgttggtcaggctggtctcgaattcctgaccttgtgatccacccgcctcggtctcccaaagtgctgggattacaggtgtgagccacatttttagtagagatggggtatcactatgttggccaggctgctgtggaactcctgacctcaagtgatcccctcaccttggcttcccaaagtgctaggattacagatgtgagctaccacgcctagccgtattttgtatttttagtagagatggggttttgctgtgttggccaggctggtcttgatctcctgggtgcaagtgatcctcccacattggcctctcaaagtgctgggattacaggcatgagccaccacacctggccaatgggaggtctcgcttcccttctctgcagcattccataagcaatgtgtttgggtagtatgtgttcgattttctctatgtatactttgaaccctacagtagtgaaaggaagagtagacaactttgaagttgatgtggtgtggtctttgagctggtggtgctaattactcttggttgttttcgtggcctccagtgacttcatcctgcttttgctgttgtaaagtgttgtaatttatgctcctgagaataactcttgaggtgtacttagggttcttgtctgcttcctggtgactgtcgaagcttttcatcttgaagaagggagatgagcagtgttccagtgtactgagattaaaattaagaatgttgcatttttttaatatgtaaaatttatagccagctgtagggtaggggtggcctactttctctaaagggccagatagtaaatattttaaggtctcactggaccctatggtctctgtcatagccatgagaccttgcagatttagtgccaaagtagccacagacaataccacgtcagcgggcaggggacgttcattctgtaaagtgtatttatggacaccaaaagatgaagtccacagaatgtttgcaagtcacaaaatactgtttttcttttgattgtttttcagttattaaaaaatataaaatacagtggccgggcgtggtggctcacatctgtaatcccagcacttttagaggctgaggcaggcggatcacctgaggtcaggagttcgagaccagcctggccaacatggtgaaaccccatctctactaaaaacaaaaaattagccgggcatggtgatgcacgcctgtaatcccagctcctcggaggctgaggcaggagaatcacttgaacctgggagaatcgtttgagcctgggaggcagaggttgtgatgagccaagactctgtctcaaaagaacaacaaaaataaaatactttctctgcgttcagaccatacacaaagaggctgtgggctgggtttggcccctgggctgtggttagtgaccccaaacacacacacacatacacacacgtagggcagagtctggcatttagagccagcacctgtgttctcacctgagctgtgttcctggctgggttctgctgtgtattctgtgacccaagatgtctatctaccttggtaaactggagacaacaaagcctgcctccttcaaggttgtttgtaaagatttaaaagggtaatgtattgttgttaggccagatgctttgcatagtacatgttaggttattttcactttttttttttttttttgagacagagtcctactctgttgtacaggctggagtccagtggcgagattccagctcactgcaacctctgcctcccaggttcaagcaattctcctgcctcagcctctcgggctgctgggattacaggtggctgccaccatgccgggccaattttgatatttttagtagagatcgggtttcaccatgttggccaggccagtctcaaactcctgacctcaagtgatccgcccacctcggcctcccaacgtggtgggattacaggagtgagccaccacatctggcccattttcactttccattagctgcttttttcccccattcatttcctacctttctgtgtatgatttctgaattaaatgtatttcatgtcttaaccttctgaattgtttgtcctctcattttccatgctgttaaggaaaataagaggctaagtgagacgtattaaatttgcatgtagtttctcagatcaggataaatgctcacctgttgcagaacgggactctgctcttgcttcacccaggatgcctttcctagttccttcctagagtggggccgcaccctgctccagccctccagacccagctccctgctctgacatgattccaccagactgtattccagctgtcctccctggacctagatattttccttcttcttctttttttttttttttttttcctgagatgaagtctcactcggtggtccaggctggagtgcaatggtgtgatctcggctcactgcaacctccgccttccaggttcaagccattctcctgcctcagcctcccaagtagctgggattacaggcacgtgccaccaagcctgggtaatttttgtatttttagtagagacagggtttcaccatgttggccaggctggtgtcgaactcctgaccttgtgatccacccgcctcggcctcccaaagtgctgggattacaggtgtgagccaccgcacccccccagccaacatatttttattaaaaaacttatatgaaatttattttattgtggtatgtagttcagtaaattttgacctctatagattcatgtaacccccatcatcatcaggatggagaattttcttcaccccaaaagctcccttgtgctgctcctttttatcacgtgttccctggtctcataccctggcaaccacggatctgttctccatcagtatggggtattctttttgagaatgtcatgtgagtggaaccatattttaagtaacattttgaaaccatcttcatttactcccagttatatgtttgagatttatgtgctgttctgtgtattaatagttctttttattgctgaatggtatttcatcatttggatgtaccacatggtgtttatccattctgccattgtaggaccttgtggttgtttccatttttctttcccaattgtaatcctgctgtgagcattactatacagattttatgtgaatatagtttccatttccctaggataaagacctagtagtgtgaaagttgggtcatgtgctgaactgttttccgaagtggctgttttagtttgcattcccactggcaatctgtcacgtttctgttgctctgtgtctttgttagcacttggtgttatcagtgttttttagttgagccattctaacaagtctagtgggatctcattgtggttttaatttgcacttccgtaatggctaagaatgctgaatatcgtgttcttctttgccactcttgtatcctctgtgaagtttctgttcagatcttttgcacggaaaaagctgtatcatggaaccagtaaaataaccaaggagaggttgattaaagttctgtttataaccctagaagattcctgccctagggatatgggatggctgaacgtaggacaccgacactggacagatgaaatagcagtttattagtcacgcatgctcacagccctggggtgggggacaccgcatgccattcagttaatcatgtgtgttgtaacttttcggggagggacatttgcagagactaatggtatgacattctgaaaagcggtgacagattaagaaattttttaattctgcagatggtagtgtcgaaccaagtggaacaaagaaagaagatctgaatgacaaagagaaaaaaaatgaagacgaaactcctgcacctgtatatagggccaagtcaattctggagacctgggtgtgggtcaagcaaccaggtaatctgagttttggcactttggaaagcttgatctgacgctccttttctaaataacttggatggattattcgtattttttggtaacaattttaaaaaatgtaattaaaaaaatttaaatatcgtggtaaaatatacataccgtaaaacttgccattttaatcatttttatgtgtacagttcattggcattaagtatattcacattattgcccagccatcaccaccatccatctctacaacttttgccctttctccaactgaaactccgtatccatgaaacactaactccttctgtccccaggcaaccaccattctacttttgtctcagaatttgactactcaaggtgtctcctataaggggaatcatacagtatttgtccttttgtgactgggttattgaacttcttaggtgtttggggttcatccgcatgtgtcagaattttcttttaaaggctcaatgctattccattatatatgtaagccacatgttatcccttcatcagtgggcaatcaggttgctttcatctcttgactgttgtgagtaatgctgctatgaacattggtttacgagtgtcttgagtgtctgcttttaattctttgtgtctatacctaggagtggaattggtcaataatgtggaatgcttacatatttattttttttgagatggcatctcgctgtcacccaggctggagtgccgtggcgccgtctcagctcacagcaagctccgcctctcgggttcacgcaattctcctgcctcagcttcctgagtagctgggactacaggcgcccgccaccatgcctggctaatttttttgtatttttagtagagactgggtttcaccgtgttagccatgatggtctccatctcctaacctcgtgatccacccgcctcagcctcccaaattgctgggattacaggtgtgagccactgcacctggccaataatgtggtagttagatttatgtttaacttattattgttgtttttgagattgggtctcactctgtcgctcaggctggaatgcgttgatgtaatcatagctcactgcagccttgaactcctgggctccagtgaccttcttgcctcagcctctcaagtagctaggactagaggcgcagggaatttctcatcttctctctactgcctctgagttggagatgtcagagggagccatggcccactgtaaagtaacacaatgtcctcacccacagggttagaacccctcttctggtggcagctctgaggggagcagtcacatgtggagagtgcagggctctgtgtccagctgggggaaggaggttaccaaggggattgacccccctctggccaggtggctgccttctgacacaccagtctctctctctagcacggtggcccctacacacccagcctgtcaaacctacagccctcgggaaggctttggccaaatccatgagcggctccctctgttaagaaggaagcacagctgaagcatgaggagggcagtagagtgtgtatgctccgccgcgtctccccacagtctgaccagaaggaaggggcctttcagccaggctcgcccaggctggggttggagtgtcagtatcaagccaatgtcttcttgcttaatgagtgagcccaggtgctcccgtgcagctgccaccgtagtgagggtgaaccggcaggaggctccacggcactttcaggctcaggctgcctggtgagatctactctgtgggctctgtaggctggtagaggcttccaggaggaggaggggatgcagccaccagtccccactcctgggagtcgtatttctgaaagcttgggtatacagtaaatattaggctgtgggctggtttatctatggatttgatgtgggagggttataggtacaagcagtttaaagatggaaattttgagagaacccttagtgctgggtaaggcaagcaggcttgtcaaagcagctcttttggggaggccagaatcctgtaccaatgtcctcagcatgttcatcagctgctgggggagtgccggacaggatgaaagcacaggagaactttgtggatgataaaatgttccatatcttcaaaggaggtgggttacatgggtaatgcatttgttaaaagtcatcaaaatgtaaaccagatctgtgcatttcacggaatataaattatacctcaaattagaaacatttttaaaaagacagatgggctggatgcagtggcacacgcctgtaatcccagcacttggggaggccgaggcgggtagatcacatgagtcaggagctcgagaccagcctggacaacatggtgaaatcccgtctctactaaaaatataaaaattagccaggggtggtggcatatgcgtgtaatcccagctacttgggaggctgaggcaggagaattgcttgaacccaggaggtggaggttacagtgagcagagattgcaccactgcactagagcctgggcaacagagtgagactccatctcaaaaaaaaaaaaaaaaaaaggttttcaacattcattaaaggcagagtagcttgttatagactagcctccccacaggaacagttagaaaaactggacaaaaatgtgtccccccttccccccaccatcaaaaacaattgttggaaggtaattggggacctcagccaggacttgagtgaccaggcctaggaggtgatcctgacagtccttagtgcttttcccacatttggtgatcggtcaacagtagagggctaagaggctaagaaactgagtatgaagtgatagttaagaggctggagagcctagctgaatgtttggcactctcacagggctgaaatgacataatgagaatttgggtcccagtaaggagatgagaccttggtggggatcctggaagggccacccctaagagtccaaaagaataaaaaatagaccagctgtcacaaaaactaaaacctgctttgagccagcttagtcccaaactagatgaaggcgatctgcttgaacgccaattgtgtgccataaagtcaaagtcagtactctctggaggcagataaaactttactaggcatgccataagacaagacaacgcaagacaaaaggagaaaacaaacaaaaaaaacaatagaaacatacatagatattagagtcctcaggtagaatttttttttttttttttgaaatgggagtttcactctgtcacccagcctggagtgcagtggtgtgatctcagctcactgcaacctcaacctcccacgtagctgggattggtgatccacccgcctaggcctcccaaagtggtgtgattacaggtgcaggccaccgtgcccggccagtattttgccacaatttaaaataaattttctttttttcaagtttgttctcagactgtattcacaaggtcacatggcggcttacacttctgtaggccttgttgaccgttctttttagatactgatgatcttgatctttttcttgtctcctccgtagaagaatgggatgcaggaggtgctgcctaagcctgggcgctcctgggcgttcttcattccagggggcagctgcatgatctgtgcagtgcggttgtcatgggaataacccttcccggcctctcgtgcaggctccaggctgccagggtggctcatatcagaaggatatttggagggagggaggcagggctctgagcaccgctcctcctgcgtcttctcctgctctcccatcctctccttcttctcccgcctcttctccacctgcctccggatcttctcctcctcctcctgcatcttctcatactcatcccacagcctctcctccttgaattgcagcctctccacctgcttccgcatctgctcctcctgctcccccatctgctcctcctgctcccccatctgctcctcctgcttcctcatctgctcctcctgctcccccatctgctcctcctgcttccgcatctgctcctcctgctcccccatctgctcctcctgcttccgcatctgctcctcctgctcccccatctgctcctcctgcttccggatctgctcctcctgctcccccatctgctcctcctgcttcctcatctgctcccccatctgctcctcctgcttccacatctgctcctcctgctttcgcatctgctcctcctgctcccctatctgctcctcctgcttccacatctgctcctcctgcttccgcatctgctcctcctgctcccctatctgctcctcctgcttccacatctgctcctcctgcttccgcatctgctccttctgcttcagcatctgcttctcctgcttccgcatctgctcctcctgctcccccatctgctcctcctgcttccccatctgctcctcctgcttccgcatctgctcctcctgcttccgcatctgctcctcctgcttccgcatctgctcctcctgcttccgcatctgctcctcctgcttccgcatctgctcctcctgcttccgcatctgctcctcctgctcctgcatctgctgctcctgctcccgcagctccttctcctggtcccgcagcctctgctcctgtctccacatcttctcctcgtgcttccgtagcttctcctgatcccgtagctcctcctgatcccgtagctcctcctcctgcctccacatcttctcctgcaaagtgttggtttgaacctcaaaaggaaatagagtcataagctaggtatataaatgtaatctataaaataacggttttcgtctatgattctttaaaaagaaattttaagccgtaaccctgaggttctgatttcccaggcatggtcccaatttgtagatttttagcacactctagaggattctgtggtgggaccagaacaaggacccaaattttccagctcttggctggagcctccccacaccctgcatgatccctagaccatgtcccagccggatgcggctcccacacccccggggctgccgccgctcacctgtggcagcgggattttgtccgtctccagtttcctttttagctccttgatgtggagctggatctcagacttttcagtttctaccagtcgaagtttttcttgtagttcggcatttttctccttcagctccttattggttatgctatggccggaggcagtagagaaaggaatgaacgaagaacagaaaggaccgctttggtgatcgaccctctaccctcgccccacaaccacagaaccgtggcactggaagggaccccaggaattaaaagtcccaggtggcaggccagagagaagacatgagttgcctgaggctaccccatgagtcagtggcacagccggcactggagcttccctgcacacacatgtaaacctgtatgaccccctaccatgctcacctgtaccccccacctcccagcacaccacccacgctaagggctctcagacctcccatccccccctcccctatcctacatgttcctgaacagctccagactcatggcttccctctcctttgttaactccttgatgtactgcaaacagagaaaggtcaagtcaggatacagcaggcagaggagcagctggacgaccagtaacgacagctacactgatactccacagtaacacttgctcctctccgtcacacccgacatgttctcaaggcgtttccaaacccgtggtgtcatttgtttttcttttctttttttttttttttttgagatggagtttcgctcttgttgcccaggctggagtgcaatggcgcgatctcaccccaccgcaacctccgcctcccggcttcaagcgattcttctgcctcagcctcctaagtagctgggattacaggcatgtgccactgcacctggctctcacttgtttttcggagaactcagtaagggtggaaggcacagagaaagagactgaattgatagctggctaacaggggcccagagcgatcagataatattgttattgctattactgttattattaccactgttggaacctttcttgagtgcttcaccaggcactatgctaacaatcccatttaatcctcacagccaccacaggagacagttatcattatcacctctattgtgtagatgaaaaacatggggtattaaaggttaagtgcttgcctaagatcacttagagctgggatttcaacacccaggtatatctgattctctaagcccattcttttggttgggggtaggggcacagataaggaggaggaaattaatcctttgttgatttttgaaagaatgatacattggcatagtccaaacctcagaaggtacagaagggaaatatcttcccccaacactgttcctctctcctgagttttttatgaatccttacaaacatgttttatgtatattaccataatacgtacgtacacacacacacacacacacacacacacacacacacacacgtacatgtgttccctctctctacacaaatggtaacatactaaagatactcttctgtaccttcatggtacaagtaccctcaactccgcctaggatttgaccaaggccacagccaagtatgggtggggtgggcacttggcctccgagctctgtgtccagtgctcgctccccacagcgccccgcaactcacccacagcagctgactcagccccaacctgcctctaacaaccacgcacaaaagcagcaagaaatggcccatgctgtcttctgggcaggacactgcatcctgcagaagggacctttaggctcattcctccatctgcgaagctgggctcccaggggaccgggtaggtggttggactcaccttgtccgccctctcgtgctctgcggacatagcagagagagcccgctgtaactctcctgcaaagtgccaggaatgatgcaggcgggctgccagatccttggaatcttctggaatgagagaggttgagctgcagcccaaaggcctgtgaaagtgccaggttgaaggatgacggggtgcccagattcccaccttcaaatttcctggcagcatcctggctgtcatggagcgctgtctccagttcagttttctgacacataaggattcgtatggtatgatcctgggcctttgggagacaagaaaagcaagtgctgaaagagaagcaaagaaaccttctccagaggacaggagggaacttcacaccctccactcacctctagctgcctccttagggcttgctgatgttggtggcttgccttattttcctatagaaaagaagaggaagacagagctcttactagagggaggcagagatggcacagcaagagacatgcccccagaatggccccactgtcccaggacaggcccacccatgggaccaggttatcagggaccctgtggggatggggtggaagctgggaggtgagccttcctccccaagctgggagtaggcgagacgagactggggcctctacatctgagtgccccccaaacccagcggtcatgtcgtgagcaaagaaagaaaccatgttacctctttcagctgagctcggttctgttgtttctgtggggagagtcaaaggaaggtgactgagggtggtccctcgactctattccccaggccaggaagcggtaggcaggggtcaggaatggattttaagggcaaagttctcagacccaatgggaacacaaactggtcaactttccttaacgcccaaagaaaaaggatttgggtctttgttggcttttgcccacagccacagaactgaaagtctgaaactagattctctggaaaagacagtaacataaaccttccgacataagagtgtgagaaaagcccacccttctgccagcttgtgatggagaaagatgtgttcattcaacaagcattgagcaagcacataggggccggggacggttcttcactgctgggatataggacggaaaaggcagacaggagcccttggccccaaggtttccattctagtgaatctttaaatctcagactctcagagcaaacagaacctctgatactctaactctacctcctcaggaaacggaagcccaaagaggaggggagcttacagcaggccctggactagggattaacacaaaaacaacagcaacaaatctgatttaagcttcacacat
